United States Patent 11,078,247 (RNA ENCODING A THERAPEUTIC PROTEIN) - sequence listing, part 23

SEQ ID NO: 40409 - RNA, 1260 nt, Artificial Sequence
  derived and/or modified sequence opt2 from BRF2__Homo_sapiens__NP_060780
augcccggccgcggccgcugccccgacugcggcuccaccgagcucgucgaggacucccacuacucccagucccagcucgucugcuccgacugcggcugcgucgucaccgagggcguccucaccaccaccuucuccgacgagggcaaccuccgcgaggucaccuacucccgcuccaccggcgagaacgagcaggucucccgcucccagcagcgcggccuccgccgcguccgcgaccucugccgcguccuccagcucccccccaccuucgaggacaccgccgucgccuacuaccagcaggccuaccgccacuccggcauccgcgccgcccgccuccagaagaaggagguccucgucggcugcugcguccucaucaccugccgccagcacaacuggccccucaccaugggcgccaucugcacccuccucuacgccgaccucgacgucuucuccuccaccuacaugcagaucgucaagcuccucggccucgacguccccucccucugccucgccgagcucgucaagaccuacugcuccuccuucaagcucuuccaggccucccccuccguccccgccaaguacgucgaggacaaggagaagaugcucucccgcaccaugcagcucgucgagcucgccaacgagaccuggcucgucaccggccgccacccccuccccgucaucaccgccgccaccuuccucgccuggcagucccuccagcccgccgaccgccucuccugcucccucgcccgcuucugcaagcucgccaacgucgaccuccccuaccccgccuccucccgccuccaggagcuccucgccguccuccuccgcauggccgagcagcucgccuggcuccgcguccuccgccucgacaagcgcuccgucgucaagcacaucggcgaccuccuccagcaccgccagucccucguccgcuccgccuuccgcgacggcaccgccgaggucgagacccgcgagaaggagccccccggcuggggccagggccagggcgagggcgaggucggcaacaacucccucggccucccccagggcaagcgccccgccucccccgcccuccuccucccccccugcaugcucaagucccccaagcgcaucugccccgucccccccgucuccaccgucaccggcgacgagaacaucuccgacuccgagaucgagcaguaccuccgcaccccccaggagguccgcgacuuccagcgcgcccaggccgcccgccaggccgccaccuccguccccaacccccccuga

SEQ ID NO: 40410 - RNA, 756 nt, Artificial Sequence
  derived and/or modified sequence opt2 from BRI3BP__Homo_sapiens__NP_542193
augggcgcccgcgccuccggcggcccccucgcccgcgccggccuccuccuccuccuccuccuccuccuccuccucggccuccucgcccccggcgcccagggcgcccgcggccgcggcggcgccgagaagaacuccuaccgccgcaccgucaacaccuucucccaguccgucuccucccucuucggcgaggacaacguccgcgccgcccagaaguuccucgcccgccucaccgagcgcuucguccucggcgucgacauguucgucgagacccucuggaaggucuggaccgagcuccucgacguccucggccucgacgucuccaaccucucccaguacuucucccccgccuccgucuccuccucccccgcccgcgcccuccuccucgucggcgucguccuccucgccuacugguuccucucccucacccucggcuucaccuucuccguccuccacgucgucuucggccgcuucuucuggaucguccgcgucguccucuucuccauguccugcgucuacauccuccacaaguacgagggcgagcccgagaacgccguccucccccucugcuucgucgucgccgucuacuucaugaccggccccaugggcuucuacuggcgcuccucccccuccggccccuccaaccccuccaaccccuccgucgaggagaagcucgagcaccucgagaagcagguccgccuccucaacauccgccucaaccgcguccucgagucccucgaccgcuccaaggacaaguga

SEQ ID NO: 40411 - RNA, 297 nt, Artificial Sequence
  derived and/or modified sequence opt2 from BRI3__Homo_sapiens__NP_001152963
auggaccacaagccccuccuccaggagcgcccccccgccuacaaccucgaggccggccagggcgacuacgccugcggcccccacggcuacggcgccauccccgccgcccccccccccccccccuaccccuaccucgucaccggcauccccacccaccacccccgcgucuacaacauccacucccgcaccgucacccgcuaccccgccaacuccaucgucgucgucggcggcugccccgucugccgccaccagcgcuccuccuggcucuacaccuacccccuccgcgucugcaccuga

SEQ ID NO: 40412 - RNA, 2286 nt, Artificial Sequence
  derived and/or modified sequence opt2 from BRINP1__Homo_sapiens__NP_055433
augaacuggcgcuucgucgagcuccucuacuuccucuucaucuggggccgcaucuccguccagcccucccaccaggagcccgccggcaccgaccagcacgucuccaaggaguucgacuggcucaucuccgaccgcggccccuuccaccacucccgcuccuaccucuccuucgucgagcgccaccgccagggcuucaccacccgcuacaagaucuaccgcgaguucgcccgcuggaagguccgcaacaccgccaucgagcgccgcgaccucguccgccaccccgucccccucaugcccgaguuccagcgcuccauccgccuccucggccgccgccccaccacccagcaguucaucgacaccaucaucaagaaguacggcacccaccuccucaucuccgccacccucggcggcgaggaggcccucaccauguacauggacaagucccgccucgaccgcaaguccggcaacgccacccaguccgucgaggcccuccaccagcucgccuccuccuacuucgucgaccgcgacggcaccaugcgccgccuccacgagauccagaucuccaccggcgccaucaaggucaccgagacccgcaccggcccccucggcugcaacuccuacgacaaccucgacuccgucuccuccguccuccuccaguccaccgaguccaagcuccaccuccagggccuccagaucaucuucccccaguaccuccaggagaaguucguccaguccgcccucuccuacaucaugugcaacggcgagggcgaguaccucugccagaacucccagugccgcugccagugcgccgaggaguucccccagugcaacugccccaucaccgacauccagaucauggaguacacccucgccaacauggccaaguccugggccgaggccuacaaggaccucgagaacuccgacgaguucaaguccuucaugaagcgccuccccuccaaccacuuccucaccaucggcuccauccaccagcacuggggcaacgacugggaccuccagaaccgcuacaagcuccuccaguccgccaccgaggcccagcgccagaagauccagcgcaccgcccgcaagcucuucggccucuccguccgcugccgccacaaccccaaccaccagcucccccgcgagcgcaccauccagcaguggcucgcccgcguccagucccuccucuacugcaacgagaacggcuucuggggcaccuuccucgagucccagcgcuccugcgucugccacggcuccaccacccucugccagcgccccauccccugcgucaucggcggcaacaacuccugcgccaugugcucccucgccaacaucucccucugcggcuccugcaacaagggcuacaagcucuaccgcggccgcugcgagccccagaacgucgacuccgagcgcuccgagcaguucaucuccuucgagaccgaccucgacuuccaggaccucgagcucaaguaccuccuccagaagauggacucccgccucuacguccacaccaccuucaucuccaacgagauccgccucgacaccuucuucgacccccgcuggcgcaagcgcaugucccucacccucaaguccaacaagaaccgcauggacuucauccacauggucaucggcauguccaugcgcaucugccagaugcgcaacuccucccucgaccccauguucuucgucuacgucaaccccuucuccggcucccacuccgagggcuggaacaugcccuucggcgaguucggcuacccccgcugggagaagauccgccuccagaacucccagugcuacaacuggacccuccuccucggcaaccgcuggaagaccuucuucgagaccguccacaucuaccuccgcucccgcacccgccuccccacccuccuccgcaacgagaccggccagggccccgucgaccucuccgaccccuccaagcgccaguucuacaucaagaucuccgacguccaggucuucggcuacucccuccgcuucaacgccgaccuccuccgcuccgccguccagcaggucaaccaguccuacacccagggcggccaguucuacuccuccuccuccgucaugcuccuccuccucgacauccgcgaccgcaucaaccgccucgccccccccgucgcccccggcaagccccagcucgaccucuucuccugcaugcucaagcaccgccucaagcucaccaacuccgagaucauccgcgucaaccacgcccucgaccucuacaacaccgagauccucaagcaguccgaccagaugaccgccaagcucugcuga

SEQ ID NO: 40413 - RNA, 2352 nt, Artificial Sequence
  derived and/or modified sequence opt2 from BRINP2__Homo_sapiens__NP_066988
augcgcuggcagugcggcacccgcuuccgcggccuccgccccgccgucgcccccuggaccgcccuccucgcccucggccuccccggcuggguccucgccgucuccgccaccgccgccgccgucguccccgagcagcacgccuccgucgccggccagcacccccucgacuggcuccucaccgaccgcggccccuuccaccgcgcccaggaguacgccgacuucauggagcgcuaccgccagggcuucaccacccgcuaccgcaucuaccgcgaguucgcccgcuggaaggucaacaaccucgcccucgagcgcaaggacuucuucucccucccccucccccucgcccccgaguucauccgcaacauccgccuccucggccgccgccccaaccuccagcaggucaccgagaaccucaucaagaaguacggcacccacuuccuccucuccgccacccucggcggcgaggagucccucaccaucuucgucgacaagcagaagcucggccgcaagaccgagaccaccggcggcgccuccaucaucggcggcuccggcaacuccaccgccgucucccucgagacccuccaccagcucgccgccuccuacuucaucgaccgcgaguccacccuccgccgccuccaccacauccagaucgccaccggcgccaucaaggucaccgagacccgcaccggcccccucggcugcuccaacuacgacaaccucgacuccgucuccuccguccucguccagucccccgagaacaagguccagcuccucggccuccagguccuccuccccgaguaccuccgcgagcgcuucgucgccgccgcccucuccuacaucaccugcuccuccgagggcgagcucgucugcaaggagaacgacugcuggugcaagugcucccccaccuuccccgagugcaacugccccgacgccgacauccaggccauggaggacucccuccuccagauccaggacuccugggccacccacaaccgccaguucgaggaguccgaggaguuccaggcccuccucaagcgccuccccgacgaccgcuuccucaacuccaccgccaucucccaguucugggccauggacaccucccuccagcaccgcuaccagcagcucggcgccggccucaagguccucuucaagaagacccaccgcauccuccgccgccucuucaaccucugcaagcgcugccaccgccagccccgcuuccgccuccccaaggagcgcucccucuccuacugguggaaccgcauccagucccuccucuacugcggcgaguccaccuuccccggcaccuuccucgagcagucccacuccugcaccugccccuacgaccaguccuccugccagggccccauccccugcgcccucggcgagggccccgccugcgcccacugcgcccccgacaacuccacccgcugcggcuccugcaaccccggcuacguccucgcccagggccucugccgccccgaggucgccgagucccucgagaacuuccucggccucgagaccgaccuccaggaccucgagcucaaguaccuccuccagaagcaggacucccgcaucgagguccacuccaucuucaucuccaacgacaugcgccucggcuccugguucgaccccuccuggcgcaagcgcaugcuccucacccucaaguccaacaaguacaagcccggccucguccacgucaugcucgcccucucccuccagaucugccucaccaagaacuccacccucgagcccgucauggccaucuacgucaaccccuucggcggcucccacuccgaguccugguucaugcccgucaacgagggcuccuuccccgacugggagcgcaccaacgucgacgccgccgcccagugccagaacuggaccaucacccucggcaaccgcuggaagaccuucuucgagaccguccacgucuaccuccgcucccgcaucaagucccucgacgacuccuccaacgagaccaucuacuacgagccccucgagaugaccgaccccuccaagaaccucggcuacaugaagaucaacacccuccaggucuucggcuacucccuccccuucgaccccgacgccauccgcgaccucauccuccagcucgacuaccccuacacccagggcucccaggacuccgcccuccuccagcucaucgagcuccgcgaccgcgucaaccagcucuccccccccggcaagguccgccucgaccucuucuccugccuccuccgccaccgccucaagcucgccaacaacgaggucggccgcauccaguccucccuccgcgccuucaacuccaagcuccccaaccccgucgaguacgagaccggcaagcucugcuccuga

SEQ ID NO: 40414 - RNA, 2301 nt, Artificial Sequence
  derived and/or modified sequence opt2 from BRINP3__Homo_sapiens__NP_950252
augaucuggcgcucccgcgccggcgccgagcucuucucccucauggcccucugggaguggaucgcccucucccuccacugcuggguccucgccgucgccgccgucuccgaccagcacgccaccucccccuucgacuggcuccucuccgacaagggccccuuccaccgcucccaggaguacaccgacuucgucgaccgcucccgccagggcuucuccacccgcuacaagaucuaccgcgaguucggccgcuggaaggucaacaaccucgccgucgagcgccgcaacuuccucggcuccccccucccccucgcccccgaguucuuccgcaacauccgccuccucggccgccgccccacccuccagcagaucaccgagaaccucaucaagaaguacggcacccacuuccuccucuccgccacccucggcggcgaggagucccucaccaucuucgucgacaagcgcaagcucuccaagcgcgccgagggcuccgacuccaccaccaacuccuccuccgucacccucgagacccuccaccagcucgccgccuccuacuucaucgaccgcgacuccacccuccgccgccuccaccacauccagaucgccuccaccgccaucaaggucaccgagacccgcaccggcccccucggcugcuccaacuacgacaaccucgacuccgucuccuccguccucguccagucccccgagaacaagauccagcuccagggccuccagguccuccuccccgacuaccuccaggagcgcuucguccaggccgcccucuccuacaucgccugcaacuccgagggcgaguucaucugcaaggagaacgacugcuggugccacugcggccccaaguuccccgagugcaacugccccuccauggacauccaggccauggaggagaaccuccuccgcaucaccgagaccuggaaggccuacaacuccgacuucgaggaguccgacgaguucaagcucuucaugaagcgccuccccaugaacuacuuccucaacaccuccaccaucaugcaccucuggaccauggacuccaacuuccagcgccgcuacgagcagcucgagaacuccaugaagcagcucuuccucaaggcccagaagaucguccacaagcucuucucccucuccaagcgcugccacaagcagccccucaucucccucccccgccagcgcaccuccaccuacuggcucacccgcauccaguccuuccucuacugcaacgagaacggccuccucggcuccuucuccgaggagacccacuccugcaccugccccaacgaccaggucgucugcaccgccuuccuccccugcaccgucggcgacgccuccgccugccucaccugcgcccccgacaaccgcacccgcugcggcaccugcaacaccggcuacaugcucucccagggccucugcaagcccgaggucgccgaguccaccgaccacuacaucggcuucgagaccgaccuccaggaccucgagaugaaguaccuccuccagaagaccgaccgccgcaucgagguccacgccaucuucaucuccaacgacaugcgccucaacuccugguucgaccccuccuggcgcaagcgcaugcuccucacccucaaguccaacaaguacaaguccucccucguccacaugauccucggccucucccuccagaucugccucaccaagaacuccacccucgagcccguccucgccgucuacgucaaccccuucggcggcucccacuccgaguccugguucaugcccgucaacgagaacuccuuccccgacugggagcgcaccaagcucgaccucccccuccagugcuacaacuggacccucacccucggcaacaaguggaagaccuucuucgagaccguccacaucuaccuccgcucccgcaucaaguccaacggccccaacggcaacgaguccaucuacuacgagccccucgaguucaucgaccccucccgcaaccucggcuacaugaagaucaacaacauccaggucuucggcuacuccaugcacuucgaccccgaggccauccgcgaccucauccuccagcucgacuaccccuacacccagggcucccaggacuccgcccuccuccagcuccucgagauccgcgaccgcgucaacaagcucuccccccccggccagcgccgccucgaccucuucuccugccuccuccgccaccgccucaagcucuccaccuccgaggucguccgcauccaguccgcccuccaggccuucaacgccaagcuccccaacaccauggacuacgacaccaccaagcucugcuccuga

SEQ ID NO: 40415 - RNA, 3750 nt, Artificial Sequence
  derived and/or modified sequence opt2 from BRIP1__Homo_sapiens__NP_114432
auguccuccaugugguccgaguacaccaucggcggcgucaagaucuacuuccccuacaaggccuaccccucccagcucgccaugaugaacuccauccuccgcggccucaacuccaagcagcacugccuccucgagucccccaccggcuccggcaagucccucgcccuccucugcuccgcccucgccuggcagcagucccucuccggcaagcccgccgacgagggcgucuccgagaaggccgagguccagcucuccugcugcugcgccugccacuccaaggacuucaccaacaacgacaugaaccagggcaccucccgccacuucaacuaccccuccaccccccccuccgagcgcaacggcaccuccuccaccugccaggacucccccgagaagaccacccucgccgccaagcucuccgccaagaagcaggccuccaucuaccgcgacgagaacgacgacuuccaggucgagaagaagcgcauccgcccccucgagaccacccagcagauccgcaagcgccacugcuucggcaccgagguccacaaccucgacgccaaggucgacuccggcaagaccgucaagcucaacuccccccucgagaagaucaacuccuucuccccccagaagccccccggccacugcucccgcugcugcugcuccaccaagcagggcaacucccaggaguccuccaacaccaucaagaaggaccacaccggcaaguccaagauccccaagaucuacuucggcacccgcacccacaagcagaucgcccagaucacccgcgagcuccgccgcaccgccuacuccggcguccccaugaccauccucuccucccgcgaccacaccugcguccaccccgaggucgucggcaacuucaaccgcaacgagaagugcauggagcuccucgacggcaagaacggcaaguccugcuacuucuaccacggcguccacaagaucuccgaccagcacacccuccagaccuuccagggcaugugcaaggccugggacaucgaggagcucgucucccucggcaagaagcucaaggccugccccuacuacaccgcccgcgagcucauccaggacgccgacaucaucuucugccccuacaacuaccuccucgacgcccagauccgcgaguccauggaccucaaccucaaggagcaggucgucauccucgacgaggcccacaacaucgaggacugcgcccgcgaguccgccuccuacuccgucaccgagguccagcuccgcuucgcccgcgacgagcucgacuccauggucaacaacaacauccgcaagaaggaccacgagccccuccgcgccgucugcugcucccucaucaacuggcucgaggccaacgccgaguaccucgucgagcgcgacuacgaguccgccugcaagaucugguccggcaacgagaugcuccucacccuccacaagaugggcaucaccaccgccaccuuccccauccuccagggccacuucuccgccguccuccagaaggaggagaagaucucccccaucuacggcaaggaggaggcccgcgagguccccgucaucuccgccuccacccagaucaugcucaagggccucuucaugguccucgacuaccucuuccgccagaacucccgcuucgccgacgacuacaagaucgccauccagcagaccuacuccuggaccaaccagaucgacaucuccgacaagaacggccuccucguccuccccaagaacaagaagcgcucccgccagaagaccgccguccacguccucaacuucuggugccucaaccccgccgucgccuucuccgacaucaacggcaagguccagaccaucguccucaccuccggcacccucucccccaugaaguccuucuccuccgagcucggcgucaccuucaccauccagcucgaggccaaccacaucaucaagaacucccaggucugggucggcaccaucggcuccggccccaagggccgcaaccucugcgccaccuuccagaacaccgagaccuucgaguuccaggacgaggucggcgcccuccuccucuccgucugccagaccgucucccagggcauccucugcuuccuccccuccuacaagcuccucgagaagcucaaggagcgcuggcucuccaccggccucuggcacaaccucgagcucgucaagaccgucaucgucgagccccagggcggcgagaagaccaacuucgacgagcuccuccaggucuacuacgacgccaucaaguacaagggcgagaaggacggcgcccuccucgucgccgucugccgcggcaaggucuccgagggccucgacuucuccgacgacaacgcccgcgccgucaucaccaucggcauccccuuccccaacgucaaggaccuccaggucgagcucaagcgccaguacaacgaccaccacuccaagcuccgcggccuccuccccggccgccagugguacgagauccaggccuaccgcgcccucaaccaggcccucggccgcugcauccgccaccgcaacgacuggggcgcccucauccucgucgacgaccgcuuccgcaacaaccccucccgcuacaucuccggccucuccaaguggguccgccagcagauccagcaccacuccaccuucgaguccgcccucgagucccucgccgaguucuccaagaagcaccagaagguccucaacgucuccaucaaggaccgcaccaacauccaggacaacgaguccacccucgaggucaccucccucaaguacuccaccucccccuaccuccucgaggccgccucccaccucucccccgagaacuucgucgaggacgaggccaagaucugcguccaggagcuccagugccccaagaucaucaccaagaacuccccccuccccuccuccaucaucucccgcaaggagaagaacgaccccgucuuccucgaggaggccggcaaggccgagaagaucgucaucucccgcuccaccucccccaccuucaacaagcagaccaagcgcgucuccugguccuccuucaacucccucggccaguacuucaccggcaagauccccaaggccacccccgagcucggcuccuccgagaacuccgccuccucccccccccgcuucaagaccgagaagauggaguccaagaccguccuccccuucaccgacaagugcgaguccuccaaccucaccgucaacaccuccuucggcuccugcccccaguccgagaccaucaucuccucccucaagaucgacgccacccucacccgcaagaaccacuccgagcacccccucugcuccgaggaggcccucgaccccgacaucgagcucucccucgucuccgaggaggacaagcaguccaccuccaaccgcgacuucgagaccgaggccgaggacgaguccaucuacuucacccccgagcucuacgaccccgaggacaccgacgaggagaagaacgaccucgccgagaccgaccgcggcaaccgccucgccaacaacuccgacugcauccucgccaaggaccucuucgagauccgcaccaucaaggaggucgacuccgcccgcgaggucaaggccgaggacugcaucgacaccaagcucaacggcauccuccacaucgaggaguccaagaucgacgacaucgacggcaacgucaagaccaccuggaucaacgagcucgagcucggcaagacccacgagaucgagaucaagaacuucaagcccucccccuccaagaacaagggcauguuccccggcuucaaguga

SEQ ID NO: 40416 - RNA, 228 nt, Artificial Sequence
  derived and/or modified sequence opt2 from BRK1__Homo_sapiens__NP_060932
auggccggccaggaggaccccguccagcgcgagauccaccaggacugggccaaccgcgaguacaucgagaucaucaccuccuccaucaagaagaucgccgacuuccucaacuccuucgacauguccugccgcucccgccucgccacccucaacgagaagcucaccgcccucgagcgccgcaucgaguacaucgaggcccgcgucaccaagggcgagacccucaccuga

SEQ ID NO: 40417 - RNA, 873 nt, Artificial Sequence
  derived and/or modified sequence opt2 from BRMS1__Homo_sapiens__NP_001020128
augcccguccagccccccuccaaggacaccgaggagauggaggccgagggcgacuccgccgccgagaugaacggcgaggaggaggaguccgaggaggagcgcuccggcucccagaccgaguccgaggaggaguccuccgagauggacgacgaggacuacgagcgccgccgcuccgagugcgucuccgagaugcucgaccucgagaagcaguucuccgagcucaaggagaagcucuuccgcgagcgccucucccagcuccgccuccgccucgaggaggucggcgccgagcgcgcccccgaguacaccgagccccucggcggccuccagcgcucccucaagauccgcauccaggucgccggcaucuacaagggcuucugccucgacgucauccgcaacaaguacgagugcgagcuccagggcgccaagcagcaccucgaguccgagaagcuccuccucuacgacacccuccagggcgagcuccaggagcgcauccagcgccucgaggaggaccgccagucccucgaccucuccuccgaguggugggacgacaagcuccacgcccgcggcuccucccgcuccugggacucccucccccccuccaagcgcaagaaggccccccucgucuccggccccuacaucgucuacaugcuccaggagaucgacauccucgaggacuggaccgccaucaagaaggcccgcgccgccgucuccccccagaagcgcaaguccgacgaccgccgcacccaccgcccccuccgcgucugccccgcccgccuccucuggugcugcugggcccucccccuccaccucgcccucgccuggacccccccccuccccuccucccgccccgcccagcucuggcccugguccuga

SEQ ID NO: 40418 - RNA, 972 nt, Artificial Sequence
  derived and/or modified sequence opt2 from BRMS1L__Homo_sapiens__NP_115728
augcccguccacucccgcggcgacaagaaggagaccaaccaccacgacgagauggaggucgacuacgccgagaacgagggcuccuccuccgaggacgaggacaccgaguccuccuccgucuccgaggacggcgacuccuccgagauggacgacgaggacugcgagcgccgccgcauggagugccucgacgagauguccaaccucgagaagcaguucaccgaccucaaggaccagcucuacaaggagcgccucucccaggucgacgccaagcuccaggaggucaucgccggcaaggcccccgaguaccucgagccccucgccacccuccaggagaacaugcagauccgcaccaaggucgccggcaucuaccgcgagcucugccucgaguccgucaagaacaaguacgagugcgagauccaggccucccgccagcacugcgaguccgagaagcuccuccucuacgacaccguccaguccgagcucgaggagaagauccgccgccucgaggaggaccgccacuccaucgacaucaccuccgagcucuggaacgacgagcuccagucccgcaagaagcgcaaggaccccuucucccccgacaagaagaagcccgucgucgucuccggccccuacaucgucuacaugcuccaggaccucgacauccucgaggacuggaccaccauccgcaaggccauggccacccucggcccccaccgcgucaagaccgagccccccgucaagcucgagaagcaccuccacuccgcccgcuccgaggagggccgccucuacuacgacggcgagugguacauccgcggccagaccaucugcaucgacaagaaggacgagugccccaccuccgccgucaucaccaccaucaaccacgacgaggucugguucaagcgccccgacggcuccaaguccaagcucuacaucucccagcuccagaagggcaaguacuccaucaagcacuccuga

SEQ ID NO: 40419 - RNA, 1200 nt, Artificial Sequence
  derived and/or modified sequence opt2 from BRS3__Homo_sapiens__NP_001718
auggcccagcgccagccccacucccccaaccagacccucaucuccaucaccaacgacaccgaguccuccuccuccgucgucuccaacgacaacaccaacaagggcugguccggcgacaacucccccggcaucgaggcccucugcgccaucuacaucaccuacgccgucaucaucuccgucggcauccucggcaacgccauccucaucaaggucuucuucaagaccaaguccaugcagaccguccccaacaucuucaucaccucccucgccuucggcgaccuccuccuccuccucaccugcguccccgucgacgccacccacuaccucgccgagggcuggcucuucggccgcaucggcugcaagguccucuccuucauccgccucaccuccgucggcgucuccgucuucacccucaccauccucuccgccgaccgcuacaaggccgucgucaagccccucgagcgccagcccuccaacgccauccucaagaccugcgucaaggccggcugcgucuggaucgucuccaugaucuucgcccuccccgaggccaucuucuccaacgucuacaccuuccgcgaccccaacaagaacaugaccuucgaguccugcaccuccuaccccgucuccaagaagcuccuccaggagauccacucccuccucugcuuccucgucuucuacaucaucccccucuccaucaucuccgucuacuacucccucaucgcccgcacccucuacaaguccacccucaacauccccaccgaggagcagucccacgcccgcaagcagaucgagucccgcaagcgcaucgcccgcaccguccucguccucgucgcccucuucgcccucugcuggcuccccaaccaccuccucuaccucuaccacuccuucaccucccagaccuacgucgaccccuccgccaugcacuucaucuucaccaucuucucccgcguccucgccuucuccaacuccugcgucaaccccuucgcccucuacuggcucuccaaguccuuccagaagcacuucaaggcccagcucuucugcugcaaggccgagcgccccgagccccccgucgccgacaccucccucaccacccucgccgucaugggcaccguccccggcaccggcuccauccagauguccgagaucuccgucaccuccuucaccggcugcuccgucaagcaggccgaggaccgcuucuga

SEQ ID NO: 40420 - RNA, 2337 nt, Artificial Sequence
  derived and/or modified sequence opt2 from BRSK1__Homo_sapiens__NP_115806
auguccuccggcgccaaggagggcggcggcggcucccccgccuaccaccucccccacccccacccccaccccccccagcacgcccaguacgucggccccuaccgccucgagaagacccucggcaagggccagaccggccucgucaagcucggcguccacugcaucaccggccagaaggucgccaucaagaucgucaaccgcgagaagcucuccgaguccguccucaugaaggucgagcgcgagaucgccauccucaagcucaucgagcacccccacguccucaagcuccacgacgucuacgagaacaagaaguaccucuaccucguccucgagcacgucuccggcggcgagcucuucgacuaccucgucaagaagggccgccucacccccaaggaggcccgcaaguucuuccgccagaucgucuccgcccucgacuucugccacuccuacuccaucugccaccgcgaccucaagcccgagaaccuccuccucgacgagaagaacaacauccgcaucgccgacuucggcauggccucccuccaggucggcgacucccuccucgagaccuccugcggcuccccccacuacgccugccccgaggucaucaagggcgagaaguacgacggccgccgcgccgacaugugguccugcggcgucauccucuucgcccuccucgucggcgcccuccccuucgacgacgacaaccuccgccagcuccucgagaaggucaagcgcggcgucuuccacaugccccacuucaucccccccgacugccagucccuccuccgcggcaugaucgaggucgagcccgagaagcgccucucccucgagcagauccagaagcaccccugguaccucggcggcaagcacgagcccgaccccugccucgagcccgcccccggccgccgcgucgccaugcgcucccuccccuccaacggcgagcucgaccccgacguccucgaguccauggccucccucggcugcuuccgcgaccgcgagcgccuccaccgcgagcuccgcuccgaggaggagaaccaggagaagaugaucuacuaccuccuccucgaccgcaaggagcgcuaccccuccugcgaggaccaggaccuccccccccgcaacgacgucgaccccccccgcaagcgcgucgacucccccaugcucucccgccacggcaagcgccgccccgagcgcaaguccauggagguccucuccaucaccgacgccggcggcggcggcucccccguccccacccgccgcgcccucgagauggcccagcacucccagcgcucccgcuccgucuccggcgccuccaccggccucuccuccuccccccucuccuccccccgcucccccgucuucuccuucucccccgagcccggcgccggcgacgaggcccgcggcggcggcucccccaccuccaagacccagacccuccccucccgcggcccccgcggcggcggcgccggcgagcagccccccccccccuccgcccgcuccaccccccuccccggcccccccggcuccccccgcuccuccggcggcaccccccuccacuccccccuccacaccccccgcgccucccccaccggcacccccggcaccacccccccccccucccccggcggcggcgucggcggcgccgccuggcgcucccgccucaacuccauccgcaacuccuuccucggcuccccccgcuuccaccgccgcaagaugcagguccccaccgccgaggagauguccucccucacccccgaguccucccccgagcucgccaagcgcuccugguucggcaacuucaucucccucgacaaggaggagcagaucuuccucguccucaaggacaagccccucuccuccaucaaggccgacaucguccacgccuuccucuccauccccucccucucccacuccguccucucccagaccuccuuccgcgccgaguacaaggccuccggcggccccuccgucuuccagaagcccguccgcuuccaggucgacaucuccuccuccgagggccccgagcccuccccccgccgcgacggcuccggcggcggcggcaucuacuccgucaccuucacccucaucuccggccccucccgccgcuucaagcgcgucgucgagaccauccaggcccagcuccucuccacccacgaccagcccuccguccaggcccucgccgacgagaagaacggcgcccagacccgccccgccggcgcccccccccgcucccuccagcccccccccggccgccccgaccccgagcucuccuccuccccccgccgcggcccccccaaggacaagaagcuccucgccaccaacggcaccccccuccccuga

SEQ ID NO: 40421 - RNA, 2211 nt, Artificial Sequence
  derived and/or modified sequence opt2 from BRSK2__Homo_sapiens__NP_001243556
augaccuccaccggcaaggacggcggcgcccagcacgcccaguacgucggccccuaccgccucgagaagacccucggcaagggccagaccggccucgucaagcucggcguccacugcgucaccugccagaaggucgccaucaagaucgucaaccgcgagaagcucuccgaguccguccucaugaaggucgagcgcgagaucgccauccucaagcucaucgagcacccccacguccucaagcuccacgacgucuacgagaacaagaaguaccucuaccucguccucgagcacgucuccggcggcgagcucuucgacuaccucgucaagaagggccgccucacccccaaggaggcccgcaaguucuuccgccagaucaucuccgcccucgacuucugccacucccacuccaucugccaccgcgaccucaagcccgagaaccuccuccucgacgagaagaacaacauccgcaucgccgacuucggcauggccucccuccaggucggcgacucccuccucgagaccuccugcggcuccccccacuacgccugccccgaggucauccgcggcgagaaguacgacggccgcaaggccgacgucugguccugcggcgucauccucuucgcccuccucgucggcgcccuccccuucgacgacgacaaccuccgccagcuccucgagaaggucaagcgcggcgucuuccacaugccccacuucaucccccccgacugccagucccuccuccgcggcaugaucgaggucgacgccgcccgccgccucacccucgagcacauccagaagcacaucugguacaucggcggcaagaacgagcccgagcccgagcagcccaucccccgcaagguccagauccgcucccuccccucccucgaggacaucgaccccgacguccucgacuccaugcacucccucggcugcuuccgcgaccgcaacaagcuccuccaggaccuccucuccgaggaggagaaccaggagaagaugaucuacuuccuccuccucgaccgcaaggagcgcuaccccucccaggaggacgaggaccuccccccccgcaacgagaucgaccccccccgcaagcgcgucgacucccccaugcucaaccgccacggcaagcgccgccccgagcgcaaguccauggagguccucuccgucaccgacggcggcucccccguccccgcccgccgcgccaucgagauggcccagcacggccagcgcucccgcuccaucuccggcgccuccuccggccucuccaccuccccccucuccuccccccgcgucaccccccaccccuccccccgcggcuccccccuccccacccccaagggcacccccguccacacccccaaggagucccccgccggcacccccaaccccaccccccccuccucccccuccgucggcggcguccccuggcgcgcccgccucaacuccaucaagaacuccuuccucggcuccccccgcuuccaccgccgcaagcuccagguccccacccccgaggagauguccaaccucacccccgaguccucccccgagcucgccaagaaguccugguucggcaacuucaucucccucgagaaggaggagcagaucuucgucgucaucaaggacaagccccucuccuccaucaaggccgacaucguccacgccuuccucuccauccccucccucucccacuccgucaucucccagaccuccuuccgcgccgaguacaaggccaccggcggccccgccgucuuccagaagcccgucaaguuccaggucgacaucaccuacaccgagggcggcgaggcccagaaggagaacggcaucuacuccgucaccuucacccuccucuccggccccucccgccgcuucaagcgcgucgucgagaccauccaggcccagcuccucuccacccacgacccccccgccgcccagcaccucuccgacaccaccaacugcauggagaugaugaccggccgccucuccaagugcggcuccccccucuccaacuucuucgacgucaucaagcagcucuucuccgacgagaagaacggccaggccgcccaggcccccuccacccccgccaagcgcuccgcccacggcccccucggcgacuccgccgccgccggccccggccccggcggcgacgccgaguaccccaccggcaaggacaccgccaagaugggcccccccaccgcccgccgcgagcagcccuga

SEQ ID NO: 40422 - RNA, 363 nt, Artificial Sequence
  derived and/or modified sequence opt2 from BRWD1__Homo_sapiens__NP_001007247
auggccgagcccuccuccgcccgccgccccgucccccucaucgaguccgagcucuacuuccucaucgcccgcuaccucuccgccggccccugccgccgcgccgcccagguccucguccaggagcucgagcaguaccagcuccuccccaagcgccucgacugggagggcaacgagcacaaccgcuccuacgaggagcucguccucuccaacaagcacgucgcccccgaccaccuccuccagaucugccagcgcaucggccccaugcucgacaaggagaucccccccuccaucucccgcgucaccucccuccucggcgccggccgccagucccuccuccgcaccgccaagggcacccucaucuga

SEQ ID NO: 40423 - RNA, 5409 nt, Artificial Sequence
  derived and/or modified sequence opt2 from BRWD3__Homo_sapiens__NP_694984
auggccgccgcccccacccagaucgaggccgagcucuacuaccucaucgcccgcuuccuccaguccggccccugcaacaaguccgcccagguccucguccaggagcucgaggagcaccagcucaucccccgccgccucgacugggagggcaaggagcaccgccgcuccuucgaggaccucgucgccgccaacgcccacaucccccccgacuaccuccucaagaucugcgagcgcaucggcccccuccucgacaaggagaucccccaguccguccccggcguccagacccuccucggcgucggccgccagucccuccuccgcgacgccaaggacugcaaguccacccucuggaacggcuccgccuucgccgcccuccaccgcggccgcccccccgagcuccccgucaacuacgucaagccccccaacgucgucaacaucaccuccgcccgccagcucaccggcugcucccgcuucggccacaucuuccccuccuccgccuaccagcacaucaagaugcacaagcgcauccucggccaccucuccuccgucuacugcgucgccuucgaccgcuccggccgccgcaucuucaccggcuccgacgacugccucgucaagaucugggccaccgacgacggccgccuccucgccacccuccgcggccacuccgccgagaucuccgacauggccgucaacuacgagaacacccucaucgccgccggcuccugcgacaaggucguccgcgucuggugccuccgcaccugcgcccccgucgccguccuccagggccacuccgccuccaucaccuccauccaguucugccccuccaccaagggcaccaaccgcuaccucaccuccaccggcgccgacggcaccaucugcuucuggcaguggcacgucaagaccaugaaguuccgcgaccgccccgucaaguucaccgagcgcucccgccccggcguccagaucuccugcuccuccuucuccuccggcggcauguucaucaccaccggcuccaccgaccacgucauccgcaucuacuaccucggcuccgagguccccgagaagaucgccgagcucgagucccacaccgacaaggucgucgccguccaguucugcaacaacggcgacucccuccgcuucgucuccggcucccgcgacggcaccgcccgcaucuggcaguaccagcagcaggaguggaaguccaucguccucgacauggccaccaagaugaccggcaacaaccuccccuccggcgaggacaagaucaccaagcucaaggucaccauggucgccugggaccgcuacgacaccaccgucaucaccgccgucaacaacuuccuccucaaggucuggaacuccaucaccggccagcuccuccacacccucuccggccacgacgacgaggucuucguccucgaggcccaccccuucgaccagcgcaucauccucuccgccggccacgacggcaacaucuucaucugggaccucgaccgcggcaccaagauccgcaacuacuucaacaugaucgagggccagggccacggcgccgucuucgacugcaaguucucccccgacggcaaccacuucgccugcaccgacucccacggccaccuccuccucuucggcuucggcugcuccaaguacuacgagaagauccccgaccagauguucuuccacaccgacuaccgcccccucauccgcgacgccaacaacuacguccucgacgagcagacccagcaggccccccaccucaugcccccccccuuccucgucgacgucgacggcaacccccaccccaccaaguuccagcgccucguccccggccgcgagaacugcaaggacgagcagcucaucccccagcucggcuacgucgccaacggcgacggcgaggucgucgagcaggucaucggccagcagaccaacgaccaggacgaguccauccucgacggcaucauccgcgagcuccagcgcgagcaggaccuccgccucaucaacgagggcgacgucccccaccuccccgucaaccgcgccuacuccgucaacggcgcccuccgcucccccaacauggacaucuccuccucccccaacauccgccuccgccgccacuccucccagaucgagggcguccgccagaugcacaacaacgccccccgcucccagauggccaccgagcgcgaccucauggccuggucccgccgcgucgucgucaacgagcucaacaacggcgucucccgcguccaggaggagugccgcaccgccaagggcgacaucgagaucucccucuacaccgucgagaagaagaagaagcccuccuacaccacccagcgcaacgacuacgagcccuccugcggccgcucccuccgccgcacccagcgcaagcgccagcacaccuaccagacccgcuccaacaucgagcacaacucccaggccuccugccagaacuccggcguccaggaggacuccgacuccuccuccgaggaggacgagaccgucggcaccuccgacgccuccgucgaggaccccgucgucgaguggcaguccgaguccuccuccuccgacuccuccuccgaguacuccgacuggaccgccgacgccggcaucaaccuccagccccccaagcgccagacccgccagaccacccgcaagaucugcuccuccuccgacgaggagaaccucaagucccucgaggagcgccagaagaagcccaagcagacccgcaagaagaagggcggccucgucuccaucgccggcgagcccaacgaggagugguucgccccccaguggauccucgacaccaucccccgccgcucccccuucgucccccagaugggcgacgagcucaucuacuuccgccagggccacgaggccuacguccgcgccguccgcaaguccaagaucuacuccgucaaccuccagaagcagcccuggaacaagauggaccuccgcgagcaggaguucgucaagaucgucggcaucaaguacgaggucggcccccccacccucugcugccucaagcucgccuuccucgaccccaucuccggcaagaugaccggcgaguccuucuccaucaaguaccacgacaugcccgacgucaucgacuuccucguccuccaccaguucuacaacgaggccaaggagcgcaacuggcagaucggcgaccgcuuccgcuccaucaucgacgacgccuggugguucggcaccgucgagucccagcagcccuuccagcccgaguaccccgacuccuccuuccagugcuacuccguccacugggacaacaacgagcgcgagaagaugucccccugggacauggagcccauccccgagggcaccgccuuccccgacgaggucggcgccggcguccccgucucccaggaggagcucaccgcccuccucuacaagccccaggagggcgaguggggcgcccacucccgcgacgaggagugcgagcgcgucauccagggcaucaaccaccuccucucccucgacuucgccucccccuucgccguccccgucgaccucuccgccuacccccucuacugcaccgucgucgccuaccccaccgaccucaacaccauccgccgccgccucgagaaccgcuucuaccgccgcaucuccgcccucaugugggagguccgcuacaucgagcacaacgcccgcaccuucaacgagcccgacucccccaucgucaaggccgccaagaucgucaccgacguccuccuccgcuucaucggcgaccaguccugcaccgacauccucgacaccuacaacaagaucaaggccgaggagcgcaacuccaccgacgccgaggaggacaccgagaucgucgaccucgacuccgacggccccggcaccuccuccggccgccgcgucaagugccgcggccgccgccagucccucaagugcaaccccgacgccuggaagaagcagugcaaggagcuccucucccucaucuacgagcgcgaggacuccgagcccuuccgccagcccgccgaccuccucuccuaccccggccaccaggagcaggagggcgaguccuccgaguccgucguccccgagcgccagcaggacuccucccucuccgaggacuaccaggacgucaucgacacccccgucgacuucuccaccgucaaggagacccucgaggccggcaacuacggcuccccccucgaguucuacaaggacguccgccagaucuucaacaacuccaaggccuacaccuccaacaagaagucccgcaucuacuccaugaugcuccgccucuccgcccucuucgagucccacaucaagaacaucaucuccgaguacaaguccgccauccagucccagaagcgccgccgcccccgcuaccgcaagcgccuccgcuccuccuccuccucccucuccuccuccggcgcccccucccccaagggcaagcagaagcagaugaagcuccagcccaagaacgaccagaacaccuccgucucccacgcccgcaccuccucccccuucuccucccccgucuccgacgccgccgagggccucucccucuaccuccucgacgacgagcccgacggccccuucuccuccuccuccuucggcggcuacucccgcuccggcaacucccacgaccccggcaaggccaaguccuuccgcaaccgcguccuccccgucaagcaggaccacucccucgacggcccccucaccaacggcgacggccgcgagccccgcaccggcaucaagcgcaagcuccucuccgccuccgaggaggacgagaacaugggcggcgaggacaaggagaagaaggagaccaaggagaagucccaccucuccaccuccgaguccggcgagcucggcuccucccucuccuccgaguccaccugcggcuccgacuccgacuccgaguccaccucccgcaccgaccaggacuacgucgacggcgaccacgacuacuccaaguucauccagacccgccccaagcgcaagcuccgcaagcagcacggcaacggcaagcgcaacuggaagacccgcggcaccggcggccgcggccgcuggggccgcuggggccgcuggucccgcggcggccgcggccgcggcggccgcggccgcggcucccgcggccgcggcggcggcggcacccgcggccgcggccgcggccgcggcggccgcggcgccucccgcggcgccacccgcgccaagcgcgcccgcaucgccgacgacgaguucgacaccauguucuccggccgcuucucccgccucccccgcaucaagacccgcaaccagggccgccgcaccguccucuacaacgacgacuccgacaacgacaacuucgucuccaccgaggacccccucaaccucggcaccucccgcuccggccgcguccgcaagaugaccgagaaggcccgcgucucccaccucaugggcuggaacuacuga

SEQ ID NO: 40424 - RNA, 1389 nt, Artificial Sequence
  derived and/or modified sequence opt2 from BSCL2__Homo_sapiens__NP_001116427
auguccaccgagaaggucgaccagaaggaggaggccggcgagaaggaggucugcggcgaccagaucaagggccccgacaaggaggaggagccccccgccgccgccucccacggccagggcuggcgccccggcggccgcgccgcccgcaacgcccgccccgagcccggcgcccgccaccccgcccuccccgccauggucaacgacccccccguccccgcccuccucugggcccaggaggucggccagguccucgccggccgcgcccgccgccuccuccuccaguucggcguccucuucugcaccauccuccuccuccucugggucuccgucuuccucuacggcuccuucuacuacuccuacaugcccaccgucucccaccucucccccguccacuucuacuaccgcaccgacugcgacuccuccaccaccucccucugcuccuuccccgucgccaacgucucccucaccaagggcggccgcgaccgcguccucauguacggccagcccuaccgcgucacccucgagcucgagcuccccgagucccccgucaaccaggaccucggcauguuccucgucaccaucuccugcuacacccgcggcggccgcaucaucuccaccuccucccgcuccgucaugcuccacuaccgcuccgaccuccuccagaugcucgacacccucgucuucuccucccuccuccucuucggcuucgccgagcagaagcagcuccucgaggucgagcucuacgccgacuaccgcgagaacuccuacguccccaccaccggcgccaucaucgagauccacuccaagcgcauccagcucuacggcgccuaccuccgcauccacgcccacuucaccggccuccgcuaccuccucuacaacuuccccaugaccugcgccuucaucggcgucgccuccaacuucaccuuccucuccgucaucguccucuucuccuacaugcagugggucuggggcggcaucuggccccgccaccgcuucucccuccaggucaacauccgcaagcgcgacaacucccgcaaggagguccagcgccgcaucuccgcccaccagcccggccccgagggccaggaggaguccaccccccaguccgacgucaccgaggacggcgagucccccgaggaccccuccggcaccgagggccagcucuccgaggaggagaagcccgaccagcagccccucuccggcgaggaggagcucgagcccgaggccuccgacggcuccggcuccugggaggacgccgcccuccucaccgaggccaaccuccccgcccccgcccccgccuccgccuccgcccccguccucgagacccucggcuccuccgagcccgccggcggcgcccuccgccagcgccccaccugcuccuccuccuga

SEQ ID NO: 40425 - RNA, 1158 nt, Artificial Sequence
  derived and/or modified sequence opt2 from BSG__Homo_sapiens__NP_001719
auggccgccgcccucuucguccuccucggcuucgcccuccucggcacccacggcgccuccggcgccgccggcuucguccaggccccccucucccagcagcgcugggucggcggcuccgucgagcuccacugcgaggccgucggcucccccguccccgagauccaguggugguucgagggccagggccccaacgacaccugcucccagcucugggacggcgcccgccucgaccgcguccacauccacgccaccuaccaccagcacgccgccuccaccaucuccaucgacacccucgucgaggaggacaccggcaccuacgagugccgcgccuccaacgaccccgaccgcaaccaccucacccgcgccccccgcgucaaguggguccgcgcccaggccgucguccucguccucgagcccggcaccgucuucaccaccgucgaggaccucggcuccaagauccuccucaccugcucccucaacgacuccgccaccgaggucaccggccaccgcuggcucaagggcggcgucguccucaaggaggacgcccuccccggccagaagaccgaguucaaggucgacuccgacgaccaguggggcgaguacuccugcgucuuccuccccgagcccaugggcaccgccaacauccagcuccacggccccccccgcgucaaggccgucaaguccuccgagcacaucaacgagggcgagaccgccaugcucgucugcaaguccgaguccgucccccccgucaccgacugggccugguacaagaucaccgacuccgaggacaaggcccucaugaacggcuccgagucccgcuucuucgucuccuccucccagggccgcuccgagcuccacaucgagaaccucaacauggaggccgaccccggccaguaccgcugcaacggcaccuccuccaagggcuccgaccaggccaucaucacccuccgcguccgcucccaccucgccgcccucuggcccuuccucggcaucgucgccgagguccucguccucgucaccaucaucuucaucuacgagaagcgccgcaagcccgaggacguccucgacgacgacgacgccggcuccgccccccucaaguccuccggccagcaccagaacgacaagggcaagaacguccgccagcgcaacuccuccuga

SEQ ID NO: 40426 - RNA, 11781 nt, Artificial Sequence
  derived and/or modified sequence opt2 from BSN__Homo_sapiens__NP_003449
augggcaacgaggucucccucgagggcggcgccggcgacggcccccucccccccggcggcgccggccccggccccggccccggccccggccccggcgccggcaagccccccuccgcccccgccggcggcggccagcuccccgccgccggcgccgcccgcuccaccgccgucccccccguccccggccccggccccggccccggccccggccccggccccggcuccaccucccgccgccucgaccccaaggagccccucggcaaccagcgcgccgccucccccacccccaagcaggccuccgccaccacccccggccacgaguccccccgcgagacccgcgcccagggccccgccggccaggaggccgacggcccccgccgcacccuccaggucgacucccgcacccagcgcuccggccgcucccccuccgucucccccgaccgcggcuccacccccaccucccccuacuccgucccccagaucgccccccuccccuccuccacccucugccccaucugcaagaccuccgaccucaccuccacccccucccagcccaacuucaacaccugcacccagugccacaacaaggucugcaaccagugcggcuucaaccccaacccccaccucacccaggucaaggaguggcucugccucaacugccagaugcagcgcgcccucggcauggacaugaccaccgccccccgcuccaagucccagcagcagcuccacucccccgcccucucccccgcccacucccccgccaagcagccccucggcaagcccgaccaggagcgcucccgcggccccggcggcccccagcccggcucccgccaggccgagaccgcccgcgccaccuccguccccggccccgcccaggccgccgccccccccgaggucggccgcgucuccccccagcccccccagcccaccaagcccuccaccgccgagccccgcccccccgccggcgaggcccccgccaaguccgccaccgccguccccgccggccucggcgccaccgagcagacccaggagggccucaccggcaagcucuucggccucggcgccucccuccucacccaggccuccacccucauguccguccagcccgaggccgacacccagggccagcccgcccccuccaagggcacccccaagaucgucuucaacgacgccuccaaggaggccggccccaagccccucggcuccggccccggccccggccccgcccccggcgccaagaccgagcccggcgcccgcaugggccccggcuccggccccggcgcccuccccaagaccggcggcaccaccucccccaagcacggccgcgccgagcaccaggccgccuccaaggccgccgccaagcccaagaccaugcccaaggagcgcgccaucugcccccucugccaggccgagcucaacgucggcuccaagucccccgccaacuacaacaccugcaccaccugccgccuccaggucugcaaccucugcggcuucaaccccaccccccaccucgucgagaagaccgaguggcucugccucaacugccagaccaagcgccuccucgagggcucccucggcgagcccaccccccuccccccccccaccucccagcagccccccgucggcgccccccaccgcgccuccggcaccuccccccucaagcagaagggcccccagggccucggccagcccuccggcccccuccccgccaaggccuccccccucuccaccaaggccuccccccuccccuccaaggccuccccccaggccaagccccuccgcgccuccgagcccuccaagacccccuccuccguccaggagaagaagacccgcguccccaccaaggccgagcccaugcccaagcccccccccgagaccacccccacccccgccacccccaaggucaaguccggcguccgccgcgccgagcccgccacccccgucgucaaggccguccccgaggcccccaagggcggcgaggccgaggaccucgucggcaagcccuacucccaggacgccucccgcuccccccagucccucuccgacaccggcuacuccuccgacggcaucuccuccucccaguccgagaucaccggcgucguccagcaggaggucgagcagcucgacuccgccggcgucaccggcccccacccccccucccccuccgagauccacaaggucggcuccuccaugcgcccccuccuccaggcccagggccucgcccccuccgagcgcuccaagccccucuccuccggcaccggcgaggagcagaagcagcgcccccacucccucuccaucacccccgaggccuucgacuccgacgaggagcucgaggacauccucgaggaggacgaggacuccgccgaguggcgccgccgccgcgagcagcaggacaccgccgaguccuccgacgacuucggcucccagcuccgccacgacuacgucgaggacuccuccgagggcggccucuccccccuccccccccagccccccgcccgcgccgccgagcucaccgacgaggacuucaugcgccgccagauccucgagauguccgccgaggaggacaaccucgaggaggacgacaccgccaccuccggccgcggccucgccaagcacggcacccagaagggcggcccccgcccccgccccgagcccucccaggagcccgccgcccuccccaagcgccgccucccccacaacgccaccaccggcuacgaggagcuccuccccgagggcggcuccgccgaggccaccgacggcuccggcacccuccagggcggccuccgccgcuucaagaccaucgagcucaacuccaccggcuccuacggccacgagcucgaccucggccagggccccgaccccucccucgaccgcgagcccgagcucgagauggagucccucaccggcucccccgaggaccgcucccgcggcgagcacuccuccacccuccccgccuccacccccuccuacaccuccggcaccucccccaccucccucuccucccucgaggaggacuccgacuccucccccucccgccgccagcgccucgaggaggccaagcagcagcgcaaggcccgccaccgcucccacggcccccuccuccccaccaucgaggacuccuccgaggaggaggagcuccgcgaggaggaggagcuccuccgcgagcaggagaagaugcgcgaggucgagcagcagcgcauccgcuccaccgcccgcaagacccgccgcgacaaggaggagcuccgcgcccagcgccgccgcgagcgcuccaagaccccccccuccaaccucucccccaucgaggacgccucccccaccgaggagcuccgccaggccgccgagauggaggagcuccaccgcuccuccugcuccgaguacucccccucccccucccucgacuccgaggccgaggcccucgacggcggccccucccgccucuacaaguccggcuccgaguacaaccuccccaccuucaugucccucuacucccccaccgagacccccuccggcuccuccaccacccccuccuccggccgcccccucaaguccgccgaggaggccuacgaggagaugaugcgcaaggccgagcuccuccagcgccagcagggccaggccgccggcgcccgcggcccccacggcggccccucccagcccaccggcccccgcggccucggcuccuucgaguaccaggacaccaccgaccgcgaguacggccaggccgcccagcccgccgccgagggcacccccgccucccucggcgccgccgucuacgaggagauccuccagaccucccaguccaucguccgcaugcgccaggccuccucccgcgaccucgccuucgccgaggacaagaagaaggagaagcaguuccucaacgccgaguccgccuacauggaccccaugaagcagaacggcggcccccucacccccggcaccucccccacccagcucgccgcccccgucuccuucuccacccccaccuccuccgacuccuccggcggccgcgucauccccgacguccgcgucacccagcacuucgccaaggagacccaggacccccucaagcuccacuccucccccgccucccccuccuccgccuccaaggagaucggcaugcccuucucccagggccccggcacccccgccaccaccgccgucgcccccugccccgccggccucccccgcggcuacaugacccccgccucccccgccggcuccgagcgcucccccucccccuccuccaccgcccacuccuacggccacucccccaccaccgccaacuacggcucccagaccgaggaccucccccaggcccccuccggccucgccgccgccggccgcgccgcccgcgagaagccccucuccgccuccgacggcgagggcggcaccccccagcccucccgcgccuacuccuacuucgccuccuccucccccccccucucccccuccucccccuccgagucccccaccuucucccccggcaagaugggcccccgcgccaccgccgaguucuccacccagacccccucccccgcccccgccuccgacaugccccgcucccccggcgcccccacccccucccccauggucgcccagggcacccagaccccccaccgccccuccaccccccgccucgucuggcaggaguccucccaggaggcccccuucauggucaucacccucgccuccgacgccuccucccagacccgcaugguccacgccuccgccuccaccuccccccucugcucccccaccgagacccagcccaccacccacggcuacucccagaccaccccccccuccgucucccagcucccccccgagccccccggcccccccggcuucccccgcguccccuccgccggcgccgacggcccccucgcccucuacggcuggggcgcccuccccgccgagaacaucucccucugccgcaucuccuccguccccggcaccucccgcgucgagcccggcccccgcacccccggcaccgccgucgucgaccuccgcaccgccgucaagcccacccccaucauccucaccgaccagggcauggaccucaccucccucgccgucgaggcccgcaaguacggccucgcccucgaccccauccccggccgccaguccaccgccguccagccccucgucaucaaccucaacgcccaggagcacaccuuccucgccaccgccaccaccgucuccaucaccauggccuccuccgucuucauggcccagcagaagcagcccgucgucuacggcgaccccuaccagucccgccucgacuucggccagggcggcggcucccccgucugccucgcccaggucaagcaggucgagcaggccguccagaccgcccccuaccgcuccggcccccgcggccgcccccgcgaggccaaguucgcccgcuacaaccuccccaaccaggucgccccccucgcccgccgcgacguccucaucacccagaugggcaccgcccaguccaucggccucaagcccggccccguccccgagcccggcgccgagccccaccgcgccacccccgccgagcuccgcucccacgcccuccccggcgcccgcaagccccacaccgucgucguccagaugggcgagggcaccgccggcaccgucaccacccuccuccccgaggagcccgccggcgcccucgaccucaccggcaugcgccccgagucccagcucgccugcugcgacauggucuacaagcuccccuucggcuccuccugcaccggcaccuuccaccccgcccccuccguccccgagaaguccauggccgacgccgccccccccggccaguccuccucccccuucuacggcccccgcgaccccgagccccccgagccccccaccuaccgcgcccagggcgucgucggccccggcccccacgaggagcagcgccccuacccccagggccuccccggccgccucuacuccuccauguccgacaccaaccucgccgaggccggccucaacuaccacgcccagcgcaucggccagcucuuccagggccccggccgcgacuccgccauggaccucuccucccucaagcacuccuacucccucggcuucgccgacggccgcuaccucggccagggccuccaguacggcuccgucaccgaccuccgccaccccaccgaccuccucgcccacccccuccccaugcgccgcuacuccuccgucuccaacaucuacuccgaccaccgcuacggcccccgcggcgacgccgucggcuuccaggaggccucccucgcccaguacuccgccaccaccgcccgcgagaucucccgcaugugcgccgcccucaacuccauggaccaguacggcggccgccacggcuccggcggcggcggccccgaccucguccaguaccagccccagcacggccccggccucuccgccccccagucccucgucccccuccgccccggccuccucggcaaccccaccuuccccgagggccaccccucccccggcaaccucgcccaguacggccccgccgccggccagggcaccgccguccgccagcuccuccccuccaccgccaccguccgcgccgccgacggcaugaucuacuccaccaucaacacccccaucgccgccacccuccccaucaccacccagcccgccuccguccuccgccccaugguccgcggcggcauguaccgccccuacgccuccggcggcaucaccgccgucccccucaccucccucacccgcguccccaugaucgccccccgcgucccccucggccccaccggccucuaccgcuaccccgcccccucccgcuuccccaucgccuccuccgucccccccgccgagggccccgucuaccucggcaagcccgccgccgccaaggcccccggcgccggcggccccucccgccccgagaugcccgucggcgccgcccgcgaggagccccuccccaccaccacccccgccgccaucaaggaggccgccggcgcccccgcccccgccccccucgccggccagaagccccccgccgacgccgcccccggcggcggcuccggcgcccucucccgccccggcuucgagaaggaggaggccucccaggaggagcgccagcgcaagcagcaggagcagcuccuccagcucgagcgcgagcgcgucgagcucgagaagcuccgccagcuccgccuccaggaggagcucgagcgcgagcgcgucgagcuccagcgccaccgcgaggaggagcagcuccucguccagcgcgagcuccaggagcuccagaccaucaagcaccacguccuccagcagcagcaggaggagcgccaggcccaguucgcccuccagcgcgagcagcucgcccagcagcgccuccagcucgagcagauccagcagcuccagcagcagcuccagcagcagcucgaggagcagaagcagcgccagaaggcccccuuccccgccgccugcgaggcccccggccgcggccccccccucgccgccgccgagcucgcccagaacggccaguacuggcccccccucacccacgccgccuucaucgccauggccggccccgagggccucggccagccccgcgagcccguccuccaccgcggccuccccuccuccgccuccgacaugucccuccagaccgaggagcagugggaggccucccgcuccggcaucaagaagcgccacuccaugccccgccuccgcgacgccugcgagcucgaguccggcaccgagcccugcgucguccgccgcaucgccgacuccuccguccagaccgacgacgaggacggcgagucccgcuaccuccucucccgccgccgccgcgcccgccgcuccgccgacugcuccguccagaccgacgacgaggacuccgccgagugggagcagcccguccgccgccgccgcucccgccucccccgccacuccgacuccggcuccgacuccaagcacgacgccaccgccuccuccuccuccgccgccgccaccguccgcgccauguccuccgucggcauccagaccaucuccgacugcuccguccagaccgagcccgaccagcucccccgcgucucccccgccauccacaucaccgccgccaccgaccccaaggucgagaucguccgcuacaucuccgcccccgagaagaccggccgcggcgagucccucgccugccagaccgagcccgacggccaggcccagggcgucgccggcccccagcucgucggccccaccgccaucucccccuaccuccccggcauccagaucgucacccccggcccccucggccgcuucgagaagaagaagcccgacccccucgagaucggcuaccaggcccaccucccccccgagucccucucccagcucgucucccgccagccccccaaguccccccagguccucuacucccccgucuccccccucuccccccaccgccuccucgacaccuccuucgccuccuccgagcgccucaacaaggcccacgucuccccccagaagcacuucaccgccgacuccgcccuccgccagcagacccucccccgccccaugaagacccuccagcgcucccucuccgaccccaagccccucucccccaccgccgaggaguccgccaaggagcgcuucucccucuaccagcaccagggcggccucggcucccaggucuccgcccucccccccaacucccucguccgcaaggucaagcgcacccuccccucccccccccccgaggaggcccaccucccccucgccggccaggccuccccccagcucuacgccgccucccuccuccagcgcggccucaccggccccaccaccguccccgccaccaaggccucccuccuccgcgagcucgaccgcgaccuccgccucgucgagcacgaguccaccaagcuccgcaagaagcaggccgagcucgacgaggaggagaaggagaucgacgccaagcucaaguaccucgagcucggcaucacccagcgcaaggagucccucgccaaggaccgcggcggccgcgacuaccccccccuccgcggccucggcgagcaccgcgacuaccucuccgacuccgagcucaaccagcuccgccuccagggcugcaccacccccgccggccaguucgucgacuuccccgccaccgccgccgcccccgccacccccuccggccccaccgccuuccagcagccccgcuuccagccccccgccccccaguacuccgccggcuccggcggccccacccagaacggcuuccccgcccaccaggcccccaccuaccccggccccuccaccuaccccgcccccgccuucccccccggcgccuccuaccccgccgagcccggccuccccaaccagcaggccuuccgccccaccggccacuacgccggccagacccccaugcccaccacccaguccacccucuuccccguccccgccgacucccgcgccccccuccagaagccccgccagaccucccucgccgaccucgagcagaagguccccaccaacuacgaggucaucgccucccccgucguccccauguccuccgcccccuccgagaccuccuacuccggccccgccgucuccuccggcuacgagcagggcaagguccccgaggucccccgcgccggcgaccgcggcuccgucucccagucccccgcccccaccuaccccuccgacucccacuacaccucccucgagcagaacgucccccgcaacuacgucaugaucgacgacaucuccgagcucaccaaggacuccaccuccaccgcccccgacucccagcgccucgagccccucggccccggcuccuccggccgccccggcaaggagcccggcgagcccggcguccucgacggccccacccuccccugcugcuacgcccgcggcgaggaggaguccgaggaggacuccuacgacccccgcggcaagggcggccaccuccgcuccauggaguccaacggccgccccgccuccacccacuacuacggcgacuccgacuaccgccacggcgcccgcgucgagaaguacggccccggccccaugggccccaagcaccccuccaagucccucgcccccgccgccaucuccuccaagcgcuccaagcaccgcaagcagggcauggagcagaagaucuccaaguucucccccaucgaggaggccaaggacgucgaguccgaccucgccuccuaccccccccccgccgucuccuccucccucgucucccgcggccgcaaguuccaggacgagaucaccuacggccucaagaagaacgucuacgagcagcagaaguacuacggcauguccucccgcgacgccgucgaggacgaccgcaucuacggcggcuccucccgcucccgcgcccccuccgccuacuccggcgagaagcucuccucccacgacuucuccggcuggggcaagggcuacgagcgcgagcgcgaggccgucgagcgccuccagaaggccggccccaagcccuccucccucuccauggcccacucccgcguccgcccccccaugcgcucccaggccuccgaggaggagucccccgucuccccccucggccgcccccgccccgccggcggcccccucccccccggcggcgacaccugcccccaguucugcuccucccacuccaugcccgacguccaggagcacgucaaggacggcccccgcgcccacgccuacaagcgcgaggagggcuacauccucgacgacucccacugcgucgucuccgacuccgaggccuaccaccucggccaggaggagaccgacugguucgacaagccccgcgacgcccgcuccgaccgcuuccgccaccacggcggccacgccgucuccuccuccucccagaagcgcggccccgcccgccacuccuaccacgacuacgacgagccccccgaggagggccucuggccccacgacgagggcggccccggccgccacgccuccgccaaggagcaccgccacggcgaccacggccgccacuccggccgccacaccggcgaggagcccggccgccgcgccgccaagccccacgcccgcgaccucggccgccacgaggcccgcccccacucccagcccuccuccgcccccgccaugcccaagaagggccagcccggcuaccccuccuccgccgaguacucccagcccucccgcgccuccuccgccuaccaccacgccuccgacuccaagaagggcucccgccaggcccacuccggccccgccgcccuccaguccaaggccgagccccaggcccagccccagcuccagggccgccaggccgcccccggcccccagcagucccagucccccuccucccgccagauccccuccggcgccgccucccgccagccccagacccagcagcagcagcagggccucggccuccagcccccccagcaggcccucacccaggcccgccuccagcagcagucccagcccaccacccgcggcuccgcccccgccgccucccagcccgccggcaagccccagcccggccccuccaccgccaccggcccccagcccgccggccccccccgcgccgagcagaccaacggcuccaagggcaccgccaaggccccccagcagggccgcgccccccaggcccagcccgcccccggccccggccccgccggcgucaaggccggcgcccgccccggcggcacccccggcgcccccgccggccagcccggcgccgacggcgaguccgucuucuccaagauccuccccggcggcgccgccgagcaggccggcaagcucaccgaggccgucuccgccuucggcaagaaguucuccuccuucugguga

SEQ ID NO: 40427 - RNA, 399 nt, Artificial Sequence
  derived and/or modified sequence opt2 from BSPH1__Homo_sapiens__NP_001121798
augggcucccucaugcuccucuucgucgagaccacccgcaacuccuccgccugcaucuuccccgucauccucaacgagcucuccuccaccgucgagaccaucacccacuuccccgaggucaccgacggcgagugcgucuuccccuuccacuacaagaacggcaccuacuacgacugcaucaaguccaaggcccgccacaaguggugcucccucaacaagaccuacgagggcuacuggaaguucugcuccgccgaggacuucgccaacugcgucuuccccuucugguaccgccgccucaucuacugggagugcaccgacgacggcgaggccuucggcaagaaguggugcucccucaccaagaacuucaacaaggaccgcaucuggaaguacugcgaguga

SEQ ID NO: 40428 - RNA, 1209 nt, Artificial Sequence
  derived and/or modified sequence opt2 from BSPRY__Homo_sapiens__NP_060158
auguccgccgagggcgccgagcccggccccggcuccggcuccggccccggccccggcccccucugccccgagcacggccaggcccucuccugguucugcggcuccgagcgccgccccgucugcgccgccugcgccggccucggcggccgcugccgcggccaccgcauccgccgcgccgaggagcgcgccgaggagcuccgcaacaagaucgucgaccagugcgagcgccuccagcuccaguccgccgccaucaccaaguacgucgccgacguccuccccggcaagaaccagcgcgccgucuccauggccuccgccgcccgcgagcucgucauccagcgccucucccucguccgcucccucugcgaguccgaggagcagcgccuccucgagcagguccacggcgaggaggagcgcgcccaccaguccauccucacccagcgcguccacugggccgaggcccuccagaagcucgacaccauccgcaccggccucgucggcaugcucacccaccucgacgaccuccagcucauccagaaggagcaggagaucuucgagcgcaccgaggaggccgagggcauccucgacccccaggaguccgagaugcucaacuucaacgagaagugcacccgcuccccccuccucacccagcucugggccaccgccguccucggcucccucuccggcaccgaggacauccgcaucgacgagcgcaccgucucccccuuccuccagcucuccgacgaccgcaagacccucaccuucuccaccaagaaguccaaggccugcgccgacggccccgagcgcuucgaccacuggcccaacgcccucgccgccaccuccuuccagaacggccuccacgccuggauggucaacguccagaacuccugcgccuacaaggucggcgucgccuccggccaccucccccgcaagggcuccggcuccgacugccgccucggccacaacgccuucuccugggucuucucccgcuacgaccaggaguuccgcuucucccacaacggccagcacgagccccucggccuccuccgcggccccgcccagcucggcgucguccucgaccuccagguccaggagcuccucuucuacgagcccgccuccggcaccguccucugcgcccaccacgucuccuuccccggcccccucuuccccgucuucgccgucgccgaccagaccaucuccaucguccgcuga

SEQ ID NO: 40429 - RNA, 957 nt, Artificial Sequence
  derived and/or modified sequence opt2 from BST1__Homo_sapiens__NP_004325
auggccgcccagggcugcgccgccucccgccuccuccagcuccuccuccagcuccuccuccuccuccuccuccucgccgccggcggcgcccgcgcccgcuggcgcggcgagggcaccuccgcccaccuccgcgacaucuuccucggccgcugcgccgaguaccgcgcccuccucucccccgagcagcgcaacaagaacugcaccgccaucugggaggccuucaaggucgcccucgacaaggaccccugcuccguccuccccuccgacuacgaccucuucaucaaccucucccgccacuccaucccccgcgacaagucccucuucugggagaacucccaccuccucgucaacuccuucgccgacaacacccgccgcuucaugccccucuccgacguccucuacggccgcgucgccgacuuccucuccuggugccgccagaagaacgacuccggccucgacuaccaguccugccccaccuccgaggacugcgagaacaaccccgucgacuccuucuggaagcgcgccuccauccaguacuccaaggacuccuccggcgucauccacgucaugcucaacggcuccgagcccaccggcgccuaccccaucaagggcuucuucgccgacuacgagauccccaaccuccagaaggagaagaucacccgcaucgagaucugggucaugcacgagaucggcggccccaacgucgaguccugcggcgagggcuccaugaagguccucgagaagcgccucaaggacaugggcuuccaguacuccugcaucaacgacuaccgccccgucaagcuccuccagugcgucgaccacuccacccaccccgacugcgcccucaaguccgccgccgccgccacccagcgcaaggcccccucccucuacaccgagcagcgcgccggccucaucaucccccucuuccucguccucgccucccgcacccagcucuga

SEQ ID NO: 40430 - RNA, 543 nt, Artificial Sequence
  derived and/or modified sequence opt2 from BST2__Homo_sapiens__NP_004326
auggccuccaccuccuacgacuacugccgcguccccauggaggacggcgacaagcgcugcaagcuccuccucggcaucggcauccucguccuccucaucaucgucauccucggcgucccccucaucaucuucaccaucaaggccaacuccgaggccugccgcgacggccuccgcgccgucauggagugccgcaacgucacccaccuccuccagcaggagcucaccgaggcccagaagggcuuccaggacgucgaggcccaggccgccaccugcaaccacaccgucauggcccucauggccucccucgacgccgagaaggcccagggccagaagaaggucgaggagcucgagggcgagaucaccacccucaaccacaagcuccaggacgccuccgccgaggucgagcgccuccgccgcgagaaccagguccucuccguccgcaucgccgacaagaaguacuaccccuccucccaggacuccuccuccgccgccgccccccagcuccucaucguccuccucggccucuccgcccuccuccaguga

SEQ ID NO: 40431 - RNA, 702 nt, Artificial Sequence
  derived and/or modified sequence opt2 from BSX__Homo_sapiens__NP_001091639
augaaccucaacuucaccuccccccuccaccccgccuccucccagcgccccaccuccuucuucaucgaggacauccuccuccacaagcccaagccccuccgcgaggucgcccccgaccacuucgccuccucccucgccucccgcgucccccuccucgacuacggcuacccccucaugcccacccccacccuccucgccccccacgcccaccacccccuccacaagggcgaccaccaccaccccuacuuccucaccaccuccggcaugcccguccccgcccucuucccccacccccagcacgccgagcuccccggcaagcacugccgccgccgcaaggcccgcaccgucuucuccgacucccagcucuccggccucgagaagcgcuucgagauccagcgcuaccucuccacccccgagcgcgucgagcucgccaccgcccucucccucuccgagacccaggucaagaccugguuccagaaccgccgcaugaagcacaagaagcagcuccgcaagucccaggacgagcccaaggcccccgacggccccgagucccccgagggcuccccccgcggcuccgaggccgccaccgccgccgaggcccgccucucccuccccgccggccccuucguccucaccgagcccgaggacgaggucgacaucggcgacgagggcgagcucggcuccggcccccacguccucuga

SEQ ID NO: 40432 - RNA, 1428 nt, Artificial Sequence
  derived and/or modified sequence opt2 from BTBD10__Homo_sapiens__XP_011518706
auggccggccgcccccaccccuacgacggcaacuccuccgaccccgagaacugggaccgcaagcuccacucccgcccccgcaagcucuacaagcacuccuccaccuccucccgcaucgccaagggcggcgucgaccacaccaagaugucccuccacggcgccuccggcggccacgagcgcucccgcgaccgccgccgcuccuccgaccgcucccgcgacuccucccacgagcgcaccgagucccagcucacccccugcauccgcaacgucaccucccccacccgccagcaccacgucgagcgcgagaaggaccacuccuccucccgccccuccuccccccgcccccagaaggccucccccaacggcuccaucuccuccgccggcaacuccucccgcaacuccucccaguccuccuccgacggcuccugcaagaccgccggcgagauggucuucgucuacgagaacgccaaggagggcgcccgcaacauccgcaccuccgagcgcgucacccucaucgucgacaacacccgcuucgucgucgaccccuccaucuucaccgcccagcccaacaccaugcucggccgcauguucggcuccggccgcgagcacaacuucacccgccccaacgagaagggcgaguacgaggucgccgagggcaucggcuccaccgucuuccgcgccauccucgacuacuacaagaccggcaucauccgcugccccgacggcaucuccauccccgagcuccgcgaggccugcgacuaccucugcaucuccuucgaguacuccaccaucaagugccgcgaccucuccgcccucaugcacgagcucuccaacgacggcgcccgccgccaguucgaguucuaccucgaggagaugauccucccccucauggucgccuccgcccaguccggcgagcgcgagugccacaucgucguccucaccgacgacgacgucgucgacugggacgaggaguaccccccccagaugggcgaggaguacucccagaucaucuacuccaccaagcucuaccgcuucuucaaguacaucgagaaccgcgacgucgccaaguccguccucaaggagcgcggccucaagaagauccgccucggcaucgagggcuaccccaccuacaaggagaaggucaagaagcgccccggcggccgccccgaggucaucuacaacuacguccagcgccccuucauccgcauguccugggagaaggaggagggcaagucccgccacgucgacuuccagugcgucaaguccaaguccaucaccaaccucgccgccgccgccgccgacaucccccaggaccagcucgucgucaugcaccccaccccccaggucgacgagcucgacauccuccccauccacccccccuccggcaacuccgaccucgaccccgacgcccagaaccccaugcucuga

SEQ ID NO: 40433 - RNA, 1926 nt, Artificial Sequence
  derived and/or modified sequence opt2 from BTBD11__Homo_sapiens__NP_001017523
augcgcaagcuccgccccaaggacucccgcgagcccgcccccggcucccccguccgcuccggcugccuccagcgccucucccacuacuccggcauccagcgccccuuccucguccuccccccccucauggaguggauccgcgucgccgucgcccacgccggccaccgccgcuccuucuccauggacuccgacgacguccgccaggccgcccgccuccuccuccccggcgucgacugcgagccccgccagcuccgcgccgacgacugcuucugcgccucccgcaagcucgacgccgucgccaucgaggccaaguucaagcaggaccucggcuuccgcaugcucaacugcggccgcaccgaccucgucaagcaggccgucucccuccucggccccgacggcaucaacaccauguccgagcagggcaugaccccccucauguacgccugcguccgcggcgacgaggccaugguccagaugcuccucgacgccggcgccgaccucaacgucgaggucgucuccaccccccacaaguaccccuccguccaccccgagacccgccacuggaccgcccucaccuucgccguccuccacggccacauccccgucguccagcuccuccucgacgccggcgccaaggucgagggcuccgucgagcacggcgaggagaacuacuccgagaccccccuccagcucgccgccgccgucggcaacuucgagcucgucucccuccuccucgagcgcggcgccgacccccucaucggcaccauguaccgcaacggcaucuccaccaccccccagggcgacaugaacuccuucucccaggccgccgcccacggccaccgcaacgucuuccgcaagcuccucgcccagcccgagaaggagaaguccgacauccucucccucgaggagauccucgccgagggcaccgaccucgccgagaccgccccccccccccucugcgccucccgcaacuccaaggccaagcuccgcgcccuccgcgaggccauguaccacuccgccgagcacggcuacgucgacgucaccaucgacauccgcuccaucggcguccccuggacccuccacaccuggcucgagucccuccgcaucgccuuccagcagcaccgccgcccccucauccagugccuccucaaggaguucaagaccauccaggaggaggaguacaccgaggagcucgucacccagggccucccccucauguucgagauccucaaggccuccaagaacgaggucaucucccagcagcucugcgucaucuucacccacugcuacggccccuaccccauccccaagcucaccgagaucaagcgcaagcagaccucccgccucgacccccacuuccucaacaacaaggagauguccgacgucaccuuccucgucgagggccgccccuucuacgcccacaagguccuccucuucaccgccuccccccgcuucaaggcccuccucuccuccaagcccaccaacgacggcaccugcaucgagaucggcuacgucaaguacuccaucuuccagcucgucaugcaguaccucuacuacggcggccccgagucccuccucaucaagaacaacgagaucauggagcuccucuccgccgccaaguucuuccagcucgaggcccuccagcgccacugcgagaucaucugcgccaaguccaucaacaccgacaacugcgucgacaucuacaaccacgccaaguuccucggcgucaccgagcucuccgccuacugcgagggcuacuuccucaagaacaugaugguccucaucgagaacgaggccuucaagcagcuccucuacgacaagaacggcgagggcaccggccaggacguccuccaggaccuccagcgcacccucgccauccgcauccaguccauccaccucuccuccuccaagggcuccgucgucuga

SEQ ID NO: 40434 - RNA, 1521 nt, Artificial Sequence
  derived and/or modified sequence opt2 from BTBD16__Homo_sapiens__NP_653188
augaucauguccaacacccacaaggcccgccucgagcgccgcgucaccggcuccaccaaccgcuggcgccuccccaagcagcccuucuccggcgaccuccucucccucucccagaugugcaaggcccucuccaucgacuucgaggaggcccuccgcaaccccgaccgccucugcaucucccagauccagaaguucuucuucgagaacuucaagaacaaggacauccaguccggcgaggccgacgucauccucgagugccucggcuucaagugggagcuccaccagccccagcucuuccaguccgagacccucgccaagcucuaccucaaggcccucgcccagggcaccacccacccccuccgcgagcucgaggagcuccuccgcgcccagucccccaagaagaccaaggagaagucccccgccaagcgcaucaucaucucccucaagaucaacgacccccucgucaccaaggucgccuucgccaccgcccucaagaaccucuacauguccgaggucgagaucaaccucgaggaccuccucggcguccucgccuccgcccacauccuccaguucuccggccucuuccagcgcugcgucgacgucaugaucgcccgccucaagcccuccaccaucaagaaguucuacgaggccggcugcaaguacaaggaggagcagcucaccaccggcugcgagaaguggcucgagaugaaccucgucccccucggcggcacccagauccaccuccacaagaucccccaggaccuccuccacaagguccucaaguccccccgccucuucaccuucuccgaguuccaccuccucaagaccaugcuccucugggucuuccuccagcucaacuacaagauccaggccauccccaccuacgagaccgucaugaccuucuucaaguccuuccccgagaacugcugcuuccucgaccgcgacaucggccgcucccuccgcccccucuuccucugccuccgccuccacggcaucaccaagggcaaggaccucgagguccuccgccaccucaacuucuuccccgaguccuggcucgaccaggucaccgucaaccacuaccacgcccucgagaacggcggcgacaugguccaccucaaggaccucaacacccaggccguccgcuucggccuccucuucaaccaggagaacaccaccuacuccaagaccaucgcccucuacggcuucuucuucaagaucaagggccucaagcacgacaccaccuccuacuccuucuacaugcagcgcaucaagcacaccgaccucgagucccccuccgccgucuacgagcacaaccacgucucccuccgcgccgcccgccucgucaaguacgagauccgcgccgaggcccucgucgacggcaaguggcaggaguuccgcaccaaccagaucaagcagaaguucggccucaccaccuccuccugcaagucccacacccucaagauccagaccgucggcauccccaucuacgucuccuucgccuucaucuuccccgccuccuga

SEQ ID NO: 40435 - RNA, 1158 nt, Artificial Sequence
  derived and/or modified sequence opt2 from BTBD1__Homo_sapiens__NP_001011885
auggccucccucggccccgccgccgccggcgagcaggccuccggcgccgaggccgagcccggccccgccggccccccccccccccccucccccuccucccucggcccccuccucccccuccagcgcgagccccucuacaacuggcaggccaccaaggccucccucaaggagcgcuucgccuuccucuucaacuccgagcuccucuccgacguccgcuucguccucggcaagggccgcggcgccgccgccgccggcggcccccagcgcauccccgcccaccgcuucguccucgccgccggcuccgccgucuucgacgccauguucaacggcggcauggccaccaccuccgccgagaucgagcuccccgacgucgagcccgccgccuuccucgcccuccuccgcuuccucuacuccgacgagguccagaucggccccgagaccgucaugaccacccucuacaccgccaagaaguacgccguccccgcccucgaggcccacugcgucgaguuccucaccaagcaccuccgcgccgacaacgccuucaugcuccucacccaggcccgccucuucgacgagccccagcucgccucccucugccucgacaccaucgacaaguccaccauggacgccaucuccgccgagggcuucaccgacaucgacaucgacacccucugcgccguccucgagcgcgacacccucuccauccgcgagucccgccucuucggcgccgucguccgcugggccgaggccgagugccagcgccagcagcuccccgucaccuucggcaacaagcagaagguccucggcaaggcccucucccucauccgcuucccccucaugaccaucgaggaguucgccgccggccccgcccaguccggcauccucuccgaccgcgaggucgucaaccucuuccuccacuucaccgucaaccccaagccccgcgucgaguacaucgaccgcccccgcugcugccuccgcggcaaggagugcugcaucaaccgcuuccagcaggucgagucccgcuggggcuacuccggcaccuccgaccgcauccgcucccucaacaugcgcaaguccaagcccugggaccgcaugauccccgcccucgucgucaugggccagcucacccacuccggcuccugcucccgcaaccccuga

SEQ ID NO: 40436 - RNA, 1578 nt, Artificial Sequence
  derived and/or modified sequence opt2 from BTBD2__Homo_sapiens__NP_060267
auggccgccggcggcuccggcggccgcgccuccugcccccccggcgucggcgucggccccggcaccggcggcucccccggccccuccgccaacgccgccgccacccccgcccccggcaacgccgccgccgccgccgccgccgccgccgccgccgccgccgcccccggccccaccccccccgccccccccggccccggcaccgacgcccaggccgccggcgccgagcgcgccgaggaggccgccggccccggcgccgccgcccuccagcgcgaggccgccuacaacuggcaggccuccaagcccaccguccaggagcgcuucgccuuccucuucaacaacgagguccucugcgacguccacuuccucgucggcaagggccucuccucccagcgcauccccgcccaccgcuucguccucgccgucggcuccgccgucuucgacgccauguucaacggcggcauggccaccaccuccaccgagaucgagcuccccgacgucgagcccgccgccuuccucgcccuccucaaguuccucuacuccgacgagguccagaucggccccgagaccgucaugaccacccucuacaccgccaagaaguacgccguccccgcccucgaggcccacugcgucgaguuccucaagaagaaccuccgcgccgacaacgccuucaugcuccucacccaggcccgccucuucgacgagccccagcucgccucccucugccucgagaacaucgacaagaacaccgccgacgccaucaccgccgagggcuucaccgacaucgaccucgacacccucgucgccguccucgagcgcgacacccucggcauccgcgagguccgccucuucaacgccgucguccgcugguccgaggccgagugccagcgccagcagcuccaggucacccccgagaaccgccgcaagguccucggcaaggcccucggccucauccgcuucccccucaugaccaucgaggaguucgccgccggccccgcccaguccggcauccucgucgaccgcgaggucgucucccucuuccuccacuucaccgucaaccccaagccccgcgucgaguucaucgaccgcccccgcugcugccuccgcggcaaggagugcuccaucaaccgcuuccagcaggucgagucccgcuggggcuacuccggcaccuccgaccgcauccgcuucuccgucaacaagcgcaucuucgucgucggcuucggccucuacggcuccauccacggccccaccgacuaccaggucaacauccagaucauccacaccgacuccaacaccguccucggccagaacgacaccggcuucuccugcgacggcuccgccuccaccuuccgcgucauguucaaggagcccgucgagguccuccccaacgucaacuacaccgccugcgccacccucaagggccccgacucccacuacggcaccaagggccuccgcaaggucacccacgagucccccaccaccggcgccaagaccugcuucaccuucugcuacgccgccggcaacaacaacggcaccuccgucgaggacggccagauccccgaggucaucuucuacaccuga

SEQ ID NO: 40437 - RNA, 1386 nt, Artificial Sequence
  derived and/or modified sequence opt2 from BTBD3__Homo_sapiens__NP_001269480
auggccgccgacaucuucccccgcaagaagcccgccaacuccuccuccaccuccguccagcaguaccaccagcagaaccucuccaacaacaaccucauccccgcccccaacuggcagggccucuaccccaccauccgcgagcgcaacgccaugauguucaacaacgaccucauggccgacguccacuucgucgucggcccccccggcggcacccagcgccuccccggccacaaguacguccucgccgucggcuccuccgucuuccacgccauguucuacggcgagcucgccgaggacaaggacgagauccgcauccccgacgucgagcccgccgccuuccucgccaugcucaaguacaucuacugcgacgagaucgaccucgccgccgacaccguccucgccacccucuacgccgccaagaaguacaucgucccccaccucgcccgcgccugcgucaacuuccucgagaccucccucuccgccaagaacgccugcguccuccucucccaguccugccucuucgaggagcccgaccucacccagcgcugcugggaggucaucgacgcccaggccgagcucgcccucaaguccgagggcuucugcgacaucgacuuccagacccucgaguccauccuccgccgcgagacccucaacgccaaggagaucgucgucuucgaggccgcccucaacugggccgaggucgagugccagcgccaggaccucgcccucuccaucgagaacaagcgcaagguccucggcaaggcccucuaccucauccgcauccccaccauggcccucgacgacuucgccaacggcgccgcccaguccggcguccucacccucaacgagaccaacgacaucuuccucugguacaccgccgccaagaagcccgagcuccaguucgucuccaaggcccgcaagggccucgucccccagcgcugccaccgcuuccaguccugcgccuaccgcuccaaccaguggcgcuaccgcggccgcugcgacuccauccaguucgccgucgacaagcgcgucuucaucgccggcuucggccucuacggcuccuccugcggcuccgccgaguacuccgccaagaucgagcucaagcgccagggcgucguccucggccagaaccucuccaaguacuucuccgacggcuccuccaacaccuuccccgucugguucgaguaccccguccagaucgagcccgacaccuucuacaccgccuccgucauccucgacggcaacgagcucuccuacuucggccaggagggcaugaccgagguccagugcggcaaggucaccguccaguuccagugcuccuccgacuccaccaacggcaccggcguccagggcggccagauccccgagcucaucuucuacgccuga

SEQ ID NO: 40438 - RNA, 1749 nt, Artificial Sequence
  derived and/or modified sequence opt2 from BTBD9__Homo_sapiens__NP_001165889
augugccgcgcccuccucuacggcggcaugcgcgagucccagcccgaggccgagaucccccuccaggacaccaccgccgaggccuucaccaugcuccucaaguacaucuacaccggccgcgccacccucaccgacgagaaggaggagguccuccucgacuuccucucccucgcccacaaguacggcuuccccgagcucgaggacuccaccuccgaguaccucugcaccauccucaacauccagaacgucugcaugaccuucgacgucgccucccucuacucccuccccaagcucaccugcaugugcugcauguucauggaccgcaacgcccaggagguccucuccuccgagggcuuccucucccucuccaagaccgcccuccucaacaucguccuccgcgacuccuucgccgcccccgagaaggacaucuuccucgcccuccucaacuggugcaagcacaacuccaaggagaaccacgccgagaucaugcaggccguccgccucccccucaugucccucaccgagcuccucaacgucguccgccccuccggccuccucucccccgacgccauccucgacgccaucaagguccgcuccgagucccgcgacauggaccucaacuaccgcggcaugcucauccccgaggagaacaucgccaccaugaaguacggcgcccaggucgucaagggcgagcucaaguccgcccuccucgacggcgacacccagaacuacgaccucgaccacggcuucucccgccaccccaucgacgacgacugccgcuccggcaucgagaucaagcucggccagcccuccaucaucaaccacauccgcauccuccucugggaccgcgacucccgcuccuacuccuacuucaucgaggucuccauggacgagcucgacuggguccgcgucaucgaccacucccaguaccucugccgcuccuggcagaagcucuacuuccccgcccgcgucugcuccggcgacggcgucucccucuggugcccccucuggucccgcacccccgagcucaagcaguccucccuccucggccuccccaagugccgcuacauccgcaucgucggcacccacaacaccgucaacaagaucuuccacaucgucgccuucgagugcauguucaccaacaagaccuucacccucgagaagggccucaucguccccauggagaacgucgccaccaucgccgacugcgccuccgucaucgagggcgucucccgcucccgcaacgcccuccucaacggcgacaccaagaacuacgacugggacuccggcuacaccugccaccagcucggcuccggcgccaucgucguccagcucgcccagcccuacaugaucggcuccauccgccuccuccucugggacugcgacgaccgcuccuacuccuacuacgucgaggucuccaccaaccagcagcaguggaccauggucgccgaccgcaccaaggucuccugcaaguccuggcaguccgucaccuucgagcgccagcccgccuccuucauccgcaucgucggcacccacaacaccgccaacgaggucuuccacugcguccacuucgagugccccgagcagcaguccucccagaaggaggagaacuccgaggaguccggcaccggcgacaccucccucgccggccagcagcucgacucccacgcccuccgcgcccccuccggcuccucccuccccuccucccccggcuccaacucccgcucccccaaccgccagcaccaguga

SEQ ID NO: 40439 - RNA, 537 nt, Artificial Sequence
  derived and/or modified sequence opt2 from BTC__Homo_sapiens__NP_001720
auggaccgcgccgcccgcugcuccggcgccuccucccucccccuccuccucgcccucgcccucggccucgucauccuccacugcgucgucgccgacggcaacuccacccgcucccccgagaccaacggccuccucugcggcgaccccgaggagaacugcgccgccaccaccacccaguccaagcgcaagggccacuucucccgcugccccaagcaguacaagcacuacugcaucaagggccgcugccgcuucgucgucgccgagcagacccccuccugcgucugcgacgagggcuacaucggcgcccgcugcgagcgcgucgaccucuucuaccuccgcggcgaccgcggccagauccucgucaucugccucaucgccgucauggucgucuucaucauccucgucaucggcgucugcaccugcugccacccccuccgcaagcgccgcaagcgcaagaagaaggaggaggagauggagacccucggcaaggacaucacccccaucaacgaggacaucgaggagaccaacaucgccuga

SEQ ID NO: 40440 - RNA, 1632 nt, Artificial Sequence
  derived and/or modified sequence opt2 from BTD__Homo_sapiens__NP_000051
auggcccacgcccacauccagggcggccgccgcgccaagucccgcuucgucgucugcaucauguccggcgcccgcuccaagcucgcccucuuccucugcggcugcuacgucgucgcccucggcgcccacaccggcgaggaguccgucgccgaccaccacgaggccgaguacuacgucgccgccgucuacgagcaccccuccauccucucccucaacccccucgcccucaucucccgccaggaggcccucgagcucaugaaccagaaccucgacaucuacgagcagcaggucaugaccgccgcccagaaggacguccagaucaucgucuuccccgaggacggcauccacggcuucaacuucacccgcaccuccaucuaccccuuccucgacuucaugcccuccccccaggucguccgcuggaaccccugccucgagccccaccgcuucaacgacaccgagguccuccagcgccucuccugcauggccauccgcggcgacauguuccucgucgccaaccucggcaccaaggagcccugccacuccuccgacccccgcugccccaaggacggccgcuaccaguucaacaccaacgucgucuucuccaacaacggcacccucgucgaccgcuaccgcaagcacaaccucuacuucgaggccgccuucgacgucccccucaaggucgaccucaucaccuucgacacccccuucgccggccgcuucggcaucuucaccugcuucgacauccucuucuucgaccccgccauccgcguccuccgcgacuacaaggucaagcacgucgucuaccccaccgccuggaugaaccagcucccccuccucgccgccaucgagauccagaaggccuucgccgucgccuucggcaucaacguccucgccgccaacguccaccaccccguccucggcaugaccggcuccggcauccacaccccccucgaguccuucugguaccacgacauggagaaccccaagucccaccucaucaucgcccaggucgccaagaaccccgucggccucaucggcgccgagaacgccaccggcgagaccgaccccucccacuccaaguuccucaagauccucuccggcgaccccuacugcgagaaggacgcccaggagguccacugcgacgaggccaccaaguggaacgucaacgccccccccaccuuccacuccgagaugauguacgacaacuucacccucguccccgucuggggcaaggagggcuaccuccacgucugcuccaacggccucugcugcuaccuccucuacgagcgccccacccucuccaaggagcucuacgcccucggcgucuucgacggccuccacaccguccacggcaccuacuacauccaggucugcgcccucguccgcugcggcggccucggcuucgacaccugcggccaggagaucaccgaggccaccggcaucuucgaguuccaccucuggggcaacuucuccaccuccuacaucuucccccucuuccucaccuccggcaugacccucgagguccccgaccagcucggcugggagaacgaccacuacuuccuccgcaagucccgccucuccuccggccucgucaccgccgcccucuacggccgccucuacgagcgcgacuga

SEQ ID NO: 40441 - RNA, 621 nt, Artificial Sequence
  derived and/or modified sequence opt2 from BTF3__Homo_sapiens__NP_001032726
augcgccgcaccggcgcccccgcccaggccgacucccgcggccgcggccgcgcccgcggcggcugccccggcggcgaggccacccucucccagccccccccccgcggcggcacccgcggccaggagccccagaugaaggagaccaucaugaaccaggagaagcucgccaagcuccaggcccagguccgcaucggcggcaagggcaccgcccgccgcaagaagaaggucguccaccgcaccgccaccgccgacgacaagaagcuccaguucucccucaagaagcucggcgucaacaacaucuccggcaucgaggaggucaacauguucaccaaccagggcaccgucauccacuucaacaaccccaagguccaggccucccucgccgccaacaccuucaccaucaccggccacgccgagaccaagcagcucaccgagaugcuccccuccauccucaaccagcucggcgccgacucccucaccucccuccgccgccucgccgaggcccuccccaagcaguccgucgacggcaaggccccccucgccaccggcgaggacgacgacgacgagguccccgaccucgucgagaacuucgacgaggccuccaagaacgaggccaacuga

SEQ ID NO: 40442 - RNA, 516 nt, Artificial Sequence
  derived and/or modified sequence opt2 from BTG1__Homo_sapiens__NP_001722
augcaccccuucuacacccgcgccgccaccaugaucggcgagaucgccgccgccgucuccuucaucuccaaguuccuccgcaccaagggccucaccuccgagcgccagcuccagaccuucucccagucccuccaggagcuccucgccgagcacuacaagcaccacugguuccccgagaagcccugcaagggcuccggcuaccgcugcauccgcaucaaccacaagauggacccccucaucggccaggccgcccagcgcaucggccucuccucccaggagcucuuccgccuccuccccuccgagcucacccucugggucgaccccuacgaggucuccuaccgcaucggcgaggacggcuccaucugcguccucuacgaggccucccccgccggcggcuccacccagaacuccaccaacguccagauggucgacucccgcaucuccugcaaggaggagcuccuccucggccgcaccucccccuccaagaacuacaacaugaugaccgucuccggcuga

SEQ ID NO: 40443 - RNA, 477 nt, Artificial Sequence
  derived and/or modified sequence opt2 from BTG2__Homo_sapiens__NP_006754
augucccacggcaagggcaccgacaugcuccccgagaucgccgccgccgucggcuuccucuccucccuccuccgcacccgcggcugcgucuccgagcagcgccucaaggucuucuccggcgcccuccaggaggcccucaccgagcacuacaagcaccacugguuccccgagaagcccuccaagggcuccggcuaccgcugcauccgcaucaaccacaagauggaccccaucaucucccgcgucgccucccagaucggccucucccagccccagcuccaccagcuccuccccuccgagcucacccucugggucgaccccuacgaggucuccuaccgcaucggcgaggacggcuccaucugcguccucuacgaggaggccccccucgccgccuccugcggccuccucaccugcaagaaccagguccuccucggccgcuccucccccuccaagaacuacgucauggccgucuccuccuga

SEQ ID NO: 40444 - RNA, 891 nt, Artificial Sequence
  derived and/or modified sequence opt2 from BTG3__Homo_sapiens__NP_001124386
augaagaacgagaucgccgccgucgucuucuucuucacccgccucguccgcaagcacgacaagcucaagaaggaggccgucgagcgcuucgccgagaagcucacccucauccuccaggagaaguacaagaaccacugguaccccgagaagcccuccaagggccaggccuaccgcugcauccgcgucaacaaguuccagcgcgucgaccccgacguccucaaggccugcgagaacuccugcauccucuacuccgaccucggccuccccaaggagcucacccucugggucgaccccugcgaggucugcugccgccgcgacggcgucucccccugcuggcccgacugcucccagacccccgaccucgucauccgcccccccuggccccccaaggcccucgacuaccgccgcgagccccuccgccccgccuccuccuuccucaucauguacggcgagaagaacaacgccuucaucgucgccuccuucgagaacaaggacgagaacaaggacgagaucucccgcaaggucacccgcgcccucgacaaggucaccuccgacuaccacuccggcuccuccuccuccgacgaggagaccuccaaggagauggaggucaagcccuccuccgucaccgccgccgccucccccgucuaccagaucuccgagcucaucuuccccccccuccccauguggcacccccucccccgcaagaagcccggcauguaccgcggcaacggccaccagaaccacuaccccccccccguccccuucggcuaccccaaccagggccgcaagaacaagcccuaccgccccauccccgucaccuggguccccccccccggcaugcacugcgaccgcaaccacuggaucaacccccacaugcucgccccccacuga

SEQ ID NO: 40445 - RNA, 672 nt, Artificial Sequence
  derived and/or modified sequence opt2 from BTG4__Homo_sapiens__NP_060059
augcgcgacgagaucgccaccaccgucuucuucgucacccgccucgucaagaagcacgacaagcucuccaagcagcagaucgaggacuucgccgagaagcucaugaccauccucuucgagaccuaccgcucccacuggcacuccgacugccccuccaagggccaggccuuccgcugcauccgcaucaacaacaaccagaacaaggaccccauccucgagcgcgccugcgucgaguccaacgucgacuucucccaccucggccuccccaaggagaugaccaucugggucgaccccuucgaggucugcugccgcuacggcgagaagaaccaccccuucaccgucgccuccuucaagggccgcugggaggagugggagcucuaccagcagaucuccuacgccgucucccgcgccuccuccgacgucuccuccggcaccuccugcgacgaggaguccugcuccaaggagccccgcgucauccccaaggucuccaaccccaaguccaucuaccaggucgagaaccucaagcagcccuuccaguccuggcuccagaucccccgcaagaagaacgucgucgacggccgcgucggccuccucggcaacaccuaccacggcucccagaagcaccccaagugcuaccgccccgccaugcaccgccucgaccgcauccucuga

SEQ ID NO: 40446 - RNA, 1980 nt, Artificial Sequence
  derived and/or modified sequence opt2 from BTK__Homo_sapiens__NP_000052
auggccgccgucauccucgaguccaucuuccucaagcgcucccagcagaagaagaagaccuccccccucaacuucaagaagcgccucuuccuccucaccguccacaagcucuccuacuacgaguacgacuucgagcgcggccgccgcggcuccaagaagggcuccaucgacgucgagaagaucaccugcgucgagaccgucguccccgagaagaaccccccccccgagcgccagaucccccgccgcggcgaggaguccuccgagauggagcagaucuccaucaucgagcgcuuccccuaccccuuccaggucgucuacgacgagggcccccucuacgucuucucccccaccgaggagcuccgcaagcgcuggauccaccagcucaagaacgucauccgcuacaacuccgaccucguccagaaguaccaccccugcuucuggaucgacggccaguaccucugcugcucccagaccgccaagaacgccaugggcugccagauccucgagaaccgcaacggcucccucaagcccggcuccucccaccgcaagaccaagaagccccucccccccacccccgaggaggaccagauccucaagaagccccucccccccgagcccgccgccgcccccgucuccaccuccgagcucaagaaggucgucgcccucuacgacuacaugcccaugaacgccaacgaccuccagcuccgcaagggcgacgaguacuucauccucgaggaguccaaccuccccugguggcgcgcccgcgacaagaacggccaggagggcuacauccccuccaacuacgucaccgaggccgaggacuccaucgagauguacgagugguacuccaagcacaugacccgcucccaggccgagcagcuccucaagcaggagggcaaggagggcggcuucaucguccgcgacuccuccaaggccggcaaguacaccgucuccgucuucgccaaguccaccggcgacccccagggcgucauccgccacuacgucgucugcuccaccccccagucccaguacuaccucgccgagaagcaccucuucuccaccauccccgagcucaucaacuaccaccagcacaacuccgccggccucaucucccgccucaaguaccccgucucccagcagaacaagaacgcccccuccaccgccggccucggcuacggcuccugggagaucgaccccaaggaccucaccuuccucaaggagcucggcaccggccaguucggcgucgucaaguacggcaaguggcgcggccaguacgacgucgccaucaagaugaucaaggagggcuccauguccgaggacgaguucaucgaggaggccaaggucaugaugaaccucucccacgagaagcucguccagcucuacggcgucugcaccaagcagcgccccaucuucaucaucaccgaguacauggccaacggcugccuccucaacuaccuccgcgagaugcgccaccgcuuccagacccagcagcuccucgagaugugcaaggacgucugcgaggccauggaguaccucgaguccaagcaguuccuccaccgcgaccucgccgcccgcaacugccucgucaacgaccagggcgucgucaaggucuccgacuucggccucucccgcuacguccucgacgacgaguacaccuccuccgucggcuccaaguuccccguccgcugguccccccccgagguccucauguacuccaaguucuccuccaaguccgacaucugggccuucggcguccucaugugggagaucuacucccucggcaagaugcccuacgagcgcuucaccaacuccgagaccgccgagcacaucgcccagggccuccgccucuaccgcccccaccucgccuccgagaaggucuacaccaucauguacuccugcuggcacgagaaggccgacgagcgccccaccuucaagauccuccucuccaacauccucgacgucauggacgaggaguccuga

SEQ ID NO: 40447 - RNA, 726 nt, Artificial Sequence
  derived and/or modified sequence opt2 from BTLA__Homo_sapiens__NP_001078826
augaagacccuccccgccaugcucggcaccggcaagcucuucugggucuucuuccucauccccuaccucgacaucuggaacauccacggcaaggaguccugcgacguccagcucuacaucaagcgccaguccgagcacuccauccucgccggcgaccccuucgagcucgagugccccgucaaguacugcgccaaccgcccccacgucaccuggugcaagcucaacggcaccaccugcgucaagcucgaggaccgccagaccuccuggaaggaggagaagaacaucuccuucuucauccuccacuucgagcccguccuccccaacgacaacggcuccuaccgcugcuccgccaacuuccaguccaaccucaucgagucccacuccaccacccucuacgucaccggcaagcagaacgagcucuccgacaccgccggccgcgagaucaaccucgucgacgcccaccucaaguccgagcagaccgaggccuccacccgccagaacucccagguccuccucuccgagaccggcaucuacgacaacgaccccgaccucugcuuccgcaugcaggagggcuccgaggucuacuccaaccccugccucgaggagaacaagcccggcaucgucuacgccucccucaaccacuccgucaucggccccaacucccgccucgcccgcaacgucaaggaggcccccaccgaguacgccuccaucugcguccgcuccuga

SEQ ID NO: 40448 - RNA, 1581 nt, Artificial Sequence
  derived and/or modified sequence opt2 from BTN1A1__Homo_sapiens__NP_001723
auggccgucuuccccuccuccggccucccccgcugccuccucacccucauccuccuccagcuccccaagcucgacuccgcccccuucgacgucaucggcccccccgagcccauccucgccgucgucggcgaggacgccgagcuccccugccgccucucccccaacgccuccgccgagcaccucgagcuccgcugguuccgcaagaaggucucccccgccguccucguccaccgcgacggccgcgagcaggaggccgagcagaugcccgaguaccgcggccgcgccacccucguccaggacggcaucgccaagggccgcgucgcccuccgcauccgcggcguccgcgucuccgacgacggcgaguacaccugcuucuuccgcgaggacggcuccuacgaggaggcccucguccaccucaaggucgccgcccucggcuccgacccccacaucuccaugcagguccaggagaacggcgagaucugccucgagugcaccuccgucggcugguaccccgagccccagguccaguggcgcaccuccaagggcgagaaguuccccuccaccuccgagucccgcaaccccgacgaggagggccucuucaccgucgccgccuccgucaucauccgcgacaccuccgccaagaacgucuccugcuacauccagaaccuccuccucggccaggagaagaaggucgagaucuccauccccgccuccucccucccccgccucacccccuggaucgucgccgucgccgucauccucaugguccucggccuccucaccaucggcuccaucuucuucaccuggcgccucuacaacgagcgcccccgcgagcgccgcaacgaguucuccuccaaggagcgccuccucgaggagcucaaguggaagaaggccacccuccacgccgucgacgucacccucgaccccgacaccgcccacccccaccucuuccucuacgaggacuccaaguccguccgccucgaggacucccgccagaagcuccccgagaagaccgagcgcuucgacuccuggcccugcguccucggccgcgagaccuucaccuccggccgccacuacugggaggucgaggucggcgaccgcaccgacugggccaucggcgucugccgcgagaacgucaugaagaagggcuucgaccccaugacccccgagaacggcuucugggccgucgagcucuacggcaacggcuacugggcccucaccccccuccgcaccccccucccccucgccggccccccccgccgcgucggcaucuuccucgacuacgaguccggcgacaucuccuucuacaacaugaacgacggcuccgacaucuacaccuucuccaacgucaccuucuccggcccccuccgccccuucuucugccucugguccuccggcaagaagccccucaccaucugccccaucgccgacggccccgagcgcgucaccgucaucgccaacgcccaggaccucuccaaggagaucccccucucccccaugggcgaggacuccgccccccgcgacgccgacacccuccacuccaagcucauccccacccagcccucccagggcgcccccuga

SEQ ID NO: 40449 - RNA, 1401 nt, Artificial Sequence
  derived and/or modified sequence opt2 from BTN2A1__Homo_sapiens__NP_001184162
auggagguccgcugguuccgcucccaguucucccccgccgucuucgucuacaagggcggccgcgagcgcaccgaggagcagauggaggaguaccgcggccgcaccaccuucgucuccaaggacaucucccgcggcuccgucgcccucgucauccacaacaucaccgcccaggagaacggcaccuaccgcugcuacuuccaggagggccgcuccuacgacgaggccauccuccaccucgucgucgccggccucggcuccaagccccucaucuccaugcgcggccacgaggacggcggcauccgccucgagugcaucucccgcggcugguaccccaagccccucaccgucuggcgcgaccccuacggcggcgucgcccccgcccucaaggaggucuccaugcccgacgccgacggccucuucauggucaccaccgccgucaucauccgcgacaaguccguccgcaacauguccugcuccaucaacaacacccuccucggccagaagaaggaguccgucaucuucauccccgaguccuucaugcccuccgucucccccugcgccgucgcccuccccaucaucgucgucauccucaugauccccaucgccgucugcaucuacuggaucaacaagcuccagaaggagaagaagauccucuccggcgagaaggaguucgagcgcgagacccgcgagaucgcccucaaggagcucgagaaggagcgcguccagaaggaggaggagcuccaggucaaggagaagcuccaggaggagcuccgcuggcgccgcaccuuccuccacgccgucgacgucguccucgaccccgacaccgcccaccccgaccucuuccucuccgaggaccgccgcuccguccgccgcugccccuuccgccaccucggcgaguccguccccgacaaccccgagcgcuucgacucccagcccugcguccucggccgcgaguccuucgccuccggcaagcacuacugggaggucgaggucgagaacgucaucgaguggaccgucggcgucugccgcgacuccgucgagcgcaagggcgagguccuccucaucccccagaacggcuucuggacccucgagaugcacaagggccaguaccgcgccgucuccucccccgaccgcauccucccccucaaggagucccucugccgcgucggcgucuuccucgacuacgaggccggcgacgucuccuucuacaacaugcgcgaccgcucccacaucuacaccugcccccgcuccgccuucuccguccccguccgccccuucuuccgccucggcugcgaggacucccccaucuucaucugccccgcccucaccggcgccaacggcgucaccguccccgaggagggccucacccuccaccgcgucggcacccaccagucccucuga

SEQ ID NO: 40450 - RNA, 1572 nt, Artificial Sequence
  derived and/or modified sequence opt2 from BTN2A2__Homo_sapiens__NP_001184166
auggagcccgccgccgcccuccacuucucccuccccgccucccuccuccuccuccuccuccuccuccuccucucccucugcgcccucgucuccgcccaguucaccgucgucggccccgccaaccccauccucgccauggucggcgagaacaccacccuccgcugccaccucucccccgagaagaacgccgaggacauggagguccgcugguuccgcucccaguucucccccgccgucuucgucuacaagggcggccgcgagcgcaccgaggagcagauggaggaguaccgcggccgcaucaccuucgucuccaaggacaucaaccgcggcuccgucgcccucgucauccacaacgucaccgcccaggagaacggcaucuaccgcugcuacuuccaggagggccgcuccuacgacgaggccauccuccgccucgucgucgccggccucggcuccaagccccucaucgagaucaaggcccaggaggacggcuccaucuggcucgagugcaucuccggcggcugguaccccgagccccucaccgucuggcgcgaccccuacggcgaggucguccccgcccucaaggaggucuccaucgccgacgccgacggccucuucauggucaccaccgccgucaucauccgcgacaaguacguccgcaacgucuccugcuccgucaacaacacccuccucggccaggagaaggagaccgucaucuucauccccgaguccuucaugcccuccgccucccccuggauggucgcccucgccgucauccucaccgccucccccuggauggucuccaugaccgucauccucgccgucuucaucaucuucauggccgucuccaucugcugcaucaagaagcuccagcgcgagaagaagauccucuccggcgagaagaaggucgagcaggaggagaaggagaucgcccagcagcuccaggaggagcuccgcuggcgccgcaccuuccuccacgccgccgacgucguccucgaccccgacaccgcccaccccgagcucuuccucuccgaggaccgccgcuccguccgccgcggccccuaccgccagcgcguccccgacaaccccgagcgcuucgacucccagcccugcguccucggcugggaguccuucgccuccggcaagcacuacugggaggucgaggucgagaacgucauggucuggaccgucggcgucugccgccacuccgucgagcgcaagggcgagguccuccucaucccccagaacggcuucuggacccucgagauguucggcaaccaguaccgcgcccucuccucccccgagcgcauccucccccucaaggagucccucugccgcgucggcgucuuccucgacuacgaggccggcgacgucuccuucuacaacaugcgcgaccgcucccacaucuacaccugcccccgcuccgccuucaccguccccguccgccccuucuuccgccucggcuccgacgacucccccaucuucaucugccccgcccucaccggcgccuccggcgucaugguccccgaggagggccucaagcuccaccgcgucggcacccaccagucccucuga

SEQ ID NO: 40451 - RNA, 1386 nt, Artificial Sequence
  derived and/or modified sequence opt2 from BTN3A1__Homo_sapiens__NP_001138480
augaagauggccuccuuccucgccuuccuccuccucaacuuccgcgucugccuccuccuccuccagcuccucaugccccacuccgcccaguucuccguccucggccccuccggccccauccucgccauggucggcgaggacgccgaccuccccugccaccucuuccccaccauguccgccgagaccauggagcucaagugggucuccuccucccuccgccaggucgucaacgucuacgccgacggcaaggaggucgaggaccgccaguccgcccccuaccgcggccgcaccuccauccuccgcgacggcaucaccgccggcaaggccgcccuccgcauccacaacgucaccgccuccgacuccggcaaguaccucugcuacuuccaggacggcgacuucuacgagaaggcccucgucgagcucaaggucgccgacggcgucggccucuacgccgucgccgccuccgucaucaugcgcggcuccuccggcgagggcgucuccugcaccauccgcuccucccuccucggccucgagaagaccgccuccaucuccaucgccgaccccuucuuccgcuccgcccagcgcuggaucgccgcccucgccggcacccuccccguccuccuccuccuccucggcggcgccggcuacuuccucuggcagcagcaggaggagaagaagacccaguuccgcaagaagaagcgcgagcaggagcuccgcgagauggccugguccaccaugaagcaggagcaguccacccgcgucaagcuccucgaggagcuccgcuggcgcuccauccaguacgccucccgcggcgagcgccacuccgccuacaacgaguggaagaaggcccucuucaagcccgccgacgucauccucgaccccaagaccgccaaccccauccuccucgucuccgaggaccagcgcuccguccagcgcgccaaggagccccaggaccuccccgacaaccccgagcgcuucaacuggcacuacugcguccucggcugcgaguccuucaucuccggccgccacuacugggaggucgaggucggcgaccgcaaggaguggcacaucggcgucugcuccaagaacguccagcgcaagggcugggucaagaugacccccgagaacggcuucuggaccaugggccucaccgacggcaacaaguaccgcacccucaccgagccccgcaccaaccucaagcuccccaagccccccaagaaggucggcgucuuccucgacuacgagaccggcgacaucuccuucuacaacgccgucgacggcucccacauccacaccuuccucgacgucuccuucuccgaggcccucuaccccgucuuccgcauccucacccucgagcccaccgcccucaccaucugccccgccuga

SEQ ID NO: 40452 - RNA, 1005 nt, Artificial Sequence
  derived and/or modified sequence opt2 from BTN3A2__Homo_sapiens__NP_001184175
augaagauggccuccucccucgccuuccuccuccucaacuuccacgucucccuccuccucguccagcuccucacccccugcuccgcccaguucuccguccucggccccuccggccccauccucgccauggucggcgaggacgccgaccuccccugccaccucuuccccaccauguccgccgagaccauggagcucaagugggucuccuccucccuccgccaggucgucaacgucuacgccgacggcaaggaggucgaggaccgccaguccgcccccuaccgcggccgcaccuccauccuccgcgacggcaucaccgccggcaaggccgcccuccgcauccacaacgucaccgccuccgacuccggcaaguaccucugcuacuuccaggacggcgacuucuacgagaaggcccucgucgagcucaaggucgccgcccucggcuccaaccuccacgucgaggucaagggcuacgaggacggcggcauccaccucgagugccgcuccaccggcugguacccccagccccagauccagugguccaacgccaagggcgagaacauccccgccgucgaggcccccgucgucgccgacggcgucggccucuacgaggucgccgccuccgucaucaugcgcggcggcuccggcgagggcgucuccugcaucauccgcaacucccuccucggccucgagaagaccgccuccaucuccaucgccgaccccuucuuccgcuccgcccagcccuggaucgccgcccucgccggcacccuccccauccuccuccuccuccucgccggcgccuccuacuuccucuggcgccagcagaaggagaucaccgcccucuccuccgagaucgaguccgagcaggagaugaaggagaugggcuacgccgccaccgagcgcgagaucucccuccgcgagucccuccaggaggagcucaagcgcaagaagauccaguaccucacccgcggcgaggaguccuccuccgacaccaacaaguccgccuga

SEQ ID NO: 40453 - RNA, 1755 nt, Artificial Sequence
  derived and/or modified sequence opt2 from BTN3A3__Homo_sapiens__NP_008925
augaagauggccuccucccucgccuuccuccuccucaacuuccacgucucccucuuccucguccagcuccucacccccugcuccgcccaguucuccguccucggccccuccggccccauccucgccauggucggcgaggacgccgaccuccccugccaccucuuccccaccauguccgccgagaccauggagcuccgcugggucuccuccucccuccgccaggucgucaacgucuacgccgacggcaaggaggucgaggaccgccaguccgcccccuaccgcggccgcaccuccauccuccgcgacggcaucaccgccggcaaggccgcccuccgcauccacaacgucaccgccuccgacuccggcaaguaccucugcuacuuccaggacggcgacuucuacgagaaggcccucgucgagcucaaggucgccgcccucggcuccgaccuccacaucgaggucaagggcuacgaggacggcggcauccaccucgagugccgcuccaccggcugguacccccagccccagaucaagugguccgacaccaagggcgagaacauccccgccgucgaggcccccgucgucgccgacggcgucggccucuacgccgucgccgccuccgucaucaugcgcggcuccuccggcggcggcgucuccugcaucauccgcaacucccuccucggccucgagaagaccgccuccaucuccaucgccgaccccuucuuccgcuccgcccagcccuggaucgccgcccucgccggcacccuccccaucucccuccuccuccucgccggcgccuccuacuuccucuggcgccagcagaaggagaagaucgcccucucccgcgagaccgagcgcgagcgcgagaugaaggagaugggcuacgccgccaccgagcaggagaucucccuccgcgagaagcuccaggaggagcucaaguggcgcaagauccaguacauggcccgcggcgagaagucccucgccuaccacgaguggaagauggcccucuucaagcccgccgacgucauccucgaccccgacaccgccaacgccauccuccucgucuccgaggaccagcgcuccguccagcgcgccgaggagccccgcgaccuccccgacaaccccgagcgcuucgaguggcgcuacugcguccucggcugcgagaacuucaccuccggccgccacuacugggaggucgaggucggcgaccgcaaggaguggcacaucggcgucugcuccaagaacgucgagcgcaagaagggcugggucaagaugacccccgagaacggcuacuggaccaugggccucaccgacggcaacaaguaccgcgcccucaccgagccccgcaccaaccucaagcuccccgagcccccccgcaaggucggcaucuuccucgacuacgagaccggcgagaucuccuucuacaacgccaccgacggcucccacaucuacaccuucccccacgccuccuucuccgagccccucuaccccgucuuccgcauccucacccucgagcccaccgcccucaccaucugccccauccccaaggaggucgaguccucccccgaccccgaccucguccccgaccacucccucgagaccccccucacccccggccucgccaacgaguccggcgagccccaggccgaggucaccucccuccuccuccccgcccaccccggcgccgaggucucccccuccgccaccaccaaccagaaccacaagcuccaggcccgcaccgaggcccucuacuga

SEQ ID NO: 40454 - RNA, 1449 nt, Artificial Sequence
  derived and/or modified sequence opt2 from BTNL2__Homo_sapiens__NP_001291490
auggucgacuuccccggcuacaaccucuccggcgccgucgccuccuuccucuucauccuccucaccaugaagcaguccgaggacuuccgcgucaucggccccgcccaccccauccucgccggcgucggcgaggacgcccuccucaccugccagcuccuccccaagcgcaccaccaugcacgucgagguccgcugguaccgcuccgagcccuccacccccgucuucguccaccgcgacggcgucgaggucaccgagaugcagauggaggaguaccgcggcugggucgaguggaucgagaacggcaucgccaagggcaacgucgcccucaagauccacaacauccagcccuccgacaacggccaguacuggugccacuuccaggacggcaacuacugcggcgagaccucccuccuccucaaggucgccggccucggcuccgcccccuccauccacauggagggccccggcgaguccggcguccagcucgucugcaccgcccgcggcugguuccccgagccccaggucuacugggaggacauccgcggcgagaagcuccucgccgucuccgagcaccgcauccaggacaaggacggccucuucuacgccgaggccacccucgucguccgcaacgccuccgccgaguccgucuccugccucguccacaaccccguccucaccgaggagaagggcuccgucaucucccuccccgagaagcuccagaccgagcucgccucccucaaggucaacggccccucccagcccauccucguccgcgucggcgaggacauccagcucaccugcuaccucucccccaaggccaacgcccaguccauggagguccgcugggaccgcucccaccgcuaccccgccguccacgucuacauggacggcgaccacgucgccggcgagcagauggccgaguaccgcggccgcaccguccucgucuccgacgccaucgacgagggccgccucacccuccagauccucuccgcccgccccuccgacgacggccaguaccgcugccucuucgagaaggacgacgucuaccaggaggccucccucgaccucaaggucgucucccucggcuccuccccccucaucaccgucgagggccaggaggacggcgagaugcagcccaugugcuccuccgacggcugguucccccagccccacguccccuggcgcgacauggagggcaagaccauccccuccuccucccaggcccucacccagggcucccacggccucuuccacguccagacccuccuccgcgucaccaacaucuccgccgucgacgucaccugcuccaucuccauccccuuccucggcgaggagaagaucgccaccuucucccucuccgagucccgcaugaccuuccucuggaagacccuccucgucuggggccuccuccucgccgucgccgucggccucccccgcaagcgcuccuga

SEQ ID NO: 40455 - RNA, 1740 nt, Artificial Sequence
  derived and/or modified sequence opt2 from BTRC__Homo_sapiens__NP_001243785
auggaccccgccgaggccguccuccaggagaaggcccucaaguucaugugcuccaugccccgcucccucuggcucggcugcuccucccucgccgacuccaugcccucccuccgcugccucuacaaccccggcaccggcgcccucaccgccuuccagaccuacaacuccugcgcccgccucugccucaaccaggagaccgucugccucgccuccaccgccaugaagaccgagaacugcgucgccaagaccaagcucgccaacggcaccuccuccaugaucguccccaagcagcgcaagcucuccgccuccuacgagaaggagaaggagcucugcgucaaguacuucgagcagugguccgaguccgaccaggucgaguucgucgagcaccucaucucccagaugugccacuaccagcacggccacaucaacuccuaccucaagcccaugcuccagcgcgacuucaucaccgcccuccccgcccgcggccucgaccacaucgccgagaacauccucuccuaccucgacgccaagucccucugcgccgccgagcucgucugcaaggagugguaccgcgucaccuccgacggcaugcucuggaagaagcucaucgagcgcaugguccgcaccgacucccucuggcgcggccucgccgagcgccgcggcuggggccaguaccucuucaagaacaagccccccgacggcaacgccccccccaacuccuucuaccgcgcccucuaccccaagaucauccaggacaucgagaccaucgaguccaacuggcgcugcggccgccacucccuccagcgcauccacugccgcuccgagaccuccaagggcgucuacugccuccaguacgacgaccagaagaucgucuccggccuccgcgacaacaccaucaagaucugggacaagaacacccucgagugcaagcgcauccucaccggccacaccggcuccguccucugccuccaguacgacgagcgcgucaucaucaccggcuccuccgacuccaccguccgcgucugggacgucaacaccggcgagaugcucaacacccucauccaccacugcgaggccguccuccaccuccgcuucaacaacggcaugauggucaccugcuccaaggaccgcuccaucgccgucugggacauggccucccccaccgacaucacccuccgccgcguccucgucggccaccgcgccgccgucaacgucgucgacuucgacgacaaguacaucgucuccgccuccggcgaccgcaccaucaaggucuggaacaccuccaccugcgaguucguccgcacccucaacggccacaagcgcggcaucgccugccuccaguaccgcgaccgccucgucgucuccggcuccuccgacaacaccauccgccucugggacaucgagugcggcgccugccuccgcguccucgagggccacgaggagcucguccgcugcauccgcuucgacaacaagcgcaucgucuccggcgccuacgacggcaagaucaaggucugggaccucgucgccgcccucgacccccgcgcccccgccggcacccucugccuccgcacccucgucgagcacuccggccgcgucuuccgccuccaguucgacgaguuccagaucgucuccuccucccacgacgacaccauccucaucugggacuuccucaacgaccccgccgcccaggccgagcccccccgcucccccucccgcaccuacaccuacaucucccgcuga

SEQ ID NO: 40456 - RNA, 3153 nt, Artificial Sequence
  derived and/or modified sequence opt2 from BUB1B__Homo_sapiens__NP_001202
auggccgccgucaagaaggagggcggcgcccucuccgaggccaugucccucgagggcgacgagugggagcucuccaaggagaacguccagccccuccgccagggccgcaucauguccacccuccagggcgcccucgcccaggaguccgccugcaacaacacccuccagcagcagaagcgcgccuucgaguacgagauccgcuucuacaccggcaacgacccccucgacgucugggaccgcuacaucuccuggaccgagcagaacuacccccagggcggcaaggaguccaacauguccacccuccucgagcgcgccgucgaggcccuccagggcgagaagcgcuacuacuccgacccccgcuuccucaaccucuggcucaagcucggccgccucugcaacgagccccucgacauguacuccuaccuccacaaccagggcaucggcgucucccucgcccaguucuacaucuccugggccgaggaguacgaggcccgcgagaacuuccgcaaggccgacgccaucuuccaggagggcauccagcagaaggccgagccccucgagcgccuccagucccagcaccgccaguuccaggcccgcgucucccgccagacccuccucgcccucgagaaggaggaggaggaggaggucuucgaguccuccgucccccagcgcuccacccucgccgagcucaaguccaagggcaagaagaccgcccgcgcccccaucauccgcgucggcggcgcccucaaggcccccucccagaaccgcggccuccagaaccccuucccccagcagaugcagaacaacucccgcaucaccgucuucgacgagaacgccgacgaggccuccaccgccgagcucuccaagcccaccguccagcccuggaucgccccccccaugccccgcgccaaggagaacgagcuccaggccggccccuggaacaccggccgcucccucgagcaccgcccccgcggcaacaccgccucccucaucgccguccccgccguccuccccuccuucacccccuacgucgaggagaccgcccagcagcccgucaugacccccugcaagaucgagcccuccaucaaccacauccucuccacccgcaagcccggcaaggaggagggcgacccccuccagcgcguccagucccaccagcaggccuccgaggagaagaaggagaagaugauguacugcaaggagaagaucuacgccggcgucggcgaguucuccuucgaggagauccgcgccgaggucuuccgcaagaagcucaaggagcagcgcgaggccgagcuccucaccuccgccgagaagcgcgccgagaugcagaagcagaucgaggagauggagaagaagcucaaggagauccagaccacccagcaggagcgcaccggcgaccagcaggaggagaccaugcccaccaaggagaccaccaagcuccagaucgccuccgagucccagaagauccccggcaugacccucuccuccuccgucugccaggucaacugcugcgcccgcgagaccucccucgccgagaacaucuggcaggagcagccccacuccaagggccccuccguccccuucuccaucuucgacgaguuccuccucuccgagaagaagaacaaguccccccccgccgaccccccccgcguccucgcccagcgccgcccccucgccguccucaagaccuccgaguccaucaccuccaacgaggacgucucccccgacgucugcgacgaguucaccggcaucgagccccucuccgaggacgccaucaucaccggcuuccgcaacgucaccaucugccccaaccccgaggacaccugcgacuucgcccgcgccgcccgcuucgucuccacccccuuccacgagaucaugucccucaaggaccuccccuccgaccccgagcgccuccuccccgaggaggaccucgacgucaagaccuccgaggaccagcagaccgccugcggcaccaucuacucccagacccucuccaucaagaagcucucccccaucaucgaggacucccgcgaggccacccacuccuccggcuucuccggcuccuccgccuccgucgccuccaccuccuccaucaagugccuccagauccccgagaagcucgagcucaccaacgagaccuccgagaaccccacccagucccccuggugcucccaguaccgccgccagcuccucaagucccuccccgagcucuccgccuccgccgagcucugcaucgaggaccgccccaugcccaagcucgagaucgagaaggagaucgagcucggcaacgaggacuacugcaucaagcgcgaguaccucaucugcgaggacuacaagcucuucugggucgccccccgcaacuccgccgagcucaccgucaucaaggucuccucccagcccguccccugggacuucuacaucaaccucaagcucaaggagcgccucaacgaggacuucgaccacuucugcuccugcuaccaguaccaggacggcugcaucgucuggcaccaguacaucaacugcuucacccuccaggaccuccuccagcacuccgaguacaucacccacgagaucaccguccucaucaucuacaaccuccucaccaucgucgagaugcuccacaaggccgagaucguccacggcgaccucuccccccgcugccucauccuccgcaaccgcauccacgaccccuacgacugcaacaagaacaaccaggcccucaagaucgucgacuucuccuacuccgucgaccuccgcguccagcucgacgucuucacccucuccggcuuccgcaccguccagauccucgagggccagaagauccucgccaacugcuccucccccuaccaggucgaccucuucggcaucgccgaccucgcccaccuccuccucuucaaggagcaccuccaggucuucugggacggcuccuucuggaagcucucccagaacaucuccgagcucaaggacggcgagcucuggaacaaguucuucguccgcauccucaacgccaacgacgaggccaccgucuccguccucggcgagcucgccgccgagaugaacggcgucuucgacaccaccuuccagucccaccucaacaaggcccucuggaaggucggcaagcucaccucccccggcgcccuccucuuccaguga

SEQ ID NO: 40457 - RNA, 3198 nt, Artificial Sequence
  derived and/or modified sequence opt2 from BUB1__Homo_sapiens__NP_001265545
auggacacccccgagaacguccuccaguacauccagugggucgaggagaacuuccccgagaacaaggaguaccucaucacccuccucgagcaccucaugaaggaguuccucgacaagaagaaguaccacaacgacccccgcuucaucuccuacugccucaaguucgccgaguacaacuccgaccuccaccaguucuucgaguuccucuacaaccacggcaucggcacccucuccuccccccucuacaucgccugggccggccaccucgaggcccagggcgagcuccagcacgccuccgccguccuccagcgcggcauccagaaccaggccgagccccgcgaguuccuccagcagcaguaccgccucuuccagacccgccucaccgagacccaccuccccgcccaggcccgcaccuccgagccccuccacaacguccagguccucaaccagaugaucaccuccaaguccaaccccggcaacaacauggccugcaucuccaagaaccagggcuccgagcucuccggcgucaucuccuccgccugcgacaaggaguccaacauggagcgccgcgucaucaccaucuccaaguccgaguacuccguccacuccucccucgccuccaaggucgacgucgagcaggucgucauguacugcaaggagaagcucauccgcggcgaguccgaguucuccuucgaggagcuccgcgcccagaaguacaaccagcgccgcaagcacgagcagugggucaacgaggaccgccacuacaugaagcgcaaggaggccaacgccuucgaggagcagcuccucaagcagaagauggacgagcuccacaagaagcuccaccaggucgucgagaccucccacgaggaccuccccgccucccaggagcgcuccgaggucaaccccgcccgcaugggccccuccgucggcucccagcaggagcuccgcgcccccugccuccccgucaccuaccagcagacccccgucaacauggagaagaacccccgcgaggccccccccgucguccccccccucgccaacgccaucuccgccgcccucgucucccccgccaccucccaguccaucgccccccccgucccccucaaggcccagaccgucaccgacuccauguucgccgucgccuccaaggacgccggcugcgucaacaaguccacccacgaguucaagccccaguccggcgccgagaucaaggagggcugcgagacccacaaggucgccaacaccuccuccuuccacaccacccccaacaccucccucggcaugguccaggccacccccuccaagguccagcccucccccaccguccacaccaaggaggcccucggcuucaucaugaacauguuccaggcccccacccuccccgacaucuccgacgacaaggacgaguggcagucccucgaccagaacgaggacgccuucgaggcccaguuccagaagaacguccgcuccuccggcgccuggggcgucaacaagaucaucuccucccucuccuccgccuuccacgucuucgaggacggcaacaaggagaacuacggccucccccagcccaagaacaagcccaccggcgcccgcaccuucggcgagcgcuccgucucccgccuccccuccaagcccaaggaggaggucccccacgccgaggaguuccucgacgacuccaccgucuggggcauccgcugcaacaagacccucgcccccucccccaagucccccggcgacuucaccuccgccgcccagcucgccuccacccccuuccacaagcuccccgucgaguccguccacauccucgaggacaaggagaacgucgucgccaagcagugcacccaggccacccucgacuccugcgaggagaacauggucguccccucccgcgacggcaaguucucccccauccaggagaagucccccaagcaggcccucuccucccacauguacuccgccucccuccuccgccucucccagcccgccgccggcggcguccucaccugcgaggccgagcucggcgucgaggccugccgccucaccgacaccgacgccgccaucgccgaggacccccccgacgccaucgccggccuccaggccgaguggaugcagauguccucccucggcaccgucgacgcccccaacuucaucgucggcaaccccugggacgacaagcucaucuucaagcuccucuccggccucuccaagcccgucuccuccuaccccaacaccuucgaguggcagugcaagcuccccgccaucaagcccaagaccgaguuccagcucggcuccaagcucgucuacguccaccaccuccucggcgagggcgccuucgcccaggucuacgaggccacccagggcgaccucaacgacgccaagaacaagcagaaguucguccucaagguccagaagcccgccaaccccugggaguucuacaucggcacccagcucauggagcgccucaagcccuccaugcagcacauguucaugaaguucuacuccgcccaccucuuccagaacggcuccguccucgucggcgagcucuacuccuacggcacccuccucaacgccaucaaccucuacaagaacacccccgagaaggucaugccccagggccucgucaucuccuucgccaugcgcaugcucuacaugaucgagcagguccacgacugcgagaucauccacggcgacaucaagcccgacaacuucauccucggcaacggcuuccucgagcaggacgacgaggacgaccucuccgccggccucgcccucaucgaccucggccaguccaucgacaugaagcucuuccccaagggcaccaucuucaccgccaagugcgagaccuccggcuuccagugcgucgagaugcucuccaacaagcccuggaacuaccagaucgacuacuucggcgucgccgccaccgucuacugcaugcucuucggcaccuacaugaaggucaagaacgagggcggcgagugcaagcccgagggccucuuccgccgccucccccaccucgacauguggaacgaguucuuccacgucaugcucaacauccccgacugccaccaccuccccucccucgaccuccuccgccagaagcucaagaaggucuuccagcagcacuacaccaacaagauccgcgcccuccgcaaccgccucaucguccuccuccucgagugcaagcgcucccgcaaguga

SEQ ID NO: 40458 - RNA, 981 nt, Artificial Sequence
  derived and/or modified sequence opt2 from BUB3__Homo_sapiens__NP_001007794
augaccggcuccaacgaguucaagcucaaccagccccccgaggacggcaucuccuccgucaaguucucccccaacaccucccaguuccuccucgucuccuccugggacaccuccguccgccucuacgacguccccgccaacuccaugcgccucaaguaccagcacaccggcgccguccucgacugcgccuucuacgaccccacccacgccugguccggcggccucgaccaccagcucaagaugcacgaccucaacaccgaccaggagaaccucgucggcacccacgacgcccccauccgcugcgucgaguacugccccgaggucaacgucauggucaccggcuccugggaccagaccgucaagcucugggacccccgcacccccugcaacgccggcaccuucucccagcccgagaaggucuacacccucuccgucuccggcgaccgccucaucgucggcaccgccggccgccgcguccucgucugggaccuccgcaacaugggcuacguccagcagcgccgcgaguccucccucaaguaccagacccgcugcauccgcgccuuccccaacaagcagggcuacguccucuccuccaucgagggccgcgucgccgucgaguaccucgaccccucccccgagguccagaagaagaaguacgccuucaagugccaccgccucaaggagaacaacaucgagcagaucuaccccgucaacgccaucuccuuccacaacauccacaacaccuucgccaccggcggcuccgacggcuucgucaacaucugggaccccuucaacaagaagcgccucugccaguuccaccgcuaccccaccuccaucgccucccucgccuucuccaacgacggcaccacccucgccaucgccuccuccuacauguacgagauggacgacaccgagcaccccgaggacggcaucuucauccgccaggucaccgacgccgagaccaagcccaaguccaccuga

SEQ ID NO: 40459 - RNA, 1458 nt, Artificial Sequence
  derived and/or modified sequence opt2 from BUD13__Homo_sapiens__NP_001153208
auggccgccgcccccccccucuccaaggccgaguaccucaagcgcuaccucuccggcgccgacgccggcgucgaccgcggcuccgaguccggccgcaagcgccgcaagaagcgccccaagcccggcggcgccggcggcaagggcaugcgcaucgucgacgacgacgucuccuggaccgccaucuccaccaccaagcucgagaaggaggaggaggaggacgacggcgaccuccccgucgucgccgaguucgucgacgagcgccccgaggaggucaagcagauggaggccuuccgcuccuccgccaaguggaagcuccucggcggccacaacgaggaccuccccuccaaccgccacuuccgccacgacacccccgacuccuccccccgccgcguccgccacggcacccccgaccccuccccccgcaaggaccgccacgacacccccgaccccuccccccgccgcgcccgccacgacacccccgaccccuccccccuccgcggcgcccgccacgacuccgacaccucccccccccgccgcauccgccacgacuccuccgacaccucccccccccgccgcgcccgccacgacucccccgaccccucccccccccgccgcccccagcacaacuccuccggcgacugccagaaggccaccgacuccgaccucuccuccccccgccacaagcagucccccggccaccaggacuccgacuccgaccucucccccccccgcaaccgcccccgccaccgcuccuccgacuccgaccucucccccccccgccgccgccagcgcaccaaguccuccgacuccgaccucucccccccccgccgcucccagccccccggcaagaaggccgcccacauguacuccggcgccaagaccggccucguccucaccgacauccagcgcgagcagcaggagcucaaggagcaggaccaggagaccauggccuucgaggccgaguuccaguacgccgagaccgucuuccgcgacaaguccggccgcaagcgcaaccucaagcucgagcgccucgagcagcgccgcaaggccgagaaggacuccgagcgcgacgagcucuacgcccaguggggcaagggccucgcccagucccgccagcagcagcagaacgucgaggacgccaugaaggagaugcagaagccccucgcccgcuacaucgacgacgaggaccucgaccgcaugcuccgcgagcaggagcgcgagggcgaccccauggccaacuucaucaagaagaacaaggccaaggagaacaagaacaagaagguccgcccccgcuacuccggccccgcccccccccccaaccgcuucaacaucuggcccggcuaccgcugggacggcgucgaccgcuccaacggcuucgagcagaagcgcuucgcccgccucgccuccaagaaggccgucgaggagcucgccuacaagugguccgucgaggacauguga

SEQ ID NO: 40460 - RNA, 435 nt, Artificial Sequence
  derived and/or modified sequence opt2 from BUD31__Homo_sapiens__NP_003901
augcccaaggucaagcgcucccgcaaggccccccccgacggcugggagcucaucgagcccacccucgacgagcucgaccagaagaugcgcgaggccgagaccgagccccacgagggcaagcgcaaggucgagucccucuggcccaucuuccgcauccaccaccagaagacccgcuacaucuucgaccucuucuacaagcgcaaggccaucucccgcgagcucuacgaguacugcaucaaggagggcuacgccgacaagaaccucaucgccaaguggaagaagcagggcuacgagaaccucugcugccuccgcugcauccagacccgcgacaccaacuucggcaccaacugcaucugccgcguccccaaguccaagcucgaggucggccgcaucaucgagugcacccacugcggcugccgcggcugcuccggcuga

SEQ ID NO: 40461 - RNA, 1083 nt, Artificial Sequence
  derived and/or modified sequence opt2 from BVES__Homo_sapiens__XP_011533700
augaacuacaccgaguccuccccccuccgcgaguccaccgccaucggcuucacccccgagcucgaguccaucauccccguccccuccaacaagaccaccugcgagaacuggcgcgagauccaccaccucgucuuccacgucgccaacaucugcuucgccgucggccucgucauccccaccacccuccaccuccacaugaucuuccuccgcggcaugcucacccucggcugcacccucuacaucgucugggccacccucuaccgcugcgcccucgacaucaugaucuggaacuccgucuuccucggcgucaacauccuccaccucuccuaccuccucuacaagaagcgccccgucaagaucgagaaggagcucuccggcauguaccgccgccucuucgagccccuccgcgucccccccgaccucuuccgccgccucaccggccaguucugcaugauccagacccucaagaagggccagaccuacgccgccgaggacaagaccuccgucgacgaccgccucuccauccuccucaagggcaagaugaaggucuccuaccgcggccacuuccuccacaacaucuaccccugcgccuucaucgacucccccgaguuccgcuccacccagaugcacaagggcgagaaguuccaggucaccaucaucgccgacgacaacugccgcuuccucugcuggucccgcgagcgccucaccuacuuccucgaguccgagcccuuccucuacgagaucuuccgcuaccucaucggcaaggacaucaccaacaagcucuacucccucaacgaccccacccucaacgacaagaaggccaagaagcucgagcaccagcucucccucugcacccagaucuccaugcucgagaugcgcaacuccaucgccuccuccuccgacuccgacgacggccuccaccaguuccuccgcggcaccuccuccauguccucccuccacgucuccuccccccaccagcgcgccuccgccaagaugaagcccaucgaggagggcgccgaggacgacgacgacgucuucgagcccgccucccccaacacccucaagguccaccagcuccccuga

SEQ ID NO: 40462 - RNA, 1314 nt, Artificial Sequence
  derived and/or modified sequence opt2 from BYSL__Homo_sapiens__NP_004044
augcccaaguucaaggccgcccgcggcgucggcggccaggagaagcacgccccccucgccgaccagauccucgccggcaacgccguccgcgccggcguccgcgagaagcgccgcggccgcggcaccggcgaggccgaggaggaguacgucggcccccgccucucccgccgcauccuccagcaggcccgccagcagcaggaggagcucgaggccgagcacggcaccggcgacaagcccgccgccccccgcgagcgcaccacccgccucggcccccgcaugccccaggacggcuccgacgacgaggacgaggaguggcccacccucgagaaggccgccaccaugaccgccgccggccaccacgccgaggucgucgucgaccccgaggacgagcgcgccaucgagauguucaugaacaagaacccccccgcccgccgcacccucgccgacaucaucauggagaagcucaccgagaagcagaccgaggucgagaccgucauguccgaggucuccggcuuccccaugccccagcucgacccccgcguccucgaggucuaccgcggcguccgcgagguccucuccaaguaccgcuccggcaagcuccccaaggccuucaagaucauccccgcccucuccaacugggagcagauccucuacgucaccgagcccgaggccuggaccgccgccgccauguaccaggccacccgcaucuucgccuccaaccucaaggagcgcauggcccagcgcuucuacaaccucguccuccucccccgcguccgcgacgacgucgccgaguacaagcgccucaacuuccaccucuacauggcccucaagaaggcccucuucaagcccggcgccugguucaagggcauccucaucccccucugcgaguccggcaccugcacccuccgcgaggccaucaucgucggcuccaucaucaccaagugcuccauccccguccuccacuccuccgccgccaugcucaagaucgccgagauggaguacuccggcgccaacuccaucuuccuccgccuccuccucgacaagaaguacgcccuccccuaccgcguccucgacgcccucgucuuccacuuccucggcuuccgcaccgagaagcgcgagcuccccguccucuggcaccagugccuccucacccucguccagcgcuacaaggccgaccucgccaccgaccagaaggaggcccuccucgagcuccuccgccuccagccccacccccagcucucccccgagauccgccgcgagcuccaguccgccgucccccgcgacgucgaggacguccccaucaccgucgaguga

SEQ ID NO: 40463 - RNA, 5547 nt, Artificial Sequence
  derived and/or modified sequence opt2 from BZRAP1__Homo_sapiens__NP_001248764
auggagcagcucaccacccucccccgccccggcgaccccggcgccauggagcccugggcccuccccaccuggcacuccuggacccccggccgcggcggcgagcccuccuccgccgcccccuccaucgccgacaccccccccgccgcccuccagcuccaggagcuccgcuccgaggaguccuccaagcccaagggcgacggcuccucccgccccgucggcggcaccgaccccgagggcgccgaggccugccuccccucccucggccagcaggccuccuccuccggccccgccugccagcgccccgaggacgaggaggucgaggccuuccucaaggccaagcucaacauguccuucggcgaccgccccaaccucgagcuccuccgcgcccucggcgagcuccgccagcgcugcgccauccucaaggaggagaaccagaugcuccgcaaguccuccuuccccgagaccgaggagaagguccgccgccucaagcgcaagaacgccgagcucgccgucaucgccaagcgccucgaggagcgcgcccgcaagcuccaggagaccaaccuccgcgucgucuccgccccccucccccgccccggcaccucccucgagcucugccgcaaggcccucgcccgccagcgcgcccgcgaccucuccgagaccgccuccgcccuccucgccaaggacaagcagaucgccgcccuccagcgcgagugccgcgagcuccaggcccgccucacccucgucggcaaggagggcccccaguggcuccacguccgcgacuucgaccgccuccuccgcgagucccagcgcgagguccuccgccuccagcgccagaucgcccuccgcaaccagcgcgagacccucccccucccccccuccuggccccccggccccgcccuccaggcccgcgccggcgcccccgcccccggcgcccccggcgaggccaccccccaggaggacgccgacaaccuccccgucauccucggcgagcccgagaaggagcagcgcguccagcagcucgaguccgagcucuccaagaagcgcaagaagugcgagucccucgagcaggaggcccgcaagaagcagcgccgcugcgaggagcucgagcuccagcuccgccaggcccagaacgagaacgcccgccucgucgaggagaacucccgccucuccggccgcgccaccgagaaggagcaggucgagugggagaacgccgagcuccgcggccagcuccucggcgucacccaggagcgcgacuccgcccuccgcaagucccagggccuccaguccaagcucgagucccucgagcagguccucaagcacaugcgcgaggucgcccagcgccgccagcagcucgaggucgagcacgagcaggcccgccucucccuccgcgagaagcaggaggagguccgccgccuccagcaggcccaggccgaggcccagcgcgagcacgagggcgccguccagcuccucgaguccacccucgacuccaugcaggcccgcguccgcgagcucgaggagcagugccgcucccagaccgagcaguucucccuccucgcccaggagcuccaggccuuccgccuccaccccggcccccucgaccuccucaccuccgcccucgacugcggcucccucggcgacugcccccccccccccugcugcugcuccaucccccagcccugccgcggcuccggccccaaggaccucgaccucccccccggcucccccggccgcugcacccccaaguccuccgagcccgcccccgccacccucaccggcgucccccgccgcaccgccaagaaggccgagucccucuccaacuccucccacuccgaguccauccacaacucccccaaguccugccccacccccgaggucgacaccgccuccgaggucgaggagcucgaggccgacuccgucucccuccuccccgccgcccccgagggcucccgcggcggcgcccgcauccaggucuuccucgcccgcuacuccuacaaccccuucgagggccccaacgagaaccccgaggccgagcucccccucaccgccggcgaguacaucuacaucuacggcaacauggacgaggacggcuucuucgagggcgagcucauggacggccgccgcggccucguccccuccaacuucgucgagcgcgucuccgacgacgaccuccucaccucccucccccccgagcucgccgaccucucccacuccuccggccccgagcucuccuuccucuccgucggcggcggcggcuccuccuccggcggccaguccuccgucggccgcucccagccccgccccgaggaggaggacgccggcgacgagcucucccucucccccucccccgagggccucggcgagccccccgccguccccuacccccgccgccucgucguccucaagcagcucgcccacuccgucguccucgccugggagcccccccccgagcaggucgagcuccacggcuuccacaucugcgucaacggcgagcuccgccaggcccucggccccggcgccccccccaaggccguccucgagaaccucgaccucugggccggcccccuccacaucuccguccaggcccucaccucccgcggcuccuccgacccccuccgcugcugccucgccgucggcgcccgcgccggcgucguccccucccagcuccgcguccaccgccucaccgccaccuccgccgagaucaccuggguccccggcaacuccaaccucgcccacgccaucuaccucaacggcgaggagugcccccccgccucccccuccaccuacugggccaccuucugccaccuccgccccggcacccccuaccaggcccaggucgaggcccagcuccccccccagggccccugggagcccggcugggagcgccucgagcagcgcgccgccacccuccaguucaccacccuccccgccggcccccccgacgccccccucgacguccagaucgagcccggccccucccccggcauccucaucaucuccuggcuccccgucaccaucgacgccgccggcaccuccaacggcguccgcgucaccggcuacgccaucuacgccgacggccagaagaucauggaggucgccucccccaccgccggcuccguccucgucgagcucucccagcuccagcuccuccaggucugccgcgaggucgucguccgcaccauguccccccacggcgaguccgccgacuccauccccgcccccaucacccccgcccucgcccccgccucccuccccgcccgcgucuccugccccuccccccaccccucccccgaggcccgcgccccccucgccuccgccucccccggccccggcgaccccuccuccccccuccagcaccccgccccccucggcacccaggagccccccggcgccccccccgccucccccucccgcgagauggccaagggcucccacgaggacccccccgcccccugcucccaggaggaggccggcgccgccguccucggcaccuccgaggagcgcaccgccuccaccuccacccucggcgagaaggaccccggccccgccgcccccucccucgccaagcaggaggccgaguggaccgccggcgaggccugccccgccuccuccuccacccagggcgcccgcgcccagcaggcccccaacaccgagaugugccagggcggcgaccccggcuccggccuccgcccccgcgccgagaaggaggacaccgccgagcucggcguccaccucgucaacucccucgucgaccacggccgcaacuccgaccucuccgacauccaggaggaggaggaggaggaggaggaggaggaggaggaggagcucggcucccgcaccugcuccuuccagaagcaggucgccggcaacuccauccgcgagaacggcgccaagucccagcccgaccccuucugcgagaccgacuccgacgaggagauccucgagcagauccucgagcucccccuccagcaguucugcuccaagaagcucuucuccauccccgaggaggaggaggaggaggaggaggacgaggaggaggagaaguccggcgccggcugcuccucccgcgaccccggcccccccgagcccgcccuccucggccucggcugcgacuccggccagccccgccgccccggccagugcccccucucccccgaguccucccgcgccggcgacugccucgaggacaugcccggccucgucggcggcuccucccgccgccgcggcggcggcucccccgagaagccccccucccgccgccgcccccccgacccccgcgagcacugcucccgccuccucuccaacaacggcccccaggccuccggccgccucggccccacccgcgagcgcggcggccuccccgucaucgagggcccccgcaccggccucgaggccuccggccgcggccgccucggccccucccgccgcugcucccgcggccgcgcccucgagcccggccucgccuccugccucucccccaagugccucgagaucuccaucgaguacgacuccgaggacgagcaggaggccggcuccggcggcaucuccaucaccuccuccugcuaccccggcgacggcgaggccuggggcaccgccaccgucggccgcccccgcggcccccccaaggccaacuccggccccaagcccuacccccgccuccccgccugggagaagggcgagcccgagcgccgcggccgcuccgccaccggccgcgccaaggagccccucucccgcgccaccgagaccggcgaggcccgcggccaggacggcuccggccgccgcggcccccagaagcgcggcguccgcguccuccgccccuccaccgccgagcucguccccgcccgcucccccuccgagacccucgccuaccagcaccuccccguccgcaucuucgucgcccucuucgacuacgaccccgucuccaugucccccaaccccgacgccggcgaggaggagcuccccuuccgcgagggccagauccucaaggucuucggcgacaaggacgccgacggcuucuaccagggcgagggcggcggccgcaccggcuacauccccugcaacauggucgccgaggucgccgucgacucccccgccggccgccagcagcuccuccagcgcggcuaccucucccccgacauccuccucgagggcuccgcccacaccaccggccccccccccaagccccgccgcuccaagaaggccgaguccgagggccccgcccagcccugccccggcccccccaagcucguccccuccgccgaccucaaggccccccacuccauggucgccgccuucgacuacaacccccaggaguccucccccaacauggacgucgaggccgagcuccccuuccgcgccggcgacgucaucaccgucuucggcggcauggacgacgacggcuucuacuacggcgagcucaacggccagcgcggccucguccccuccaacuuccucgagggccccggccccgaggccggcggccucgaccgcgagccccgcaccccccaggccgagucccagcgcacccgccgccgccgcguccagugcuga

SEQ ID NO: 40464 - RNA, 1260 nt, Artificial Sequence
  derived and/or modified sequence opt2 from BZW1__Homo_sapiens__NP_001193996
augaacaaccagaagcagcagaagcccacccucuccggccagcgcuucaagacccgcaagcgcgacgagaaggagcgcuucgaccccacccaguuccaggacugcaucauccagggccucaccgagaccggcaccgaccucgaggccgucgccaaguuccucgacgccuccggcgccaagcucgacuaccgccgcuacgccgagacccucuucgacauccucgucgccggcggcaugcucgcccccggcggcacccucgccgacgacaugaugcgcaccgacgucugcgucuucgccgcccaggaggaccucgagaccaugcaggccuucgcccaggucuucaacaagcucauccgccgcuacaaguaccucgagaagggcuucgaggacgaggucaagaagcuccuccucuuccucaagggcuucuccgaguccgagcgcaacaagcucgccaugcucaccggcguccuccucgccaacggcacccucaacgccuccauccucaacucccucuacaacgagaaccucgucaaggagggcgucuccgccgccuucgccgucaagcucuucaaguccuggaucaacgagaaggacaucaacgccgucgccgccucccuccgcaaggucuccauggacaaccgccucauggagcucuuccccgccaacaagcaguccgucgagcacuucaccaaguacuucaccgaggccggccucaaggagcucuccgaguacguccgcaaccagcagaccaucggcgcccgcaaggagcuccagaaggagcuccaggagcagaugucccgcggcgaccccuucaaggacaucauccucuacgucaaggaggagaugaagaagaacaacauccccgagcccgucgucaucggcaucgucugguccuccgucauguccaccgucgaguggaacaagaaggaggagcucgucgccgagcaggccaucaagcaccucaagcaguacuccccccuccucgccgccuucaccacccagggccaguccgagcucacccuccuccucaagauccaggaguacugcuacgacaacauccacuucaugaaggccuuccagaagaucgucguccucuucuacaaggccgagguccucuccgaggagcccauccucaagugguacaaggacgcccacgucgccaagggcaaguccgucuuccucgagcagaugaagaaguucgucgaguggcucaagaacgccgaggaggaguccgaguccgaggccgaggagggcgacuga

SEQ ID NO: 40465 - RNA, 627 nt, Artificial Sequence
  derived and/or modified sequence opt2 from C10orf107__Homo_sapiens__XP_005269657
auggacuucuccaucauccaguacuccaaguucaugacccuccucgccaugucccuccagaaccucaagacccuccacaugucccucgaggaguccaucaaguggcucggcgaggucauggccgagaucggccccacccacucccagaaguccgaggacuggaacaucuucgacgucaagcaggccaacgccaucaucgacuaccucaagaucucccucuuccagcacuacaagcucuacgaguucauguucuacuccgcccgcgaggagaucgucaucggcaccgagcaggucaucgaggucgucaaguccgccugcggccccuuccccaacccccucgaggagggcaucuccuucgacaucuacuccaccuucaucgagccccccaccauccucgacaccgagaugaagcgccucgaccaggagcagggccccgaggagucccagcccgagaccgacaccuccgacauggacccccucgucggcuucaccaucgaggacgucaaguccguccucgaccaggucaccgacgacauccucaucggcauccagaccgagaucaacgagaagcuccagauccaggaggaggccuucaacgcccgcaucgagaagcucaagaaggccuga

SEQ ID NO: 40466 - RNA, 639 nt, Artificial Sequence
  derived and/or modified sequence opt2 from C10orf10__Homo_sapiens__NP_008952
augcgcucccgccuccuccucuccgucgcccaccuccccaccauccgcgagaccaccgaggagaugcuccucggcggccccggccaggagcccccccccucccccucccucgacgacuacguccgcuccaucucccgccucgcccagcccaccuccguccucgacaaggccaccgcccagggccagccccgccccccccaccgccccgcccaggccugccgcaagggccgccccgccgucucccuccgcgacaucaccgcccgcuucuccggccagcagcccacccuccccauggccgacaccgucgacccccucgacuggcucuucggcgagucccaggagaagcagcccucccagcgcgaccucccccgccgcaccggccccuccgccggccucuggggcccccaccgccagauggacuccuccaagcccaugggcgccccccgcggccgccucugcgaggcccgcaugcccggccacucccucgcccgccccccccaggacggccagcaguccuccgaccuccgcuccuggaccuucggccaguccgcccaggccauggccucccgccaccgcccccgccccuccuccguccuccgcacccucuacucccaccuccccgucauccacgagcucuga

SEQ ID NO: 40467 - RNA, 468 nt, Artificial Sequence
  derived and/or modified sequence opt2 from C10orf113__Homo_sapiens__NP_001010896
auggccaaguccgagcgccgcaucuacuccauggaguccauggcccccgagaucuccgaggacaucggcugcccccucgccuacaugcgcgaguccgucugcgcccuccucaucaaccaguccuucuucuccugcgucgccgagauguacauccccgacaugaaccgccccggcaaggccgagcgccgcgccgagaagggccuccgccccccccgcaagcucgucggcgagacccgccgccuccaguccuggcccacccucgcccgcuggcuccgccgcgucuccuucucccucuacaagccccccauccaggccgcccccgagcccgaccccggcaacugggccaaguccccccgccucucccucggccccgagggcaucaccaagggcaagcacggcuucaaguuccagggcaucaaggagaaguucaacgucuccaagaagguccucaagaugaccuuccucuga

SEQ ID NO: 40468 - RNA, 597 nt, Artificial Sequence
  derived and/or modified sequence opt2 from C10orf11__Homo_sapiens__NP_114413
auggagaaguaccucucccucuccggcaaccacuccuccaacaagcgcucccucgagggccucuccgccuuccgcucccucgaggagcucauccucgacaacaaccagcucggcgacgaccucguccuccccggccucccccgccuccacacccucacccucaacaagaaccgcaucaccgaccucgagaaccuccucgaccaccucgccgaggucacccccgcccucgaguaccucucccuccucggcaacgucgccugccccaacgagcucgucucccucgagaaggacgaggaggacuacaagcgcuaccgcugcuucguccucuacaagcuccccaaccucaaguuccucgacgcccagaaggucacccgccaggagcgcgaggaggcccucguccgcggcgucuucaugaaggucgucaagcccaaggccuccuccgaggacgucgccuccucccccgagcgccacuacaccccccuccccuccgccucccgcgagcucaccucccaccagggcguccucggcaagugccgcuacgucuacuacggcaagaacuccgagggcaaccgcuucauccgcgacgaccagcucuga

SEQ ID NO: 40469 - RNA, 1749 nt, Artificial Sequence
  derived and/or modified sequence opt2 from C10orf2__Homo_sapiens__NP_001157284
auguggguccuccuccgcuccggcuacccccuccgcauccuccucccccuccgcggcgaguggaugggccgccgcggccucccccgcaaccucgcccccggccccccccgccgccgcuaccgcaaggagacccuccaggcccucgacaugcccguccuccccgucaccgccaccgagauccgccaguaccuccgcggccacggcauccccuuccaggacggccacuccugccuccgcgcccucucccccuucgccgaguccucccagcucaagggccagaccggcgucaccaccuccuucucccucuucaucgacaagaccaccggccacuuccucugcaugaccucccucgccgagggcuccugggaggacuuccaggccuccgucgagggccgcggcgacggcgcccgcgagggcuuccuccucuccaaggcccccgaguucgaggacuccgaggagguccgccgcaucuggaaccgcgccaucccccucugggagcuccccgaccaggaggagguccagcucgccgacaccauguucggccucaccaaggucaccgacgacacccucaagcgcuucuccguccgcuaccuccgccccgcccgcucccucgucuuccccugguucucccccggcggcuccggccuccgcggccucaagcuccucgaggccaagugccagggcgacggcgucuccuacgaggagaccaccaucccccgccccuccgccuaccacaaccucuucggccucccccucaucucccgccgcgacgccgaggucguccucaccucccgcgagcucgacucccucgcccucaaccaguccaccggccuccccacccucacccucccccgcggcaccaccugccucccccccgcccuccuccccuaccucgagcaguuccgccgcaucgucuucuggcucggcgacgaccuccgcuccugggaggccgccaagcucuucgcccgcaagcucaaccccaagcgcugcuuccucguccgccccggcgaccagcagccccgcccccucgaggcccucaacggcggcuucaaccucucccgcauccuccgcaccgcccuccccgccuggcacaaguccaucgucuccuuccgccagcuccgcgaggagguccucggcgagcucuccaacgucgagcaggccgccggccuccgcuggucccgcuuccccgaccucaaccgcauccucaagggccaccgcaagggcgagcucaccgucuucaccggccccaccggcuccggcaagaccaccuucaucuccgaguacgcccucgaccucugcucccagggcgucaacacccucuggggcuccuucgagaucuccaacguccgccucgcccgcgucaugcucacccaguucgccgagggccgccucgaggaccagcucgacaaguacgaccacugggccgaccgcuucgaggaccucccccucuacuucaugaccuuccacggccagcaguccauccgcaccgucaucgacaccaugcagcacgccgucuacgucuacgacaucugccacgucaucaucgacaaccuccaguucaugaugggccacgagcagcucuccaccgaccgcaucgccgcccaggacuacaucaucggcgucuuccgcaaguucgccaccgacaacaacugccacgucacccucgucauccacccccgcaaggaggacgacgacaaggagcuccagaccgccuccaucuucggcuccgccaaggucuccggccucuga

SEQ ID NO: 40470 - RNA, 321 nt, Artificial Sequence
  derived and/or modified sequence opt2 from C10orf32__Homo_sapiens__NP_001129672
augauggccaccggcacccccgagucccaggcccgcuucggccaguccgucaagggccuccucaccgagaaggucaccaccugcggcaccgacgucaucgcccucaccaagcagguccucaagggcucccgcuccuccgagcuccucggccaggccgcccgcaacaugguccuccaggaggacgccauccuccacuccgaggacucccuccgcaagauggccaucaucaccacccaccuccaguaccagcaggaggccauccagaagaacgucgagcaguccuccgaccuccaggaccagcucaaccaccuccucaaguga

SEQ ID NO: 40471 - RNA, 366 nt, Artificial Sequence
  derived and/or modified sequence opt2 from C10orf35__Homo_sapiens__NP_660349
augguccgcauccucgccaacggcgagaucguccaggacgacgacccccgcguccgcaccaccacccagcccccccgcggcuccaucccccgccaguccuucuucaaccgcggccacggcgccccccccggcggccccggcccccgccagcagcaggccggcgcccgccucggcgccgcccagucccccuucaacgaccucaaccgccagcucgucaacaugggcuucccccaguggcaccucggcaaccacgccgucgagcccgucaccuccauccuccuccucuuccuccucaugaugcucggcguccgcggccuccuccucgucggccucgucuaccucgucucccaccucucccagcgcuga

SEQ ID NO: 40472 - RNA, 936 nt, Artificial Sequence
  derived and/or modified sequence opt2 from C10orf54__Homo_sapiens__NP_071436
augggcguccccaccgcccucgaggccggcuccuggcgcuggggcucccuccucuucgcccucuuccucgccgccucccucggccccgucgccgccuucaaggucgccacccccuacucccucuacgucugccccgagggccagaacgucacccucaccugccgccuccucggccccgucgacaagggccacgacgucaccuucuacaagaccugguaccgcuccucccgcggcgagguccagaccugcuccgagcgccgccccauccgcaaccucaccuuccaggaccuccaccuccaccacggcggccaccaggccgccaacaccucccacgaccucgcccagcgccacggccucgaguccgccuccgaccaccacggcaacuucuccaucaccaugcgcaaccucacccuccucgacuccggccucuacugcugccucgucgucgagauccgccaccaccacuccgagcaccgcguccacggcgccauggagcuccagguccagaccggcaaggacgcccccuccaacugcgucgucuaccccuccuccucccaggacuccgagaacaucaccgccgccgcccucgccaccggcgccugcaucgucggcauccucugccucccccucauccuccuccucgucuacaagcagcgccaggccgccuccaaccgccgcgcccaggagcucguccgcauggacuccaacauccagggcaucgagaaccccggcuucgaggccuccccccccgcccagggcauccccgaggccaagguccgccacccccucuccuacgucgcccagcgccagcccuccgaguccggccgccaccuccucuccgagcccuccaccccccucuccccccccggccccggcgacgucuucuuccccucccucgaccccguccccgacucccccaacuucgaggucaucuga

SEQ ID NO: 40473 - RNA, 558 nt, Artificial Sequence
  derived and/or modified sequence opt2 from C10orf67__Homo_sapiens__NP_714925
augauggcccucguccgcgaccgccgcgcccacuacgucauguccaucgucauccgcuggguccacugcuucuccuccucccuccgcggcaccuucggcacccgcugggaggccaugaaggccaaggccaccgagcuccgcgucugcugcgcccgccgcaagcgcgaggcccgcgaguucaagcccccccagaugcgcggcuccacccgccucaacaucuccgacgaccucaagaucggcuucuucuccaccgaccacgccacccagaccgacuccuccgagauccucuccgucaaggagcucuccuccuccacccagaagcucgcccagaugaugaagucccuccaggucgacuucggcuuccucaagcagcuccuccagcucaaguucgaggaccgccucaaggaggagucccucucccucuucaccauccuccacgaccgcauccucgagaucgagaagcacuaccagcagaacgaggacaagaugcgcaaguccuucaaccagcagcucgccgacgccaucgccgucaucaagggcauguaccagccccucuga

SEQ ID NO: 40474 - RNA, 465 nt, Artificial Sequence
  derived and/or modified sequence opt2 from C10orf82__Homo_sapiens__NP_653262
auggagcccuccaagaccuucaugcgcaaccuccccaucacccccggcuacuccggcuucguccccuuccucuccugccagggcauguccaaggaggacgacaugaaccacugcgucaagaccuuccaggagaagacccagcgcuacaaggagcagcuccgcgagcucugcugcgccgucgccaccgcccccaagcucaagcccgucaacuccgaggagaccguccuccaggcccuccaccaguacaaccuccaguaccacccccucauccucgagugcaaguacgucaagaagccccuccaggagccccccauccccggcugggccggcuaccucccccgcgccaaggucaccgaguucggcugcggcacccgcuacaccgucauggccaagaacugcuacaaggacuuccucgagaucaccgagcgcgccaagaaggcccaccucaagcccuacgaggaguga

SEQ ID NO: 40475 - RNA, 1338 nt, Artificial Sequence
  derived and/or modified sequence opt2 from C10orf88__Homo_sapiens__NP_079218
auggagacccgcaccgaggacggcggccucacccgccgccccacccucgccuccuccugggacgucgccggcggcgcccucacccacucccuccuccucacccgcgccggccucggccccggcgacuucgacugggaggagcuccucgccccccccgcccccggccaggaccucgucauccucaagcgcaaccacaacaacaaggacgagaaccccugcuuccucuaccuccgcugcggccccgacggcggcgaggagaucgccuccaucggcauccucuccuccgcccgcaacauggaggucuaccucggcgaggaguacugcggcaccucccgcggcaagaacgucugcaccguccucgacgacuccgagcacgagaagaucauccucuacaagaagaaccucaagcucgaguccuccacccacgccugcaagaucaagcuccucuccuucggcgagcgccagugcgucuucaucuccaaggucgucguccacaugcgcuccgucuucgccaacuccuccaccuccucccccgcccucggcucccgcaucgaccucgacaagguccagaccaucauggaguccaugggcuccaagcucucccccggcgcccagcagcucauggacaugguccgcugccagcagcgcaacugcauccccaucggcgagcagcuccaguccguccucggcaacuccggcuacaagcacaugaucggccuccaguccuccuccacccucggcacccucaacaaguccuccuccacccccuuccccuuccgcaccggccucaccuccggcaacgucaccgagaaccuccagaccuacaucgacaaguccacccagcuccccggcggcgagaacuccaccaagcucgacgagugcaaggucaugccccagaaccacuccuuccucgagaacgaccucaagaacgccauggccuccuuccuccccaagaaggucuccgacaacuccaacauccccaacuccgagcuccuccccuuccuccagaaccucugcucccaggucaaccaccuccacgucggcaacaagaccgagugccaggagaacaucaccaagcacggcgagcgcauccucggcgucggcauggaggagcaguccaucugcuccuaccucgagaagauccucuccaagaacauggagcucauggagaagaagcucauggacuacaucgaccagcgcauccacgagcuccaggagcacaucgacgacaagaucgcccuccuccucgaccuccuccagaaccccaacuccccccccaccggcaucccccuccgccacuacgacuccggcgagcgccucuccaacggcgagcgcuga

SEQ ID NO: 40476 - RNA, 2100 nt, Artificial Sequence
  derived and/or modified sequence opt2 from C10orf90__Homo_sapiens__NP_001004298
augcucaagcucuccggcgagggccuccgcgacuccuaccacucccgccgcgaccagaucgcccucaagaaccuccaguccgacgucaccgaggccaaguccgacuucaccaaggagacccucgccucccagaacaccaagaugaucuccuccaucgucaucucccagaugaucgacgagaacaagucccgcgagaaccgcgccucccucccccuccccugcgccaucgcccagucccgcgcccaccacgccaagcagucccucgccaaccgcuccggcgucaacauccaccgcgccuucgcccuccuccccggccgccucggcauccccgcccccuccgacgagcgcggccccgaggccgagcucccccccaaggaggagcgccccugcggcggcccccgccgcggcuucgccuccaucaccaucaccgcccgccgcgucggcccccccgcccgcgcccucgucuggggcaccgccggcgacucccucugccccaagugccgcgccgaggacacccucuuccaggccccccccgcccucgccaacggcgcccaccccggccgccaccagcgcuccuucgccugcaccgaguucucccgcaacuccuccgucguccgccucaagguccccgaggcccacaccggccucugcgagcgccgcaaguacugggucacccacgccgacgacaaggagaccuccuucucccccgacaccccccucuccggcaaguccccccucgucuucuccuccugcguccaccuccgcgucucccagcagugccccgacuccaucuacuacgucgacaagucccucuccguccccaucgagcccccccagaucgccucccccaagaugcaccgcuccguccucucccucaaccucaacugcuccucccaccgccucaccgccgacggcgucgacggccucgucaaccgcgagcccaucuccgaggcccucaagcaggagcuccucgagggcgaccaggaccucgucggccagcgcuggaaccccggccuccaggagucccaccucaaggagacccccucccuccgccgcguccaccucggcaccggcgccugccccugguccggcuccuucccccucgagaacaccgagcucgccaacgucggcgccaaccaggucaccguccgcaagggcgagaaggaccacaccacccacugccacgccuccgaccacgccaaccagcucuccauccacauccccggcugguccuaccgcgccguccacaccaaggucuucuccggcuccuccaagcgccagcagggcgaggucugcaugaccgucuccgccccccccgucgagcagaagcccacccgccacuuccuccccaucggcgacuccucccccuccgacgacugccucucccgcgaccucuccgagcccaccgagcgccgccaccaguccuuccucaagccccgcauccucuuccccggcuuccucugcccccuccaggacgucugcgccucccuccaggaggacaacggcguccagaucgaguccaaguuccccaagggcgacuacaccugcugcgaccucgucgucaagaucaaggagugcaagaaguccgaggaccccaccacccccgagcccucccccgccgcccccucccccgccccccgcgacggcgccggcucccccggccucuccgaggacugcuccgagucccagcagacccccgcccgcucccucacccuccaggaggcccucgagguccgcaagccccaguucaucucccgcucccaggagcgccucaagaagcucgagcacaugguccagcagcgcaaggcccagcgcaaggaggaccuccgccagaagcagucccuccuccccauccgcaccuccaagaagcaguucaccaucccccacccccucuccgacaaccucuucaagcccaaggagcgcugcaucuccgagaaggagaugcacaugcgcuccaagcgcaucuacgacaaccuccccgaggucaagaagaagaaggaggagcagcgcaagcgcgucauccuccaguccaaccgccuccgcgccgaggucuucaagaagcagcuccucgaccagcuccuccagcgcaacgccgucuga

SEQ ID NO: 40477 - RNA, 537 nt, Artificial Sequence
  derived and/or modified sequence opt2 from C11orf21__Homo_sapiens__NP_001136418
auggccuccuuccucgucuggccccuccgcaccgcccuccgcggcggcaaguccugggccggccccggcgucggcugcggcggcgacggcgcccgcggcggcggcgagcucucccucuccaaccucgaccuccccggcgccggcgaggccggccucgagcaccacccccuccucggccaccucuucaucuccgccgucccccgcuggccccaccucuccucccaguccggcgucgagccccccgaccgcuggaccggcacccccggcuggcccucccgcgaccaggaggcccccggcuccaugaugccccccgccgccgcccagcccuccgcccacggcgcccucgucccccccgccaccgcccacgagcccgucgaccaccccgcccuccacuggcucgccugcugcugcugccucucccuccccggccagcucccccucgccauccgccucggcugggaccucgaccucgaggccggccccuccuccggcaagcucugcccccgcgcccgccgcuggcagccccuccccuccuga

SEQ ID NO: 40478 - RNA, 3969 nt, Artificial Sequence
  derived and/or modified sequence opt2 from C11orf30__Homo_sapiens__NP_064578
augcccgucgucuggcccacccuccucgaccucucccgcgacgagugcaagcgcauccuccgcaagcucgagcucgaggccuacgccggcgucaucuccgcccuccgcgcccagggcgaccucaccaaggagaagaaggaccuccucggcgagcucuccaagguccucuccaucuccaccgagcgccaccgcgccgagguccgccgcgccgucaacgacgagcgccucaccaccaucgcccacaacauguccggccccaacuccuccuccgagugguccaucgagggccgccgccucgucccccucaugccccgccucgucccccagaccgccuucaccgucaccgccaacgccgucgccaacgccgccauccagcacaacgccucccuccccguccccgccgagaccggcuccaaggaggucgucugcuacuccuacaccuccaccaccuccacccccaccuccacccccguccccuccggcuccaucgccaccgucaaguccccccgccccgccucccccgccuccaacgucgucguccuccccuccggcuccaccgucuacgucaaguccgucuccugcuccgacgaggacgagaagccccgcaagcgccgccgcaccaacuccuccuccuccucccccgucguccucaaggagguccccaaggccgucguccccgucuccaagaccaucaccguccccgucuccggcucccccaagauguccaacaucaugcaguccaucgccaacucccuccccccccacaugucccccgucaagaucaccuucaccaagcccuccacccagaccaccaacaccaccacccagaaggucaucaucgucaccaccucccccuccuccaccuucguccccaacauccucuccaagucccacaacuacgccgccgucaccaagcucguccccaccuccgucaucgccuccaccacccagaagccccccgucgucaucaccgccucccaguccucccucgucuccaacuccuccuccggcuccuccuccuccacccccucccccauccccaacaccgucgccgucaccgccgucgucuccuccacccccuccgucgucauguccaccgucgcccagggcgucuccaccuccgccaucaagauggccuccacccgccuccccucccccaagucccucgucuccgcccccacccagauccucgcccaguuccccaagcagcaccagcagucccccaagcagcagcucuaccagguccagcagcagacccagcagcaggucgcccagcccucccccgucucccaccagcagcagccccagcaguccccccucccccccggcaucaagcccaccauccagaucaagcaggaguccggcgucaagaucaucacccagcagguccagcccuccaagauccuccccaagcccgucaccgccacccuccccaccuccuccaacucccccaucauggucgucuccuccaacggcgccaucaugaccaccaagcucgucaccacccccaccggcacccaggccaccuacacccgccccaccgucucccccuccaucggccgcauggccgccacccccggcgccgccaccuacgucaagaccaccuccggcuccaucaucaccgucguccccaagucccucgccacccucggcggcaagaucaucuccuccaacaucgucuccggcaccaccaccaagaucaccaccauccccaugaccuccaagcccaacgucaucgucguccagaagaccaccggcaagggcaccaccauccagggccuccccggcaagaacgucgucaccacccuccucaacgccggcggcgagaagaccauccagaccguccccaccggcgccaagcccgccauccucaccgccacccgccccaucaccaagaugaucgucacccagcccaagggcaucggcuccaccguccagcccgccgccaagaucauccccaccaagaucgucuacggccagcagggcaagacccagguccucaucaagcccaagcccgucaccuuccaggccaccgucgucuccgagcagacccgccagcucgucaccgagacccuccagcaggccucccgcgucgccgaggccggcaacuccuccauccaggagggcaaggaggagccccagaacuacaccgacuccuccuccuccuccaccgaguccucccaguccucccaggacucccagcccgucguccacgucaucgccucccgccgccaggacugguccgagcacgagaucgccauggagaccucccccaccaucaucuaccaggacgucuccuccgagucccaguccgccaccuccaccaucaaggcccuccucgagcuccagcagaccaccgucaaggagaagcucgaguccaagccccgccagcccaccaucgaccucucccagauggccguccccauccagaugacccaggagaagcgccacucccccgagucccccuccaucgccgucgucgaguccgagcucgucgccgaguacaucaccaccgagcgcaccgacgagggcaccgaggucgccuucccccuccucgucucccaccgcucccagccccagcagcccucccagccccagcgcacccuccuccagcacgucgcccagucccagaccgccacccagaccuccgucgucgucaaguccauccccgccuccucccccggcgccaucacccacaucaugcagcaggcccucuccucccacaccgccuucaccaagcacuccgaggagcucggcaccgaggagggcgaggucgaggagauggacacccucgacccccagaccggccucuucuaccgcuccgcccucacccagucccaguccgccaagcagcagaagcucucccagcccccccucgagcagacccagcuccaggucaagacccuccagugcuuccagaccaagcagaagcagaccauccaccuccaggccgaccagcuccagcacaagcucccccagaugccccagcucuccauccgccaccagaagcucaccccccuccagcaggagcaggcccagcccaagcccgacguccagcacacccagcaccccauggucgccaaggaccgccagcuccccacccucauggcccagcccccccagaccgucguccagguccucgccgucaagaccacccagcagcuccccaagcuccagcaggcccccaaccagcccaagaucuacguccagccccagaccccccagucccagaugucccuccccgccuccuccgagaagcagaccgccucccaggucgagcagcccaucaucacccagggcuccuccgucaccaagaucaccuucgagggccgccagccccccaccgucaccaagaucaccggcggcuccuccguccccaagcucaccucccccgucaccuccaucucccccauccaggccuccgagaagaccgccgucuccgacauccucaagaugucccucauggaggcccagaucgacaccaacgucgagcacaugaucgucgacccccccaagaaggcccucgccaccuccaugcucaccggcgaggccggcucccuccccuccacccacauggucgucgccggcauggccaacuccaccccccagcagcagaagugccgcgaguccugcuccucccccuccaccgucggcuccucccucaccacccgcaagaucgacccccccgccguccccgccaccggccaguucaugcgcauccagaacgucggccagaagaaggccgaggagucccccgccgagaucaucauccaggccaucccccaguacgccauccccugccacuccuccuccaacgucgucgucgagcccuccggccuccucgagcucaacaacuucaccucccagcagcucgacgacgaggagaccgccauggagcaggacaucgacuccuccaccgaggacggcaccgagcccucccccucccaguccuccgccgagcgcuccuga

SEQ ID NO: 40479 - RNA, 711 nt, Artificial Sequence
  derived and/or modified sequence opt2 from C11orf53__Homo_sapiens__NP_940900
augcccggcucccccgucaccuccggcuacuacggcguccgccgcuccuuccucuccgacuccgacuuccacaacuccaagcaguucuccaacgacgucuacaccuccuccgucggcaagcccuuccccugcgaguccuccgccggccagucccacgccgcccuccucgagcccuacuucccccaggagcccuacggcgacuaccgcccccccgcccucacccccaacgccggcucccucuucuccgccuccccccuccccccccuccuccccccccccuuccccggcgaccccgcccacuuccucuuccgcgacuccugggagcagacccuccccgacggccucucccagcccgaccccgucuccgccgacgcccuccucacccucccccccuccaccuccugccucucccagcucgaguccggcuccaucgcccagcaccgcggcuccuccuggggcuccucccucgccggcgcccaguccuacucccuccacgcccucgaggaccuccaccacacccccggcuaccccacccccccccccuaccccuucacccccuucaugaccgucuccaacgaccucccccccaaggucggcccccucucccccgacgaggaggccgacaccggcucccuccacgaccccucccccugggucaaggaggacggcuccaucgccuggggcuccuacgagugccgccgcgccuacuga

SEQ ID NO: 40480 - RNA, 942 nt, Artificial Sequence
  derived and/or modified sequence opt2 from C11orf65__Homo_sapiens__NP_689800
augcccuggaaggaggaguccgaguucaccaagcaggacaaggccgcccgcgucauccagcaggccuggaaguccuuccucaacgucgccaucuuccagcacuucaagucccucaucgaccuccgccgccagggcgagccccgccagaucgucaaguacaucaaccccaaggaggccgagcuccucgacgccgccgccggcauccacguccgcuuccgccucggcggcgucaaguucccccccgacaucuacuacaagaucuucacccaccgccccaucgaggaccucugcgccaacuccccccgcaacuacgccaagcuccccgccaagcacaccucccacaacaagaacgaccaccuccaggaggaggaccacuccggcugguaccaccgcaucgagaacaacggcuggcgccccgucuccgacaccuucuggcucuccaccgacggcauggucgucgaggacaagaaggaguccgaguuccacuucuccaagcucaagcgccgccaggaccucgagaagaagcgcaagcuccgcaagaucgaguggaugcgccagauguacuacuccggcucccucgaggccaaguccacccaccacgagacccucggccucauccacaccgccaccaagggccucauccgcgccuucgaggacggcggcaucgacuccgucauggagugggaggucgacgagguccucaacuggaccaacacccucaacuucgacgaguacaucgccuccuggaaggagaucgccaccuccaacuccuccgccaacuucaagggcuuccgcuucaaccaggcccagaagaacaucuacaacuacggcggcgacaucuccaagaugcagaugggcauccccgacgacaccuacuacgagaacgucuaccaggagcccaacgucacccgccucacccccgacuccaccuacggccucuga

SEQ ID NO: 40481 - RNA, 882 nt, Artificial Sequence
  derived and/or modified sequence opt2 from C11orf68__Homo_sapiens__NP_001129107
auggccgccgccgccgccgccgccgucgccggcgucggccgcggcggcggcggcgccgagccccgccaggagcgcucccgcgcccgcggcugggccggcgucgagcgcuccgagggccgcucccgcauggagcccggcgaggagcucgaggaggagggcucccccggcggccgcgaggacggcuucaccgccgagcaccucgccgccgaggccauggccgccgacauggaccccuggcucgucuucgacgcccgcaccacccccgccaccgagcucgacgccuggcucgccaaguacccccccucccaggucacccgcuacggcgaccccggcucccccaacuccgagcccgucggcuggaucgccgucuacggccagggcuacucccccaacuccggcgacguccagggccuccaggccgccugggaggcccuccagaccuccggccgccccaucacccccggcacccuccgccagcucgccaucacccaccacguccucuccggcaaguggcucaugcaccucgcccccggcuucaagcucgaccacgccugggccggcaucgcccgcgccgucgucgagggccagcuccaggucgccaaggucuccccccgcgccaaggagggcggccgccaggucaucugcgucuacaccgacgacuucaccgaccgccucggcguccucgaggccgacuccgccauccgcgccgccggcaucaagugccuccucaccuacaagcccgacgucuacaccuaccucggcaucuaccgcgccaaccgcuggcaccucugccccacccucuacgagucccgcuuccagcucggcggcuccgcccgcggcucccgcguccucgaccgcgccaacaacgucgagcucaccuga

SEQ ID NO: 40482 - RNA, 594 nt, Artificial Sequence
  derived and/or modified sequence opt2 from C11orf73__Homo_sapiens__NP_057485
auguucggcugccucgucgccggccgccucguccagaccgccgcccagcaggucgccgaggacaaguucgucuucgaccuccccgacuacgaguccaucaaccacgucgucgucuucaugcucggcaccauccccuuccccgagggcaugggcggcuccgucuacuucuccuaccccgacuccaacggcaugcccgucuggcagcuccucggcuucgucaccaacggcaagcccuccgccaucuucaagaucuccggccucaaguccggcgagggcucccagcaccccuucggcgccaugaacaucguccgcacccccuccgucgcccagaucggcaucuccgucgagcuccucgacuccauggcccagcagacccccgucggcaacgccgccgucuccuccgucgacuccuucacccaguucacccagaagaugcucgacaacuucuacaacuucgccuccuccuucgccgucucccaggcccagaugacccccucccccuccgagauguucauccccgccaacgucguccucaagugguacgagaacuuccagcgccgccucgcccagaacccccucuucuggaagaccuga

SEQ ID NO: 40483 - RNA, 444 nt, Artificial Sequence
  derived and/or modified sequence opt2 from C11orf74__Homo_sapiens__NP_001263656
auguccgcccacauguccggccucgagaucauggacgaggaccagcucaucaaggacguccucgacaaguuccucaacugccacgagcagaccuacgacgaggaguuccucaacaccuucacccaccucucccaggaccuccuccuccuccccggcgaggucgagcaggacgucuccaccuccauccccuccugcauccccuucgucgcccagccccccaccugcgaggucaagcccaagcccuccgucaagcgcauggacaagcagaccgaggagauccucggcgacgagguccagcucuucucccucgacgaggaguucgacuacgacaacgucaugcucaccuccaaguucucccccgccgagaucgagaacaucaaggagcucugcaagcagcagaagcgcaaggacaccucccccgaccucgagaaguccugcgacuga

SEQ ID NO: 40484 - RNA, 1536 nt, Artificial Sequence
  derived and/or modified sequence opt2 from C11orf80__Homo_sapiens__NP_001289013
augguccucaagaaguuccucaaggagauccaguccauccuccccggcaucuccgccaagcucaccuggaccuccgaggagggcuccuacucccaggacaugaccggcgucacccccuuccagaugaucuucgaggucgacgagaagccccgcacccucaugaccgacugccucgucaucaagcacuuccuccgcaagaucaucaugguccaccccaagguccgcuuccacuucuccgucaaggucaacggcauccucuccaccgagaucuucggcgucgagaacgagcccacccucaaccucggcaacggcaucgcccuccucgucgacucccagcacuacgucucccgccccaacuucggcaccaucgagucccacugcucccgcauccaccccguccucggccaccccgucaugcucuucauccccgaggacgucgccggcauggaccuccucggcgagcucauccucacccccgccgccgcccucugccccucccccaaggucuccuccaaccagcucaaccgcaucuccuccgucuccaucuuccucuacggcccccucggccucccccucauccucuccaccugggagcagcccaugaccaccuucuucaaggacaccuccucccucgucgacuggaagaaguaccaccucugcaugauccccaaccucgaccucaaccucgaccgcgaccucguccuccccgacgucuccuaccaggucgaguccuccgaggaggaccagucccagaccauggacccccagggccagacccuccuccucuuccucuucgucgacuuccacuccgccuuccccguccagcagauggagaucuggggcgucuacacccuccucaccacccaccucaacgccauccucgucgagucccacuccgucguccagggcuccauccaguucaccgucgacaagguccucgagcagcaccaccaggccgccaaggcccagcagaagcuccaggccucccucuccgucgccgucaacuccaucauguccauccucaccggcuccacccgcuccuccuuccgcaagaugugccuccagacccuccaggccgccgacacccaggaguuccgcaccaagcuccacaaggucuuccgcgagaucacccagcaccaguuccuccaccacugcuccugcgaggucaagcagcucacccucgagaagaaggacuccgcccagggcaccgaggacgcccccgacaacuccucccucgagcuccucgccgacaccuccggccaggccgagaacaagcgccucaagcgcggcuccccccgcaucgaggagaugcgcgcccuccgcuccgcccgcgcccccucccccuccgaggccgccccccgccgccccgaggccaccgccgccccccucaccccccgcggccgcgagcaccgcgaggcccacggccgcgcccucgcccccggccgcgccucccucggcucccgccucgaggacguccucuggcuccaggaggucuccaaccucuccgaguggcucucccccucccccggccccuga

SEQ ID NO: 40485 - RNA, 1035 nt, Artificial Sequence
  derived and/or modified sequence opt2 from C11orf87__Homo_sapiens__XP_011541119
augggccccaagggcuccgacgccguccagggcggccgcgucuggaccggccgcgagcgcaagggcggccuccgcacccgcuccccccgcggcggccccgaguggguccucggccgcgucggcucccgccgccgccaccagccccgcggccgccgcaaggaggagucccgccgcuccggcaaccucgucccccuccagcgcaagggcgagcgcggcgacgucuucgaggucgucuccgcccgcaucucccgcgccccccucacccccuggucccccugccuccccgccgucgccccccucguccucggcucccucgcccacccccucccccuccagggcgccguccucggcggcgucggcuccguccucuuccucgccggccgcaacggcguccccaagcgcggcucccucgucggccucgccccccccucccccgcccccauguccgcccgcgcccccaaggagcuccgccucgcccucccccccugccuccucaaccgcaccuucgccucccccaacgccuccggcuccggcaacaccggcgcccgcggccccggcgccgucggcuccggcaccugcaucacccaggucggccagcagcucuuccaguccuucuccuccacccucguccucaucguccucgucacccucaucuucugccucaucguccucucccucuccaccuuccacauccacaagcgccgcaugaagaagcgcaagaugcagcgcgcccaggaggaguacgagcgcgaccacugcuccggcucccgcggcggcggcggccucccccgccccggccgccaggcccccacccacgccaaggagacccgccucgagcgccagccccgcgacucccccuucugcgcccccuccaacgccuccucccucuccuccuccucccccggccuccccugccagggccccugcgccccccccccccccccccccgccuccuccccccagggcgcccacgccgccuccuccugccucgacaccgccggcgagggccuccuccagaccgucguccucuccuga

SEQ ID NO: 40486 - RNA, 2037 nt, Artificial Sequence
  derived and/or modified sequence opt2 from C11orf95__Homo_sapiens__NP_001138408
auggagcccggcggcgaccaccgcucccgcuccuccggcggccgcggcggccccggccccgccgucgccuccgcccgcggccgccgccucccccccgccggcuccuccggcuccgccgagcccgaggaggacgagggcggccaggaccuccagcucgagggcggcgcccucggcuccuggggcuccgccccccuccccuccucccgcgcccgcggccccgccuccuccggccgcaaguacuccgaccacugcgaggcccgcgccucccgccccggcaagucccgcauccccggccgcgaccaccgccgcuacuaccacgaccacuggcgccucgaguaccucauggacuucaaccccgcccgccacggcauggucugcauggucugcggcuccucccucgccacccucaagcucuccaccaucaagcgccacauccgccagaagcaccccuacucccuccacugguccccccgcgagaaggaggucaucuccaacuccugggacgcccaccucggccucggcgccugcggcgaggccgagggccucggcguccagggcgccgaggaggaggaggaggaggaggaggaggaggaggaggagggcgccggcguccccgccugcccccccaagggccccggcaaggcccccgccggcggcggcugccgccgccagcgccgcggcggccccgucgccccccgcgcccgccgccuccgccucuccgccucccgccgcgccggcggcucccgcggccucggcgcccgccgccucgagcgccgccucaaggagucccuccagaacugguuccgcgccgagugccucauggacuacgacccccgcggcaaccgccucgucugcauggccugcggccgcgcccuccccucccuccaccucgacgacauccgcgcccacguccucgagguccaccccggcucccucggccucuccggcccccagcgcuccgcccuccuccaggccuggggcggccagcccgaggcccucuccgagcucacccaguccccccccggcgacgaccucgccccccaggaccucaccggcaagucccgcgacuccgccuccgccgccggcgcccccuccucccaggaccucuccccccccgacgucaaggaggaggccggcuggguccccgagcgccccggccccgccgaggaggaggaggagcucgaggagggcgagggcgagcgcgccggcguccccggccgcuccccccgcggccgcgcccaccgccgccacccccaggagcgcuggcgccucgaguaccucauggagcucgacggcggccgccgcggccucgucugcggcgucugcggcggcgcccucgccucccucaagauguccaccaucgagcgccacauccgccgccgccaccccggcuccacccgccucggcggccccguccaggcccucaucgcccgcgagugguccgagaaggccgcccaccuccucgcccucggccccccccgccccgaguccccccagggccccaucccccccggcaccgccgccgccuccgacgagggcggcggcgacgaggaggaggagcccgaggaggaggaggaggaguggggcgacgucccccucucccccggcgccccccucgagcgccccgccgaggaggaggaggacgaggaggacggccaggagcccggcggccucgcccuccccccccccccccccccccccccccccccccccccccgcucccgcgagcagcgccgcaacuaccagccccgcuggcgcggcgaguaccucauggacuacgacggcucccgccgcggccucgucugcauggucugcggcggcgcccucgccacccucaaggucuccaccaucaagcgccacauccuccagguccaccccuucuccauggacuucacccccgaggagcgccagaccauccucgaggccuacgaggaggccgcccuccgcugcuacggccacgagggcuucggcccccccgcccccgccccccgcgacggcggcgccgaccucaaguccggcgccgucugccgcgccuga

SEQ ID NO: 40487 - RNA, 1131 nt, Artificial Sequence
  derived and/or modified sequence opt2 from C12orf10__Homo_sapiens__NP_067653
augggccaccaguuccuccgcggccuccucacccuccuccuccccccccccccccucuacacccgccaccgcaugcucggccccgaguccguccccccccccaagcgcucccgcuccaagcucauggcccccccccgcaucggcacccacaacggcaccuuccacugcgacgaggcccucgccugcgcccuccuccgccuccuccccgaguaccgcgacgccgagaucguccgcacccgcgaccccgagaagcucgccuccugcgacaucgucgucgacgucggcggcgaguacgacccccgccgccaccgcuacgaccaccaccagcgcuccuucaccgagaccauguccucccucucccccggcaagcccuggcagaccaagcucuccuccgccggccucaucuaccuccacuucggccacaagcuccucgcccagcuccucggcaccuccgaggaggacuccauggucggcacccucuacgacaagauguacgagaacuucgucgaggaggucgacgccgucgacaacggcaucucccagugggccgagggcgagccccgcuacgcccucaccaccacccucuccgcccgcgucgcccgccucaaccccaccuggaaccaccccgaccaggacaccgaggccggcuucaagcgcgccauggaccucguccaggaggaguuccuccagcgccucgacuucuaccagcacuccuggcuccccgcccgcgcccucgucgaggaggcccucgcccagcgcuuccaggucgaccccuccggcgagaucgucgagcucgccaagggcgccugccccuggaaggagcaccucuaccaccucgaguccggccucuccccccccgucgccaucuucuucgucaucuacaccgaccaggccggccaguggcgcauccagugcguccccaaggagccccacuccuuccagucccgccucccccuccccgagcccuggcgcggccuccgcgacgaggcccucgaccaggucuccggcauccccggcugcaucuucguccacgccuccggcuucaucggcggccaccacacccgcgagggcgcccucuccauggcccgcgccacccucgcccagcgcuccuaccucccccagaucuccuga

SEQ ID NO: 40488 - RNA, 1083 nt, Artificial Sequence
  derived and/or modified sequence opt2 from C12orf42__Homo_sapiens__NP_940923
auguccaccgucaucugcaugaagcagcgcgaggaggaguuccuccucaccauccgccccuucgccaaccgcaugcagaagucccccugcuacauccccaucgucuccuccgccacccucugggaccgcuccacccccuccgccaagcacauccccugcuacgagcgcaccuccguccccugcucccgcuucaucaaccacaugaagaacuucuccgagucccccaaguuccgcucccuccacuuccucaacuuccccgucuuccccgagcgcacccagaacuccauggccugcaagcgccuccuccacaccugccaguacaucgucccccgcugcuccgucuccaccgucuccuucgacgaggaguccuacgaggaguuccgcuccucccccgcccccuccuccgagaccgacgaggccccccucaucuucaccgcccgcggcgagaccgaggagcgcgcccgcggcgcccccaagcaggccuggaacuccuccuuccucgagcagcucgucaagaagcccaacugggcccacuccgucaaccccguccaccucgaggcccagggcauccacaucucccgccacacccgccccaagggccagccccucuccucccccaagaagaacuccggcuccgccgcccgccccuccaccgccaucggccucugccgccgcucccagacccccggcgcccuccaguccaccggccccuccaacaccgagcucgagcccgaggagcgcauggccguccccgccggcgcccaggcccaccccgacgacauccagucccgccuccucggcgccuccggcaaccccgucggcaagggcgccgucgccauggcccccgagaugcuccccaagcacccccacaccccccgcgaccgccgcccccaggccgacaccucccuccacggcaaccucgccggcgccccccucccccuccucgccggcgccuccacccacuuccccuccaagcgccucaucaaggucugcuccuccgcccccccccgccccacccgccgcuuccacaccgucugcucccaggcccucucccgccccgucgucaacgcccaccuccacuga

SEQ ID NO: 40489 - RNA, 666 nt, Artificial Sequence
  derived and/or modified sequence opt2 from C12orf43__Homo_sapiens__NP_001273127
auguucugccagaaccccggcgccgccaacucccagcucuccaccucccagcccucccuccgccacaaggucaacgagcacgagcaggacggcaacgagcuccagaccacccccgaguuccgcgcccacgucgccaagaagcucggcgcccuccucgacuccuucaucaccaucuccgaggccgccaaggagcccgccaaggccaagguccagaaggucgcccucgaggacgacggcuuccgccucuucuucaccuccguccccggcggccgcgagaaggaggaguccccccagccccgccgcaagcgccagcccuccuccuccuccuccgaggacuccgacgaggaguggcgccgcugccgcgaggccgccgucuccgccuccgacauccuccaggaguccgccauccacucccccggcaccgucgagaaggaggccaagaagaagcgcaagcucaagaagaaggccaagaaggucgccuccgucgacuccgccgucgccgccaccacccccaccuccauggccaccguccagaagcagaaguccggcgagcucaacggcgaccaggucucccucggcaccaagaagaagaagaaggccaagaaggccuccgagaccucccccuucccccccgccaaguccgccaccgccauccccgccaacuga

SEQ ID NO: 40490 - RNA, 1245 nt, Artificial Sequence
  derived and/or modified sequence opt2 from C12orf50__Homo_sapiens__NP_689802
auggagaugcagcagaacugcuccaucuccugcuucugggagacccagccccucggcugcgucaagaucuccugcaucuucuaccacuccaagccccgcaacaucaacggccucuuccucccccccuccuccaacaucacccuccagaaggagauccaggagggcaucccccuccagucccagucccaggagccccucaagccccaggagaacaucucccgccccauccaccacccccucguccucaagaccaacuucgaggaggaggaggaggucgacgagcagaacgacgccuccucccucuggaccaagacccccgaggagaucgaggagaagcgcgccaucaaggagaugugcuacaaguccggcgaguacuaccgcuuccacaccccccccgacauccucuccuccaaguccaugacccccaccgccgagaagcagcucgagaagccccucgagaacggcuccgagcuccaggagggcgacucccucaccguccccaccaagcucucccaguacgagcgccagggcgagaucaagaccucccuccacggcaagcccaagaccgacaucgccgccuucgagaacggcggcggcgacugcuacgucccccagcgcgucaucuuccucggcgucgacgaguccgaggcccucaccgaggagaaggagaucaccaucuccaagugcuccaacaccaaggacaacaaggacuccccccaccccaagcacucccucaccacccgccucguccccaccacccacguccucaacgccaccgagaacaucuccaugaagugccgcgaggaccccuccuccaugaacgacguccagcccgucaagaagccccacuucaagggcgucaagaagcgcaaguggaucuacgacgagccccagaacuuccccaacuccggcaugcagcgcgccguccaggccccccgcccccagaacaagauguccuaccaccgcaacaacaagaaccgcaacgccgagaacgccuccuacauccacguccagcgcgacgccguccgcaccgucgcccucaacgcccccucccgcucccgccccacccacggcuccuacaacaagguccacgccaaccgcgagcccaagcccaaccucucccccgacaaguacaccuccaccuccuacaacgacuccgccuggcgcaagcgcauccccuucuccaagaccuacuccaaguccgagaagaucuaccccgagccccgccgcaacggcuccaaguga

SEQ ID NO: 40491 - RNA, 381 nt, Artificial Sequence
  derived and/or modified sequence opt2 from C12orf57__Homo_sapiens__NP_001288763
auggccuccgccuccacccagcccgccgcccucuccgccgagcaggccaaggucguccucgccgaggucauccaggccuucuccgcccccgagaacgccguccgcauggacgaggcccgcgacaacgccugcaacgacaugggcaagaugcuccaguucguccuccccgucgccacccagauccagcaggaggucaucaaggccuacggcuucuccugcgacggcgagggcguccucaaguucgcccgccucgucaaguccuacgaggcccaggaccccgagaucgccucccucuccggcaagcucaaggcccucuuccucccccccaugacccuccccccccacggccccgccgccggcggcuccgucgccgccuccuga

SEQ ID NO: 40492 - RNA, 813 nt, Artificial Sequence
  derived and/or modified sequence opt2 from C12orf5__Homo_sapiens__NP_065108
auggcccgcuucgcccucaccgucguccgccacggcgagacccgcuucaacaaggagaagaucauccagggccagggcgucgacgagccccucuccgagaccggcuucaagcaggccgccgccgccggcaucuuccucaacaacgucaaguucacccacgccuucuccuccgaccucaugcgcaccaagcagaccaugcacggcauccucgagcgcuccaaguucugcaaggacaugaccgucaaguacgacucccgccuccgcgagcgcaaguacggcgucgucgagggcaaggcccucuccgagcuccgcgccauggccaaggccgcccgcgaggagugccccgucuucaccccccccggcggcgagacccucgaccaggucaagaugcgcggcaucgacuucuucgaguuccucugccagcucauccucaaggaggccgaccagaaggagcaguucucccagggcucccccuccaacugccucgagaccucccucgccgagaucuucccccucggcaagaaccacuccuccaaggucaacuccgacuccggcauccccggccucgccgccuccguccucgucgucucccacggcgccuacaugcgcucccucuucgacuacuuccucaccgaccucaagugcucccuccccgccacccucucccgcuccgagcucauguccgucacccccaacaccggcaugucccucuucaucaucaacuucgaggagggccgcgaggucaagcccaccguccagugcaucugcaugaaccuccaggaccaccucaacggccucaccgagacccgcuga

SEQ ID NO: 40493 - RNA, 501 nt, Artificial Sequence
  derived and/or modified sequence opt2 from C12orf65__Homo_sapiens__NP_001181924
auguccaccgucggccucuuccacuuccccaccccccucacccgcaucugccccgcccccuggggccuccgccucugggagaagcucacccuccucucccccggcaucgccgucacccccguccagauggccggcaagaaggacuaccccgcccuccucucccucgacgagaacgagcucgaggagcaguucgucaagggccacggccccggcggccaggccaccaacaagaccuccaacugcgucguccucaagcacauccccuccggcaucgucgucaagugccaccagacccgcuccgucgaccagaaccgcaagcucgcccgcaagauccuccaggagaaggucgacgucuucuacaacggcgagaacucccccguccacaaggagaagcgcgaggccgccaagaagaagcaggagcgcaagaagcgcgccaaggagacccucgagaagaagaagcuccucaaggagcucugggaguccuccaagaagguccacuga

SEQ ID NO: 40494 - RNA, 1407 nt, Artificial Sequence
  derived and/or modified sequence opt2 from C12orf66__Homo_sapiens__NP_001287869
augggcgaguccaucccccucgccgcccccguccccgucgagcaggccguccucgagaccuucuucucccaccucggcaucuucuccuacgacaaggccaaggacaacgucgagaaggagcgcgaggccaacaaguccgccggcggcuccuggcucucccuccucgccgcccucgcccaccucgccgccgccgagaaggucuaccacucccucaccuaccucggccagaagcucggcggccaguccuucuucucccgcaaggacuccauccgcaccaucuacaccucccuccacaacgagcucaagaaggucgucaccggccgcggcgcccucggcggcaccgccccccacgucgaggagcuccucucccaccucuccgagcagcucugcuucuucguccaggcccgcauggagaucgccgacuucuacgagaagauguacacccucuccacccagaaguucaucaacgccgaggagcucgucggccuccucgacgccaucaugaagaaguacuccucccgcuuccaccaccccauccucuccccccucgaguccuccuuccagcucgaggucgacguccucugccaccuccucaaggcccaggcccaggucuccgaguggaaguuccuccccucccucgucaaccuccacuccgcccacaccaagcuccagaccuggggccagaucuucgagaagcagcgcgagaccaagaagcaccucuucggcggccagucccagaaggccguccagcccccccaccucuuccucuggcucaugaagcucaagaacaugcuccucgccaaguucuccuucuacuuccacgaggcccucucccgccagaccaccgccuccgagaugaagacccucaccgccaaggccaaccccgacuucuucggcaagaucuccuccuucauccgcaaguacgacgccgccaacgucucccucaucuucgacaaccgcggcuccgaguccuuccagggccacggcuaccaccacccccacuccuaccgcgaggcccccaagggcgucgaccaguaccccgccgucgucucccuccccuccgaccgccccgucaugcacuggcccaacgucaucaugaucaugaccgaccgcaccuccgaccucaacucccucgagaaggucguccacuucuacgacgacaagguccaguccaccuacuuccucacccgccccgagccccacuucaccaucgucaucaucuucgaguccaagaaguccgagcgcgacucccacuucaucuccuuccucaacgaggucucccucgcccucaagaaccccaaggucuucgccucccucaagcccggcuccaagggcuccugcuaccagugcaacuacuucgucgccuucugccucaacuacuccaagcuccuccuccagcgcaaguga

SEQ ID NO: 40495 - RNA, 192 nt, Artificial Sequence
  derived and/or modified sequence opt2 from C12orf75__Homo_sapiens__NP_001138671
augggcugcggcaacuccaccgccaccuccgccggcgccggccagggccccgccggcgccgccaaggacgucaccgaggaguccgucaccgaggacgacaagcgccgcaacuacggcggcgucuacgucggccuccccuccgaggccgucaacauggucuccucccagaccaagaccguccgcaagaacuga

SEQ ID NO: 40496 - RNA, 438 nt, Artificial Sequence
  derived and/or modified sequence opt2 from C12orf77__Homo_sapiens__NP_001094809
augauccccaagcucgccaccccccgcgacaucucccuccucgucaucaaggaggccuccucccgcgcccgcaacaacauccagauccucgacccccucgaccacaucgcccgccucaccaacuacacccucaccuccugcuucuccuccaacaagguccccaccaugcccggcucccuccccaccggcuccaagcagggcaacguccagacccucgacuccauccgcuggaugcccgccacccccguccccgcccccgagugccaccagaaguacgccaucuccaccgagaccgccuuccccacccucuccaccuucaugaacaccgagaaguccgucaagggcuccaacgccgacuucaccaagcgcaacccccgcuggcgcuuccucuucggcaucuacugcucccuccaccacgccaugaccaucuucaucuga

SEQ ID NO: 40497 - RNA, 735 nt, Artificial Sequence
  derived and/or modified sequence opt2 from C14orf166__Homo_sapiens__NP_057123
auguuccgccgcaagcucaccgcccucgacuaccacaaccccgccggcuucaacugcaaggacgagaccgaguuccgcaacuucaucgucuggcucgaggaccagaagauccgccacuacaagaucgaggaccgcggcaaccuccgcaacauccacuccuccgacuggcccaaguucuucgagaaguaccuccgcgacgucaacugccccuucaagauccaggaccgccaggaggccaucgacuggcuccucggccucgccguccgccucgaguacggcgacaacgccgagaaguacaaggaccucguccccgacaacuccaagaccgccgacaacgccaccaagaacgccgagccccucaucaaccucgacgucaacaaccccgacuucaaggccggcgucauggcccucgccaaccuccuccagauccagcgccacgacgacuaccucgucaugcucaaggccauccgcauccucguccaggagcgccucacccaggacgccgucgccaaggccaaccagaccaaggagggccuccccgucgcccucgacaagcacauccucggcuucgacaccggcgacgccguccucaacgaggccgcccagauccuccgccuccuccacaucgaggagcuccgcgagcuccagaccaagaucaacgaggccaucgucgccguccaggccaucaucgccgaccccaagaccgaccaccgccucggcaaggucggccgcuga

SEQ ID NO: 40498 - RNA, 378 nt, Artificial Sequence
  derived and/or modified sequence opt2 from C14orf177__Homo_sapiens__NP_872366
augcaccgcaaggagcccggcgcccgccucgaggccacccgcggcgccgcccgcccccacaagcagggcaccaagcccaugaucacccgccccuccgucucccagcucggcgagggcaagugccccuccucccagcaccuccagucccuccgccacaacaagcagcacgcccucacccucaccaaggcccgcugcugcggcgagugcuccaccugcuucugcaccgaggagaaguccgagugccagcgccacgaggagaccucccccggcuccugcaaccaccagaucauguccgccuccaccaucuccgccuucugcgccaccccccgcuucaagcagcucuucaagggcaccgucgagcagaugucccagauguga

SEQ ID NO: 40499 - RNA, 423 nt, Artificial Sequence
  derived and/or modified sequence opt2 from C14orf1__Homo_sapiens__NP_009107
augucccgcuuccucaacguccuccgcuccuggcucgucauggucuccaucaucgccaugggcaacacccuccaguccuuccgcgaccacaccuuccucuacgagaagcucuacaccggcaagcccaaccucgucaacggccuccaggcccgcaccuucggcaucuggacccuccucuccuccgucauccgcugccucugcgccaucgacauccacaacaagacccucuaccacaucacccucuggaccuuccuccucgcccucggccacuuccucuccgagcucuucgucuacggcaccgccgcccccaccaucggcguccucgccccccucauggucgccuccuucuccauccucggcaugcucgucggccuccgcuaccucgaggucgagcccgucucccgccagaagaagcgcaacuga

SEQ ID NO: 40500 - RNA, 537 nt, Artificial Sequence
  derived and/or modified sequence opt2 from C15orf32__Homo_sapiens__NP_694585
augaacaagcgcaccuccgucgacgccuccaaggaggaccuccaccccgccgacccccaguccggcgagggcgucccccccaaccgcaagaacaccaagaccuccccccgcggcgagggcaccgccccccccuucuccgcccgccccugcgucuggacccucugcgagaugcucuccauccucgcccucgucggcguccuccaccccuucuaccgcuccaacaaccaggucuaccagaagcucaagacccaccuccgcugccaguccucccgcgucgacggccucaugcucaagcccacccuccucacccccucccagcucaagucccccgagggccaccucauccuccccaccuucaaccaccucgucauccgccacauccucgaccccaagcagaucuucugcgucgccgacgucugcaccgacugcaaguucaacugcggcuccaucgagcgccaccagaagcgccaccucaugcgcgucucccaggacugggagcaccucauccgcuaccgcaaccagaucugccucuccuga

SEQ ID NO: 40501 - RNA, 846 nt, Artificial Sequence
  derived and/or modified sequence opt2 from C15orf41__Homo_sapiens__XP_011520412
augauccucaccaaggcccaguacgacgagaucgcccagugccucgucuccgucccccccacccgccagucccuccgcaagcucaagcagcgcuuccccucccagucccaggccacccuccucuccaucuucucccaggaguaccagaagcacaucaagcgcacccacgccaagcaccacaccuccgaggccaucgaguccuacuaccagcgcuaccucaacggcgucgucaagaacggcgccgcccccguccuccucgaccucgccaacgaggucgacuacgcccccucccucauggcccgccucauccucgagcgcuuccuccaggagcacgaggagaccccccccuccaaguccaucaucaacuccaugcuccgcgaccccucccagauccccgacggcguccucgccaaccaggucuaccagugcaucgucaacgacugcugcuacggcccccucgucgacugcaucaagcacgccaucggccacgagcacgagguccuccuccgcgaccuccuccucgagaagaaccucuccuuccucgacgaggaccagcuccgcgccaagggcuacgacaagacccccgacuucauccuccagguccccgucgccgucgagggccacaucauccacuggaucgaguccaaggccuccuucggcgacgagugcucccaccacgccuaccuccacgaccaguucugguccuacuggaaccgcuucggccccggccucgucaucuacugguacggcuucauccaggagcucgacugcaaccgcgagcgcggcauccuccucaaggccugcuuccccaccaacaucgucacccucugccacuccaucgccuga

SEQ ID NO: 40502 - RNA, 252 nt, Artificial Sequence
  derived and/or modified sequence opt2 from C15orf48__Homo_sapiens__NP_922946
auguccuucuuccagcuccucaugaagcgcaaggagcucaucccccucgucgucuucaugaccgucgccgccggcggcgccuccuccuucgccgucuacucccucuggaagaccgacgucauccucgaccgcaagaagaaccccgagcccugggagaccgucgaccccaccgucccccagaagcucaucaccaucaaccagcaguggaagcccaucgaggagcuccagaacguccagcgcgucaccaaguga

SEQ ID NO: 40503 - RNA, 540 nt, Artificial Sequence
  derived and/or modified sequence opt2 from C15orf53__Homo_sapiens__NP_997327
auggagcuccagggcgcccaggaggaccucggcaucucccucuccuccccccgccgcaaccacgagacccgccccggcuccaaggccaagggccgcuccuccaucugccuccaggccuccgucuggauggccggcggcaagcuccgccuccgcgccuccgagcaccucacccagggccaccagcaggagcuccgcgacuggaaccucggcgaggacgccucccuccucuucuccaagucccccuucggcgccggcaagcucauccaggcccccgcccacgucuuccgccagugcuggguccagggcaacgccuggaucuccugcaucaccaaguucgacuccaagcgcucccccgaggucgccuccucccccuccuaccucaccgucccccgccgcuccccccuccccgucuuccuccgccccuccgaccgcugcgucugcggcggcugcuaccucggcaaguccacccgccgccgcgccugccagucccuccucuccgacccccucggcgucaccuuccccacccagacccgccccuga

SEQ ID NO: 40504 - RNA, 882 nt, Artificial Sequence
  derived and/or modified sequence opt2 from C15orf59__Homo_sapiens__XP_005254426
augaacauccgcggcgcccccgaccucggccagcccuccgacgaccccuccuccggcggcgagcgcgagcgcauccgccagcgcaugaagauggucaucggccagcucgagggcauccuccgcgagcucaaggaggucgccaaggagcuccgcgaggucgucucccagaucgacaagcucaccuccgacuucgacuucgagcucgagcccgacgacuggaccaccgccaccgucuccuccaccuccuccuccgacaaggccggcaugggcggccccuucgaccucggccaccucgacuucaugaccgccgacauccucuccgacuccugggaguucugcuccuuccucgacgucuccacccccuccgacuccgucgacggccccgaguccacccgccccggcgccggccccgacuaccgccucaugaacggcggcacccccauccccaacggcccccgcgucgagacccccgacuccuccuccgaggaggccuucggcgccggccccaccgucaagucccagcucccccagcgcacccccggcacccgcgagcgcguccgcuucuccgacaagguccucuaccacgcccucugcugcgacgacgaggagggcgacggcgagcaggaggucgaggaggaggaggucggccucccccccgagcccgcccacaccgaggcccacgccggcccccacaagcccucccccgcccccuacaagucccgccgcuccccccucaccucccgccacuccggcuccacccucgcccccgagcagacccgccgcgucacccgcaacuccuccacccagaccgucuccgacaaguccacccagaccguccuccccuacaccgccacccgccagaaggcccgcggcaagaacuga

SEQ ID NO: 40505 - RNA, 828 nt, Artificial Sequence
  derived and/or modified sequence opt2 from C16orf72__Homo_sapiens__NP_054836
auggaggagcgcaaggaggagggcgaggccgagauccaggagcacggccccgagcacugguucuccaagugggagcgccagugccucgccgaggccgagcaggacgagcagcucccccccgagcuccaggaggaggccgccgccgccgcccagcccgagcacaagcagcagaagcucuggcaccucuuccagaacuccgccaccgccgucgcccagcucuacaaggaccgcgucugccagcagcccggccucucccucuggguccccuuccagaacgccgccaccgccgucaccaaccucuacaaggaguccgucgacacccaccagcgcuccuucgacaucggcauccagaucggcuaccagcgccgcaacaaggacguccucgccugggucaagaagcgccgccgcaccauccgccgcgaggaccucaucuccuuccucugcggcaaggucccccccccccgcaacucccgcgcccccccccgccucaccgucgucucccccaaccgcgccaccuccaccgagaccuccuccuccgucgagaccgaccuccagcccuuccgcgaggccaucgcccuccacggccucuccggcgccauggccuccaucuccguccgcuccuccacccccggcucccccacccacgucuccuccggcuccaacgccucccgccgccgcaacggccuccacgacgucgaccucaacaccuucaucuccgaggagauggcccuccaccucgacaacggcggcacccgcaagcgcaccuccgcccagugcggcgacgucaucaccgacucccccacccacaagcgcaaccgcaugaucuga

SEQ ID NO: 40506 - RNA, 231 nt, Artificial Sequence
  derived and/or modified sequence opt2 from C16orf74__Homo_sapiens__NP_996850
augggccucaagauguccugccucaagggcuuccagaugugcgucuccuccuccuccuccucccacgacgaggcccccguccucaacgacaagcaccucgacguccccgacaucaucaucaccccccccacccccaccggcaugaugcucccccgcgaccucggcuccaccgucuggcucgacgagaccggcuccugccccgacgacggcgagaucgaccccgaggccuga

SEQ ID NO: 40507 - RNA, 798 nt, Artificial Sequence
  derived and/or modified sequence opt2 from C16orf78__Homo_sapiens__NP_653203
auguccgagcagcagauggaccucaaggaccucaugcccaccaagcgcaaguacauguggaagaccgccgaggaccgccgcauguccgaccucaccugcguccucgaguggcucgagcgccgccagggcaagaagaagcaggcccccgagaagcagaagcccaaggucgucaccguccucaagcgcaacaagaagaaggaggagaagaagggcaagggccucaugaccgcccgcggcggcaaccgccgcgacaccgagaccucccagcaggcccucggcaagcgcuuccgcaaggacgccgccuccuaccgcucccucuacggcgucgagcagaagggcaagcaccucuccaugguccccggcuccuacaucaaggacggccccaagaaguccgacaccgacaucaaggacgccgucgaccccgaguccacccagcgccccaaccccuuccgccgccaguccaucguccucgaccccaugcuccaggagggcaccuucaacucccagcgcgccaccuucauccgcgacugguccaacaagaugcccgacauggccuacgagcgcaagcucaagucccucauggagaaguccaccgagcccaagauggagaccaugcgcaugcucaagcccgaggagguccucuccugccgcuaccuccgccucuccaaggagaacauccgcacccuccucaagcucugcaaggacgccggcaugaacgucgacauccacccccacauggucgaggaggacaucgacgccaagaaggucuucaccggcauccccuccauggcccucuga

SEQ ID NO: 40508 - RNA, 720 nt, Artificial Sequence
  derived and/or modified sequence opt2 from C16orf95__Homo_sapiens__NP_001182053
augcgcgccucccgcuccccccccuccccccgccgcugccaccaccaccacgaggccaccggcgccgccuccggcgccgccgccggcggccccggcgccggcugcgucggccucugccgccucgcccucacccccuccgcccaggacggccgcaacuccaccuuccagaccuacaagaaggaggucugccucccccgccacuccaugcaccccggccccugggccaucugcugcgagugccagacccgcuucggcggccgccuccccgucucccgcgucgaggccgcccuccccuacugggucccccucucccuccgcccccgcaagcagucccagaagaccguccaguuccccaucccccagaccgccaagaugugccccugccucugccaccgcuucggcggccgccuccccaugccccgcgaccaggccgucaugcccuacugggucccccagguccuccgcucccagcagcagaucguccgccgccagcagucccucaagggcauccaggccccccuccucgacgccugcugcuggcacaacugcuggcgcaucugcggcgacgagugccuccucuccaaguuccagcagcuccaggcccccuaccaggaccagcuccccgcccccgccgcccgccuccucccccucggccuccucacccuccuccaggccaucccccgcgucaucauggccauccgccagugcuucggcgucuga

SEQ ID NO: 40509 - RNA, 666 nt, Artificial Sequence
  derived and/or modified sequence opt2 from C17orf51__Homo_sapiens__NP_001106905
augggcgagaagucccgccgcaagggccccgccccccgccacgccgacggcaagcucggccgcaccugcgaccaccccuacgcccccugguccuucacccccuccucccgcgcccccaccgccuggguccgcccccccugccccgucugggccucccgccuccaggagcacucccccgagccccgccgcgcccgcgccccccccacccgccgcgcccaggccgcccucuacgcccccgcccuccgccuccgcgaccaccucgaccgcuucuccauccucaugaccuccugcaccuccuggcuccaggccccccaggcccccggccucugccgcgacgagcaguccucccgcaucuccgucccccagcucuccggcgcccccauccuccuccccgaccucgagggcaccaagcucuccaacuuccaggaguccuccccccucccccacaagcacgagcgcaaggacaagcgcuccacccccgaggaggagggccgcuccgcccccgagaagaucauccagucccucaagcucugccccggcggccaccgccccgccucccucuccuccggcugccccgccggcugccgccucuccuucaaccucccccccuccaugcuccucuccguccagaagugcugcaugcccuccucccucaagaccugcuga

SEQ ID NO: 40510 - RNA, 1944 nt, Artificial Sequence
  derived and/or modified sequence opt2 from C17orf53__Homo_sapiens__NP_076937
auggccugcucccuccagaagcucuucgccgucgaggaggaguucgaggacgaggacuuccucuccgccgucgaggacgccgagaaccgcuucaccggcucccuccccgucaacgccggccgccuccgccccgucuccucccgcccccaggagaccguccaggcccaguccucccgccuccuccuccuccaccccaccgcccccuccgaggcccucggccuccccgaccucgaccucugccuccccgccuccuccacccccuccgccgacucccgccccuccugcaucggcgccgccccccuccgccccgucuccaccuccuccuccuggaucggcaaccagcgccgcgucaccgucaccgagguccuccgcgagaccgcccgcccccaguccuccgcccuccacccccuccucaccuucgagucccagcagcagcaggucggcggcuucgagggccccgagcaggacgaguucgacaagguccucgccuccauggagcucgaggagcccggcauggagcucgagugcggcgucuccuccgaggccauccccauccuccccgcccagcagcgcgagggcuccguccucgccaagaaggcccgcgucgucgaccucuccggcuccugccagaagggccccguccccgccauccacaaggccggcaucauguccgcccaggacgagucccucgaccccgucauccagugccgcaccccccgccccccccuccgccccggcgccgucggccaccuccccguccccaccgcccucaccguccccacccagcagcuccacugggaggucugcccccagcgcucccccguccaggcccuccagccccuccaggccgcccgcggcaccauccaguccuccccccagaaccgcuuccccugccagcccuuccagucccccuccuccuggcucuccggcaaggcccaccucccccgcccccgcacccccaacuccuccugcuccacccccucccgcaccuccuccggccucuucccccgcaucccccuccagccccaggcccccgucuccuccaucggcucccccgucggcacccccaagggcccccagggcgcccuccagacccccaucgucaccaaccaccucguccagcucgucaccgccgccucccgcaccccccagcagcccacccaccccuccacccgcgccaagacccgccgcuuccccggccccgccggcauccucccccaccagcaguccggccgcucccucgaggacaucauggucuccgccccccagacccccacccacggcgcccucgccaaguuccagaccgagaucgucgccuccucccaggccuccgucgaggaggacuucggccgcggccccuggcucaccaugaaguccacccucggccucgacgagcgcgaccccuccugcuuccucugcaccuacuccaucgucaugguccuccgcaagcaggccgcccucaagcagcucccccgcaacaagguccccaacauggccgucaugaucaagucccucacccgcuccaccauggacgccuccgucgucuucaaggaccccaccggcgagaugcagggcaccguccaccgccuccuccucgagaccugccagaacgagcucaagcccggcuccguccuccuccucaagcagaucggcgucuucucccccucccuccgcaaccacuaccucaacgucacccccaacaaccucguccacaucuacucccccgacuccggcgacggcuccuuccucaagcccucccagcccuuccccaaggacuccggcuccuuccagcacgacgucgccgccaagcccgaggagggcuuccgcaccgcccagaaccucgaggccgaggccucccccgaggaggagcuccccgaggccgacgaccucgacggccuccucuccgagcuccccgaggacuucuucugcggcaccuccuccuga

SEQ ID NO: 40511 - RNA, 711 nt, Artificial Sequence
  derived and/or modified sequence opt2 from C17orf64__Homo_sapiens__NP_859058
auggaggccuccgacggccagggcggcgagggcgacaagccccucgagcaggucaccaacgucuccugccucgagaccuccuccuccgccucccccgcccgcgacucccucaugcgccacgccaagggccucgaccaggacaccuucaagaccugcaaggaguaccuccgcccccucaagaaguuccuccgcaagcuccaccucccccgcgaccucccccagaagaagaagcucaaguacaugaagcagucccucgucguccucggcgaccacaucaacaccuuccuccagcacuacugccaggccugggagaucaagcacuggcgcaagaugcucuggcgcuucaucucccucuucuccgagcucgaggccaagcagcuccgccgccucuacaaguacaccaaguccucccagcccgccaaguuccucgucaccuucugcgccuccgacgcccccgagcgcucccuccucgccgaccgcgaggacucccuccccaagcucugccacgccuggggccuccacuccaacaucuccggcaugaaggagcgccucuccaacaugcagacccccggccagggcuccccccuccccggccagccccgcucccaggaccacgucaagaaggacucccuccgcgagcucucccagaagcccaagcucaagcgcaagcgcaucaaggaggcccccgagacccccgagaccgagcccuga

SEQ ID NO: 40512 - RNA, 1140 nt, Artificial Sequence
  derived and/or modified sequence opt2 from C17orf96__Homo_sapiens__NP_001124149
auggagacccucugccccgccccccgccucgccguccccgccuccccccgcggcucccccugcucccccaccccccgcaagcccugccgcggcacccaggaguucuccccccucugccuccgcgcccucgccuucugcgcccucgccaagccccgcgccuccucccucggccccggccccggcgagcucgccgcccgcucccccguccuccgcggcccccaggccccccuccgccccggcggcugggcccccgacggccucaagcaccucugggcccccaccggccgccccggcguccccaacaccgccgccggcgaggacgccgacgucgccgccugcccccgccgcggcgaggaggaggagggcggcggcggcuucccccacuucggcguccgcuccugcgccccccccggccgcugccccgcccccccccacccccgcgaguccaccaccuccuucgccuccgcccccccccgccccgcccccggccucgagccccagcgcggccccgccgccucccccccccaggagcccuccucccgcccccccuccccccccgccggccucuccaccgagcccgccggccccggcaccgccccccgccccuuccuccccggccagcccgccgaggucgacggcaaccccccccccgccgcccccgaggcccccgccgccucccccuccaccgccucccccgcccccgccgcccccggcgaccuccgccaggagcacuucgaccgccucauccgccgcuccaagcucuggugcuacgccaagggcuucgcccucgacacccccucccuccgccgcggccccgagcgcccccccgccaagggccccgcccgcggcgccgccaagaagcgccgccuccccgccccccccccccgcaccgcccagccccgccgccccgcccccacccuccccaccaccuccaccuucucccuccucaacugcuuccccugcccccccgcccucgucgucggcgaggacggcgaccucaagcccgccuccucccuccgccuccagggcgacuccaagcccccccccgcccacccccucuggcgcuggcagaugggcggccccgccguccccgagccccccggccucaaguucuggggcaucaacauggacgaguccuga

SEQ ID NO: 40513 - RNA, 1602 nt, Artificial Sequence
  derived and/or modified sequence opt2 from C18orf54__Homo_sapiens__NP_001275909
auggccaaguccaagaccaagcaccgccucugcucccaggaguccuccgucuccgcccuccucgccuccugcacccucuccggcuccaacuccuccaacuccgacggcuccuuccacuacaaggacaagcucuaccgcuccgccucccaggcccuccaggccuacaucgacgacuucgaccucggccagaucuaccccggcgccuccaccggcaagaucaacaucgacgaggacuucaccaacaugucccaguucugcaacuacaucuacaagcccaacaacgccuucgagaaccucgaccacaagaagcacuccaacuucaucuccugccgccgccacaccgucaacgacaucgacuccaugucccucaccaccgacgaccuccuccgccuccccgccgacggcuccuucuccuacaccuacgucggccccucccaccgcaccuccaagaagaacaagaagugccgcggccgccucggcucccucgacaucgagaagaacccccacuuccagggccccuacaccuccaugggcaaggacaacuucgucacccccgucauccgcuccaacaucaacggcaagcagugcggccgccucaagaaccccaagcucaugaaccgcaccaacaacugcaucuccgaguccucccucuccuuccccaagaaguccuccuucaaggacuccuccgagcacucccucgagaagaacuacccccgcuggcucaccucccagaaguccgaccucaacgucuccggcaucaccuccauccccgacuucaaguaccccgucuggcuccacaaccaggaccuccuccccgacgccaacucccagcgcgucuaccagaucuucaaggacgaccagugcuccccccgccacucccaccaggcccagggcaccucccgccucaucaacaagcucgacugcuucgaguacgccuucgagcccuccaacuucuccaacucccucuccgacgacaaggagcucgucaacgaguacaagugcgacuucgagcacucccagugccagugcgagaacccccuccuccccggccaguccaccaagcccuucuccggcgacaagaucgagcuccucauccucaaggccaagcgcaaccucgagcagugcaccgaggagcuccccaaguccaugaagaaggacgacucccccugcucccucgacaagcucgaggccgaccgcuccugggagaacauccccgucaccuucaagucccccguccccgucaacuccgacgacuccccccagcagaccucccgcgccaaguccgccaagggcguccucgaggacuuccucaacaacgacaaccaguccugcacccucuccggcggcaagcaccacggccccgucgaggcccucaagcagaugcucuucaaccuccaggccguccaggagcgcuucaaccagaacaagaccaccgaccccaaggaggagaucaagcaggucuccgaggacgacuucuccaagcuccagcucaaggaguccaugauccccaucacccgcucccuccagaaggcccuccaccaccucucccgccuccgcgaccucgucgacgacaccaacggcgagcgcucccccaagauguga

SEQ ID NO: 40514 - RNA, 1686 nt, Artificial Sequence
  derived and/or modified sequence opt2 from C18orf8__Homo_sapiens__NP_001263271
augggcgaggaggacuacuaccucgagcucugcgagcgccccguccaguucgagaaggccaaccccgucaacugcgucuucuucgacgaggccaacaagcaggucuucgccguccgcuccggcggcgccaccggcgucgucgucaagggccccgacgaccgcaaccccaucuccuuccgcauggacgacaagggcgaggucaagugcaucaaguucucccucgagaacaagauccucgccguccagcgcaccuccaagaccgucguccuccccgagaagcgcucccucaagcuccucaagucccacaaccucaacgucaacugguacauguacugccccgaguccgccgucauccuccucuccaccaccguccucgagaacguccuccagcccuuccacuuccgcgccggcaccauguccaagcuccccaaguucgagaucgagcuccccgccgcccccaaguccaccaagcccucccucuccgagcgcgacaucgccauggccaccaucuacggccagcucuacguccucuuccuccgccaccacucccgcaccuccaacuccaccggcgccgaggucguccucuaccaccucccccgcgagggcgccugcaagaagaugcacauccucaagcucaaccgcaccggcaaguucgcccucaacgucgucgacaaccucgucgucguccaccaccaggacaccgagaccuccgucaucuucgacaucaagcuccgcggcgaguucgacggcuccgucaccuuccaccaccccguccuccccgcccgcuccauccagcccuaccagauccccaucaccggccccgccgccgucaccucccagucccccguccccugcaagcucuacuccuccuccuggaucgucuuccagcccgacaucaucaucuccgccucccagggcuaccucuggaaccuccaggucaagcucgagcccaucgucaaccuccuccccgacaagggccgccucauggacuuccuccuccagcgcaaggagugcaagauggucauccucuccgucugcucccagaugcucuccgaguccgaccgcgccucccuccccgucaucgccaccgucuucgacaagcucaaccacgaguacaagaaguaccucgacgccgagcaguccuacgccauggccgucgaggccggccagucccgcuccuccccccuccucaagcgccccguccgcacccaggccguccucgaccaguccgacgucuacacccacguccucuccgccuucgucgagaagaaggagaugccccacaaguucgucaucgccguccucauggaguacauccgcucccucaaccaguuccagaucgccguccagcacuaccuccacgagcucgucaucaagacccucguccagcacaaccucuucuacaugcuccaccaguuccuccaguaccacguccucuccgacuccaagccccucgccugccuccuccucucccucgaguccuucuacccccccgcccaccagcucucccucgacaugcucaagaugcuccagucccgccucaagaccaccugcuucuccauccaguacuccgccuuccucaacuccgagaccuccgucugcgagggcgcccccaucucccaccagggcaacaccgucaagaacaugcuccucuucuccaaccgcuuccucgagaccaagcucuga

SEQ ID NO: 40515 - RNA, 459 nt, Artificial Sequence
  derived and/or modified sequence opt2 from C19orf12__Homo_sapiens__NP_001026896
auggagcgccucaagucccacaagcccgccaccaugaccaucauggucgaggacaucaugaagcuccucugcucccucuccggcgagcgcaagaugaaggccgccgucaagcacuccggcaagggcgcccucgucaccggcgccauggccuucgucggcggccucgucggcggcccccccggccucgccgucggcggcgccgucggcggccuccucggcgccuggaugaccuccggccaguucaagcccgucccccagauccucauggagcucccccccgccgagcagcagcgccucuucaacgaggccgccgccaucauccgccaccucgaguggaccgacgccguccagcucaccgcccucgucaugggcuccgaggcccuccagcagcagcuccucgccaugcucgucaacuacgucaccaaggagcuccgcgccgagauccaguacgacgacuga

SEQ ID NO: 40516 - RNA, 648 nt, Artificial Sequence
  derived and/or modified sequence opt2 from C19orf18__Homo_sapiens__NP_689687
auggacaagguccaguccggcuuccucauccucuuccucuuccucauggagugccagcuccaccucugccuccccuacgccgacggccuccaccccaccggcaacaucaccggccuccccggcuccaagcgcucccagcccccccgcaacaucaccaaggagcccaaggucuucuuccacaagacccagcuccccggcauccagggcgccgccucccgcuccaccgccgccucccccaccaaccccaugaaguuccuccgcaacaaggccaucauccgccaccgccccgcccucgucaaggucauccucaucuccuccgucgccuucuccaucgcccucaucugcggcauggccaucuccuacaugaucuaccgccucgcccaggccgaggagcgccagcagcucgagucccucuacaagaaccuccgcaucccccuccucggcgacgaggaggagggcuccgaggacgagggcgaguccacccaccuccuccccgagaacgagaacgagcucgagaaguucauccacuccgucaucaucuccaagcgcuccaagaacaucaagaagaagcucaaggaggagcagaacuccgucaccgagaacaagaccaagaacgccucccacaacggcaagauggaggaccucuga

SEQ ID NO: 40517 - RNA, 399 nt, Artificial Sequence
  derived and/or modified sequence opt2 from C19orf24__Homo_sapiens__NP_060384
augggcccccgcguccuccagcccccccuccuccuccuccuccucgcccuccuccucgccgcccuccccugcggcgccgaggaggccuccccccuccgccccgcccaggucacccucucccccccccccgccgucaccaacggcucccagcccggcgccccccacaacuccacccacacccgcccccccggcgccuccggcuccgcccucacccgcuccuucuacgucauccucggcuucugcggccucaccgcccucuacuuccucauccgcgccuuccgccucaagaagccccagcgccgccgcuacggccuccucgccaacaccgaggaccccaccgagauggccucccucgacuccgacgaggagaccgucuucgagucccgcaaccuccgcuga

SEQ ID NO: 40518 - RNA, 1362 nt, Artificial Sequence
  derived and/or modified sequence opt2 from C19orf26__Homo_sapiens__NP_689982
augcagcccaccgccaccauggccaccgccgccaccaccaccaccaccaccaccgccaccgucgcccucaccaccuccugggacaacgccaccggccgccccaccgccgagcccgaccccauccucgacaacuacguccuccucgucgucgucaugucccucuucgucggcggcacccucgucguccucuccggcguccuccuccucugcaagcgcugcugggacguccaccagcgccucaaccgcgccauggaggaggccgagaagaccaccaccaccuaccucgacaacggcacccaccccgcccaggaccccgacuuccgcggcgaggaccccgagugccaggacgccgagaccgagcgcuuccucuccaccuccuccaccggccgccgcgucuccuucaacgaggccgcccucuucgagcagucccgcaagacccaggacaagggccgccgcuacacccucaccgagggcgacuuccaccaccucaagaacgcccgccucacccaccuccaccuccccccccucaagaucgucaccauccacgagugcgacuccggcgaggccuccuccgccaccaccccccaccccgccaccucccccaaggccacccucgccaucuuccagccccccggcaaggcccucaccggccgcuccgucggccccuccuccgcccuccccggcgaccccuacaacuccgccgccggcgccaccgacuucgccgagaucucccccuccgccuccuccgacuccggcgagggcaccucccucgacgccggcacccgcuccaccaaggccggcggccccggcgccgccgccggccccggcgaggccggccccggcuccggcgccggcaccguccuccaguuccucacccgccuccgccgccacgccucccucgacggcgccucccccuacuucaaggucaagaaguggaagcucgagcccucccagcgcgccgccucccucgacacccgcggcucccccaagcgccaccacuuccagcgccagcgcgccgccuccgaguccaccgagcaggaggagggcgacgccccccaggaggacuucauccaguacaucgcccgcgccggcgacgccgucgccuucccccacccccgccccuuccucgccucccccccccccgcccucggccgcuacuucuccgucgacggcggcgcccgcggcggccccgucggccccugcccccccuccccccccccccgccgcccccgcgagcgcucccccggccccgucgacacccgcucccccgccuccuccggcaaggcccccccccgcggcggccucaccggcgccaccucccccgccuggacccgcggcggcaagcagggcgagaccggcuga

SEQ ID NO: 40519 - RNA, 321 nt, Artificial Sequence
  derived and/or modified sequence opt2 from C19orf33__Homo_sapiens__NP_277055
auggaguucgaccucggcgccgcccucgagcccaccucccagaagcccggcgucggcgccggccacggcggcgaccccaagcucuccccccacaagguccagggccgcuccgaggccggcgccggccccggccccaagcagggccaccacuccuccuccgacuccuccuccuccuccuccgacuccgacaccgacgucaagucccacgccgccggcuccaagcagcacgaguccauccccggcaaggccaagaagcccaaggucaagaagaaggagaagggcaagaaggagaagggcaagaagaaggaggccccccacuga

SEQ ID NO: 40520 - RNA, 648 nt, Artificial Sequence
  derived and/or modified sequence opt2 from C19orf40__Homo_sapiens__NP_689479
auggagaagaacccccccgacgacaccggccccguccacgucccccucggccacaucgucgccaacgagaaguggcgcggcucccagcucgcccaggagaugcagggcaagaucaagcucaucuucgaggacggccucacccccgacuucuaccucuccaaccgcugcugcauccucuacgucaccgaggccgaccucgucgccggcaacggcuaccgcaagcgccucguccgcguccgcaacuccaacaaccucaagggcaucgucgucgucgagaagacccgcauguccgagcaguacuuccccgcccuccagaaguucaccguccucgaccucggcaugguccuccuccccgucgccucccagauggaggccuccugccucgucauccagcucguccaggagcagaccaaggagcccuccaagaacccccuccucggcaagaagcgcgcccuccuccucuccgagcccucccuccuccgcaccguccagcagauccccggcgucggcaaggucaaggccccccuccuccuccagaaguuccccuccauccagcagcucuccaacgccuccaucggcgagcucgagcaggucgucggccaggccgucgcccagcagauccacgccuucuucacccagccccgcuga

SEQ ID NO: 40521 - RNA, 1518 nt, Artificial Sequence
  derived and/or modified sequence opt2 from C19orf45__Homo_sapiens__XP_011526294
auggccaccggcgcccuccuccccugcucccgccccugccccaugucccgccucgacuuccucaaggccucccacuucucccucggccccgaccuccgccuccacgagggcaccaugcgcaccaccucccaccgcgacuucgccuaccccgccgccacccgcgagccccccucccuccagcccccccccgcccuccucuuccccauggacccccgcugggaccgcgaggagcgcgucuccgaggcccaccgcgccuuccccccccccuccaccccccccugggagcuccuccaggcccaggcccgcgagcgcacccucgccaugcaggccggcaaccuccaccuccacgaggacgcccacgccggcaucggccucuccaacgcccacgccgccuacggcuggcccgagcuccccgcccgcacccgcgagcgcauccgcggcgcccgccucaucuucgaccgcgacucccucccccccggcgaccgcgacaagcuccgcaucccccccaccacccaccaggcccucuuccccccccacgacgcccgcccccagccccgcgcccccuccugccaccucggcggccccaacacccucaagugggacuacacccgccaggacggcaccuccuaccagcgccaguuccaggcccuccccggcccccccgcccuccgcugcaagcgcgccuccuccggcgucgagcucggcgacugcaagaucuccuacggcuccaccugcuccgagcagaagcaggccuaccgcccccaggaccuccccgaggaccgcuacgacaaggcccaggccaccgcccacauccacugcgucaacauccgccccggcgacggccucuuccgcgaccgcaccaccaaggccgagcacuucuacgcccgcgagcccgagcccuucguccuccaccacgaccagacccccgagucccacauccucaagggcaacuggugccccggccccggcucccucgacaccuucaugcaguacuucuacggccagccccccccccccacccagccccccucccgccacgucccccacgagaagcuccagucccacgucacccucggcgagcccaagcuccucaagcgcuucuucaagaccaccaugggcuccgacuacugccccuccgaguggcgccagguccagaaggcccccaaccuccaccuccagcaguccuaccucccccgcggcaccggcgaguucgacuuccucaccaugaaccagaagaugcucaagccccaccgcaccccccccgcccccgucaccgaggagaugcuccagcgcugcaaguacucccacauggagcccccccucggcggccuccgcuucuucuccacccaguacaaggacgaguuccccuucaaguaccagggccccgccgcccuccgccucaagaacccccaggagggcuucgucccccucggcaccccccaccagcgcggcugccgcgagaagaucgacccccucgucccccagccccccauguaccucugccccucccagcaguga

SEQ ID NO: 40522 - RNA, 354 nt, Artificial Sequence
  derived and/or modified sequence opt2 from C19orf48__Homo_sapiens__NP_001277083
augaccguccucgaggccguccucgagauccaggccaucaccggcucccgccuccucuccaugguccccggccccgcccgcccccccggcuccugcugggaccccacccagugcacccgcaccuggcuccucucccacaccccccgccgccgcuggaucuccggccucccccgcgccuccugccgccucggcgaggagccccccccccuccccuacugcgaccaggccuacggcgaggagcucuccauccgccaccgcgagaccugggccuggcucucccgcaccgacaccgccuggcccggcgcccccggcgucaagcaggcccgcauccucggcgagcuccuccucgucuga

SEQ ID NO: 40523 - RNA, 1914 nt, Artificial Sequence
  derived and/or modified sequence opt2 from C19orf57__Homo_sapiens__NP_077299
augaccaagcgcaagaagcuccgcaccuccggcgagggccucugcccccccaagccccucaagaacccccgccucggcgacuucuacggcgacccccaguccuccaugcucggcugccuccaccaccccgaggagcccgagggcaagcucggccccguccccuccacccagcagcacggcgaggagcccggcaaggccgucuccuccucccccgacgaggagaccggcucccccugccgccuccuccgccagcccgagaaggagcccgccccccucccccccucccagaacuccuucggccgcuucgucccccaguucgccaagucccgcaagaccgucacccgcaaggaggagaugaaggacgaggaccgcggcuccggcgccuucucccucgagaccaucgccgaguccuccgcccagucccccggcugccagcuccucgucgagacccucggcgucccccuccaggaggccaccgagcucggcgaccccacccaggccgacuccgcccgccccgagcaguccucccagucccccguccaggccguccccggcuccggcgacucccagcccgacgacccccccgaccgcggcaccggccucuccgccucccagcgcgccucccaggaccaccucuccgagcagggcgccgacgacuccaagcccgagaccgaccgcguccccggcgacggcggccagaaggagcaccuccccuccaucgacuccgagggcgagaagcccgaccgcggcgccccccaggagggcggcgcccagcgcaccgccggcgccggccuccccggcggcccccaggaggagggcgacggcguccccugcacccccgccuccgcccccaccuccggccccgcccccggccucggccccgccuccuggugccucgagcccggcuccgucgcccagggcucccccgacccccagcagacccccucccgcaugggccgcgagggcgagggcacccacuccucccucggcugcuccucccucggcauggucgucaucgccgaccucuccaccgaccccaccgagcucgaggagcgcgcccucgaggucgccggccccgacggccaggccuccgccaucucccccgccuccccccgccgcaaggccgccgacggcggccaccgccgcgcccuccccggcugcaccucccucaccggcgagaccaccggcgaguccggcgaggccggccaggacggcaagccccccggcgacguccucgucggccccaccgccucccucgcccucgcccccggcuccggcgaguccaugaugggcgccggcgacuccggccacgccucccccgacaccggccccugcgucaaccagaagcaggagcccggccccgcccaggaggaggccgagcucggcggccagaaccucgagcgcgaccucgagggcuuccgcgucuccccccaggccuccgucguccucgagcaccgcgagaucgccgacgacccccuccaggagcccggcgcccagcagggcauccccgacaccaccuccgagcucgccggccagcgcgaccaccucccccacuccgccgaccagggcaccugggccgacucccucgccgucgagcucgacuuccuccucgacucccagauccaggacgcccucgacgccuccgacuucgaggccccccccgagcagcucuuccccuccggcaacaagcccggccccugcuggcccggccccuccucccacgccaacggcgaccccgucgccgucgccaaggcccagcccucccgccucaucaugggcacccaccgcgaccucgaggccuucaagcgccucaacuaccgcaagaccaagcucggcggcaaggccccccuccccuaccccuccaagggccccggcaacaucccccgcggcgacccccccuggcgcgagcucuga

SEQ ID NO: 40524 - RNA, 2763 nt, Artificial Sequence
  derived and/or modified sequence opt2 from C19orf68__Homo_sapiens__NP_955373
auggagcgccccgagcccccccccggcaccgccgccggccaggaggagcaggagcuccgcgagcgcgccuucuucuccugggccgaguucucccgcuucuucgacgccuggugccagcagcgccucgcccucuucuucgucaaguccuccaugcaccucgcccgcugccgcugggccuccgcccccccccucuacacccucaucgacguccucaaguacuccuacguccgccucgucugcaaggacguccgcgcccccucccgccccgccgucggccccccccagcccggcugccccgccuucaucaucgucaagcucuccccccuccgcgaccgccucgucgucaccgagugccagcucacccacucccaccccgccugcccccucgaguucgccuacuacuuccgccccggccaccuccucgccaacgccugccuccccguccgcaccaccaacaagaucuccaagcaguucgucgcccccgccgacguccgccgccuccucuccuacugcaagggccgcgaccacggcguccucgacgcccuccacguccucgagggccucuuccgcaccgaccccgaggccaaggucaagcucgucuucgucgaggaccaggccgucgucgagaccgucuucuuccucaccucccgcacccgcgcccuccuccgccgcuucccccgcaugcuccucgucgaccgccuccccggccuccagggcgcccucgaccuccucgccguccucugcgucgacggcuccggccgcgcccgccaggccgccugcugcgucgcccgccccggcacccccucccuccuccgcuucgcccucgccucccuccuccaguccgcccccgacgucaagggccgcguccgcugccucaccgccggccccgaggucgccgcccagcuccccgccguccgccagcuccuccccugcgcccgcguccagaucugccgcgcccagggccucgagacccucuucuccaaggcccaggagcucggcggcgccggccgcgaggaccccggccucuggucccgccucugccgccucgccggcgccuccucccccgccgccuacgacgaggcccucgccgagcuccacgcccacggccccgccgccuucgucgacuacuucgagcgcaacugggagccccgccgcgacauguggguccgcuuccgcgccuucgaggccgcccgcgaccucgacgccugcgcccucguccgcggccaccgccgccgccuccuccgccgccucucccccucccgcggcgucgcccagugccuccgcgaccucgucgccaugcagugggccgacgccgccggcgaggccguccccgagggccccgacggcggcggccccuggcucgaggacgagcccggccgcggcgcccagggcgagaacgagcgcguccgcggccucgagaccggcgacuggggcggcgcccccaaggagggcuccaucuggcgcggcgcccagauggagaaggagugggcccgcgcccucgagacccgcgacuggggcggcgcccaguucgagggcgagaagggccgcgcccuccagauccgcgacuggcgcggcggccgccucgagaaccagaagccccgcggccucgagggcggcguccuccgcggcuccaagcucgagaagggccaccuccgcggccccgagauccgcgacuggcgcggcccccagcucgagggcgagaaggacuggggccucgagggcuacgucuggcgcggcucccagcucgaggaccaggcccuccgcggccucgagggcuacaccuggcgcgucgcccagcucgaggaccgccgcuccaccaccgaccuccgcggcacccaguucgacuacgagcgcguccgcucccucgagggcucccccuggcgcggcgcccagcuccacgacgagcgcgccggcggccuccgcaccgccgaguggaagggcccccaguccgaggucgagaagggccgcggccucgagguccgcaaccuccgcggcaucccccucgagaagucccucgagcucgcccccgagaacggcgaccagcgcggcccccagugggaggacgagcgccgccgcggccccgagaucgccgaggagcgcggcgcccgcgucggcgucaagcgccgccgcggccucgaggacaucguccucguccagcucggcgacacccgcgucaccggcauggagaacggcgacggcggcggcgcccgcuccgucggccccaagucccgcgccggccgcggcauggaguggggcgacgccggcggccgcugccucggccucggcaacggcgucgucuccggcacccccgucggcaccguccucgagggcucccccgagugggccgccgcccgcuccgagcaccucgccgccggcgacggccuccaggagggcggcgaggacggcccccgcgagcccaagcgccucugccgcccccccggcgaggaggaggucgacugggagccccucgccaaguuccgcgccgccugcggccccgagcucgccgaccucgucgccgaggagcucgccuucgcccgccagcacggcacccgcggcuuccacuggaccggcgccggcuucgcccucaaggacggcaccuccgacuucuuccucgacggcgcccucacccgcugcuccugcuccauccacgccgcccgccgccuccccugccgccaccucuucgccgcccgccuccucaccggcgccgcccucuuccacauggaccuccuccgcgacugcuggggccgcgcccccgagcccuga

SEQ ID NO: 40525 - RNA, 426 nt, Artificial Sequence
  derived and/or modified sequence opt2 from C1D__Homo_sapiens__NP_775269
auggccggcgaggagaucaacgaggacuaccccgucgagauccacgaguaccucuccgccuucgagaacuccaucggcgccgucgacgagaugcucaagaccaugauguccgucucccgcaacgagcuccuccagaagcucgacccccucgagcaggccaaggucgaccucgucuccgccuacacccucaacuccauguucugggucuaccucgccacccagggcgucaaccccaaggagcaccccgucaagcaggagcucgagcgcauccgcgucuacaugaaccgcgucaaggagaucaccgacaagaagaaggccggcaagcucgaccgcggcgccgccucccgcuucgucaagaacgcccucugggagcccaaguccaagaacgccuccaaggucgccaacaagggcaaguccaaguccuga

SEQ ID NO: 40526 - RNA, 957 nt, Artificial Sequence
  derived and/or modified sequence opt2 from C1GALT1C1__Homo_sapiens__NP_689905
augcucuccgaguccuccuccuuccucaagggcgucaugcucggcuccaucuucugcgcccucaucaccaugcucggccacauccgcaucggccacggcaaccgcaugcaccaccacgagcaccaccaccuccaggcccccaacaaggaggacauccucaagaucuccgaggacgagcgcauggagcucuccaaguccuuccgcgucuacugcaucauccucgucaagcccaaggacgucucccucugggccgccgucaaggagaccuggaccaagcacugcgacaaggccgaguucuucuccuccgagaacgucaaggucuucgaguccaucaacauggacaccaacgacauguggcucaugaugcgcaaggccuacaaguacgccuucgacaaguaccgcgaccaguacaacugguucuuccucgcccgccccaccaccuucgccaucaucgagaaccucaaguacuuccuccucaagaaggaccccucccagcccuucuaccucggccacaccaucaaguccggcgaccucgaguacgucggcauggagggcggcaucguccucuccgucgaguccaugaagcgccucaacucccuccucaacauccccgagaagugccccgagcagggcggcaugaucuggaagaucuccgaggacaagcagcucgccgucugccucaaguacgccggcgucuucgccgagaacgccgaggacgccgacggcaaggacgucuucaacaccaaguccgucggccucuccaucaaggaggccaugaccuaccaccccaaccaggucgucgagggcugcugcuccgacauggccgucaccuucaacggccucacccccaaccagaugcacgucaugauguacggcgucuaccgccuccgcgccuucggccacaucuucaacgacgcccucgucuuccucccccccaacggcuccgacaacgacuga

SEQ ID NO: 40527 - RNA, 1116 nt, Artificial Sequence
  derived and/or modified sequence opt2 from C1GALT1__Homo_sapiens__XP_005249869
auguccgagauccacuuccgcgagauggccuccaaguccuggcucaacuuccucaccuuccucugcggcuccgccaucggcuuccuccucugcucccagcucuucuccauccuccucggcgagaaggucgacacccagcccaacguccuccacaacgacccccacgcccgccacuccgacgacaacggccagaaccaccucgagggccagaugaacuucaacgccgacuccucccagcacaaggacgagaacaccgacaucgccgagaaccucuaccagaagguccgcauccucugcugggucaugaccggcccccagaaccucgagaagaaggccaagcacgucaaggccaccugggcccagcgcugcaacaagguccucuucauguccuccgaggagaacaaggacuuccccgccgucggccucaagaccaaggagggccgcgaccagcucuacuggaagaccaucaaggccuuccaguacguccacgagcacuaccucgaggacgccgacugguuccucaaggccgacgacgacaccuacgucauccucgacaaccuccgcuggcuccucuccaaguacgaccccgaggagcccaucuacuucggccgccgcuucaagcccuacgucaagcagggcuacauguccggcggcgccggcuacguccucuccaaggaggcccucaagcgcuucgucgacgccuucaagaccgacaagugcacccacuccuccuccaucgaggaccucgcccucggccgcugcauggagaucaugaacgucgaggccggcgacucccgcgacaccaucggcaaggagaccuuccaccccuucguccccgagcaccaccucaucaagggcuaccucccccgcaccuucugguacuggaacuacaacuacuacccccccgucgagggccccggcugcugcuccgaccucgccgucuccuuccacuacgucgacuccaccaccauguacgagcucgaguaccucgucuaccaccuccgccccuacggcuaccucuaccgcuaccagcccacccuccccgagcgcauccucaaggagaucucccaggccaacaagaacgaggacaccaaggucaagcucggcaaccccuga

SEQ ID NO: 40528 - RNA, 1737 nt, Artificial Sequence
  derived and/or modified sequence opt2 from C1orf106__Homo_sapiens__NP_001136041
auggaguccaaggacgaggucuccgacaccgacuccggcaucauccuccaguccggccccgacucccccgucucccccaugaaggagcucacccacgccguccacaagcagcagcgcgcccucgaggcccgccucgaggccugccucgaggagcuccgccgccucugccuccgcgaggccgagcucaccggcacccuccccgccgaguacccccucaagcccggcgagaaggcccccaagguccgccgccgcaucggcgccgccuacaagcucgacgacugggcccuccaccgcgaggacccccucuccucccucgagcgccagcucgcccuccagcuccagaucaccgaggccgcccgccgccucugccucgaggagaaccucucccgccaggcccgccgccagcgcaagcacuccaugcuccaggaggagaagaagcuccaggagcuccagcgcugccucgucgagcgccgccgcaacuccgagcccccccccgccgccgcccucccccucggccgcgagcucuccgccuccgacgacuccucccucuccgacggccuccuccucgaggaggaggagucccagguccccaagcccccccccgagucccccgccccccccucccgcccccuccccccccagacccucgagggccuccagcccaccggccccgaggccggcucccccgagcgcgcccccguccagaacucccccuggaaggagaccucccucgaccaccccuacgagaagccccgcaaguccuccgagcccugguccgaguccuccucccccgccaccaccccccaggacggccccuccgccuccucccucuggcuccucgagcccgccuccuaccacgucguccccauccgcggcguccccggccaguggcagggccgcaccuccgcccccgccacccccgagauccagggccgccgcggccagucccagucccuccgcgucgacuccuuccgcgccggccccgagggccgcggccgcuccgccuucccccgccgccgccccacccacuacaccgucaccguccccgacuccugcuuccccgccaccaagcccccccucccccacgccgccugccacuccugcuccgaggacuccggcuccgacgucuccuccaucucccaccccaccucccccggcuccuccucccccgacaucuccuuccuccagccccucuccccccccaagacccaccgccaccgcggcgccuggguccccgccggcucccgcgagcucgucgcccaccaccccaagcuccuccucccccccggcuacuuccccgccggccgcuacgucgucgucgccgaguccccccucccccccggcgagugggagcuccgccgcgccgcccccggccccgccuacgaggaggagggcaccccccuccgcuaccagcgccucguccccucccgcucccgcaucguccgcacccccucccucaaggacucccccgccggccgcggccucuccaaggccgccgucuccgaggagcucaagugguggcacgagcgcgcccgccuccgcuccacccgcccccacucccucgaccgccagggcgccuuccgcguccgcucccucccccucggccgcgagggcuucggccgcgcccucggcccccgcgcccagguccccaccgucugcguccuccgccgcucccccgacggcgcccccguccaggucuucguccccgagaagggcgagaucaucucccaggucuga

SEQ ID NO: 40529 - RNA, 798 nt, Artificial Sequence
  derived and/or modified sequence opt2 from C1orf109__Homo_sapiens__NP_001289959
auguccgagaagcgccgccgccucgacgcccgcaacccccucaagcaggagaccgcccucucccgccuccccuucccccgcggcaaccagggccuccuccagaaggccgaggccggccgcgcccgcuggcucacccccgucauccccgcccucuggaagaccgaggccggcggcucccccgagaagaugacccaggaccgcccccuccucgccguccaggaggcccucaagaagugcuuccccgucgucgaggagcagcagggccucuggcaguccgcccuccgcgacugccagccccuccucuccucccucuccaaccucgccgagcagcuccaggccgcccagaaccuccgcuucgaggacguccccgcccuccgcgccuuccccgaccucaaggagcgccuccgccgcaagcagcucgucgccggcgacaucguccucgacaagcucggcgagcgccucgccauccuccucaagguccgcgacauggucuccucccacgucgagcgcgucuuccagaucuacgagcagcacgccgacaccgucggcaucgacgccguccuccagcccuccgccgucucccccuccgucgccgacaugcucgaguggcuccaggacaucgagcgccacuaccgcaaguccuaccucaagcgcaaguaccuccucuccuccauccaguggggcgaccucgccaacauccaggcccuccccaaggccugggaccgcaucuccaaggacgagcaccaggaccucguccaggacauccuccucaacgucuccuucuuccucgaggaguga

SEQ ID NO: 40530 - RNA, 909 nt, Artificial Sequence
  derived and/or modified sequence opt2 from C1orf110__Homo_sapiens__NP_848645
auggagcgccacaugguccgcggccagcucuacaagcacuucgaccucgagcgcaagaacgccaagcaggccgaggcccgccucgaccagcgccuccagcgccucaaggucaucugccucuaccacgucaagcuccucaccugggagcagcgccagcuccagaaggagcuccagcgccuccagcaggccgagaccaugaagaagaaguucuccuccuaccucggcaacggcuuccagaagcgccccgaggacguccucgucuucuccccccagggccgccagaagcaccgcgccccccaggccaagaagaugcgcgcccucgccacccgcauggcccaggacaccugcaaguccaagucccaggucccccccucccacgacgccggccucaaggaccccaugaaguccaagaagcagccccucucccagaacaaccgcaccgccugcuucaucaaggagcagccccaggcccaggagaaggacuccgucaaccccuccaaggacgucgaccccuccaagggcaucuccguccccugccagaaccaggaggucuccaccaacaccaucgagcagggccccuccuccucccccgccuccgacuccggcauggccugcgccgacgagacccgcuccaaggacgucgcccucaagcccgacggcaacaccggcaagcagaucccccccaagcacauggagugcgccggcuccuucgagggcgaguucaccaagcccaccuuccucgagcuccucuccaaggcccgcaacgcccacuaccuccgccaccgcgucccccccgaguccgagcgccuccucuccaucggcgagaucuucggccacggcgaguccuccuccucccgcgccggcaaggagugcgagaaccgcguccccuccaaguuccucccccucuga

SEQ ID NO: 40531 - RNA, 2736 nt, Artificial Sequence
  derived and/or modified sequence opt2 from C1orf112__Homo_sapiens__XP_005245374
augucccaggagggcgccguccccgccuccgccgucccccucgaggagcucuccuccuggcccgaggagcucugccgccgcgagcuccccuccguccucccccgccuccucucccucucccagcacuccgacuccuggaucgagcacauccagauccucaagaucaucgucgagauguuccucccccacaugaaccaccucacccucgagcagaccuucuucucccagguccuccccaagaccgucaagcucuucgacgacaugauguacgagcucaccucccaggcccgcggccucuccucccagaaccucgagauccagaccacccuccgcaacauccuccagaccaugguccagcuccucggcgcccucaccggcugcguccagcacaucugcgccacccaggaguccaucauccucgagaacauccagucccuccccuccuccguccuccacaucaucaaguccaccuucguccacugcaagaacuccgaguccgucuacuccggcugccuccaccucgucuccgaccuccuccaggcccucuucaaggaggccuacucccuccagaagcagcucauggagcuccucgacauggucugcauggacccccucgucgacgacaacgacgacauccucaacauggucaucgucauccacucccuccucgacaucugcuccgucaucuccuccauggaccacgccuuccacgccaacaccuggaaguucaucaucaagcagucccucaagcaccaguccaucaucaagucccagcucaagcacaaggacaucaucaccucccucugcgaggacauccucuucuccuuccacuccugccuccagcucgccgagcagaugacccaguccgacgcccaggacaacgccgacuaccgccucuuccagaagacccucaagcucugccgcuucuucgccaacucccuccuccacuacgccaaggaguuccuccccuuccucuccgacuccugcugcacccuccaccagcucuaccuccagauccacuccaaguucccccccucccucuacgccacccgcaucuccaaggcccaccaggaggagaucgccggcgccuuccucgucacccucgacccccucaucucccagcuccucaccuuccagcccuucaugcaggucguccucgacuccaagcucgaccuccccugcgagcuccaguucccccagugccuccuccucgucgucgucauggacaagcuccccucccagcccaaggagguccagacccucuggugcaccgacucccaggucuccgagaccaccacccgcaucucccuccucaaggccgucuucuacuccuucgagcagugcuccggcgagcucucccuccccguccaccuccagggccucaaguccaagggcaaggccgaggucgccgucacccucuaccagcacgucugcguccaccucugcaccuucaucaccuccuuccaccccucccucuucgccgagcucgacgccgcccuccucaacgccguccucuccgccaacaugaucaccucccuccucgccauggacgccuggugcuuccucgcccgcuacggcaccgccgagcucugcgcccaccacgucaccaucgucgcccaccucaucaaguccugccccggcgagugcuaccagcucaucaaccucuccauccuccucaagcgccucuucuucuucauggcccccccccaccagcucgaguucauccagaaguucucccccaaggaggccgagaaccucccccucuggcagcacaucuccuuccaggcccucccccccgagcuccgcgagcagaccguccacgaggucaccaccgucggcaccgccgagugccgcaaguggcucucccgcucccgcacccucggcgagcucgagucccucaacaccguccucuccgcccuccucgccgucugcaacuccgccggcgaggcccucgacaccggcaagcagaccgccaucaucgaggucgucucccagcucugggccuuccucaacaucaagcaggucgccgaccagcccuacguccagcagaccuucucccuccuccucccccuccucggcuucuucauccagacccucgaccccaagcucauccuccaggccgucacccuccagaccucccuccucaagcucgagcuccccgacuacguccgccucgccaugcucgacuucgucuccucccucggcaagcucuucauccccgaggccauccaggaccgcauccuccccaaccucuccugcauguucgcccuccuccucgccgaccgcuccuggcuccucgagcagcacacccucgaggccuucacccaguucgccgagggcaccaaccacgaggagaucgucccccagugccucuccuccgaggagaccaagaacaaggucgucuccuuccucgagaagaccggcuucgucgacgagaccgaggccgccaaggucgagcgcgucaagcaggagaagggcaucuucugggagcccuucgccaacgucaccgucgaggaggccaagcgcuccucccuccagcccuacgccaagcgcgcccgccaggaguuccccugggaggaggaguaccgcuccgcccuccacaccaucgccggcgcccucgaggccaccgagucccuccuccagaagggccccgcccccgccuggcucuccauggagauggaggcccuccaggagcgcauggacaagcucaagcgcuacauccacacccucggcuga

SEQ ID NO: 40532 - RNA, 429 nt, Artificial Sequence
  derived and/or modified sequence opt2 from C1orf115__Homo_sapiens__NP_078985
augaccgucggcgcccgccuccgcuccaaggccgaguccucccuccuccgccgcggcccccgcggccgcggccgcaccgagggcgacgaggaggccgccgccauccucgagcaccucgaguacgccgacgaggccgaggccgccgccgaguccggcaccuccgccgccgacgagcgcggccccggcacccgcggcgcccgccgcguccacuucgcccuccuccccgagcgcuacgagccccucgaggagcccgcccccuccgagcagccccgcaagcgcuaccgccgcaagcucaagaaguacggcaagaacgucggcaaggucaucaucaagggcugccgcuacgucgucaucggccuccagggcuucgccgccgccuacuccgcccccuucgccgucgccaccuccgucgucuccuucguccgcuga

SEQ ID NO: 40533 - RNA, 1929 nt, Artificial Sequence
  derived and/or modified sequence opt2 from C1orf127__Homo_sapiens__XP_011539059
auguccaccuuccccaccuccucccacuccggccucuucucccccuccuccggccaccucaucccccucugccucauccccccccuccucuccuccguccccacccucgccaugcgcuuccgcaacgcccgcgacaaggagaaguucgccuucgccggccgcugcugggucuccuuccagcccgaguccgagguccucguccacauccccaagcagcgccucggccucgucaagcgcggcuccuacaucgaggagacccucucccuccgcuuccuccgcguccaccaguccaacaucuucauggucaccgagaacaaggacuucgucgucgucuccauccccgccgccggcguccuccagguccagcgcugccaggaggucggcggcacccccggcacccaggccuucuaccgcgucgaccucucccucgaguucgccgagauggccgcccccguccucuggaccgucgaguccuucuuccagugcgucggcuccggcaccgagucccccgccuccaccgccgcccuccgcaccacccccuccccccccucccccggccccgagaccccccccgccggcgucccccccgccgccuccucccaggucugggccgccggccccgccgcccaggaguggcucucccgcgaccuccuccaccgccccuccgacgcccucgccaaggcccgccucuggcuccacccccuccccauggucuccuccaaggaguccggcccccaggaggucuccaagggccucggccccuuccuccagaccgccaagcccgcccgccgcggccagaccuccgccuccauccucccccgcgucguccaggcccagcgcggcccccagcccccccccggcgaggccggcauccccggccaccccaccccccccgccacccuccccuccgagcccgucgagggcguccaggccucccccuggcgcccccgccccguccuccccacccaccccgcccucacccuccccgucuccuccgacgccuccucccccuccccccccgccccccgccccgagcgccccgagucccuccucgucuccggccccuccgucacccucaccgagggccucggcaccguccgccccgagcaggaccccgccaagucccccggcuccccccuccuccuccgcggccucuccuccggcgacgucgccgcccccgagcccaucaugggcgagcccggccaggccuccgaggaguuccagccccucgcccgccccuggcgcgccacccucgccgccgaggagcucgucucccaccgcucccccggcgagccccaggagaccugcuccggcaccgaggucgagcgcccccgccagaccggccccggccucccccgcgagggcgcccgcggccacauggaccucuccuccuccgagcccucccaggacaucgagggccccggccucuccauccuccccgcccgcgacgccaccuucuccacccccuccguccgccagcccgaccccuccgccuggcucuccuccggccccgagcucaccggcaugccccgcguccgccucgccgccccccucgccguccuccccauggagccccucccccccgagcccguccgccccgccgcccuccucacccccgaggccuccuccgucggcggccccgaccaggcccgcuaccucgaguccgcccccggcuggcccgucggccaggaggaguggggcgucgcccacaccuccuccccccccuccacccagacccucucccucugggcccccaccggcguccuccuccccucccucgucgagcucgaguaccccuuccaggccggccgcggcgccucccuccagcaggagcucaccgagcccacccucgcccucuccgccgagucccaccgcccccccgagcuccaggacuccgucgagggccucuccgagcgccccucccgcuga

SEQ ID NO: 40534 - RNA, 1416 nt, Artificial Sequence
  derived and/or modified sequence opt2 from C1orf141__Homo_sapiens__XP_011539768
auggccgagaagauccucgagaagcucgacguccucgacaagcaggccgagaucauccucgcccgccgcaccaagaucaaccgccuccaguccgagggccgcaagaccaccauggccaucccccucaccuucgacuuccagcucgaguucgaggaggcccucgccaccuccgccuccaaggccaucuccaagaucaaggaggacaaguccugcuccaucaccaaguccaagaugcacgucuccuucaagugcgagcccgagccccgcaaguccaacuucgagaaguccaaccuccgccccuucuucauccagaccaacgucaagaacaaggaguccgaguccaccgagcccgucgaggagcaccucaagucccgcuccauccgccccuaccucuaccucaaggacaccaccgagauggagaacgccggcccccucaacguccucuacucccagcaccgccaggccugccgccgcucccucggcuccaccgacuucucccccauguucaacauccaguccaacgcccacaagaaggagaaggacuccacccucuucaccgcccagaucgagaagaagccccgcaagccccucgacuccgucggccuccucgagggcgaccgcaacaagcgcaagaaguccccccagaugaacgacuucaacaucaaggagaacaaguccguccgcaacuaccagcucuccaaguaccgcuccguccgcaagaagucccuccucccccucugcuucgaggacgagcucaagaacccccacgccaagaucgucaacgucucccccaccaagaccgucaccucccacauggagcagaaggacaccaaccccaucaucuuccacgacaccgaguacguccgcaugcuccuccucaccaagaaccgcuucuccucccacccccucgagaacgagaacaucuacccccacaagcgcaccaacuucauccucgagcgcaacugcgagauccucaaguccaucaucggcaaccaguccaucucccucuucaagccccagaagaccaugcccaccguccagcgcaaggacauccagauccccauguccuucaaggccggccacaccaccgucgacgacaagcucaagaagaagaccaacaagcagacccucgagaaccgcuccuggaacacccucuacaacuucucccagaacuucuccucccucaccaagcaguucgucggcuaccucgacaaggccgucauccacgagauguccgcccagaccggcaaguucgagcgcauguucuccgccggcaagcccaccuccauccccaccuccuccgcccuccccgucaagugcuacuccaagcccuucaaguacaucuacgagcucaacaacgucaccccccucgacaaccuccucaaccucuccaacgagauccucaacgccuccuga

SEQ ID NO: 40535 - RNA, 4485 nt, Artificial Sequence
  derived and/or modified sequence opt2 from C1orf167__Homo_sapiens__XP_011539574
augaagcgccgccucuccggcguccgcacccgccagaacaagggcgaccagcucggcggcggccgcgcccaccucaucaagcagacccgcccccucaccgucgaguggaccaaggacacccccguccccgagcccauggagcuccgcuccgacgccucccacaaggagaacgucucccccaagcccgccgcccuccccaagcccgagcagcgccgcuuccgccgcucccucggcaucggccucuccggccgccacgaccaguggguccccggcugccaggucgagcgcggcggccccgccgccacccccucccccggcgccguccucgaccaggagcccugccgcguccagaccaaccucgccucccccggcccccgccucggccucgcccucaaggacaccaccggccagcucgucaacuccuccuucuggcagcaguccaaccuccagucccucgcccgccgccgccagggcaaggcccgcgaguucgccauccagcaguccaaccucuccaucaacgagaccuccuccccccaccucugccccgagcccggcggcuccuccggcccccacaagcuccccuggggcccccuccucucccaggagccccucgcccgccccuccuccugccuccgccaguccggccuccccgcccccggcacccccuccggcgacuuccgccccaccgaggccuucgccccccucgacggccacacccagcccggccuccgcuccuggggcggccucggcuccuggcgcucccgccucgucggcgagccccucacccucgaggaccucgccguccccucccagaaccagacccaggcccccucccgcgccgccguccaccagcuccucgccuccguccacugccucgcccaggaggccgcccgccuccgcugccaggccccccaggagccccccggcgccguccagcaggaccucuggaccggcggcggccagcccuucuccgcccacccccagcccucccagcccguccucgccuccuccgacggccgccgccgccgccuccgcggccaccgcgagaccgccgccuuccucgagacccccgccucccucuccgacuccugggcccaguccaagcucaugucccccgagaccacccucggcacccgcaccaaggacucccucaaccccgagcagggccucccccccgcccacccccucggcuccggcgacuccugcucccccuggucccaggacggccgcgcccagcgcggcgaccccucccucccccgcggcgucggcucccgcggcaccgaccccugcuccuccgccuucuccaacaccgccuggggcgucucccccaagcagaagggcgaggagggcgccccccgcgagcgcguccaccgcgaggaggagcgcaccgccuuccaccucuccgacaccguccccgccuccuccgccuccaagaacaaggcccagaacaucaccgcccccgaguccgaggccaucugcuggcagcuccucucccgcugcuuccgcuccuggcgccaccucgucaagcgccagcgcgagcccgccgccgccgccgucgcccucggccgcuggcagcuccuccgcaagugccuccaggcccucuggcuccgcgaggcccagcucgaggccgccuggggccaguacaccaagguccuccucguccgcuccuuccgcgaguggcgcaaccucgcccuccagcagaagcagguccagccccacaugcaggccggccccggcuccccccccucccgccgcgcccagggcaagggccucucccucggccgcuccaccgucgucgaccccgcccagcgcucccgccucgagcacaccucccccggcucccuccgcgaggaggagaucgcccagcgccuccucucccacccccgccagcgcaccgacucccgccacgagcgcguccagauccuccaggcccuccagcucgccgucuucuuccucuggugccagcagaagaagcgcgcccgccaggagcgcgagacccuccgcaaggccacccgcgccacccagcgcaccggcuccuucccccaggccuggcacuccaccgccgccggcgucgccugggucgccccccucuccccccagcaccagcgcgccuggcucugccgcugcuucggcgccuggcagcaguucguccagcgcggcucccgcuaccgcgaccaccucgccgaccgccgcaccggcacccuccgcaagugccucgagcaguggguccgcaugaagcagcuccgcgaguccgacggcgccaaggucacccagcucucccucugccgccagaaggccggccgcgaggccgucuacaccgccggccccggcgccugcggccucggcgccgucggccaggcccagggccagcaggagcagggccgcggcucccuccaggacgccugcuggacccucgcccucugcugggcccuccuccucuggaagaugcgccucuuccagcgccagugggccaacuccuucuuccagggccuccagcagcgcaugcuccagcgcucccuccgcugguggcaccuccgcgcccucggccccgacgccaccuccuccugcaccaagacccccuccgcccucgagccccucuccuccuccacccuccaggacucccucgagaaggucccccgcgcccccacccuccccgacacccuccagggcucccuccucugggccgccggccagcgccagcagggccagugccuccuccucuggcaggcccgcgcccagcaguuccagggcaccgcccgcugguaccagcacacccgccagcgccgcaucuuccucuccuggucccgcugggccaccgcccagugggccuggcgcgagcucgccucccaccgcgccugggaccgcaccugccgcgccguccucggccucuggcgccagcgccuccuccagucccgccucgucgaguggugggcccaggagcgcggcuggcgccucgcccgcgacgcccucugccacuggcacuccugcuggcagggccagcaguuccuccacgagaagugccagaccuggguccagguccaccuccagggccuccagaaggucgucuuccgcuccuggcagcaggccgccgcccaccagcgcugcaccgucacccgccccgagcagcuccuccuccaguccuacuuccaggccuggugcgaggucguccgcgacaccggcguccuccgcgcccagcaccaggccuuccaggacggccuccgccgccgcgcccucggcgccgucuucgccaccuggcgcgaggcccaggaggucgccgccggcgcccaggagcagcgcgucgcccaggccucccucgcccgcuggcgcuccugcggccagcagggccaggaggacggccagcagaagaaggcccgcgccccccaggccuuccccgccuggcccgucgcccccggcaugcaccacgaggcccagcagcaggccggcgaguccgccggcgcccaggccgcccagugcuggaccuggugcugggcccucuggguccacgaguccugccgcggccaggucucccgcgcccacgccuccuggaagccccgcgccuggguccucgaggccuccguccaguccgccguccgcggcggcguccagcgcgccauccucacccagcuccgccccgccgagcuccgccgcuuccuccgcaccguccagcuccgcguccgccucggccuccccggcgccggcaagacccgcuccugcuggacccaggccaccgagcucgucccccccgcccccucccuccagugcucccucggcggccgccgcaagccccgcggcaccgccugggcccagcgcugccgcgagcacucccucugccccgccuuccagcucuggccccaguggcccggccaguccuccuggguccccggccucccccucuggacccgcgaccagggcccccgcgcccacuccucccccgagccccgcgccugcaaggcccaguccaaggcccacaagcgccgccuccgcgcccgcuccugccgcauccucgagaagcaggcccaggcccacggcuccgcccuccuccucgcccucaagggccacgacgcccucggccaccaggaggagguccccgccgcccccgucccccgcggcaccgccucccgcgccgccggcuuccccgccggccagguccccggcuccggcauggccgcccucggcggcugcccccgcggccgcgccgccggcgccgaccccgcccagggcgucgcccccgagaugggccucgccgacgucgucgccgccgaccccgccaccgccuccggcuccgccgucaccgccgccggccgcugggccuucaagaaguggcaccagcgccucgccgcccgcuccccccgccgcggcgccgccuccuccccccgccccugguccaagcccggccccaagggccccgaguccggccaggaggccgcccgcgccccccgcggcuggggccucggcgccgagcacggcgcccagcuccagcucuga

SEQ ID NO: 40536 - RNA, 708 nt, Artificial Sequence
  derived and/or modified sequence opt2 from C1orf204__Homo_sapiens__NP_001127705
augggcaugcucgcccccggcccccuccagggccgccgcccccgcaagggccacaagggccaggaggacgccgucgcccccggcugcaaggccuccggccgcggcucccgcgucacccaccuccucggcuaccccacccagaacgucucccgcucccuccgccgcaaguacgcccccccccccugcggcggccccgaggacgucgcccucgcccccugcaccgccgccgccgccugcgaggccggccccucccccgucuacgucaaggucaaguccgccgagcccgccgacugcgccgagggccccguccagugcaagaacggccuccucgucuccuccccccacugcgaggagcccugcgcccacuccugcgcccaccccggccuccccccccaccucguccacaagcucccccucuccuaccuccagacccaggacaccgacgccgccucccgccgcaucaacgccccccucgccgccggcugguccuggcuccgccucuggcucgucacccucgccuccggcgucgacuucccccaggucuccgccuggaugcgcgcccuccccucccccgacugccccggccuccgcaccaccggcgagcagaugcagaagcuccuccucaaggagaacaaggucaagacccgcaaguccaagcgccgcuccggcgagggcucccaccucaccaccuccauccucgagcaguga

SEQ ID NO: 40537 - RNA, 819 nt, Artificial Sequence
  derived and/or modified sequence opt2 from C1orf226__Homo_sapiens__NP_001078844
auguucgagaaccucaacaccgcccucacccccaagcuccaggccucccgcuccuucccccaccucuccaagcccgucgcccccggcuccgccccccucggcuccggcgagcccggcggccccggccucugggucggcuccucccagcaccucaagaaccucggcaaggccaugggcgccaaggucaacgacuuccuccgccgcaaggagcccuccucccucggcuccgucggcgucaccgagaucaacaagaccgccggcgcccagcucgccuccggcaccgacgccgcccccgaggccuggcucgaggacgagcgcuccguccuccaggagaccuucccccgccucgacccccccccccccaucacccgcaagcgcaccccccgcgcccucaagaccacccaggacaugcucaucuccucccagcccguccucuccucccucgaguacggcaccgagcccucccccggccaggcccaggacuccgcccccaccgcccagcccgacguccccgccgacgccucccagcccgaggccaccauggagcgcgaggagcgcggcaagguccuccccaacggcgaggucucccucuccguccccgaccucauccacaaggacucccaggacgaguccaagcucaagaugaccgagugccgccgcgccuccucccccucccucaucgagcgcaacggcuucaagcucucccucucccccaucucccucgccgaguccugggaggacggcuccccccccccccaggcccgcaccuccucccucgacaacgagggcccccaccccgaccuccucuccuucgaguga

SEQ ID NO: 40538 - RNA, 1323 nt, Artificial Sequence
  derived and/or modified sequence opt2 from C1orf228__Homo_sapiens__XP_011539646
augaccuccaucaaggagcaggccgccaucucccgccuccucuccuuccuccaggagugggacaacgccggcaaggucgcccgcucccacauccucgacaaguucaucgagaccaaccagggcaagaccgcccccgagcucgagcaggaguucucccagggcgccucccucuuccucguccgccucaccaccucccuccgcaucaccuacaugaccgacuccugccucgagaagcuccuccgcuccaucggcaucuuccucuccgccgucuccuccaaccgcuaccucaucgaguuccucgaggucggcggcguccucacccuccucgagauccucggccucgagaagaucaaggaggaggccaagaaggaguccgucaagcuccuccaggucaucgccaacuccggccgcaccuacaaggagcucaucugcgaguccuacggcguccgcuccaucgccgaguuccucgccaaguccaaguccgaggagacccaggaggagguccagguccuccucgacucccucguccacggcaaccccaaguaccagaaccaggucuacaagggccucaucgcccuccuccccugcgagucccccaaggcccagcagcucucccuccagacccuccgcaccgcccagcccaucaucggcaccacccaccccuccaucgucgacugcguccucaagguccucggcaccaugcaccucgagguccaguacgaggccaucgagcucaucaaggaccucgucggcuacgacguccgccaggcccuccucaagggccucgucgcccuccucauccccuccgucaaggagaucuccaagcuccaggccaagauccucuccgaccccuccguccuccagcucacccccucccuccccauguuccuccagcaggccgccgccgccaaggccaucggcguccucgcccgcaacgacauguccaucgccgaggagcuccucuaccuccgcgucguccgcggccucauggccgccaugggcaacaccgaccacuccaacucccagcgccucgccucccucacccucgagugcuucguccagauguucccccucgucgccgagcacguccgcaagugcaugggcgaggagcucuaccagcucuuccucuccaacgccgaggaccucuacaugaagaucgacuccauccaggccgacauccucgccgccaacaccgucaacgucaccaaggcccucugccuccacggcuccuccuacuccaugaacacccucuacggcucccgcgacuccgcccagauggccuaccucacccacuucgaggaggacgucgaguccaaggaguga

SEQ ID NO: 40539 - RNA, 1296 nt, Artificial Sequence
  derived and/or modified sequence opt2 from C1orf27__Homo_sapiens__NP_001157717
augggccgcaccuacaucgucgaggagaccgucggccaguaccucuccaacaucaaccuccagggcaaggccuucgucuccggccuccucaucggccagugcuccucccagaaggacuacgucauccucgccacccgcaccccccccaaggaggagcaguccgagaaccucaagcaccccaaggccaagcucgacaaccucgacgaggagugggccaccgagcacgccugccaggucucccgcaugcuccccggcggccuccucguccucggcgucuucaucaucaccacccucgagcucgccaacgacuuccagaacgcccuccgccgccucauguucgccgucgagaaguccaucaaccgcaagcgccucuggaacuucaccgaggaggaggucuccgagcgcgucacccuccacaucugcgccuccaccaagaagaucuucugccgcaccuacgacauccacgaccccaaguccuccgcccgccccgccgacuggaaguaccaguccggccucuccuccuccuggcucucccucgagugcaccguccacaucaacauccacaucccccucuccgccaccuccgucuccuacacccucgagaagaacaccaagaacggccucacccgcugggccaaggagaucgagaacggcgucuaccucaucaacggccaggucaaggacgaggacugcgaccuccucgagggccagcuccucaacuccgaccaccgcuccaccgccaccguccagaucugcuccggcuccgucaaccucaagggcgccgucaagugccgcgccuacauccacuccuccaagcccaaggucaaggacgccguccaggccgucaagcgcgacauccucaacaccgucgccgaccgcugcgagaugcucuucgaggaccuccuccucaacgagauccccgagaagaaggacuccgagaaggaguuccacguccuccccuaccgcgucuucgucccccuccccggcuccaccgucaugcucugcgacuacaaguucgacgacgaguccgccgaggagauccgcgaccacuucauggagaugcucgaccacaccauccagaucgaggaccucgagaucgccgaggagaccaacaccgccugcauguccuccuccaugaacucccaggccucccucgacaacaccgacgacgagcagcccaagcagcccaucaagaccaccaugcuccucaagauccagcagaacaucggcgucaucgccgccuucaccgucgccguccucgccgccggcaucuccuuccacuacuucuccgacuga

SEQ ID NO: 40540 - RNA, 330 nt, Artificial Sequence
  derived and/or modified sequence opt2 from C1orf61__Homo_sapiens__NP_001307383
augggcacccucggcuccaucuucucccccggcgccggcggcuucugcaccacccucccccccuccuuccuccgcgucgacgaccgcgccaccuccuccaccaccgacuccucccgcgcccccuccuccccccgcccccccggcuccaccucccacugcggcaucuccacccgcugcaccgagcgcugccucugcguccucccccuccgcaccucccagguccccgacgucauggccccccagcacgaccaggagcccaagcgccgcauguacuucaucuggcucggcuggauccccuccgacaagcccucccagcucaccgagcgcuga

SEQ ID NO: 40541 - RNA, 588 nt, Artificial Sequence
  derived and/or modified sequence opt2 from C1orf86__Homo_sapiens__XP_011539224
auggaggccgcccgccgcccccgccucggccucucccgccgccgcccccgccccgccggcggccccuccggcggccgccccugguuccuccucggcggcgacgagcgcgagcgccucugggccgagcuccuccgcaccgucucccccgagcucauccucgaccacgagguccccucccuccccgccuuccccggccaggagccccgcugcggccccgagcccaccgaggucuucaccgucggccccaagaccuucuccuggacccccuucccccccgaccucuggggccccggccgcuccuaccgccuccuccacggcgccggcggccaccucgagucccccgcccgcucccucccccagcgccccgcccccgaccccugccgcgccccccgcgucgagcagcagcccuccgucgagggcgccgccgcccuccgcuccugccccaugugccagaaggaguucgccccccgcuccaagaacuccuccggcaugcgccgccaccgcucccccaagcucgccgccaacaacaacaacaacaagcgcaagggccgcgcccgcuggcucacccccgucauccccgcccucuga

SEQ ID NO: 40542 - RNA, 762 nt, Artificial Sequence
  derived and/or modified sequence opt2 from C1QB__Homo_sapiens__XP_011540361
augaugaugaagauccccuggggcuccauccccguccucaugcuccuccuccuccucggccucaucgacaucucccaggcccagcucuccugcaccggcccccccgccauccccggcauccccggcauccccggcacccccggccccgacggccagcccggcacccccggcaucaagggcgagaagggccuccccggccucgccggcgaccacggcgaguucggcgagaagggcgaccccggcauccccggcaaccccggcaaggucggccccaagggccccaugggccccaagggcggccccggcgcccccggcgcccccggccccaagggcgaguccggcgacuacaaggccacccagaagaucgccuucuccgccacccgcaccaucaacgucccccuccgccgcgaccagaccauccgcuucgaccacgucaucaccaacaugaacaacaacuacgagccccgcuccggcaaguucaccugcaagguccccggccucuacuacuucaccuaccacgccuccucccgcggcaaccucugcgucaaccucaugcgcggccgcgagcgcgcccagaaggucgucaccuucugcgacuacgccuacaacaccuuccaggucaccaccggcggcaugguccucaagcucgagcagggcgagaacgucuuccuccaggccaccgacaagaacucccuccucggcauggagggcgccaacuccaucuucuccggcuuccuccucuuccccgacauggaggccuga

SEQ ID NO: 40543 - RNA, 849 nt, Artificial Sequence
  derived and/or modified sequence opt2 from C1QBP__Homo_sapiens__NP_001203
augcucccccuccuccgcugcgucccccgcguccucggcuccuccgucgccggccuccgcgccgccgcccccgccucccccuuccgccagcuccuccagcccgccccccgccucugcacccgccccuucggccuccucuccguccgcgccggcuccgagcgccgccccggccuccuccgcccccgcggccccugcgccugcggcugcggcugcggcucccuccacaccgacggcgacaaggccuucgucgacuuccucuccgacgagaucaaggaggagcgcaagauccagaagcacaagacccuccccaagauguccggcggcugggagcucgagcucaacggcaccgaggccaagcucguccgcaaggucgccggcgagaagaucaccgucaccuucaacaucaacaacuccaucccccccaccuucgacggcgaggaggagcccucccagggccagaaggucgaggagcaggagcccgagcucaccuccacccccaacuucgucgucgaggucaucaagaacgacgacggcaagaaggcccucguccucgacugccacuaccccgaggacgaggucggccaggaggacgaggccgaguccgacaucuucuccauccgcgaggucuccuuccaguccaccggcgaguccgaguggaaggacaccaacuacacccucaacaccgacucccucgacugggcccucuacgaccaccucauggacuuccucgccgaccgcggcgucgacaacaccuucgccgacgagcucgucgagcucuccaccgcccucgagcaccaggaguacaucaccuuccucgaggaccucaaguccuucgucaagucccaguga

SEQ ID NO: 40544 - RNA, 777 nt, Artificial Sequence
  derived and/or modified sequence opt2 from C1QL1__Homo_sapiens__NP_006679
augcuccucguccucgucguccucauccccguccucgucuccuccggcggccccgagggccacuacgagaugcucggcaccugccgcauggucugcgaccccuaccccgcccgcggccccggcgccggcgcccgcaccgacggcggcgacgcccucuccgagcaguccggcgcccccccccccuccacccucguccagggcccccagggcaagcccggccgcaccggcaagcccggcccccccggcccccccggcgaccccggcccccccggccccgucggcccccccggcgagaagggcgagcccggcaagcccggcccccccggccuccccggcgccggcggcuccggcgccaucuccaccgccaccuacaccaccgucccccgcgucgccuucuacgccggccucaagaacccccacgagggcuacgagguccucaaguucgacgacgucgucaccaaccucggcaacaacuacgacgccgccuccggcaaguucaccugcaacauccccggcaccuacuucuucaccuaccacguccucaugcgcggcggcgacggcaccuccaugugggccgaccucugcaagaacggccagguccgcgccuccgccaucgcccaggacgccgaccagaacuacgacuacgccuccaacuccgucauccuccaccucgacgccggcgacgaggucuucaucaagcucgacggcggcaaggcccacggcggcaacuccaacaaguacuccaccuucuccggcuucaucaucuacuccgacuga

SEQ ID NO: 40545 - RNA, 768 nt, Artificial Sequence
  derived and/or modified sequence opt2 from C1QL3__Homo_sapiens__NP_001010908
augguccuccuccucgucauccucauccccguccucgucuccuccgccggcaccuccgcccacuacgagaugcucggcaccugccgcauggucugcgaccccuacggcggcaccaaggcccccuccaccgccgccacccccgaccgcggccucaugcagucccuccccaccuucauccagggccccaagggcgaggccggccgccccggcaaggccggcccccgcggcccccccggcgagcccggcccccccggccccaugggcccccccggcgagaagggcgagcccggccgccagggccuccccggcccccccggcgcccccggccucaacgccgccggcgccaucuccgccgccaccuacuccaccguccccaagaucgccuucuacgccggccucaagcgccagcacgagggcuacgagguccucaaguucgacgacgucgucaccaaccucggcaaccacuacgaccccaccaccggcaaguucaccugcuccauccccggcaucuacuucuucaccuaccacguccucaugcgcggcggcgacggcaccuccaugugggccgaccucugcaagaacaaccagguccgcgccuccgccaucgcccaggacgccgaccagaacuacgacuacgccuccaacuccgucguccuccaccucgagcccggcgacgaggucuacaucaagcucgacggcggcaaggcccacggcggcaacaacaacaaguacuccaccuucuccggcuucaucaucuacgccgacuga

SEQ ID NO: 40546 - RNA, 846 nt, Artificial Sequence
  derived and/or modified sequence opt2 from C1QTNF1__Homo_sapiens__NP_112230
augggcucccgcggccagggccuccuccucgccuacugccuccuccucgccuucgccuccggccucguccucucccgcgucccccacguccagggcgagcagcaggagugggagggcaccgaggagcuccccuccccccccgaccacgccgagcgcgccgaggagcagcacgagaaguaccgccccucccaggaccagggccuccccgccucccgcugccuccgcugcugcgaccccggcaccuccauguaccccgccaccgccgucccccagaucaacaucaccauccucaagggcgagaagggcgaccgcggcgaccgcggccuccagggcaaguacggcaagaccggcuccgccggcgcccgcggccacaccggccccaagggccagaagggcuccaugggcgcccccggcgagcgcugcaagucccacuacgccgccuucuccgucggccgcaagaagcccaugcacuccaaccacuacuaccagaccgucaucuucgacaccgaguucgucaaccucuacgaccacuucaacauguucaccggcaaguucuacugcuacguccccggccucuacuucuucucccucaacguccacaccuggaaccagaaggagaccuaccuccacaucaugaagaacgaggaggaggucgucauccucuucgcccaggucggcgaccgcuccaucaugcagucccagucccucaugcucgagcuccgcgagcaggaccaggucuggguccgccucuacaagggcgagcgcgagaacgccaucuucuccgaggagcucgacaccuacaucaccuucuccggcuaccucgucaagcacgccaccgagcccuga

SEQ ID NO: 40547 - RNA, 741 nt, Artificial Sequence
  derived and/or modified sequence opt2 from C1QTNF3__Homo_sapiens__NP_112207
augcucuggcgccagcucaucuacuggcagcuccucgcccucuucuuccuccccuucugccucugccaggacgaguacauggaguccccccagaccggcggccucccccccgacugcuccaagugcugccacggcgacuacuccuuccgcggcuaccagggcccccccggcccccccggcccccccggcauccccggcaaccacggcaacaacggcaacaacggcgccaccggccacgagggcgccaagggcgagaagggcgacaagggcgaccucggcccccgcggcgagcgcggccagcacggccccaagggcgagaagggcuaccccggcaucccccccgagcuccagaucgccuucauggccucccucgccacccacuucuccaaccagaacuccggcaucaucuucuccuccgucgagaccaacaucggcaacuucuucgacgucaugaccggccgcuucggcgcccccgucuccggcgucuacuucuucaccuucuccaugaugaagcacgaggacgucgaggaggucuacgucuaccucaugcacaacggcaacaccgucuucuccauguacuccuacgagaugaagggcaaguccgacaccuccuccaaccacgccguccucaagcucgccaagggcgacgaggucuggcuccgcaugggcaacggcgcccuccacggcgaccaccagcgcuucuccaccuucgccggcuuccuccucuucgagaccaaguga

SEQ ID NO: 40548 - RNA, 732 nt, Artificial Sequence
  derived and/or modified sequence opt2 from C1QTNF5__Homo_sapiens__NP_001265360
augcgcccccuccucguccuccuccuccucggccucgccgccggcucccccccccucgacgacaacaagauccccucccucugccccggccaccccggccuccccggcacccccggccaccacggcucccagggccuccccggccgcgacggccgcgacggccgcgacggcgcccccggcgcccccggcgagaagggcgagggcggccgccccggccuccccggcccccgcggcgaccccggcccccgcggcgaggccggccccgccggccccaccggccccgccggcgagugcuccguccccccccgcuccgccuucuccgccaagcgcuccgagucccgcguccccccccccuccgacgccccccuccccuucgaccgcguccucgucaacgagcagggccacuacgacgccgucaccggcaaguucaccugccagguccccggcgucuacuacuucgccguccacgccaccgucuaccgcgccucccuccaguucgaccucgucaagaacggcgaguccaucgccuccuucuuccaguucuucggcggcuggcccaagcccgccucccucuccggcggcgccaugguccgccucgagcccgaggaccaggucuggguccaggucggcgucggcgacuacaucggcaucuacgccuccaucaagaccgacuccaccuucuccggcuuccucgucuacuccgacuggcacuccucccccgucuucgccuga

SEQ ID NO: 40549 - RNA, 837 nt, Artificial Sequence
  derived and/or modified sequence opt2 from C1QTNF6__Homo_sapiens__NP_872292
augcaguggcuccgcguccgcgagucccccggcgaggccaccggccaccgcgucaccaugggcaccgccgcccucggccccgucugggccgcccuccuccucuuccuccucaugugcgagauccccauggucgagcucaccuucgaccgcgccgucgccuccggcugccagcgcugcugcgacuccgaggacccccucgaccccgcccacgucuccuccgccuccuccuccggccgcccccacgcccuccccgagauccgccccuacaucaacaucaccauccucaagggcgacaagggcgaccccggccccaugggccuccccggcuacaugggccgcgagggcccccagggcgagcccggcccccagggcuccaagggcgacaagggcgagaugggcucccccggcgcccccugccagaagcgcuucuucgccuucuccgucggccgcaagaccgcccuccacuccggcgaggacuuccagacccuccucuucgagcgcgucuucgucaaccucgacggcugcuucgacauggccaccggccaguucgccgccccccuccgcggcaucuacuucuucucccucaacguccacuccuggaacuacaaggagaccuacguccacaucaugcacaaccagaaggaggccgucauccucuacgcccagcccuccgagcgcuccaucaugcagucccaguccgucaugcucgaccucgccuacggcgaccgcgucuggguccgccucuucaagcgccagcgcgagaacgccaucuacuccaacgacuucgacaccuacaucaccuucuccggccaccucaucaaggccgaggacgacuga

SEQ ID NO: 40550 - RNA, 891 nt, Artificial Sequence
  derived and/or modified sequence opt2 from C1QTNF7__Homo_sapiens__NP_001128642
augucccgccaggagcccaagauguucguccuccucuacgucaccuccuucgccaucugcgccuccggccagccccgcggcaaccagcucaagggcgagaacuacuccccccgcuacaucugcuccauccccggccuccccggcccccccggcccccccggcgccaacggcucccccggcccccacggccgcaucggccuccccggccgcgacggccgcgacggccgcaagggcgagaagggcgagaagggcaccgccggccuccgcggcaagaccggcccccucggccucgccggcgagaagggcgaccagggcgagaccggcaagaagggccccaucggccccgagggcgagaagggcgaggucggccccaucggcccccccggccccaagggcgaccgcggcgagcagggcgaccccggccuccccggcgucugccgcugcggcuccaucguccucaaguccgccuucuccgucggcaucaccaccuccuaccccgaggagcgccuccccaucaucuucaacaagguccucuucaacgagggcgagcacuacaaccccgccaccggcaaguucaucugcgccuuccccggcaucuacuacuucuccuacgacaucacccucgccaacaagcaccucgccaucggccucguccacaacggccaguaccgcaucaagaccuucgacgccaacaccggcaaccacgacgucgccuccggcuccaccgucaucuaccuccagcccgaggacgaggucuggcucgagaucuucuucaccgaccagaacggccucuucuccgaccccggcugggccgacucccucuucuccggcuuccuccucuacgucgacaccgacuaccucgacuccaucuccgaggacgacgagcucuga

SEQ ID NO: 40551 - RNA, 324 nt, Artificial Sequence
  derived and/or modified sequence opt2 from C1QTNF9B-AS1__Homo_sapiens__NP_001014442
auguggauccucuccaaccucaugggcaccuccgaggagggcaaccuccucuccaccgucucccccaccgucaaggcccucuucggcaagacccgcgucucccccaucuuccccuucuccccccgcucccccuuccagccccucaucccccgcacccccggcucccccuggggccccgucggccccgccuccccccucggccccggcuuccccaucggccccaugggccccggcaagcccgucggccccaagggccccaugcucccccucggccccuccggccccgucggccccaccuccccccucuuccccuucugccccuga

SEQ ID NO: 40552 - RNA, 2118 nt, Artificial Sequence
  derived and/or modified sequence opt2 from C1R__Homo_sapiens__NP_001724
auguggcuccucuaccuccucguccccgcccucuucugccgcgccggcggcuccauccccaucccccagaagcucuucggcgaggucaccuccccccucuuccccaagcccuaccccaacaacuucgagaccaccaccgucaucaccguccccaccggcuaccgcgucaagcucgucuuccagcaguucgaccucgagcccuccgagggcugcuucuacgacuacgucaagaucuccgccgacaagaagucccucggccgcuucugcggccagcucggcuccccccucggcaacccccccggcaagaaggaguucaugucccagggcaacaagaugcuccucaccuuccacaccgacuucuccaacgaggagaacggcaccaucauguucuacaagggcuuccucgccuacuaccaggccgucgaccucgacgagugcgccucccgcuccaagcucggcgaggaggacccccagccccagugccagcaccucugccacaacuacgucggcggcuacuucugcuccugccgccccggcuacgagcuccaggaggaccgccacuccugccaggccgagugcuccuccgagcucuacaccgaggccuccggcuacaucuccucccucgaguacccccgcuccuacccccccgaccuccgcugcaacuacuccauccgcgucgagcgcggccucacccuccaccucaaguuccucgagcccuucgacaucgacgaccaccagcagguccacugccccuacgaccagcuccagaucuacgccaacggcaagaacaucggcgaguucugcggcaagcagcgcccccccgaccucgacaccuccuccaacgccgucgaccuccucuucuucaccgacgaguccggcgacucccgcggcuggaagcuccgcuacaccaccgagaucaucaagugcccccagcccaagacccucgacgaguucaccaucauccagaaccuccagccccaguaccaguuccgcgacuacuucaucgccaccugcaagcagggcuaccagcucaucgagggcaaccagguccuccacuccuucaccgccgucugccaggacgacggcaccuggcaccgcgccaugccccgcugcaagaucaaggacugcggccagccccgcaaccuccccaacggcgacuuccgcuacaccaccaccaugggcgucaacaccuacaaggcccgcauccaguacuacugccacgagcccuacuacaagaugcagacccgcgccggcucccgcgaguccgagcagggcgucuacaccugcaccgcccagggcaucuggaagaacgagcagaagggcgagaagaucccccgcugccuccccgucugcggcaagcccgucaaccccgucgagcagcgccagcgcaucaucggcggccagaaggccaagaugggcaacuuccccuggcaggucuucaccaacauccacggccgcggcggcggcgcccuccucggcgaccgcuggauccucaccgccgcccacacccucuaccccaaggagcacgaggcccaguccaacgccucccucgacgucuuccucggccacaccaacgucgaggagcucaugaagcucggcaaccaccccauccgccgcgucuccguccaccccgacuaccgccaggacgaguccuacaacuucgagggcgacaucgcccuccucgagcucgagaacuccgucacccucggccccaaccuccuccccaucugccuccccgacaacgacaccuucuacgaccucggccucaugggcuacgucuccggcuucggcgucauggaggagaagaucgcccacgaccuccgcuucguccgccuccccgucgccaacccccaggccugcgagaacuggcuccgcggcaagaaccgcauggacgucuucucccagaacauguucugcgccggccaccccucccucaagcaggacgccugccagggcgacuccggcggcgucuucgccguccgcgaccccaacaccgaccgcugggucgccaccggcaucgucuccuggggcaucggcugcucccgcggcuacggcuucuacaccaagguccucaacuacgucgacuggaucaagaaggagauggaggaggaggacuga

SEQ ID NO: 40553 - RNA, 564 nt, Artificial Sequence
  derived and/or modified sequence opt2 from C1RL__Homo_sapiens__NP_001284572
augcccggcccccgcgucuggggcaaguaccucuggcgcuccccccacuccaagggcugccccggcgccaugugguggcuccuccucuggggcguccuccaggccugccccacccgcggcuccguccuccucgcccaggagcucccccagcagcucaccucccccggcuaccccgagcccuacggcaagggccaggaguccuccaccgacaucaaggcccccgagggcuucgccguccgccucgucuuccaggacuucgaccucgagcccucccaggacugcgccggcgacuccgucaccaucuccuucgucggcuccgaccccucccaguucugcggccagcagggcuccccccucggccgcccccccggccagcgcgaguucgucuccuccggccgcucccuccgccucaccuuccgcacccagcccuccuccgagaacaagaccgcccaccuccacaagggcuuccucgcccucuaccagaccgucggcgagugccccuccuggggcugccgcgagggcgccuccguccccucccacgaccccggcaucuucaagcccuga

SEQ ID NO: 40554 - RNA, 2067 nt, Artificial Sequence
  derived and/or modified sequence opt2 from C1S__Homo_sapiens__XP_005253817
auguggugcaucguccucuucucccuccucgccugggucuacgccgagcccaccauguacggcgagauccucucccccaacuacccccaggccuaccccuccgaggucgagaaguccugggacaucgagguccccgagggcuacggcauccaccucuacuucacccaccucgacaucgagcucuccgagaacugcgccuacgacuccguccagaucaucuccggcgacaccgaggagggccgccucugcggccagcgcuccuccaacaacccccacucccccaucgucgaggaguuccagguccccuacaacaagcuccaggucaucuucaaguccgacuucuccaacgaggagcgcuucaccggcuucgccgccuacuacgucgccaccgacaucaacgagugcaccgacuucgucgacguccccugcucccacuucugcaacaacuucaucggcggcuacuucugcuccugcccccccgaguacuuccuccacgacgacaugaagaacugcggcgucaacugcuccggcgacgucuucaccgcccucaucggcgagaucgccucccccaacuaccccaagcccuaccccgagaacucccgcugcgaguaccagauccgccucgagaagggcuuccaggucgucgucacccuccgccgcgaggacuucgacgucgaggccgccgacuccgccggcaacugccucgacucccucgucuucgucgccggcgaccgccaguucggccccuacugcggccacggcuuccccggcccccucaacaucgagaccaaguccaacgcccucgacaucaucuuccagaccgaccucaccggccagaagaagggcuggaagcuccgcuaccacggcgaccccaugcccugccccaaggaggacacccccaacuccgucugggagcccgccaaggccaaguacgucuuccgcgacgucguccagaucaccugccucgacggcuucgaggucgucgagggccgcgucggcgccaccuccuucuacuccaccugccaguccaacggcaagugguccaacuccaagcucaagugccagcccgucgacugcggcauccccgaguccaucgagaacggcaaggucgaggaccccgaguccacccucuucggcuccgucauccgcuacaccugcgaggagcccuacuacuacauggagaacggcggcggcggcgaguaccacugcgccggcaacggcuccugggucaacgagguccucggccccgagcuccccaagugcguccccgucugcggcgucccccgcgagcccuucgaggagaagcagcgcaucaucggcggcuccgacgccgacaucaagaacuuccccuggcaggucuucuucgacaaccccugggccggcggcgcccucaucaacgaguacuggguccucaccgccgcccacgucgucgagggcaaccgcgagcccaccauguacgucggcuccaccuccguccagaccucccgccucgccaaguccaagaugcucacccccgagcacgucuucauccaccccggcuggaagcuccucgagguccccgagggccgcaccaacuucgacaacgacaucgcccucguccgccucaaggaccccgucaagaugggccccaccgucucccccaucugccuccccggcaccuccuccgacuacaaccucauggacggcgaccucggccucaucuccggcuggggccgcaccgagaagcgcgaccgcgccguccgccucaaggccgcccgccuccccgucgccccccuccgcaagugcaaggaggucaaggucgagaagcccaccgccgacgccgaggccuacgucuucacccccaacaugaucugcgccggcggcgagaagggcauggacuccugcaagggcgacuccggcggcgccuucgccguccaggaccccaacgacaagaccaaguucuacgccgccggccucgucuccuggggcccccagugcggcaccuacggccucuacacccgcgucaagaacuacgucgacuggaucaugaagaccaugcaggagaacuccaccccccgcgaggacuga

SEQ ID NO: 40555 - RNA, 3534 nt, Artificial Sequence
  derived and/or modified sequence opt2 from C20orf194__Homo_sapiens__NP_001009984
auggacgucuaccccccccgccgccagggccucccccgcgcccgcucccccggcggcuccucccgcggcucccccuccgucuccugcucccgccuccgccagguccaguccauccucacccaguccuccaagucccgccccgacggcauccucugcauccucggcaucgacucccgcuacaacgagggcugccgcgagcucgccaacuaccuccucuucggccucuacaaccagaacaccuccgacuucgagaagaccggcuucuccgaggagguccucgacgacgucaucauccucaucaaguccgacuccguccaccucuacugcaaccccgucaacuuccgcuaccuccuccccuacgucgcccacuggcgcaaccuccacuuccacugcaugaccgagaacgaguacgaggacgaggaggccgccgaggaguucaagaucaccuccuucgucgacaugguccgcgacugcucccgcaucggcauccccuacuccucccagggccaccuccagaucuucgacauguucgucgucgagaaguggcccaucguccaggccuucgcccucgagggcaucggcggcgacggcuucuucaccaugaaguacgagcuccaggacgucucccucaaccucuggaacgucuacuccaagauggaccccaugucccucgagucccuccucuccgacgaccucgucgccuucgagcaccaguggaccuccuucuucgccaacuucgacaccgagauccccuuccuccucgagcucuccgagucccaggccggcgagcccuuccgcuccuacuucucccacggcaugaucuccucccacaucaccgagaacucccccaaccgccagcccuucguccucuucggcaaccacuccacccgcgagaaccucaacgccggcaacuucaacuuccccuccgagggccaccucguccgcuccaccggccccggcggcuccuucgccaagcacauggucgcccagugcgucucccccaagggcccccucgccugcucccgcaccuacuucuucggcgccacccacguccccuaccucggcggcgacuccaagcuccccaagaagaccgagcagauccgccuccucucccagaucuacgccgccgucaucgaggccguccucgccggcaucgccugcuacgccaagaccuccucccucaccaaggccaaggaggucgccgagcagacccucggcuccggccucgacuccuucgagcucauccccuucaaggccgcccuccgcuccaagaugaccuuccacauccacgccgucaacaaccagggccgcaucgucccccucgacuccgaggacucccucuccuucgucaagaccgccugcauggccgucuacgacauccccgaccuccucggcggcaacggcugccucggcuccgucgucuucuccgaguccuuccucaccucccagauccucgucaaggagaaggacggcaccgucaccaccgagaccuccuccgucguccucaccgccgccgucccccgcuucugcuccuggcucgucgaggacaacgaggucaagcucuccgagaagacccagcaggccguccgcggcgacgaguccuuccucggcaccuaccucaccggcggcgagggcgccuaccucuacuccuccaaccuccaguccuggcccgaggagggcaacguccacuucuucuccuccggccuccucuucucccacugccgccaccgcuccaucaucaucuccaaggaccacaugaacuccaucuccuucuacgacggcgacuccaccuccaccgucgccgcccuccucaucgacuucaaguccucccuccucccccaccuccccguccacuuccacggcuccuccaacuuccucaugaucgcccucuuccccaaguccaagaucuaccaggccuucuacuccgaggucuucucccucuggaagcagcaggacaacuccggcaucucccucaaggucauccaggaggacggccucuccgucgagcagaagcgccuccacuccuccgcccagaagcucuucuccgcccucucccagcccgccggcgagaagcgcuccucccucaagcuccucuccgccaagcuccccgagcucgacugguuccuccagcacuucgccaucuccuccaucucccaggagcccgucaugcgcacccaccuccccguccuccuccagcaggccgagaucaacaccacccaccgcaucgaguccgacaaggucaucaucuccaucgucaccggccuccccggcugccacgccuccgagcucugcgccuuccucgucacccuccacaaggagugcggccgcuggauggucuaccgccagaucauggacuccuccgagugcuuccacgccgcccacuuccagcgcuaccucuccuccgcccucgaggcccagcagaaccgcuccgcccgccaguccgccuacauccgcaagaagacccgccuccucgucguccuccagggcuacaccgacgucaucgacgucguccaggcccuccagacccaccccgacuccaacgucaaggccuccuucaccaucggcgccaucaccgccugcgucgagcccauguccugcuacauggagcaccgcuuccucuuccccaagugccucgaccagugcucccagggccucgucuccaacgucgucuucaccucccacaccaccgagcagcgccacccccuccucguccagcuccagucccucauccgcgccgccaaccccgccgccgccuucauccucgccgagaacggcaucgucacccgcaacgaggacaucgagcucauccucuccgagaacuccuucuccucccccgagaugcuccgcucccgcuaccucauguaccccggcugguacgagggcaagcucaacgccggcuccgucuacccccucaugguccagaucugcgucugguucggccgcccccucgagaagacccgcuucgucgccaagugcaaggccauccaguccuccaucaagcccucccccuucuccggcaacaucuaccacauccucggcaaggucaaguucuccgacuccgagcgcaccauggaggucugcuacaacacccucgccaacucccucuccaucaugcccguccucgagggccccacccccccccccgacuccaaguccgucucccaggacuccuccggccagcaggagugcuaccucgucuucaucggcugcucccucaaggaggacuccaucaaggacuggcuccgccaguccgccaagcagaagccccagcgcaaggcccucaagacccgcggcaugcucacccagcaggagauccgcuccauccacgucaagcgccaccucgagccccuccccgccggcuacuucuacaacggcacccaguucgucaacuucuucggcgacaagaccgacuuccacccccucauggaccaguucaugaacgacuacgucgaggaggccaaccgcgagaucgagaaguacaaccaggagcucgagcagcaggaguaccacgaccucuucgagcucaagcccuga

SEQ ID NO: 40556 - RNA, 618 nt, Artificial Sequence
  derived and/or modified sequence opt2 from C20orf196__Homo_sapiens__NP_001290406
auggccgcccgcgacgccaccuccggcucccucuccgaggaguccuccgcccucgaccuccccuccgccugcgacauccgcgacuacguccuccagggccccucccaggaggccaacuccgaggccuucuccucccucgaguuccacuccuuccccuacuccuccgacgucgaccccgacaccuccaaccucaacaucgagcagaacaacuccuggaccgccgagaacuucuggcucgaccccgccgucaagggccaguccgagaaggaggaggacgacggccuccgcaagucccucgaccgcuucuacgagauguucggccacccccagcccggcuccgccaacucccucuccgccuccgucugcaagugccucucccagaagaucacccagcuccgcggccaggagucccagaaguacgcccuccgcuccuuccagauggcccgcgucaucuucaaccgcgacggcugcuccguccuccagcgccacucccgcgacacccacuucuacccccucgaggagggcuccaccucccucgacgacgagaagcccaaccccggccucuccaaggacaucacccacuuccuccuccagcagaacgucaugaaggaccucuga

SEQ ID NO: 40557 - RNA, 600 nt, Artificial Sequence
  derived and/or modified sequence opt2 from C20orf27__Homo_sapiens__NP_001034229
auggccgccgccaacaagggcaagugccuccccggcgucgucggccucgcccaggcccuccccgucggccccggccgccgcgccaucgccgccggcaacaagccccgcguccgcuccauccgcuucgccgccggccacgacgccgagggcucccacucccacguccacuucgacgagaagcuccacgacuccgucgucauggucacccaggaguccgacuccuccuuccucgucaaggucggcuuccucaagauccuccaccgcuacgagaucaccuucacccucccccccguccaccgccucuccaaggacguccgcgaggcccccguccccucccuccaccucaagcuccucuccgucguccccguccccgagggcuacuccgucaagugcgaguacuccgcccacaaggagggcguccucaaggaggagauccuccucgccugcgagggcggcaccggcaccugcguccgcgucaccguccaggcccgcgucauggaccgccaccacggcacccccaugcuccucgacggcgucaagugcgucggcgccgagcucgaguacgacuccgagcacuccgacuggcacggcuucgacuga

SEQ ID NO: 40558 - RNA, 414 nt, Artificial Sequence
  derived and/or modified sequence opt2 from C20orf85__Homo_sapiens__NP_848551
auggcccagaagccccucuccaccgccgccgccgagcgcaugaaccucgucggccaggacgagaucuggaaguaccgccucaaggccgaguccgaggcccgccagaacuggccccagaacuggggcuuccucaccacccccuucgaggagcucaucaagugcgaggaggaccuccccacccccaagcccaagaucgagcuccccgagcgcuuccgcauccgccccgucacccccgucgagaaguacaucaaggucuuccccuccccccccgucccccagaccacccagggcuucaucggcuggcgcuccgccguccccggccucaacaagugccucgagcucgacgacgccauccgcuccugcaagggcgccuucgcccgcgagcucugcuggcccaagcagggcguccacuga

SEQ ID NO: 40559 - RNA, 768 nt, Artificial Sequence
  derived and/or modified sequence opt2 from C21orf2__Homo_sapiens__NP_001258369
augaagcucacccgcaagaugguccucacccgcgccaaggccuccgagcuccacuccguccgcaagcucaacugcuggggcucccgccucaccgacaucuccaucugccaggagaugcccucccucgaggucaucacccucuccgucaacuccaucuccacccucgagcccgucucccgcugccagcgccucuccgagcucuaccuccgccgcaaccgcauccccucccucgccgagcucuucuaccucaagggccucccccgccuccgcguccucuggcucgccgagaaccccugcugcggcaccuccccccaccgcuaccgcaugaccguccuccgcacccucccccgccuccagaagcucgacaaccaggccgucaccgaggaggagcucucccgcgcccucuccgagggcgaggagaucaccgccgcccccgagcgcgagggcaccggccacggcggccccaagcucugcugcacccucuccucccucuccuccgccgccgagaccggccgcgacccccucgacuccgaggaggaggccaccggcgcccaggacgagcgcggccucaagccccccucccgcggccaguuccccucccucuccgcccgcgacgccuccuccucccaccgcggccgcaacguccucaccgccauccuccuccuccuccgcgagcucgacgccgagggccucgaggccguccagcagaccgucggcucccgccuccaggcccuccgcggcgaggagguccaggagcacgccgaguga

SEQ ID NO: 40560 - RNA, 807 nt, Artificial Sequence
  derived and/or modified sequence opt2 from C21orf33__Homo_sapiens__NP_004640
auggccgccguccgcguccucgucgccucccgccucgccgccgccuccgccuucaccucccucucccccggcggccgcacccccucccagcgcgccgcccuccaccucuccgucccccgccccgccgcccgcgucgcccucguccucuccggcugcggcgucuacgacggcaccgagauccacgaggccuccgccauccucguccaccucucccgcggcggcgccgagguccagaucuucgcccccgacgucccccagaugcacgucaucgaccacaccaagggccagcccuccgagggcgagucccgcaacguccucaccgaguccgcccgcaucgcccgcggcaagaucaccgaccucgccaaccucuccgccgccaaccacgacgccgccaucuuccccggcggcuucggcgccgccaagaaccucuccaccuucgccgucgacggcaaggacugcaaggucaacaaggaggucgagcgcguccucaaggaguuccaccaggccggcaagcccaucggccucugcugcaucgcccccguccucgccgccaagguccuccgcggcgucgaggucaccgucggccacgagcaggaggagggcggcaaguggcccuacgccggcaccgccgaggccaucaaggcccucggcgccaagcacugcgucaaggaggucgucgaggcccacgucgaccagaagaacaaggucgucaccacccccgccuucaugugcgagaccgcccuccacuacauccacgacggcaucggcgccaugguccgcaagguccucgagcucaccggcaaguga

SEQ ID NO: 40561 - RNA, 873 nt, Artificial Sequence
  derived and/or modified sequence opt2 from C21orf59__Homo_sapiens__NP_067077
augguccuccuccacgucaagcgcggcgacgagucccaguuccuccuccaggcccccggcuccaccgagcucgaggagcucaccguccaggucgcccgcgucuacaacggccgccucaagguccagcgccucugcuccgagauggaggagcucgccgagcacggcaucuuccucccccccaacaugcagggccucaccgacgaccagaucgaggagcucaagcucaaggacgaguggggcgagaagugcguccccuccggcggcgccgucuucaagaaggacgacaucggccgccgcaacggccaggcccccaacgagaagaugaagcagguccucaagaagaccaucgaggaggccaaggccaucaucuccaagaagcaggucgaggccggcgucugcgucaccauggagauggucaaggacgcccucgaccagcuccgcggcgccgucaugaucgucuaccccaugggccucccccccuacgaccccauccgcauggaguucgagaacaaggaggaccucuccggcacccaggccggccucaacgucaucaaggaggccgaggcccagcucuggugggccgccaaggagcuccgccgcaccaagaagcucuccgacuacgucggcaagaacgagaagaccaagaucaucgccaagauccagcagcgcggccagggcgcccccgcccgcgagcccaucaucuccuccgaggagcagaagcagcucaugcucuacuaccaccgccgccaggaggagcucaagcgccucgaggagaacgacgacgacgccuaccucaacucccccugggccgacaacaccgcccucaagcgccacuuccacggcgucaaggacaucaaguggcgcccccgcuga

SEQ ID NO: 40562 - RNA, 660 nt, Artificial Sequence
  derived and/or modified sequence opt2 from C21orf62__Homo_sapiens__XP_011545334
auggccccccccucccgccacugccuccuccucaucuccacccucggcgucuucgcccucaacugcuucaccaagggccagaagaacuccacccucaucuucacccgcgagaacaccauccgcaacugcuccugcuccgccgacauccgcgacugcgacuacucccucgccaaccucaugugcaacugcaagaccguccucccccucgccgucgagcgcaccuccuacaacggccaccucaccaucugguucaccgacaccuccgcccucggccaccuccucaacuucacccucguccaggaccucaagcucucccucugcuccaccaacacccuccccaccgaguaccucgccaucugcggccucaagcgccuccgcaucaacauggaggccaagcaccccuuccccgagcagucccuccucauccacuccggcggcgacuccgacucccgcgagaagcccauguggcuccacaagggcuggcagcccugcauguacaucuccuuccucgacauggcccucuucaaccgcgacuccgcccucaaguccuacuccaucgagaacgucaccuccaucgccaacaacuuccccgacuucuccuacuuccgcaccuuccccaugcccuccaacaaguccuacgucgucaccuucaucuacuga

SEQ ID NO: 40563 - RNA, 894 nt, Artificial Sequence
  derived and/or modified sequence opt2 from C21orf91__Homo_sapiens__NP_001093890
augaacgaggaggagcaguucgucaacaucgaccucaacgacgacaacaucugcuccgucugcaagcucggcaccgacaaggagacccucuccuucugccacaucugcuucgagcucaacaucgagggcguccccaaguccgaccuccuccacaccaagucccuccgcggccacaaggacugcuucgagaaguaccaccucaucgccaaccagggcugcccccgcuccaagcucuccaaguccaccuacgaggaggucaagaccauccucuccaagaagaucaacuggaucguccaguacgcccagaacaaggaccucgacuccgacuccgagugcuccaagaacccccagcaccaccucuucaacuuccgccacaagcccgaggagaagcuccucccccaguucgacucccagguccccaaguacuccgccaaguggaucgacggcuccgccggcggcaucuccaacugcacccagcgcauccucgagcagcgcgagaacaccgacuucggccucuccaugcuccaggacuccggcgccacccucugccgcaacuccguccucuggccccacucccacaaccaggcccagaagaaggaggagaccaucuccucccccgaggccaacguccagacccagcacccccacuacucccgcgaggagcucaacuccaugacccucggcgaggucgagcagcucaacgccaagcuccuccagcagauccaggaggucuucgaggagcucacccaccagguccaggagaaggacucccucgccucccagcuccacguccgccacgucgccaucgagcagcuccucaagaacugcuccaagcuccccugccuccaggucggccgcaccggcaugaagucccaccuccccaucaacaacuga

SEQ ID NO: 40564 - RNA, 1095 nt, Artificial Sequence
  derived and/or modified sequence opt2 from C22orf29__Homo_sapiens__NP_078903
augccccgcggccgcugccgccagcagggcccccgcauccccaucugggccgccgccaacuacgccaacgcccaccccuggcagcagauggacaaggccucccccggcgucgccuacaccccccucgucgaccccuggaucgagcgccccugcugcggcgacaccgucugcguccgcaccaccauggagcagaaguccaccgccuccggcaccugcggcggcaagcccgccgagcgcggcccccucgccggccacaugcccuccucccgcccccaccgcgucgacuucugcuggguccccggcuccgaccccggcaccuucgacggcucccccuggcuccucgaccgcuuccucgcccagcucggcgacuacauguccuuccacuucgagcacuaccaggacaacaucucccgcgucugcgagauccuccgccgccucaccggccgcgcccaggccugggccgcccccuaccucgacggcgaccucccccuccccgacgacuacgagcucuucugccaggaccucaaggaggucguccaggaccccaacuccuucgccgaguaccacgccgucgucaccugcccccucccccucgccuccucccagcuccccgucgccccccagcuccccgucguccgccaguaccucgcccgcuuccucgagggccucgcccucgacaugggcaccgccccccgcucccuccccgccgccauggccacccccgccgucuccggcuccaacuccgucucccgcuccgcccucuucgagcagcagcucaccaaggaguccacccccggccccaaggagccccccguccuccccuccuccaccugcuccuccaagcccggccccgucgagcccgccuccucccagcccgaggaggccgcccccacccccgucccccgccucuccgaguccgccaacccccccgcccagcgccccgaccccgcccaccccggcggccccaagccccagaagaccgaggaggagguccucgagaccgagggcgaccaggaggucucccucggcaccccccaggaggucgucgaggcccccgagacccccggcgagcccccccucucccccggcuucuga

SEQ ID NO: 40565 - RNA, 7062 nt, Artificial Sequence
  derived and/or modified sequence opt2 from C2CD3__Homo_sapiens__NP_001273506
augaagcagcgcaagggccagggcuccggcggcucccgcggccgcaagaagcgcggccucuccgacaucucccccuccaccucccuccccccccucgucgagggccagcuccgcugcuuccucaagcucaccgucaaccgcgucaucuggaagaucgccaagccccccaccugcguccucguccgcguccgcugguggggcgagaccuccgacggcacccucuucugcccccgcgacgcccuccagaccgagcccaaggccguccgcaccaccacccgcuacgccauccgcugcggccccaagcaguucaccuccuaccucaccgacauggccguccucguccucgaggucaucaccaagcucgacggccuccccaucggccgcguccagaucaacggccucgcccagcucucccccacccaccagaucaacggcuucuucaccaucgucuccuccaccuccaagaagcucggcgagcuccaggucucccucgcccucgagccccucuccgagaccuacgacuccuaccacccccuccccaccaccgacaugaccgagaacguccuccucuccaagcagggcuuccgcgagaacaccgagcccuccuccacccaguuccagguccccucccgcccccgcgacauccacaccaucaagaucgacggcaaggagcucgccgccaacuccucccgcuccaccaccccccgcggcaaggaccacgucugcuucgccgagaaccccgacaccaucaaggacuccuccuucggccuccagcacucccucaacuccggccagucccucgaguccgucacccucaagggccgcgccccccgcaagcagaugucccuccucaacuccuccgaguuccagccccagauccgcaccgucgccaagucccacuccgacuccugcauccucuccuccaacaaccuccccaccaaggaccuccucuccgcccuccucgagcagggcaacaagcuccgcaacgccauggucaucuccgccaugaaguccucccccgagaccuccaugcuccucgaccagguccacccccccaucaacgaggacucccuccgcgccuccacccagauccgcgccuucucccgcaaccgcuucaaggaccacaucgaggaccaccuccuccccuccaccgagaacaccuucuggcgccacgacaccaaggccgacacccgcgccauccagcuccuccucggcuccgccgagcucucccagggcaacuucugggacggccucggcuccccccccgacucccccucccccggcuccgacgucuacugcaucuccgagcucaacgacccccaguacgaccagucccuccucgagaaccucuucuacaccgcccccaaguccgacaccuccaucuccgacuuccucuccgaggaggacgacaucguccccuccaagaagaucucccaguccaccgcccucgcccgcuccuccaagguccucgaguccuccgaccacaagcucaagaagcgcuccgccggcaagcgcaaccgcaaccucgucgagcagcagaugcucuccgagacccccgaggacgcccagaccaugacccucuccgucgaccgccucgcccuccucggccgcacccacuccguccgcaucaucaucgagaccaugggcgucccccccgacuccccccagaugacccccggcaagaaguccuacgccggccccccccccaaggucaccaccgccaagaagcgcaccuucuucgucgaguaccacuuccccgucggcuucuccgaguccggccucggcaagaccgcccucaucaccgaggucguccgccucgccuccuccaagaucaccgacggcaaggucaaguuccagcagcgcuucgucuuccccguccaguucggcggccccaugaucgagcacugguggaacuccaaccucaccuuccagaucuacgucaagaagaccccccagaagaagcccgaggucaucggcuccgucucccucucccuccgcgccgucauccaguccgagcuccucuccuucuccgaccagcuccccguccagcaggagaacggccagucccccuucggcccccucaaggucaccauggagcucaucaccgacaacaaggacuucaccggcaucaacaccaagcucuccggcaacacccacuacaccccccucugcgcccccaccucccccaacaaggcccuccccgagcucaaccaggacaugaccugcaccaagaacccccagaaccucaaccagauccacgaggagaccgccaagaaggcccagaaccucguccuccccaaccgcaagucccccucccccgucgccccccaccccuccaccuucgucgccacccccgccucccacaaccucgucaaccagaccaacggcaccaccaaggaguccgcccuccuccuccacguccuccucaugguccccgacggcaaggacuucaucuccggcgaguccgagaagcagucccccugcaacgucuaccucaacugcaagcucuucuccaccgaggaggucacccgcuccgucaucgccuggggcaccacccagcccgucuucaacuucucccaggucauccccgucucccucuccuccaaguaccucgagcgccucaagaacaacgucauggucaucgagaccuggaacaagguccgcucccccggccaggacaagcuccucggccucgucaagcucccccuccaccaguucuacauguccuucaaggacgccaagaucucccgccuccuccucgacgcccaguaccccgucgucgccgucgacuccuacaugcccgucaucgacgucuucuccggccaccagaacggcucccuccgcgucuuccucgccaugggcuccuccaaccagaucauggcccuccagcgccucaagaacgaggagggcacccucccccccuucuccccccgccccgcccacuuccucgaccagcccaccgccgccuccgucgccauggccgaggaccgcggcaacggccucauggagcacugcuucgagauccacaucgagauggucaagggccucgccccccuccaggccaccgucuggggcgaggccgacugcuacguccaguacuacuuccccguccagcacucccaguccuccguccucaagggccccgaguuccucgagaacggcaucacccucaagcccuuccgcaccgccaccacccucugcguccccgaccccaucuucaacuccgagcaccaccacucccuccuccuccccgccgagguccccguccagcgccuccuccucuccgccuucuccgcccagggccucguccccggcggcggcguccaguucgagaucuggugccgcuacuacuaccccaacguccgcgaccagaaggucgccaagggcacccucccccucucccgcaucugcgccauggucaccacccagcaccgcgaggacgucggcauccagaccuucaaccucccccucaccccccgcaucgagaaccgcaaggagcuccgcaaccaguccuccggccuccucgacgucggccuccgcuaccgccgcuccccccgcaccgccgagggcguccucgccgcccgcaccgucuccaucuccguccagaucauccgcgccugcggccuccaggccgccgccaaggcccucgccgagcgcgagcccgcccuccaguucuccgccaccgucggcgucaacgccuccgucaccacccaccucuccuuccucccccagggcgagcagcgccgcacccaccccgucgccugcuccuucugccccgaguucucccaccacgucgaguucaccugcaaccucgucacccagcacugcuccggcgaggccugcuuccucgccgagcuccucgaguucgccgaggucaucuucgccgucuaccacgagaacaccaaguccgccuccgacaucaucuccaucgaguccugcaaggaguaccuccucggcgucgucaagguccccaccaaggagcuccucaucaagcgcuccggcaucaccggcugguaccccaucauccuccccgaggacggcggccucccccacggccucgagcucaugcagaagaucgucggcggccucgagcucuccaucuccuucacccaccgcggcgaccgcgagcgcguccucgaggccgccgagcaccucggcugguccuucgagaacucccucaaggacuucguccgcauggacgagggcgagcccgccaccgucaccaucuccaccccccgccucuggcuccccauccacugcguccuccucgccggccacaaccacauccacaagaacaccuacugcuaccuccgcuacaaguucuacgaccacgaggccuucuggaccccccucaagaagcccaaggaguccgucaacaagaagcagaucauggucaccuucaaggccuccaagcgcgccgaggucacccgcggccccucccuccucugguacuuccgcgaggagcgccucgagauccaggucuggcgcgccuacggcaacgacuccgucgagcgcccccaccagaccgacuccuggaucggcuccgccuacgucgaccucgcccgccucggcgagcgcuccgcccgcacccucaccgucuccggcgucuacccccucuucggccgcaacgccuccaaccucuccggcgccgcccuccgcguccacgucguccucuccucccucuccucccaccucgagcccacccacgagcucgacuccauggacugcuccucccacuccgaguccgagcagcucccccgccgcaacgacgagguccagcucuccccccccgaggucaucuccugccaccagaagucccccgccuccacccagguccccugcuccuccaccaccgccgagguccgccucacccaggagggccccgccgaccucgacggcaccuucgccgucuccauccucgucgagcgcgccaugcaccucucccucaagggcuccccccucaccgagcgcaaggucuccauccccuccugcugcgucuccuucgccaccgccgacgaguccucccccgucuacacccaggucgucgagaacaccgacucccccaucuggaacuuccagcagcagucccgccucuccaaggagcuccuccucgacccccagcagacccucgucuucaaggucuggcacaagggcgacgaggagcgcgucaucggcuucgccuccgucgaccucuccccccuccucuccggcuuccaguucgucugcggcugguacaacaucaccgacuucuccggcgagugccagggccagaucaaggucgccgucuccccccucgagucccucauccacuucaaggaggagcgccaggcccgccgcggcgucgagaccuccaagucccucauccccaucuacucccccuucuccuuccccgccuccgacaccuacgccgccuucuccucccacauggcccgccagacccucgaccagcucgcccacgccuccuccaaggagcucgacuucuccucccccggccgcuccgacaccacccgcucccaggccucccgccacgaggagcacguccagaacauccgccgcuuccacgagucccuccaccuccagggcgaggccccccuccccugcgacgacaagcucaccaccuccccccucuccucccagaccuccauccucaccucccuccgcaagaaccucuccgagcucgaccagauccagcgcuacuuccgccagaagcucaccaagcccuuccucccccucuccccccagacccagaccgccaucucccagcaccaggaguccugccgcgaccaccucggccccggcgccuccucccucgaccccggcucccagugcauccucgagaaguccuccaaccucguccuccaggucuccucccucaucaccgaccuccagaccaucacccgcgacucccaggccgcccucuccucccaccgcgcccgcucccgcuccaacaaggccaccacccuccccgacgcccaggacaccgaggcccuccaggagcgcugcaccaugcccgacgagccccucguccgcgcccccgacaagggcaccgacucccccuccccccccccccucgaggagaccuccaacggcggccgcaugcuccacgagucccuccgccacgccguccccaucacccgcaugcaguccuccgaggacaccgaggccggccccgccuacuccgacgaggacuacgaggaggacaucaucgagccccgcacccucaacgagaucaccaccgucaccgacaagaccucccccugguccuccgucaucuccgacaccuccgaggucaucuccccccagcccgacgagguccagcgcgagggccccuccugccccucccccggccccuucugccgcgaggagcucauggucaaguccuccuuccucuccucccccgagcgcgccgucaacccccaccucccccgccagggcucccccucccagucccucgucgccugcgagugcgaggccuccaaggcccgcgucggcggcgaguccgccuccgccaacccccagcccauccccugccccacccucuccggcgcccagcaguccuccaccuucgucggcugguccuccccccagaccgaccagaacaaggagcccaaguccgaggcccccgccgagaacgaggccgccaccuccgagcucggcgacuccgccgacuccuucaagaagcucccccucaaccucgccucccagucccgccgcgagaaccacaagggcccccccaucgacuccuccgacauccgccagcgccaggucaccaccggcuccgagaccuccaccaagcagucccuccuccuccccggccccaucgucguccccaacuucuuccuccccccccagcagcucgaggccucccuccgcaugcucucccucuccgccacccucccccccgccgccaccaccgaccaggacaaguccgaggccacccgcggcgcccucucccagcgccccugccgcccccgccccaacucccucccccucaaccuccccgaggaggagacccuccgcaucgcccgcaucuucuccucccaguacucccagaaggacuga

SEQ ID NO: 40566 - RNA, 1110 nt, Artificial Sequence
  derived and/or modified sequence opt2 from C2CD4A__Homo_sapiens__NP_997205
auguggugccucgagcgccuccgccucggccccgagugccuccgccgcuccggcgacuggcuccuccccggccgcgcccgcggcgccaagucccgcaccaccgccgccugcgccaacguccucacccccgaccgcauccccgaguucugcauccccccccgccucaugccccgccucgcccucgccgcccuccgcaacuccugggucgaggaggccggcauggacgagggcgccggccgcaccgacugggacccccgcucccaggccgcccucucccucccccaccucccccgcguccgcaccgccuacggcuucugcgcccuccucgaguccccccacacccgccgcaaggagucccuccuccucggcggcccccccgccccccgcccccgcgcccacaccuacggcggcggcggcggccccgacgcccuccucggcacccuccgcgucccccgcgcccccggccccgccacccccgccgcccccggcugcccccgccccccccaggacgcccucgcccgccgcccccgcggcugccgccuccuccgcguccccgacggccuccucucccgcgcccuccgcgccggccgcucccgccgccucacccgcguccgcuccgucuccuccggcaacgaggacaaggagcgccgcgccggcucccagucccccgcccgcgcccccuccaccuccccccccuccucccgcguccccuuccccgagcgccucgaggccgagggcaccgucgcccucggccgcgccggcgacgcccuccgccucgccgccgaguacugccccggcaccggccgccuccgccuccgccuccuccgcgccgagucccccgccggcggcgcccccggcccccgcgccgucuccugccgccucucccucguccuccgcccccccggcaccgcccuccgccagugcuccaccgucgucggccgcucccgcaaggccuccuucgaccaggacuucugcuucgacggccucuccgaggacgagguccgccgccucgccguccgcgucaaggcccgcgacgagggccgcggccgcgagcgcggccgccuccucggccagggcgagcucucccucggcgcccuccuccuccucuga

SEQ ID NO: 40567 - RNA, 1095 nt, Artificial Sequence
  derived and/or modified sequence opt2 from C2CD4B__Homo_sapiens__NP_001007596
augcgccuccucgagaagcucugcuccuccgccgccggcuccuccgcccccaagcccgccuucgccaagguccucacccccaaccgcauccccgaguucugcauccccccccgccuccccgcccccugcacccucgagucccccauccgcgccgccgccgucccccgccgcugcgccgccgaguccgaccucuggccccgcgccgccgacgaggacgccggccgcaccgacugggacccccgcucccaggccgcccucucccucccccaccucccccgcguccgcaccaccuacggcuucugcgcccuccucgaguccccccacacccgccgcaaggagucccuccuccucggcggcccccccgccccccgcccccgcgcccacuccugcggcggcggcggcggccccgacgccccccucggcacccucugcggcccccgcggccccggccccgccacccccgccgcccccggcggcccccgccucccccaggacgcccucgccgccggcccccgccgcugccgccuccuccgcguccccgacggccuccucucccgcgcccuccgcgccggccgcucccgccgccucgcccgcguccgcuccgucuccuccggcaacgaggacgaggagcgccgcgccggcuccgagucccccgcccgcgcccccuccuccuccccccucuccucccgcgccccccuccccgagcgccucgaggccaagggcaccgucgcccucggccgcgccggcgacgcccuccgccucgccgccgaguacugccccggcacccgccgccuccgccuccgccuccuccgcgccgagucccucuucggcggcgcccccggcccccgcgccguccgcugccgccucucccucguccuccgcccccccggcaccgcccgcuggcagugcuccgccgucgucggccgcucccgcaaggccuccuucgaccaggacuucugcuucgacggccucuccgaggacgagguccgccgccucgccguccgcgucaaggcccgcgacgagggccgcggccgcgaccgcggccgccuccucggccagggcgagcucucccucggcgcccuccuccuccucuga

SEQ ID NO: 40568 - RNA, 3165 nt, Artificial Sequence
  derived and/or modified sequence opt2 from C2CD5__Homo_sapiens__NP_001273104
augcccggcaagcucaaggucaagaucgucgccggccgccaccuccccgucauggaccgcgccuccgaccucaccgacgccuucgucgaggucaaguucggcaacaccaccuucaagaccgacgucuaccucaagucccucaacccccaguggaacuccgagugguucaaguucgaggucgacgacgaggaccuccaggacgagccccuccagaucaccguccucgaccacgacaccuacuccgccaacgacgccaucggcaaggucuacaucgacaucgacccccuccucuacuccgaggccgccaccgucaucuccggcugguuccccaucuacgacaccauccacggcauccgcggcgagaucaacgucgucgucaaggucgaccucuucaacgaccucaaccgcuuccgccaguccuccugcggcgucaaguucuucugcaccaccuccauccccaagugcuaccgcgccgucaucauccacggcuucgucgaggagcucgucgucaacgaggaccccgaguaccaguggaucgaccgcauccgcaccccccgcgccuccaacgaggcccgccagcgccucaucucccucauguccggcgagcuccagcgcaagaucggccucaagguccucgagaugcgcggcaacgccgucgucggcuaccuccagugcuucgaccucgagggcgaguccggccucgucguccgcgccaucggcaccgccugcacccucgacaagcucuccucccccgccgccuuccuccccgccugcaacucccccuccaaggagaugaaggaguccccccucguccacccccccucccacggcugccgcuccacccacaacucccccauccacaccgccaccggcucccgccucacccagaacuucuccgucuccguccccacccucaucuacaccggcaugggcuccggcuccgccggcaaggagggcggccccuucaaggcccuccuccgccagcagacccaguccgcccucgagcagcgcgaguuccccuucuucacccucaccgccuucccccccggcuuccucguccacgucggcggcgucgucuccgcccgcuccgucaagcuccucgaccgcauccacaaccccgccuucgucggcaucaugggcaacacccgcuccuacaagcuccucgacuggaacuccuucaacuccgacgagcccgagacccgcgacgccuggugggccgagauccgccaggagaucaagucccacgccaaggcccucggcugccacgccgucgucggcuacuccgaguccaccuccaucugcgaggaggucugcauccucuccgccuccggcaccgccgccguccucaacccccgcuuccuccaggacggcaccgucgagggcugccucgagcagcgccucgaggagaaccuccccacccgcugcggcuucugccacauccccuacgacgagcucaacaugcccuuccccgcccaccucaccuacugcuacaacugccgcaagcagaagguccccgacguccucuucaccaccaucgaccuccccaccgacgccaccgucaucggcaagggcugccucauccaggcccgccucugccgccucaagaagaaggcccaggccgaggccaacgccaccgccaucuccaaccuccuccccuucauggaguacgagguccacacccagcucaugaacaagcucaagcucaagggcaugaacgcccucuucggccuccgcauccagaucaccgucggcgagaacaugcucaugggccucgccuccgccaccggcgucuaccucgccgcccuccccacccccggcggcauccagaucgccggcaagacccccaacgacggcuccuacgagcagcacaucucccacaugcagaagaagaucaacgacaccaucgccaagaacaaggagcucuacgagaucaacccccccgagaucuccgaggagaucaucggcucccccauccccgagccccgccagcgcucccgccuccuccgcucccaguccgaguccuccgacgaggucaccgagcucgaccucucccacggcaagaaggacgccuucguccucgagaucgacgacaccgacgccauggaggacguccacucccuccucaccgacguccccccccccuccggcuucuacuccugcaacaccgagaucaugcccggcaucaacaacuggaccuccgagauccagauguucaccuccguccgcgucauccgccucuccucccucaaccucaccaaccaggcccucaacaagaacuucaacgaccucugcgagaaccuccucaagucccucuacuucaagcuccgcuccaugauccccugcugccucugccacgucaacuucaccgucucccuccccgaggacgagcucauccaggucaccgucaccgccgucgccaucaccuucgacaagaaccaggcccuccagaccaccaagacccccgucgagaagucccuccagcgcgccuccaccgacaacgaggagcuccuccaguucccccucgagcucugcuccgacucccuccccucccaccccuucccccccgccaaggagcaccucgaguccgccuccuccaacuccggcauccccgccgcccagcgcgaccgcugcuccuccuggaucgagcucaucaagcucaaggcccagaccauccgccgcggcuccaucaagaccaccaugaccgucgagaaggccucccccgucggcgacggcaacuuccgcaaccgcuccgccccccccugcgccaacuccaccgucggcgucgucaagaugaccccccucuccuucauccccggcgccaagaucaccaaguaccucggcaucaucaacauguucuucauccgcgagaccaccucccuccgcgaggagggcggcgucuccggcuuccuccacgccuucaucgccgaggucuucgccaugguccgcgcccacgucgccgcccucggcggcaacgccgucgucuccuacaucaugaagcagugcgucuucauggagaaccccaacaagaaccaggcccagugccucaucaacgucuccggcgacgccgucgucuucguccgcgaguccgaccucgaggucgucuccucccagcagcccaccaccaacugccaguccuccugcaccgagggcgaggucaccaccuga

SEQ ID NO: 40569 - RNA, 2259 nt, Artificial Sequence
  derived and/or modified sequence opt2 from C2__Homo_sapiens__NP_000054
augggcccccucaugguccucuucugccuccucuuccucuaccccggccucgccgacuccgcccccuccugcccccagaacgucaacaucuccggcggcaccuucacccucucccacggcugggcccccggcucccuccucaccuacuccugcccccagggccucuaccccucccccgccucccgccucugcaaguccuccggccaguggcagacccccggcgccacccgcucccucuccaaggccgucugcaagcccguccgcugccccgcccccgucuccuucgagaacggcaucuacaccccccgccucggcuccuaccccgucggcggcaacgucuccuucgagugcgaggacggcuucauccuccgcggcucccccguccgccagugccgccccaacggcaugugggacggcgagaccgccgucugcgacaacggcgccggccacugccccaaccccggcaucucccucggcgccguccgcaccggcuuccgcuucggccacggcgacaagguccgcuaccgcugcuccuccaaccucguccucaccggcuccuccgagcgcgagugccagggcaacggcgucugguccggcaccgagcccaucugccgccagcccuacuccuacgacuuccccgaggacgucgcccccgcccucggcaccuccuucucccacaugcucggcgccaccaaccccacccagaagaccaaggagucccucggccgcaagauccagauccagcgcuccggccaccucaaccucuaccuccuccucgacugcucccaguccgucuccgagaacgacuuccucaucuucaaggaguccgccucccucauggucgaccgcaucuucuccuucgagaucaacgucuccgucgccaucaucaccuucgccuccgagcccaagguccucauguccguccucaacgacaacucccgcgacaugaccgaggucaucuccucccucgagaacgccaacuacaaggaccacgagaacggcaccggcaccaacaccuacgccgcccucaacuccgucuaccucaugaugaacaaccagaugcgccuccucggcauggagaccauggccuggcaggagauccgccacgccaucauccuccucaccgacggcaaguccaacaugggcggcucccccaagaccgccgucgaccacauccgcgagauccucaacaucaaccagaagcgcaacgacuaccucgacaucuacgccaucggcgucggcaagcucgacgucgacuggcgcgagcucaacgagcucggcuccaagaaggacggcgagcgccacgccuucauccuccaggacaccaaggcccuccaccaggucuucgagcacaugcucgacgucuccaagcucaccgacaccaucugcggcgucggcaacauguccgccaacgccuccgaccaggagcgcacccccuggcacgucaccaucaagcccaagucccaggagaccugccgcggcgcccucaucuccgaccaguggguccucaccgccgcccacugcuuccgcgacggcaacgaccacucccucuggcgcgucaacgucggcgaccccaagucccaguggggcaaggaguuccucaucgagaaggccgucaucucccccggcuucgacgucuucgccaagaagaaccagggcauccucgaguucuacggcgacgacaucgcccuccucaagcucgcccagaaggucaagauguccacccacgcccgccccaucugccuccccugcaccauggaggccaaccucgcccuccgccgcccccagggcuccaccugccgcgaccacgagaacgagcuccucaacaagcaguccguccccgcccacuucgucgcccucaacggcuccaagcucaacaucaaccucaagaugggcgucgaguggaccuccugcgccgaggucgucucccaggagaagaccauguuccccaaccucaccgacguccgcgaggucgucaccgaccaguuccucugcuccggcacccaggaggacgagucccccugcaagggcgaguccggcggcgccgucuuccucgagcgccgcuuccgcuucuuccaggucggccucgucuccuggggccucuacaaccccugccucggcuccgccgacaagaacucccgcaagcgcgccccccgcuccaaggucccccccccccgcgacuuccacaucaaccucuuccgcaugcagcccuggcuccgccagcaccucggcgacguccucaacuuccucccccucuga

SEQ ID NO: 40570 - RNA, 5955 nt, Artificial Sequence
  derived and/or modified sequence opt2 from C2orf16__Homo_sapiens__NP_115642
auggagcucacccccggcgcccagcagcagggcaucaacuaccaggagcucaccuccggcuggcaggacgucaaguccaugaugcucguccccgagcccacccgcaaguuccccuccggcccccuccucaccuccguccgcuucuccaaccucucccccgagucccagcagcaggacgucaagucccucgaguucaccgucgagcccaagcuccaguccgucaagcacgucaagcucuccuccgucucccuccagcagaccaucaaguccgucgagcucgcccccggcucccucccccagcgcgucaaguacggcgagcagaccccccgcaccaacuaccagaucauggaguccuccgagcucaucccccgccccggccaccaguucgccaaguacgccgagaugaucccccagcccaaguaccagauccccaaguccgccaaccucaucuccauccccaucuaccacgccaccgaguccuccgagauggcccagggccucgccuacaagggcaucgacaccgucgagaaguccgucggccucacccccaagcucaccggccgcgccaaggagucccucggcaugcuccuccagcccgaccuccagguccccaaguucgucgaccucacccccaugguccgcgaccagggcuccaaguuccucggccucacccccgagaaguccuaccagauccucgagaccauggagcuccucucccagucccgcccccgcgucaaggacgucggcgagcucuacaugaagccccuccagcagaccgucgaguacgagggcaucacccccgagcucaagcacuacuucaccgaggccaugggccucaccgccgaggcccgcauccaggccaacgaguucuucggcaugacccccaagcccaccucccaggccaccggcuucgccgagcgcuccccccgccucugcccccagaaccucgagugcgucgaggucaucuccgagaagcgccuccagggcgaggaguccgucguccucauccccaagucccuccaccacguccccgacuccgccuccggcaugacccccggccucggccaccgcguccccgaguccgucgagcucaccuccaaguccggcguccaggucgagaagacccuccagcucacccccaagccccagcaccacgucggcucccccggcaucaucuccggccucggccaccagguccccgaguccgucaaccucaccugcaagcaguggcuccagauggaggagucccucgaggucccccucaagcagaccucccaggucaucggccacgaggaguccgucgagcucaccuccgaggcccgccagcaccgcgaggucuccaugggccucaccaaguccaagaaccaguccaugaagucccccggcaccacccccggcccccucggccgcaucgucgaguucaugcgcaucucccccgagccccucgaccaggucaccgaguccgcccgcacccagcuccaggucgcccaguccgaggaggucauccucaucgacguccccaaggucguccaguccgucaaggucacccccggcccccccuuccagaucgucaaguccgucaccaucccccgccccaccccccagauggucgaguacaucgagcucacccccaagcuccaguacguccgccccuccgagcaccacaccggccccugccuccaggacgucaaguccaccaagcucaucaccaagcccaagcaccagauccucgagaccgucgagcucaccggcuuccagaucgucaagaccaugcucauccccggccccucccuccagaucgucaaguccgaggagcucgcccccggccccaucccccaggucgucgagcccaucggcgucgcccucgaguccggcaucgaggccaucaacugcgucgaccuccucccccgcccccaccuccaggagcucaucguccccgccgagcucacccccucccccugcacccaggucaaguccgccgagcucaccuccccccagaccucccccuucgaggagcacaccauccucacccacaagcagggccuccaggccgucaaguccaccgucaucaagaccgagccccccaaggucauggagaccgaggaccucaaccucggccacgucugccagaaccgcgacugccagaagcucaccuccgaggagcuccaggucggcaccgacuucucccgcuuccuccaguccuccuccaccacccucaucuccuccuccguccgcaccgccuccgagcucggcggccucugggacuccggcauccaggaggucucccgcgcccucgacaucaagaaccccggcaccgacauccuccagcccgaggagaccuacaucgaccccaccaugauccagucccucaccuucccccucgcccuccacaaccaguccuccgacaagaccgccaacaucgucgagaaccccugccccgagauccucggcgucgacgucaucuccaaggagaccaccaagcgcaagcagauggaggagcucgagaacucccuccagcgccaccucccccaguccuggcgcucccgcucccgcaccuuccaggccgaguccggcguccagaagggccucaucaaguccuuccccggccgccagcacaacgucugggagucccacgccuggcgccagcgccucccccgcaaguaccucuccaccaugcucaugcucggcaacauccucggcaccaccauggagcgcaagcucugcucccagaccucccucgccgagcgcgccaccgccgacaccugccaguccauccagaaccucuucggcauccccgccgagcucauggagcccucccagucccuccccgagaagggccccgucaccaucucccagcccuccgucgucaagaacuacauccagcgccacaccuucuaccacggccacaagaagcgcauggcccuccgcaucuggacccgcggcuccaccuccuccaucauccagcaguacuccggcacccgcguccgcaucaagaagaccaacuccaccuucaacggcaucucccaggaggucauccagcacaugcccgucuccugcgccggcggccagcuccccguccucgucaaguccgaguccucccucuccaucuucuacgaccgcgaggaccucguccccauggaggaguccgaggacucccaguccgacucccagacccgcaucuccgagucccagcacucccucaagcccaacuaccucucccaggccaagaccgacuucuccgagcaguuccagcuccucgaggaccuccagcucaagaucgccgccaagcuccuccgcucccagaucccccccgacgucccccccccccucgccuccggccucguccucaaguaccccaucugccuccagugcggccgcugcuccggccucaacugccaccacaagcuccagaccaccuccggccccuaccuccucaucuacccccagcuccaccucguccgcacccccgagggccacggcgagguccgccuccaccucggcuuccgccuccgcaucggcaagcgcucccagaucuccaaguaccgcgagcgcgaccgccccgucauccgccgcucccccaucucccccucccagcgcaaggccaagaucuacacccaggccuccaagucccccaccuccaccaucgaccuccaguccggccccucccagucccccgcccccguccaggucuacauccgccgcggccagcgcucccgccccgaccucgucgagaagaccaagacccgcgcccccggccacuacgaguucacccagguccacaaccuccccgaguccgacuccgaguccacccagaacgagaagcgcgccaagguccgcaccaagaagaccuccgacuccaaguaccccaugaagcgcaucaccaagcgccuccgcaagcaccgcaaguucuacaccaacucccgcaccaccaucgagucccccucccgcgagcucgccgcccaccuccgccgcaagcgcaucggcgccacccagaccuccaccgccucccucaagcgccagcccaagaagcccucccagcccaaguucaugcagcuccucuuccagucccucaagcgcgccuuccagaccgcccaccgcgucaucgccuccgucggccgcaagcccgucgacggcacccgccccgacaaccucugggccuccaagaacuacuaccccaagcagaacgcccgcgacuacugccuccccuccuccaucaagcgcgacaagcgcuccgccgacaagcucacccccgccggcuccaccaucaagcaggaggacauccucuggggcggcaccguccagugccgcuccgcccagcagccccgccgcgccuacuccuuccagccccgcccccuccgccuccccaagcccaccgacucccaguccggcaucgccuuccagaccgccuccgucggccagccccuccgcaccguccagaaggacuccuccucccgcuccaagaagaacuucuaccgcaacgagaccuccucccaggaguccaagaaccucuccacccccggcacccgcguccaggcccgcggccgcauccuccccggcucccccgucaagcgcaccuggcaccgccaccucaaggacaagcucacccacaaggagcacaaccaccccuccuucuaccgcgagcgcaccccccgcggccccuccgagcgcacccgccacaaccccuccuggcgcaaccaccgcucccccuccgagcgcucccagcgcuccucccucgagcgccgccaccacucccccucccagcgcucccacugcucccccucccgcaagaaccacuccucccccuccgagcgcuccuggcgcucccccucccagcgcaaccacugcuccccccccgagcgcuccugccacucccucuccgagcgcggccuccacucccccucccagcgcucccaccgcggccccucccagcgccgccaccacucccccuccgagcgcucccaccgcucccccuccgagcgcucccaccgcuccuccuccgagcgccgccaccgcucccccucccagcgcucccaccgcggccccuccgagcgcucccacugcucccccuccgagcgccgccaccgcucccccucccagcgcucccaccgcggccccuccgagcgccgccaccacucccccuccaagcgcucccaccgcucccccgcccgccgcucccaccgcucccccuccgagcgcucccaccacucccccuccgagcgcucccaccacucccccuccgagcgccgccaccacucccccuccgagcgcucccacugcucccccuccgagcgcucccacugcucccccuccgagcgccgccaccgcucccccuccgagcgccgccaccacucccccuccgagaagucccaccacucccccuccgagcgcucccaccacucccccuccgagcgccgccgccacuccccccucgagcgcucccgccacucccuccucgagcgcucccaccgcucccccuccgagcgccgcucccaccgcuccuucgagcgcucccaccgccgcaucuccgagcgcucccacucccccuccgagaagucccaccucuccccccucgagcgcucccgcugcucccccuccgagcgccgcggccacuccuccuccggcaagaccugccacucccccuccgagcgcucccaccgcucccccuccggcaugcgccagggccgcaccuccgagcgcucccaccgcuccuccugcgagcgcacccgccacucccccuccgagaugcgccccggccgccccuccggccgcaaccacugcucccccuccgagcgcucccgccgcuccccccucaaggagggccucaaguacuccuuccccggcgagcgccccucccacucccucucccgcgacuucaagaaccagaccacccuccucggcaccacccacaagaaccccaaggccggccaggucuggcgccccgaggccacccgcuga

SEQ ID NO: 40571 - RNA, 447 nt, Artificial Sequence
  derived and/or modified sequence opt2 from C2orf40__Homo_sapiens__NP_115787
auggccgccucccccgcccgccccgccguccucgcccucaccggccucgcccuccuccuccuccucugcuggggccccggcggcaucuccggcaacaagcucaagcucaugcuccagaagcgcgaggcccccguccccaccaagaccaaggucgccgucgacgagaacaaggccaaggaguuccucggcucccucaagcgccagaagcgccagcucugggaccgcacccgccccgagguccagcagugguaccagcaguuccucuacaugggcuucgacgaggccaaguucgaggacgacaucaccuacuggcucaaccgcgaccgcaacggccacgaguacuacggcgacuacuaccagcgccacuacgacgaggacuccgccaucggcccccgcucccccuacggcuuccgccacggcgccuccgucaacuacgacgacuacuga

SEQ ID NO: 40572 - RNA, 834 nt, Artificial Sequence
  derived and/or modified sequence opt2 from C2orf43__Homo_sapiens__NP_001269649
auggacuccgagcucaaggaggagauccccguccacgaggaguucauccucugcggcggcgccgagacccagguccucaagugcggccccuggaccgaccucuuccacgaccaguccgucaagcgccccaagcuccucaucuucaucauccccgacuccaacgcccaggagaucaaggacaucuacggccucaacggccagaucgagcacaagcucgccuuccuccgcacccacguccccaaggacaugaagcucguccucaucggccacuccaucggcuccuacuucacccuccagaugcucaagcgcguccccgagcuccccgucauccgcgccuuccuccucuuccccaccaucgagcgcauguccgagucccccaacggccgcaucgccaccccccuccucugcugguuccgcuacguccucuacgucaccggcuaccuccuccucaagcccugccccgagaccaucaagucccuccucauccgccgcggccuccaggucaugaaccucgagaacgaguucuccccccucaacauccucgagcccuucugccucgccaacgccgccuaccucggcggccaggagaugauggaggucgucaagcgcgacgacgagaccaucaaggagcaccucugcaagcucaccuucuacuacggcaccaucgaccccuggugccccaaggaguacuacgaggacaucaagaaggacuuccccgagggcgacauccgccucugcgagaagaacaucccccacgccuucaucacccacuucaaccaggagauggccgacaugaucgccgacucccucaaggacgaccucuccaagauguga

SEQ ID NO: 40573 - RNA, 876 nt, Artificial Sequence
  derived and/or modified sequence opt2 from C2orf47__Homo_sapiens__NP_078796
auggcccucgccgcccgccuccucccccaguuccuccacucccgcucccuccccugcggcgccguccgccuccgcacccccgccgucgccgagguccgccuccccuccgccacccucugcuacuucugccgcugccgccucggccucggcgccgcccucuucccccgcuccgcccgcgcccucgccgccuccgcccuccccgcccagggcucccgcuggcccguccucuccucccccggccuccccgccgccuucgccuccuuccccgccugcccccagcgcuccuacuccaccgaggagaagccccagcagcaccagaagaccaagaugaucguccucggcuucuccaaccccaucaacuggguccgcacccgcaucaaggccuuccucaucugggccuacuucgacaaggaguucuccaucaccgaguucuccgagggcgccaagcaggccuucgcccacgucuccaagcuccucucccagugcaaguucgaccuccucgaggagcucgucgccaaggagguccuccacgcccucaaggagaaggucaccucccuccccgacaaccacaagaacgcccucgccgccaacaucgacgagaucgucuucaccuccaccggcgacaucuccaucuacuacgacgagaagggccgcaaguucgucaacauccucaugugcuucugguaccucaccuccgccaacauccccuccgagacccuccgcggcgccuccgucuuccaggucaagcucggcaaccagaacgucgagaccaagcagcuccucuccgccuccuacgaguuccagcgcgaguucacccagggcgucaagcccgacuggaccaucgcccgcaucgagcacuccaagcuccucgaguga

SEQ ID NO: 40574 - RNA, 1188 nt, Artificial Sequence
  derived and/or modified sequence opt2 from C2orf57__Homo_sapiens__NP_689827
auggcccuccccggcuacccccucggcaacgucgacgacucccgcuccaaggacucccccgccggcgagccccagggccaggucccccucaccgccgacguccucgccgucuccuccuccgucgccuccaccgacuggcaggacaucgaccaggccuccuucaagaccgccaccccccgcgccaucuccaccuccggcgacaaggacaaguccgccgucguccccgagcacggccagaagaccccccgcaagaucaccccccuccuccccucccagaaccccuccccccuccaggucuccaugucccuccagaaccccgccugggaccgccagguccaggacgcccgcaccucccagucccucgucgucuuccccucccaccuccucggcaaggacaagaugucccagauggccuccguccccgagcgcgagcccgaguccgcccccuccgcccccuccgccgagcuccaguccacccagcacauggaggcccagcccgucgaguccgacgccgaccacgucaccgccggcgccaacggccagcacggcccccaggccgccuccaccaccaaguccgccgaggagaaggccgagcaccccaaggccccccaccccgaggccgaggcccuccccuccgacgagucccccgucgccaugggcgccaacgucgucgacucccucggcgaccuccagaccugguucuucccccccccccccgccggcuccgucucccccucccccggcccccacgaggucgcccucggccgccgcccccucgacuccucccucuacaccgccuccgaggagaacuccuacaugcgcuccaugaccucccuccucgaccgcggcgagggcuccaucuccucccucgccgacauccucgucugguccgagaccaccaugggcauggccaucgccaccggcuuccucgacuccggccacuccaccgucgccgaccuccuccacuccuccggccccucccuccgcuccguccccucccucgucggcuccgucuccuccgccuucuccuccggccucgucuccggcaccuccuccgcccuccgcaccaucacccgcguccucgagaccgucgagcagcgcaccgucgagggcauccgcuccgccaugcgcuaccucaccucccaccucaccccccgccaggcccaggccgaccccaacuacgacuga

SEQ ID NO: 40575 - RNA, 747 nt, Artificial Sequence
  derived and/or modified sequence opt2 from C2orf61__Homo_sapiens__NP_001157033
auggaccagcccgccgucgccaccgccuccaccuccauccgcgaggaccucgucggcggcgaguccuucaucaccgccuccaagcccgcccagaagaccuccuccuucgagcgcgagggcugguggcgcaucgcccucaccgacacccccauccccggcaccuaccaccucaagaccuucaucgaggagucccuccucaaccccgucaucgccaccuacaacuucaagaacgagggccgcaagaagcccccccucguccagcgcaacaaccccguccucaacgaccucccccaguacaugccccccgacuuccucgaccuccucaagaagcaggucgccaccuacuccuucaaggacaagccccgccccucccccuccacccucgucgacaaggaccagucccuccagcucucccccggccaguacaacguccuccccgcccccguccccaaguacgccucccgcuccugcgucuuccgcuccaccguccagcgcuuccccaccaccuacuucaucccccacgagggccccggccccggccacuacaacgucaagaugccccccaccuccuccgucaccuccugcuuccagucccgcgucccccgcuuccuccccuccugcuccaagacccccggccccggcgccuacaccacccuccgccaguuccccaagcagucccccaccaucgccaagaugggccaggagcacucccucuucuucaacaacaacaacuggcuccucaaguga

SEQ ID NO: 40576 - RNA, 1449 nt, Artificial Sequence
  derived and/or modified sequence opt2 from C3AR1__Homo_sapiens__NP_004045
auggccuccuucuccgccgagaccaacuccaccgaccuccucucccagcccuggaacgagccccccgucauccucuccauggucauccucucccucaccuuccuccucggccuccccggcaacggccucguccucugggucgccggccucaagaugcagcgcaccgucaacaccaucugguuccuccaccucacccucgccgaccuccucugcugccucucccuccccuucucccucgcccaccucgcccuccagggccaguggcccuacggccgcuuccucugcaagcucauccccuccaucaucguccucaacauguucgccuccgucuuccuccucaccgccaucucccucgaccgcugccucgucgucuucaagcccaucuggugccagaaccaccgcaacgucggcauggccugcuccaucugcggcugcaucugggucgucgccuucgucaugugcauccccgucuucgucuaccgcgagaucuucaccaccgacaaccacaaccgcugcggcuacaaguucggccucuccuccucccucgacuaccccgacuucuacggcgacccccucgagaaccgcucccucgagaacaucguccagccccccggcgagaugaacgaccgccucgaccccuccuccuuccagaccaacgaccaccccuggaccguccccaccgucuuccagccccagaccuuccagcgccccuccgccgacucccucccccgcggcuccgcccgccucaccucccagaaccucuacuccaacgucuucaagcccgccgacgucgucucccccaagauccccuccggcuuccccaucgaggaccacgagaccuccccccucgacaacuccgacgccuuccucuccacccaccucaagcucuuccccuccgccuccuccaacuccuucuacgaguccgagcucccccagggcuuccaggacuacuacaaccucggccaguucaccgacgacgaccagguccccaccccccucgucgccaucaccaucacccgccucgucgucggcuuccuccuccccuccgucaucaugaucgccugcuacuccuucaucgucuuccgcaugcagcgcggccgcuucgccaagucccaguccaagaccuuccgcgucgccgucgucgucgucgccgucuuccucgucugcuggacccccuaccacaucuucggcguccucucccuccucaccgaccccgagaccccccucggcaagacccucauguccugggaccacgucugcaucgcccucgccuccgccaacuccugcuucaaccccuuccucuacgcccuccucggcaaggacuuccgcaagaaggcccgccaguccauccagggcauccucgaggccgccuucuccgaggagcucacccgcuccacccacugccccuccaacaacgucaucuccgagcgcaacuccaccaccgucuga

SEQ ID NO: 40577 - RNA, 4992 nt, Artificial Sequence
  derived and/or modified sequence opt2 from C3__Homo_sapiens__NP_000055
augggccccaccuccggccccucccuccuccuccuccuccucacccaccucccccucgcccucggcucccccauguacuccaucaucacccccaacauccuccgccucgaguccgaggagaccaugguccucgaggcccacgacgcccagggcgacguccccgucaccgucaccguccacgacuuccccggcaagaagcucguccucuccuccgagaagaccguccucacccccgccaccaaccacaugggcaacgucaccuucaccauccccgccaaccgcgaguucaaguccgagaagggccgcaacaaguucgucaccguccaggccaccuucggcacccaggucgucgagaaggucguccucgucucccuccaguccggcuaccucuucauccagaccgacaagaccaucuacacccccggcuccaccguccucuaccgcaucuucaccgucaaccacaagcuccuccccgucggccgcaccgucauggucaacaucgagaaccccgagggcauccccgucaagcaggacucccucuccucccagaaccagcucggcguccucccccucuccugggacauccccgagcucgucaacaugggccaguggaagauccgcgccuacuacgagaacuccccccagcaggucuucuccaccgaguucgaggucaaggaguacguccuccccuccuucgaggucaucgucgagcccaccgagaaguucuacuacaucuacaacgagaagggccucgaggucaccaucaccgcccgcuuccucuacggcaagaaggucgagggcaccgccuucgucaucuucggcauccaggacggcgagcagcgcaucucccuccccgagucccucaagcgcauccccaucgaggacggcuccggcgaggucguccucucccgcaagguccuccucgacggcguccagaacccccgcgccgaggaccucgucggcaagucccucuacgucuccgccaccgucauccuccacuccggcuccgacaugguccaggccgagcgcuccggcauccccaucgucaccucccccuaccagauccacuucaccaagacccccaaguacuucaagcccggcaugcccuucgaccucauggucuucgucaccaaccccgacggcucccccgccuaccgcguccccgucgccguccagggcgaggacaccguccagucccucacccagggcgacggcgucgccaagcucuccaucaacacccaccccucccagaagccccucuccaucaccguccgcaccaagaagcaggagcucuccgaggccgagcaggccacccgcaccaugcaggcccuccccuacuccaccgucggcaacuccaacaacuaccuccaccucuccguccuccgcaccgagcuccgccccggcgagacccucaacgucaacuuccuccuccgcauggaccgcgcccacgaggccaagauccgcuacuacaccuaccucaucaugaacaagggccgccuccucaaggccggccgccagguccgcgagcccggccaggaccucgucguccucccccucuccaucaccaccgacuucauccccuccuuccgccucgucgccuacuacacccucaucggcgccuccggccagcgcgaggucgucgccgacuccgucugggucgacgucaaggacuccugcgucggcucccucgucgucaaguccggccaguccgaggaccgccagcccguccccggccagcagaugacccucaagaucgagggcgaccacggcgcccgcgucguccucgucgccgucgacaagggcgucuucguccucaacaagaagaacaagcucacccaguccaagaucugggacgucgucgagaaggccgacaucggcugcacccccggcuccggcaaggacuacgccggcgucuucuccgacgccggccucaccuucaccuccuccuccggccagcagaccgcccagcgcgccgagcuccagugcccccagcccgccgcccgccgccgccgcuccguccagcucaccgagaagcgcauggacaaggucggcaaguaccccaaggagcuccgcaagugcugcgaggacggcaugcgcgagaaccccaugcgcuucuccugccagcgccgcacccgcuucaucucccucggcgaggccugcaagaaggucuuccucgacugcugcaacuacaucaccgagcuccgccgccagcacgcccgcgccucccaccucggccucgcccgcuccaaccucgacgaggacaucaucgccgaggagaacaucgucucccgcuccgaguuccccgaguccuggcucuggaacgucgaggaccucaaggagccccccaagaacggcaucuccaccaagcucaugaacaucuuccucaaggacuccaucaccaccugggagauccucgccgucuccauguccgacaagaagggcaucugcgucgccgaccccuucgaggucaccgucaugcaggacuucuucaucgaccuccgccuccccuacuccgucguccgcaacgagcaggucgagauccgcgccguccucuacaacuaccgccagaaccaggagcucaagguccgcgucgagcuccuccacaaccccgccuucugcucccucgccaccaccaagcgccgccaccagcagaccgucaccaucccccccaaguccucccucuccguccccuacgucaucgucccccucaagaccggccuccaggaggucgaggucaaggccgccgucuaccaccacuucaucuccgacggcguccgcaagucccucaaggucguccccgagggcauccgcaugaacaagaccgucgccguccgcacccucgaccccgagcgccucggccgcgagggcguccagaaggaggacaucccccccgccgaccucuccgaccagguccccgacaccgaguccgagacccgcauccuccuccagggcacccccgucgcccagaugaccgaggacgccgucgacgccgagcgccucaagcaccucaucgucacccccuccggcugcggcgagcagaacaugaucggcaugacccccaccgucaucgccguccacuaccucgacgagaccgagcagugggagaaguucggccucgagaagcgccagggcgcccucgagcucaucaagaagggcuacacccagcagcucgccuuccgccagcccuccuccgccuucgccgccuucgucaagcgcgcccccuccaccuggcucaccgccuacgucgucaaggucuucucccucgccgucaaccucaucgccaucgacucccagguccucugcggcgccgucaaguggcucauccucgagaagcagaagcccgacggcgucuuccaggaggacgcccccgucauccaccaggagaugaucggcggccuccgcaacaacaacgagaaggacauggcccucaccgccuucguccucaucucccuccaggaggccaaggacaucugcgaggagcaggucaacucccuccccggcuccaucaccaaggccggcgacuuccucgaggccaacuacaugaaccuccagcgcuccuacaccgucgccaucgccggcuacgcccucgcccagaugggccgccucaagggcccccuccucaacaaguuccucaccaccgccaaggacaagaaccgcugggaggaccccggcaagcagcucuacaacgucgaggccaccuccuacgcccuccucgcccuccuccagcucaaggacuucgacuucgucccccccgucguccgcuggcucaacgagcagcgcuacuacggcggcggcuacggcuccacccaggccaccuucauggucuuccaggcccucgcccaguaccagaaggacgcccccgaccaccaggagcucaaccucgacgucucccuccagcuccccucccgcuccuccaagaucacccaccgcauccacugggaguccgccucccuccuccgcuccgaggagaccaaggagaacgagggcuucaccgucaccgccgagggcaagggccagggcacccucuccgucgucaccauguaccacgccaaggccaaggaccagcucaccugcaacaaguucgaccucaaggucaccaucaagcccgcccccgagaccgagaagcgcccccaggacgccaagaacaccaugauccucgagaucugcacccgcuaccgcggcgaccaggacgccaccauguccauccucgacaucuccaugaugaccggcuucgcccccgacaccgacgaccucaagcagcucgccaacggcgucgaccgcuacaucuccaaguacgagcucgacaaggccuucuccgaccgcaacacccucaucaucuaccucgacaaggucucccacuccgaggacgacugccucgccuucaagguccaccaguacuucaacgucgagcucauccagcccggcgccgucaaggucuacgccuacuacaaccucgaggaguccugcacccgcuucuaccaccccgagaaggaggacggcaagcucaacaagcucugccgcgacgagcucugccgcugcgccgaggagaacugcuucauccagaaguccgacgacaaggucacccucgaggagcgccucgacaaggccugcgagcccggcgucgacuacgucuacaagacccgccucgucaagguccagcucuccaacgacuucgacgaguacaucauggccaucgagcagaccaucaaguccggcuccgacgagguccaggucggccagcagcgcaccuucaucucccccaucaagugccgcgaggcccucaagcucgaggagaagaagcacuaccucauguggggccucuccuccgacuucuggggcgagaagcccaaccucuccuacaucaucggcaaggacaccugggucgagcacuggcccgaggaggacgagugccaggacgaggagaaccagaagcagugccaggaccucggcgccuucaccgaguccauggucgucuucggcugccccaacuga

SEQ ID NO: 40578 - RNA, 1704 nt, Artificial Sequence
  derived and/or modified sequence opt2 from C3orf17__Homo_sapiens__NP_056227
augauggccgccgucccccccggccucgagcccuggaaccgcguccgcauccccaaggccggcaaccgcuccgccgucaccguccagaaccccggcgccgcccucgaccucugcaucgccgccgucaucaaggagugccaccucgucauccucucccucaagucccagacccucgacgccgagaccgacguccucugcgccguccucuacuccaaccacaaccgcaugggccgccacaagccccaccucgcccucaagcaggucgagcagugccucaagcgccucaagaacaugaaccucgagggcuccauccaggaccucuucgagcucuucuccuccaacgagaaccagccccucaccaccaaggucugcgucguccccucccagcccgucgucgagcucguccucaugaagguccucggcgccugcaagcuccuccuccgccuccucgacugcugcugcaagaccuuccuccucaccgucaagcaccucggccuccaggaguucaucauccucaaccucgucauggucggccucgucucccgccucuggguccucuacaagggcguccucaagcgccucauccuccucuacgagccccucuucggccuccuccaggaggucgcccgcauccagcccaugcccuacuucaaggacuucaccuuccccuccgacaucaccgaguuccucggccagcccuacuucgaggccuucaagaagaagaugcccaucgccuucgccgccaagggcaucaacaagcuccucaacaagcucuuccucaucaacgagcaguccccccgcgccuccgaggagacccuccucggcaucuccaagaaggccaagcagaugaagaucaacguccagaacaacgucgaccucggccagcccgucaagaacaagcgcgucuucaaggaggaguccuccgaguucgacguccgcgccuucugcaaccagcucaagcacaaggccacccaggagaccuccuucgacuucaagugcucccagucccgccucaagaccaccaaguacuccucccagaaggucaucggcaccccccacgccaaguccuucguccagcgcuuccgcgaggccgaguccuucacccagcucuccgaggagauccagauggccgucgucuggugccgcuccaagaagcucaaggcccaggccaucuuccucggcaacaagcuccucaaguccaaccgccucaagcaccucgaggcccagggcaccucccuccccaagaagcucgagugcaucaagaccuccaucugcaaccaccuccuccgcggcuccggcaucaagaccuccaagcaccaccuccgccagcgccgcucccagaacaaguuccuccgccgccagcgcaagccccagcgcaagcuccaguccacccuccuccgcgagauccagcaguucucccagggcacccgcaaguccgccaccgacaccuccgccaaguggcgccucucccacugcaccguccaccgcaccgaccucuaccccaacuccaagcagcuccucaacuccggcgucuccaugcccgucauccagaccaaggagaagaugauccacgagaaccuccgcggcauccacgagaacgagaccgacuccuggaccgucaugcagaucaacaagaacuccaccuccggcaccaucaaggagaccgacgacaucgacgacaucuucgcccucaugggcgucuga

SEQ ID NO: 40579 - RNA, 489 nt, Artificial Sequence
  derived and/or modified sequence opt2 from C3orf18__Homo_sapiens__NP_001165212
augaacucccgcaccgccuccgcccgcggcugguucuccucccgcccccccaccuccgaguccgaccucgagcccgccaccgacggccccgccuccgagaccaccacccucucccccgaggccaccaccuucaacgacacccgcauccccgacgccgccggcggcaccgccggcgucggcaccaugcuccucuccuucggcaucaucaccgucaucggccucgccgucgcccucguccucuacauccgcaagaagaagcgccucgagaagcuccgccaccagcucaugcccauguacaacuucgaccccaccgaggagcaggacgagcucgagcaggagcuccucgagcacggccgcgacgccgccuccguccaggccgccaccuccguccaggccaugcagggcaagaccacccuccccucccagggcccccuccagcgccccucccgccucgucuucaccgacgucgccaacgccauccacgccuga

SEQ ID NO: 40580 - RNA, 2349 nt, Artificial Sequence
  derived and/or modified sequence opt2 from C3orf20__Homo_sapiens__NP_001171887
auggcccgccagguccgcacccaccaggagacccucaaccgcuuccagcagcaguccauccaccuccucaccgagcuccuccgccucaagaugaaggccauggucgaguccauguccgucggcgccaacccccucgacaucacccgccgcuucgucgaggccucccagcuccuccaccucaacgccaaggagauggccuucaacugccucaucuccaccgccggccgcuccggcuacuccuccggccagcucuggaaggagucccucgccaacauguccgccaucggcgucaacucccccuaccagcucaucuaccacuccuccaccgccugccucuccuucucccucuccgccggcaaggaggccaagaagaagaucggcaagucccgcaccaccgaggacgucuccaugcccccccuccaccgcggcgucggcacccccgccaacucccucgaguucuccgaccccugccccgaggcccgcgagaagcuccaggagcucugccgccacaucgaggccgagcgcgccaccuggaagggccgcaacaucuccuaccccaugauccuccgcaacuacaaggccaagaugcccucccaccucaugcucgcccgcaagggcgacucccagacccccggccuccacuacccccccaccgccggcgcccagacccucucccccaccucccaccccuccuccgccaaccaccacuucucccagcacugccaggagggcaaggcccccaagaaggccuucaaguuccacuacaccuucuacgacggcuccuccuucgucuacuaccccuccggcaacgucgccgucugccagauccccaccugcugccgcggccgcaccaucaccugccucuucaacgacauccccggcuucucccuccucgcccucuucaacaccgagggccagggcugcguccacuacaaccucaagaccuccugccccuacguccucauccucgacgaggagggcggcaccaccaacgaccagcagggcuacgucguccacaagugguccuggaccucccgcaccgagacccuccucucccucgaguacaaggucaacgaggagaugaagcucaagguccucggccaggacuccaucaccgucaccuucaccucccucaacgagaccgucacccucaccgucuccgccaacaacugcccccacggcauggccuacgacaagcgccucaaccgccgcaucuccaacauggacgacaaggucuacaagaugucccgcgcccucgccgagaucaagaagcgcuuccagaagaccgucacccaguucaucaacuccauccuccucgccgccggccucuucaccaucgaguaccccaccaagaaggaggaggaggaguucguccgcuucaagaugcgcucccgcacccaccccgagcgccuccccaagcucucccucuacuccggcgagucccuccuccgcucccaguccggccaccucgaguccuccaucgccgagacccucaaggacgagcccgaguccgcccccgucucccccguccgcaagaccaccaagauccacaccaaggccaaggucaccucccgcggcaaggcccgcgagggccgcucccccacccgcugggccgcccuccccuccgacugcccccucguccuccgcaagcucaugcucaaggaggacacccgcgccggcugcaagugccucgucaaggccccccucgucuccgacgucgagcucgagcgcuuccuccucgccccccgcgaccccucccagguccucgucuucggcaucaucuccucccagaacuacaccuccaccggccagcuccaguggcuccucaacacccucuacaaccaccagcagcgcggccgcggcucccccugcauccagugccgcuacgacuccuaccgccuccuccaguacgaccucgacuccccccuccaggaggaccccccccucauggucaagaagaacuccgucguccagggcaugauccucauguucgccggcggcaagcucaucuucggcggccgcguccucaacggcuacggccucuccaagcagaaccuccucaagcagaucuuccgcucccagcaggacuacaagaugggcuacuuccuccccgacgacuacaaguucuccguccccaacuccguccucucccucgaggacuccgaguccgucaagaaggccgaguccgaggacauccagggcuccuccuccucccucgcccucgaggacuacgucgagaaggagcucucccucgaggccgagaagacccgcgagcccgaggucgagcuccacccccucucccgcgacuccaagaucaccuccuggaagaagcaggccuccaagaaguga

SEQ ID NO: 40581 - RNA, 513 nt, Artificial Sequence
  derived and/or modified sequence opt2 from C3orf35__Homo_sapiens__NP_848029
augaagaccauggccacccgcaagcgcugcaagcucucccgcaccggccccgaguucgagaacgucaucaagcgccuccucugcgcccgcaccuuccacacccgcaucggcggcgaccucacccacggcaucaucaaccgcggccgccgcgccaacgccgagcagaugggccuccagggcuccgcccagcacuucaacaucuucccccucgaccucuggacccagggcaagaagaccgagguccagaagcgcgagggcaccgacuccauccccgccgccggccgcuccggcaccgccaaccagcccuccaucgccccccaccgcugccucuucucccgcggcaucaccgcccucgacggccucaagcgcggccgcggcugcaacggcgccgcccaccucguccgcggcgacgccuggaagaccaagcucggcgagcccugggucuccaucgcccucgcccucgccggccccggcgccauccucauccucgagcucuccugguuccucggcuga

SEQ ID NO: 40582 - RNA, 729 nt, Artificial Sequence
  derived and/or modified sequence opt2 from C3orf56__Homo_sapiens__NP_001007535
augggcaccggcgccuccgagaagcaggccgagcagaagguccgccgcgccuucgaggccuccgaggaggcccacggcacccucgccgccuccacccccugggucgccaugggcuccgccuacggcuccugcaccugccucggcgcccagcccgucaccgaccucgcccucuggcccgucaucuacuccugcaugggcuucuccccccaggccuaccccgccuucugggccuaccccuggguccucuacggcggcuaccucuggaugggcuaccccccccccgccgcccucguccccuccgucuggcucuacuggcgcggcgccuccuccuucgacccccucaucggcucccccuaccucgccgcccucgcccccaaccucuuccccuuccccaugaaguucccccccaccuacucccucgccucccccacccucggcggcgccaccuccucccacugcccccaggucggcugcuggacccccgccuccuccgccccccgcgccgccgucgagggccccucccgcggcgcccccuaccucaagaccugcaaggccccccccuccgagugggccucccgcuucggcaucugggccccccuccccugcugcuccuccgagcuccgcccccucccccccucccccaucgaggacucccagcucgaccccggcugcucccgcuccuccucccgcucccccugccgcgcccgccgccgccucuucgagugcuga

SEQ ID NO: 40583 - RNA, 666 nt, Artificial Sequence
  derived and/or modified sequence opt2 from C3orf58__Homo_sapiens__NP_001127942
augaaguccgagaacggcaccgucgucggcuccuuccccuccgacgagggcuggcccuucgccaaguaccucggcgccugcggccgcauggucgccgucaacuacgucggcgaggagcucugguccuacuucaacgcccccugggagaagcgcgucgaccucgccuggcagcucauggagaucgccgagcagcucaccaacaacgacuucgaguucgcccucuaccuccucgacgucuccuucgacaacuucgccgucggcccccgcgacggcaaggucaucaucgucgacgccgagaacguccucgucgccgacaagcgccucauccgccagaacaagcccgagaacugggacgucugguacgaguccaaguucgacgacugcgacaaggaggccugccucuccuucuccaaggagauccucugcgcccgcgccaccgucgaccacaacuacuacgccgucugccagaaccuccucucccgccacgccaccuggcgcggcaccuccggcggccuccuccacgacccccccuccgagaucgccaaggacggccgccucgaggcccuccucgacgagugcgccaaccccaagaagcgcuacggccgcuuccaggccgccaaggagcuccgcgaguaccucgcccagcucuccaacaacguccgcuga

SEQ ID NO: 40584 - RNA, 1692 nt, Artificial Sequence
  derived and/or modified sequence opt2 from C3orf67__Homo_sapiens__NP_940865
augaucaagcgcaagaucuggugcaaccucugcaucgaccucgucgccuucaccuccgagaucuucaagggcgccgucuuccagucccucgacggcaucgucgucuccgccaacugcaagcuccgcaagaucuucacccucaaguccaagccccaggacaccgccgacaaggacgccgucuacggcguccccuucuccaccgacgagcccaccgacaucaucccccgcuccugccagcucaugaccgacgucccccacgucacccagcuccucaacaugaccaagcuccgccagaccgagaucaaguucggcggccacccccuccgcuccgccgaguccgaccaguucaucaaccgcggcaccuccaucacccgcaacuccaagaaccaggacgucugccacaucgccuucggcuccaagguccucggcccccccccccucuccggccgccgcaacaacaugaagaucuccuccgagaccguccgcuccgucggcuccaagaacaaccgcuccugccagcccuccaccgucgagaagugcgucaacggcaccgagauguccgcccuccucauccccgaguccgaggagcagggcaacaaggagaacauccaccagaucaagcagaccguccccauccacgccgccaaccuccacaucaugcacccccaccccccccaggagcccuccgccgacaagaacaacaaccgccgccgccuccgccucaaguccaccucccgcgagcgcaccgagacccccuccggcuccuccuccggcaacaaccgcaucgaggacaaggccuccaccauccucaccaccgucucccagcagggcgccgagcuccucaacuccggcacccucggcccccagucccccgaccaguccgacgaguggaucuuccccgagaacgccgaccacaucuccuaccucgccuccucccgccagucccuccuccucggcgacgacuccugcaaccccucccaccucuggcucgaggccuccaaggaguccgagcacgaccagcaggccgaggagucccaguccguccccaaggacaucuucaccuucuccucccgcccccgcuccgccccccacggcaagacccagaccaugucccccgaggagcucuccuucauccucgaccucaaggaggacaacuccgucaccucccgcgacacccaguccgaggacgacuucuacggcggcgacuccuccgaggaggaguacgacuggcgcaacuaccagcccucccagauguccgaguccgagcuccagaugcucgccucccuccgcuggcagcagaacgaggagcucgaggacgccggcaccucccacggccucuccgccucccaggucgacaacugcaacgucuccaucuccaccuccuccgacgacaccaccaccuggaacuccugccuccccccccccgucaaccagggccgccacuaccagaaggagaugaacccccccucccccuccaacccccgcgacuggcucaacaugcucuccccccccaucgucccccccucccagcagcccgccgagcagcgccccgacuccugcgagucccucuccguccagggcgaggaggaccucuccgucgaggaggacgaggagguccucacccuccucuacgaccccugccucaacugcuacuucgacccccagaccggcaaguacuacgagcucgucuga

SEQ ID NO: 40585 - RNA, 303 nt, Artificial Sequence
  derived and/or modified sequence opt2 from C3orf79__Homo_sapiens__NP_001094807
augcacgucugcgaccuccagaagcucguccgcauccagcucgccuucaccaccuuccccuggauguucuccugccaccuccuccccacccccgagcucuccuccaagcgcaaccagugccuccucuacaagaccuccggcugccucacccagaugcccauccucuacggccaccccgccacccuccucaaggacuacauccuccaggccauccuccagcccggcaagaagauccagggcggcaccgagauccagcgcggcuccuucgccaaccaguaccagaccgacgccucccaccucuga

SEQ ID NO: 40586 - RNA, 5097 nt, Artificial Sequence
  derived and/or modified sequence opt2 from C4A__Homo_sapiens__NP_001239133
augcgccuccucuggggccucaucugggccuccuccuucuucacccucucccuccagaagccccgccuccuccucuucucccccuccgucguccaccucggcgucccccucuccgucggcguccagcuccaggacgucccccgcggccaggucgucaagggcuccgucuuccuccgcaaccccucccgcaacaacguccccugcucccccaaggucgacuucacccucuccuccgagcgcgacuucgcccuccucucccuccaggucccccucaaggacgccaaguccugcggccuccaccagcuccuccgcggccccgagguccagcucgucgcccacucccccuggcucaaggacucccucucccgcaccaccaacauccagggcaucaaccuccucuucuccucccgccgcggccaccucuuccuccagaccgaccagcccaucuacaaccccggccagcgcguccgcuaccgcgucuucgcccucgaccagaagaugcgccccuccaccgacaccaucaccgucauggucgagaacucccacggccuccgcguccgcaagaaggaggucuacaugcccuccuccaucuuccaggacgacuucgucauccccgacaucuccgagcccggcaccuggaagaucuccgcccgcuucuccgacggccucgaguccaacuccuccacccaguucgaggucaagaaguacguccuccccaacuucgaggucaagaucacccccggcaagcccuacauccucaccguccccggccaccucgacgagaugcagcucgacauccaggcccgcuacaucuacggcaagcccguccagggcgucgccuacguccgcuucggccuccucgacgaggacggcaagaagaccuucuuccgcggccucgagucccagaccaagcucgucaacggccagucccacaucucccucuccaaggccgaguuccaggacgcccucgagaagcucaacaugggcaucaccgaccuccagggccuccgccucuacgucgccgccgccaucaucgagucccccggcggcgagauggaggaggccgagcucaccuccugguacuucgucuccucccccuucucccucgaccucuccaagaccaagcgccaccucguccccggcgcccccuuccuccuccaggcccucguccgcgagauguccggcucccccgccuccggcauccccgucaaggucuccgccaccgucuccucccccggcuccguccccgagguccaggacauccagcagaacaccgacggcuccggccaggucuccauccccaucaucaucccccagaccaucuccgagcuccagcucuccgucuccgccggcuccccccaccccgccaucgcccgccucaccgucgccgccccccccuccggcggccccggcuuccucuccaucgagcgccccgacucccgccccccccgcgucggcgacacccucaaccucaaccuccgcgccgucggcuccggcgccaccuucucccacuacuacuacaugauccucucccgcggccagaucgucuucaugaaccgcgagcccaagcgcacccucaccuccgucuccgucuucgucgaccaccaccucgcccccuccuucuacuucgucgccuucuacuaccacggcgaccaccccgucgccaacucccuccgcgucgacguccaggccggcgccugcgagggcaagcucgagcucuccgucgacggcgccaagcaguaccgcaacggcgaguccgucaagcuccaccucgagaccgacucccucgcccucgucgcccucggcgcccucgacaccgcccucuacgccgccggcuccaagucccacaagccccucaacaugggcaaggucuucgaggccaugaacuccuacgaccucggcugcggccccggcggcggcgacuccgcccuccaggucuuccaggccgccggccucgccuucuccgacggcgaccaguggacccucucccgcaagcgccucuccugccccaaggagaagaccacccgcaagaagcgcaacgucaacuuccagaaggccaucaacgagaagcucggccaguacgccucccccaccgccaagcgcugcugccaggacggcgucacccgccuccccaugaugcgcuccugcgagcagcgcgccgcccgcguccagcagcccgacugccgcgagcccuuccucuccugcugccaguucgccgagucccuccgcaagaagucccgcgacaagggccaggccggccuccagcgcgcccucgagauccuccaggaggaggaccucaucgacgaggacgacauccccguccgcuccuucuuccccgagaacuggcucuggcgcgucgagaccgucgaccgcuuccagauccucacccucuggcuccccgacucccucaccaccugggagauccacggccucucccucuccaagaccaagggccucugcgucgccacccccguccagcuccgcgucuuccgcgaguuccaccuccaccuccgccuccccauguccguccgccgcuucgagcagcucgagcuccgccccguccucuacaacuaccucgacaagaaccucaccgucuccguccacgucucccccgucgagggccucugccucgccggcggcggcggccucgcccagcagguccucguccccgccggcuccgcccgccccgucgccuucuccgucguccccaccgccgccgccgccgucucccucaaggucgucgcccgcggcuccuucgaguuccccgucggcgacgccgucuccaagguccuccagaucgagaaggagggcgccauccaccgcgaggagcucgucuacgagcucaacccccucgaccaccgcggccgcacccucgagauccccggcaacuccgaccccaacaugauccccgacggcgacuucaacuccuacguccgcgucaccgccuccgacccccucgacacccucggcuccgagggcgcccucucccccggcggcgucgccucccuccuccgccucccccgcggcugcggcgagcagaccaugaucuaccucgcccccacccucgccgccucccgcuaccucgacaagaccgagcagugguccacccucccccccgagaccaaggaccacgccgucgaccucauccagaagggcuacaugcgcauccagcaguuccgcaaggccgacggcuccuacgccgccuggcucucccgcgacuccuccaccuggcucaccgccuucguccucaagguccucucccucgcccaggagcaggucggcggcucccccgagaagcuccaggagaccuccaacuggcuccucucccagcagcaggccgacggcuccuuccaggaccccugccccguccucgaccgcuccaugcagggcggccucgucggcaacgacgagaccgucgcccucaccgccuucgucaccaucgcccuccaccacggccucgccgucuuccaggacgagggcgccgagccccucaagcagcgcgucgaggccuccaucuccaaggccaacuccuuccucggcgagaaggccuccgccggccuccucggcgcccacgccgccgccaucaccgccuacgcccucacccucaccaaggcccccgucgaccuccucggcgucgcccacaacaaccucauggccauggcccaggagaccggcgacaaccucuacuggggcuccgucaccggcucccaguccaacgccgucucccccacccccgccccccgcaaccccuccgaccccaugccccaggcccccgcccucuggaucgagaccaccgccuacgcccuccuccaccuccuccuccacgagggcaaggccgagauggccgaccaggccuccgccuggcucacccgccagggcuccuuccagggcggcuuccgcuccacccaggacaccgucaucgcccucgacgcccucuccgccuacuggaucgccucccacaccaccgaggagcgcggccucaacgucacccucuccuccaccggccgcaacggcuucaagucccacgcccuccagcucaacaaccgccagauccgcggccucgaggaggagcuccaguucucccucggcuccaagaucaacgucaaggucggcggcaacuccaagggcacccucaagguccuccgcaccuacaacguccucgacaugaagaacaccaccugccaggaccuccagaucgaggucaccgucaagggccacgucgaguacaccauggaggccaacgaggacuacgaggacuacgaguacgacgagcuccccgccaaggacgaccccgacgccccccuccagcccgucaccccccuccagcucuucgagggccgccgcaaccgccgccgccgcgaggcccccaagcucaccucccucuccgaccgcuacgucucccacuucgagaccgagggcccccacguccuccucuacuucgacuccguccccaccucccgcgagugcgucggcuucgaggccguccaggagguccccgucggccucguccagcccgccuccgccacccucuacgacuacuacaaccccgagcgccgcugcuccgucuucuacggcgcccccuccaagucccgccuccucgccacccucugcuccgccgaggucugccagugcgccgagggcaagugcccccgccagcgccgcgcccucgagcgcggccuccaggacgaggacggcuaccgcaugaaguucgccugcuacuacccccgcgucgaguacggcuuccaggucaagguccuccgcgaggacucccgcgccgccuuccgccucuucgagaccaagaucacccagguccuccacuucaccaaggacgucaaggccgccgccaaccagaugcgcaacuuccucguccgcgccuccugccgccuccgccucgagcccggcaaggaguaccucaucaugggccucgacggcgccaccuacgaccucgagggccacccccaguaccuccucgacuccaacuccuggaucgaggagaugcccuccgagcgccucugccgcuccacccgccagcgcgccgccugcgcccagcucaacgacuuccuccaggaguacggcacccagggcugccaggucuga

SEQ ID NO: 40587 - RNA, 5235 nt, Artificial Sequence
  derived and/or modified sequence opt2 from C4B_2__Homo_sapiens__NP_001229752
augcgccuccucuggggccucaucugggccuccuccuucuucacccucucccuccagaagccccgccuccuccucuucucccccuccgucguccaccucggcgucccccucuccgucggcguccagcuccaggacgucccccgcggccaggucgucaagggcuccgucuuccuccgcaaccccucccgcaacaacguccccugcucccccaaggucgacuucacccucuccuccgagcgcgacuucgcccuccucucccuccaggucccccucaaggacgccaaguccugcggccuccaccagcuccuccgcggccccgagguccagcucgucgcccacucccccuggcucaaggacucccucucccgcaccaccaacauccagggcaucaaccuccucuucuccucccgccgcggccaccucuuccuccagaccgaccagcccaucuacaaccccggccagcgcguccgcuaccgcgucuucgcccucgaccagaagaugcgccccuccaccgacaccaucaccgucauggucgagaacucccacggccuccgcguccgcaagaaggaggucuacaugcccuccuccaucuuccaggacgacuucgucauccccgacaucuccgagcccggcaccuggaagaucuccgcccgcuucuccgacggccucgaguccaacuccuccacccaguucgaggucaagaaguacguccuccccaacuucgaggucaagaucacccccggcaagcccuacauccucaccguccccggccaccucgacgagaugcagcucgacauccaggcccgcuacaucuacggcaagcccguccagggcgucgccuacguccgcuucggccuccucgacgaggacggcaagaagaccuucuuccgcggccucgagucccagaccaagcucgucaacggccagucccacaucucccucuccaaggccgaguuccaggacgcccucgagaagcucaacaugggcaucaccgaccuccagggccuccgccucuacgucgccgccgccaucaucgaguaccccggcggcgagauggaggaggccgagcucaccuccugguacuucgucuccucccccuucucccucgaccucuccaagaccaagcgccaccucguccccggcgcccccuuccuccuccaggcccucguccgcgagauguccggcucccccgccuccggcauccccgucaaggucuccgccaccgucuccucccccggcuccguccccgagguccaggacauccagcagaacaccgacggcuccggccaggucuccauccccaucaucaucccccagaccaucuccgagcuccagcucuccgucuccgccggcuccccccaccccgccaucgcccgccucaccgucgccgccccccccuccggcggccccggcuuccucuccaucgagcgccccgacucccgccccccccgcgucggcgacacccucaaccucaaccuccgcgccgucggcuccggcgccaccuucucccacuacuacuacaugauccucucccgcggccagaucgucuucaugaaccgcgagcccaagcgcacccucaccuccgucuccgucuucgucgaccaccaccucgcccccuccuucuacuucgucgccuucuacuaccacggcgaccaccccgucgccaacucccuccgcgucgacguccaggccggcgccugcgagggcaagcucgagcucuccgucgacggcgccaagcaguaccgcaacggcgaguccgucaagcuccaccucgagaccgacucccucgcccucgucgcccucggcgcccucgacaccgcccucuacgccgccggcuccaagucccacaagccccucaacaugggcaaggucuucgaggccaugaacuccuacgaccucggcugcggccccggcggcggcgacuccgcccuccaggucuuccaggccgccggccucgccuucuccgacggcgaccaguggacccucucccgcaagcgccucuccugccccaaggagaagaccacccgcaagaagcgcaacgucaacuuccagaaggccaucaacgagaagcucggccaguacgccucccccaccgccaagcgcugcugccaggacggcgucacccgccuccccaugaugcgcuccugcgagcagcgcgccgcccgcguccagcagcccgacugccgcgagcccuuccucuccugcugccaguucgccgagucccuccgcaagaagucccgcgacaagggccaggccggccuccagcgcgcccucgagauccuccaggaggaggaccucaucgacgaggacgacauccccguccgcuccuucuuccccgagaacuggcucuggcgcgucgagaccgucgaccgcuuccagauccucacccucuggcuccccgacucccucaccaccugggagauccacggccucucccucuccaagaccaagggccucugcgucgccacccccguccagcuccgcgucuuccgcgaguuccaccuccaccuccgccuccccauguccguccgccgcuucgagcagcucgagcuccgccccguccucuacaacuaccucgacaagaaccucaccgucuccguccacgucucccccgucgagggccucugccucgccggcggcggcggccucgcccagcagguccucguccccgccggcuccgcccgccccgucgccuucuccgucguccccaccgccgccgccgccgucucccucaaggucgucgcccgcggcuccuucgaguuccccgucggcgacgccgucuccaagguccuccagaucgagaaggagggcgccauccaccgcgaggagcucgucuacgagcucaacccccucgaccaccgcggccgcacccucgagauccccggcaacuccgaccccaacaugauccccgacggcgacuucaacuccuacguccgcgucaccgccuccgacccccucgacacccucggcuccgagggcgcccucucccccggcggcgucgccucccuccuccgccucccccgcggcugcggcgagcagaccaugaucuaccucgcccccacccucgccgccucccgcuaccucgacaagaccgagcagugguccacccucccccccgagaccaaggaccacgccgucgaccucauccagaagggcuacaugcgcauccagcaguuccgcaaggccgacggcuccuacgccgccuggcucucccgcggcuccuccaccuggcucaccgccuucguccucaagguccucucccucgcccaggagcaggucggcggcucccccgagaagcuccaggagaccuccaacuggcuccucucccagcagcaggccgacggcuccuuccaggaccucucccccgucauccaccgcuccaugcagggcggccucgucggcaacgacgagaccgucgcccucaccgccuucgucaccaucgcccuccaccacggccucgccgucuuccaggacgagggcgccgagccccucaagcagcgcgucgaggccuccaucuccaaggccuccuccuuccucggcgagaaggccuccgccggccuccucggcgcccacgccgccgccaucaccgccuacgcccucacccucaccaaggcccccgccgaccuccgcggcgucgcccacaacaaccucauggccauggcccaggagaccggcgacaaccucuacuggggcuccgucaccggcucccaguccaacgccgucucccccacccccgccccccgcaaccccuccgaccccaugccccaggcccccgcccucuggaucgagaccaccgccuacgcccuccuccaccuccuccuccacgagggcaaggccgagauggccgaccaggccgccgccuggcucacccgccagggcuccuuccagggcggcuuccgcuccacccaggacaccgucaucgcccucgacgcccucuccgccuacuggaucgccucccacaccaccgaggagcgcggccucaacgucacccucuccuccaccggccgcaacggcuucaagucccacgcccuccagcucaacaaccgccagauccgcggccucgaggaggagcuccaguucucccucggcuccaagaucaacgucaaggucggcggcaacuccaagggcacccucaagguccuccgcaccuacaacguccucgacaugaagaacaccaccugccaggaccuccagaucgaggucaccgucaagggccacgucgaguacaccauggaggccaacgaggacuacgaggacuacgaguacgacgagcuccccgccaaggacgaccccgacgccccccuccagcccgucaccccccuccagcucuucgagggccgccgcaaccgccgccgccgcgaggcccccaaggucgucgaggagcaggagucccgcguccacuacaccgucugcaucuggcgcaacggcaaggucggccucuccggcauggccaucgccgacgucacccuccucuccggcuuccacgcccuccgcgccgaccucgagaagcucaccucccucuccgaccgcuacgucucccacuucgagaccgagggcccccacguccuccucuacuucgacuccguccccaccucccgcgagugcgucggcuucgaggccguccaggagguccccgucggccucguccagcccgccuccgccacccucuacgacuacuacaaccccgagcgccgcugcuccgucuucuacggcgcccccuccaagucccgccuccucgccacccucugcuccgccgaggucugccagugcgccgagggcaagugcccccgccagcgccgcgcccucgagcgcggccuccaggacgaggacggcuaccgcaugaaguucgccugcuacuacccccgcgucgaguacggcuuccaggucaagguccuccgcgaggacucccgcgccgccuuccgccucuucgagaccaagaucacccagguccuccacuucaccaaggacgucaaggccgccgccaaccagaugcgcaacuuccucguccgcgccuccugccgccuccgccucgagcccggcaaggaguaccucaucaugggccucgacggcgccaccuacgaccucgagggccacccccaguaccuccucgacuccaacuccuggaucgaggagaugcccuccgagcgccucugccgcuccacccgccagcgcgccgccugcgcccagcucaacgacuuccuccaggaguacggcacccagggcugccaggucuga

SEQ ID NO: 40588 - RNA, 5235 nt, Artificial Sequence
  derived and/or modified sequence opt2 from C4B__Homo_sapiens__NP_001002029
augcgccuccucuggggccucaucugggccuccuccuucuucacccucucccuccagaagccccgccuccuccucuucucccccuccgucguccaccucggcgucccccucuccgucggcguccagcuccaggacgucccccgcggccaggucgucaagggcuccgucuuccuccgcaaccccucccgcaacaacguccccugcucccccaaggucgacuucacccucuccuccgagcgcgacuucgcccuccucucccuccaggucccccucaaggacgccaaguccugcggccuccaccagcuccuccgcggccccgagguccagcucgucgcccacucccccuggcucaaggacucccucucccgcaccaccaacauccagggcaucaaccuccucuucuccucccgccgcggccaccucuuccuccagaccgaccagcccaucuacaaccccggccagcgcguccgcuaccgcgucuucgcccucgaccagaagaugcgccccuccaccgacaccaucaccgucauggucgagaacucccacggccuccgcguccgcaagaaggaggucuacaugcccuccuccaucuuccaggacgacuucgucauccccgacaucuccgagcccggcaccuggaagaucuccgcccgcuucuccgacggccucgaguccaacuccuccacccaguucgaggucaagaaguacguccuccccaacuucgaggucaagaucacccccggcaagcccuacauccucaccguccccggccaccucgacgagaugcagcucgacauccaggcccgcuacaucuacggcaagcccguccagggcgucgccuacguccgcuucggccuccucgacgaggacggcaagaagaccuucuuccgcggccucgagucccagaccaagcucgucaacggccagucccacaucucccucuccaaggccgaguuccaggacgcccucgagaagcucaacaugggcaucaccgaccuccagggccuccgccucuacgucgccgccgccaucaucgagucccccggcggcgagauggaggaggccgagcucaccuccugguacuucgucuccucccccuucucccucgaccucuccaagaccaagcgccaccucguccccggcgcccccuuccuccuccaggcccucguccgcgagauguccggcucccccgccuccggcauccccgucaaggucuccgccaccgucuccucccccggcuccguccccgagguccaggacauccagcagaacaccgacggcuccggccaggucuccauccccaucaucaucccccagaccaucuccgagcuccagcucuccgucuccgccggcuccccccaccccgccaucgcccgccucaccgucgccgccccccccuccggcggccccggcuuccucuccaucgagcgccccgacucccgccccccccgcgucggcgacacccucaaccucaaccuccgcgccgucggcuccggcgccaccuucucccacuacuacuacaugauccucucccgcggccagaucgucuucaugaaccgcgagcccaagcgcacccucaccuccgucuccgucuucgucgaccaccaccucgcccccuccuucuacuucgucgccuucuacuaccacggcgaccaccccgucgccaacucccuccgcgucgacguccaggccggcgccugcgagggcaagcucgagcucuccgucgacggcgccaagcaguaccgcaacggcgaguccgucaagcuccaccucgagaccgacucccucgcccucgucgcccucggcgcccucgacaccgcccucuacgccgccggcuccaagucccacaagccccucaacaugggcaaggucuucgaggccaugaacuccuacgaccucggcugcggccccggcggcggcgacuccgcccuccaggucuuccaggccgccggccucgccuucuccgacggcgaccaguggacccucucccgcaagcgccucuccugccccaaggagaagaccacccgcaagaagcgcaacgucaacuuccagaaggccaucaacgagaagcucggccaguacgccucccccaccgccaagcgcugcugccaggacggcgucacccgccuccccaugaugcgcuccugcgagcagcgcgccgcccgcguccagcagcccgacugccgcgagcccuuccucuccugcugccaguucgccgagucccuccgcaagaagucccgcgacaagggccaggccggccuccagcgcgcccucgagauccuccaggaggaggaccucaucgacgaggacgacauccccguccgcuccuucuuccccgagaacuggcucuggcgcgucgagaccgucgaccgcuuccagauccucacccucuggcuccccgacucccucaccaccugggagauccacggccucucccucuccaagaccaagggccucugcgucgccacccccguccagcuccgcgucuuccgcgaguuccaccuccaccuccgccuccccauguccguccgccgcuucgagcagcucgagcuccgccccguccucuacaacuaccucgacaagaaccucaccgucuccguccacgucucccccgucgagggccucugccucgccggcggcggcggccucgcccagcagguccucguccccgccggcuccgcccgccccgucgccuucuccgucguccccaccgccgccaccgccgucucccucaaggucgucgcccgcggcuccuucgaguuccccgucggcgacgccgucuccaagguccuccagaucgagaaggagggcgccauccaccgcgaggagcucgucuacgagcucaacccccucgaccaccgcggccgcacccucgagauccccggcaacuccgaccccaacaugauccccgacggcgacuucaacuccuacguccgcgucaccgccuccgacccccucgacacccucggcuccgagggcgcccucucccccggcggcgucgccucccuccuccgccucccccgcggcugcggcgagcagaccaugaucuaccucgcccccacccucgccgccucccgcuaccucgacaagaccgagcagugguccacccucccccccgagaccaaggaccacgccgucgaccucauccagaagggcuacaugcgcauccagcaguuccgcaaggccgacggcuccuacgccgccuggcucucccgcggcuccuccaccuggcucaccgccuucguccucaagguccucucccucgcccaggagcaggucggcggcucccccgagaagcuccaggagaccuccaacuggcuccucucccagcagcaggccgacggcuccuuccaggaccucucccccgucauccaccgcuccaugcagggcggccucgucggcaacgacgagaccgucgcccucaccgccuucgucaccaucgcccuccaccacggccucgccgucuuccaggacgagggcgccgagccccucaagcagcgcgucgaggccuccaucuccaaggccuccuccuuccucggcgagaaggccuccgccggccuccucggcgcccacgccgccgccaucaccgccuacgcccucacccucaccaaggcccccgccgaccuccgcggcgucgcccacaacaaccucauggccauggcccaggagaccggcgacaaccucuacuggggcuccgucaccggcucccaguccaacgccgucucccccacccccgccccccgcaaccccuccgaccccaugccccaggcccccgcccucuggaucgagaccaccgccuacgcccuccuccaccuccuccuccacgagggcaaggccgagauggccgaccaggccgccgccuggcucacccgccagggcuccuuccagggcggcuuccgcuccacccaggacaccgucaucgcccucgacgcccucuccgccuacuggaucgccucccacaccaccgaggagcgcggccucaacgucacccucuccuccaccggccgcaacggcuucaagucccacgcccuccagcucaacaaccgccagauccgcggccucgaggaggagcuccaguucucccucggcuccaagaucaacgucaaggucggcggcaacuccaagggcacccucaagguccuccgcaccuacaacguccucgacaugaagaacaccaccugccaggaccuccagaucgaggucaccgucaagggccacgucgaguacaccauggaggccaacgaggacuacgaggacuacgaguacgacgagcuccccgccaaggacgaccccgacgccccccuccagcccgucaccccccuccagcucuucgagggccgccgcaaccgccgccgccgcgaggcccccaaggucgucgaggagcaggagucccgcguccacuacaccgucugcaucuggcgcaacggcaaggucggccucuccggcauggccaucgccgacgucacccuccucuccggcuuccacgcccuccgcgccgaccucgagaagcucaccucccucuccgaccgcuacgucucccacuucgagaccgagggcccccacguccuccucuacuucgacuccguccccaccucccgcgagugcgucggcuucgaggccguccaggagguccccgucggccucguccagcccgccuccgccacccucuacgacuacuacaaccccgagcgccgcugcuccgucuucuacggcgcccccuccaagucccgccuccucgccacccucugcuccgccgaggucugccagugcgccgagggcaagugcccccgccagcgccgcgcccucgagcgcggccuccaggacgaggacggcuaccgcaugaaguucgccugcuacuacccccgcgucgaguacggcuuccaggucaagguccuccgcgaggacucccgcgccgccuuccgccucuucgagaccaagaucacccagguccuccacuucaccaaggacgucaaggccgccgccaaccagaugcgcaacuuccucguccgcgccuccugccgccuccgccucgagcccggcaaggaguaccucaucaugggccucgacggcgccaccuacgaccucgagggccacccccaguaccuccucgacuccaacuccuggaucgaggagaugcccuccgagcgccucugccgcuccacccgccagcgcgccgccugcgcccagcucaacgacuuccuccaggaguacggcacccagggcugccaggucuga

SEQ ID NO: 40589 - RNA, 1794 nt, Artificial Sequence
  derived and/or modified sequence opt2 from C4BPA__Homo_sapiens__XP_005273308
augcacccccccaagacccccuccggcgcccuccaccgcaagcgcaagauggccgccuggcccuucucccgccucuggaaggucuccgaccccauccucuuccagaugacccucaucgccgcccuccuccccgccguccucggcaacugcggccccccccccacccucuccuucgccgcccccauggacaucacccucaccgagacccgcuucaagaccggcaccacccucaaguacaccugccuccccggcuacguccgcucccacuccacccagacccucaccugcaacuccgacggcgagugggucuacaacaccuucugcaucuacaagcgcugccgccaccccggcgagcuccgcaacggccaggucgagaucaagaccgaccucuccuucggcucccagaucgaguucuccugcuccgagggcuucuuccucaucggcuccaccaccucccgcugcgagguccaggaccgcggcgucggcuggucccacccccucccccagugcgagaucgucaagugcaagcccccccccgacauccgcaacggccgccacuccggcgaggagaacuucuacgccuacggcuucuccgucaccuacuccugcgacccccgcuucucccuccucggccacgccuccaucuccugcaccgucgagaacgagaccaucggcgucuggcgccccuccccccccaccugcgagaagaucaccugccgcaagcccgacgucucccacggcgagauggucuccggcuucggccccaucuacaacuacaaggacaccaucgucuucaagugccagaagggcuucguccuccgcggcuccuccgucauccacugcgacgccgacuccaaguggaaccccuccccccccgccugcgagcccaacuccugcaucaaccuccccgacaucccccacgccuccugggagaccuacccccgccccaccaaggaggacgucuacgucgucggcaccguccuccgcuaccgcugccaccccggcuacaagcccaccaccgacgagcccaccaccgucaucugccagaagaaccuccgcuggacccccuaccagggcugcgaggcccucugcugccccgagcccaagcucaacaacggcgagaucacccagcaccgcaagucccgccccgccaaccacugcgucuacuucuacggcgacgagaucuccuucuccugccacgagaccucccgcuucuccgccaucugccagggcgacggcaccugguccccccgcacccccuccugcggcgacaucugcaacuucccccccaagaucgcccacggccacuacaagcaguccuccuccuacuccuucuucaaggaggagaucaucuacgagugcgacaagggcuacauccucgucggccaggccaagcucuccugcuccuacucccacugguccgcccccgccccccagugcaaggcccucugccgcaagcccgagcucgucaacggccgccucuccgucgacaaggaccaguacgucgagcccgagaacgucaccauccagugcgacuccggcuacggcgucgucggcccccaguccaucaccugcuccggcaaccgcaccugguaccccgagguccccaagugcgagugggagacccccgagggcugcgagcagguccucaccggcaagcgccucaugcagugccuccccaaccccgaggacgucaagauggcccucgaggucuacaagcucucccucgagaucgagcagcucgagcuccagcgcgacuccgcccgccaguccacccucgacaaggagcucuga

SEQ ID NO: 40590 - RNA, 759 nt, Artificial Sequence
  derived and/or modified sequence opt2 from C4BPB__Homo_sapiens__NP_001017365
auguucuucuggugcgccugcugccucauggucgccuggcgcgucuccgccuccgacgccgagcacugccccgagcucccccccgucgacaacuccaucuucgucgccaaggaggucgagggccagauccucggcaccuacgucugcaucaagggcuaccaccucgucggcaagaagacccucuucugcaacgccuccaaggagugggacaacaccaccaccgagugccgccucggccacugccccgaccccguccucgucaacggcgaguucuccuccuccggccccgucaacgucuccgacaagaucaccuucaugugcaacgaccacuacauccucaagggcuccaaccgcucccagugccucgaggaccacaccugggccccccccuuccccaucugcaagucccgcgacugcgacccccccggcaaccccguccacggcuacuucgagggcaacaacuucacccucggcuccaccaucuccuacuacugcgaggaccgcuacuaccucgucggcguccaggagcagcagugcgucgacggcgagugguccuccgcccuccccgucugcaagcucauccaggaggcccccaagcccgagugcgagaaggcccuccucgccuuccaggaguccaagaaccucugcgaggccauggagaacuucaugcagcagcucaaggaguccggcaugaccauggaggagcucaaguacucccucgagcucaagaaggccgagcucaaggccaagcuccucuga

SEQ ID NO: 40591 - RNA, 753 nt, Artificial Sequence
  derived and/or modified sequence opt2 from C4orf22__Homo_sapiens__NP_001193926
auggaccaggaggagggccucaaggcccucgacaacaucgucacccaguucaacgccuacgaggacuuccucgacucccagaucaccaccgucgaccucuacuaccucgaggacgagacccucgcccgccagcucgucgagcucggcuaccgcggcaccggcgagcgcgucaagcgcgaggacuucgaggcccgcaaggccgccaucgagaucgcccgccucgccgagcgcgcccagcagaagacccucaccuccgccggcaaggaccuccaggacaacuuccucaccgcccucgccaugcgcgaggaggacaaccgcuccggcaagcucucccucaaccagcaggagaccgacgccgcccacauccucaagaagcagcucgccuccgucaucuucauccgcgaccgcaacucccacggccaggagaucuccggcuacaucgacuacgcccaccgccucaagaccgaggacuucgaggucuacuucaccggcaagaagcgccuccucccccgccccaccgacaucuccuucuacaacugggacgccgacaucgccgucuccaacuccucccccaacuaccaggucaucgccgacaaccccgagggccuccucuuccgcuacaagcgcgaccgcaagauccucaacgucgaccccaaggcccagcccggcgacaacuccacccgcaucaccauccucaccgagcucuacguccaggccgucaucuucgaccacaucucccgccgcaagaccuga

SEQ ID NO: 40592 - RNA, 531 nt, Artificial Sequence
  derived and/or modified sequence opt2 from C4orf26__Homo_sapiens__NP_001193910
auggcccgccgccacugcuucuccuacuggcuccucgucugcuggcucgucgucaccgucgccgaggcccucuccaccuucuaccuccagcagcacaucaaccuccacauggacaagaagcgcuaccuccgccuccucgagauccacaagaucaugcgcacccuccccaccgcccgcucccuccacuccccccuccaccucccccgcggcguccgcucccagggccccucccccucccagcgccaccccggcguccccuccaucuucuuccacgagggccccgaguccauccucggcuuccagaccgaccucuccucccuccagggcgucaccaccgucuuccacuccucccacuucaucggccacaccgucacccuccucaucggcaucucccccgaggaggacucccgcgaggaggcccaccuccgcaaggccgagcgcgaggagaagcccaagcacaccgaggccaagaagucccucuccuuccgcaagaagcagcagaaggacuucugcuucaucuuccgcaacuga

SEQ ID NO: 40593 - RNA, 1041 nt, Artificial Sequence
  derived and/or modified sequence opt2 from C4orf27__Homo_sapiens__NP_060337
auggucggcggcggcggcaagcgccgccccggcggcgagggcccccagugcgagaagaccaccgacgucaagaaguccaaguucugcgaggccgacgucuccuccgaccuccgcaaggaggucgagaaccacuacaagcucucccuccccgaggacuucuaccacuucuggaaguucugcgaggagcucgaccccgagaagcccuccgacucccucuccgccucccucggccuccagcucgucggccccuacgacauccucgccggcaagcacaagaccaagaagaaguccaccggccucaacuucaaccuccacuggcgcuucuacuacgacccccccgaguuccagaccaucaucaucggcgacaacaagacccaguaccacaugggcuacuuccgcgacucccccgacgaguuccccgucuacgucggcaucaacgaggccaagaagaacugcaucaucguccccaacggcgacaacgucuucgccgccgucaagcucuuccucaccaagaagcuccgcgagaucaccgacaagaagaagaucaaccuccucaagaacaucgacgagaagcucaccgaggccgcccgcgagcucggcuacucccucgagcagcgcaccgucaagaugaagcagcgcgacaagaaggucgucaccaagaccuuccacggcgccggccucgucguccccgucgacaagaacgacgucggcuaccgcgagcuccccgagaccgacgccgaccucaagcgcaucugcaagaccaucgucgaggccgccuccgacgaggagcgccucaaggccuucgcccccauccaggagaugaugaccuucguccaguucgccaacgacgagugcgacuacggcaugggccucgagcucggcauggaccucuucugcuacggcucccacuacuuccacaaggucgccggccagcuccucccccucgccuacaaccuccucaagcgcaaccucuucgccgagaucaucgaggagcaccucgccaaccgcucccaggagaacaucgaccagcucgccgccuga

SEQ ID NO: 40594 - RNA, 399 nt, Artificial Sequence
  derived and/or modified sequence opt2 from C4orf32__Homo_sapiens__NP_689613
augugcuccgccggcgagcuccuccgcggcggcgacggcggcgagcgcgacgaggacggcgacgcccucgccgagcgcgaggccgccggcaccgagugggaccccggcgccuccccccgccgccgcggccagcgccccaaggaguccgagcaggacgucgaggacucccagaaccacaccggcgagcccgucggcgacgacuacaagaagaugggcacccucuucggcgagcucaacaagaaccucaucaacaugggcuucacccgcauguacuucggcgagcgcaucgucgagcccgucaucgucaucuucuucugggucaugcucugguuccucggccuccaggcccucggccucgucgccguccucugccucgucaucaucuacguccagcaguga

SEQ ID NO: 40595 - RNA, 600 nt, Artificial Sequence
  derived and/or modified sequence opt2 from C4orf33__Homo_sapiens__NP_001093253
auggacuucaagaucgagcacaccugggacggcuuccccgucaagcacgagcccgucuucauccgccucaaccccggcgaccgcggcgucaugauggacaucuccgcccccuucuuccgcgacccccccgccccccucggcgagcccggcaagcccuucaacgagcucugggacuacgaggucgucgaggccuucuuccucaacgacaucaccgagcaguaccucgaggucgagcucugcccccacggccagcaccucguccuccuccucuccggccgccgcaacgucuggaagcaggagcucccccucuccuuccgcaugucccgcggcgagaccaagugggagggcaaggccuaccuccccugguccuacuucccccccaacgucaccaaguucaacuccuucgccauccacggcuccaaggacaagcgcuccuacgaggcccucuaccccgucccccagcacgagcuccagcagggccagaagcccgacuuccacugccucgaguacuucaaguccuucaacuucaacacccuccucggcgaggaguggaagcagcccgaguccgaccucuggcucaucgagaagugcgacaucuga

SEQ ID NO: 40596 - RNA, 354 nt, Artificial Sequence
  derived and/or modified sequence opt2 from C4orf36__Homo_sapiens__XP_011529917
auggccuacggcgucccccgcaagaacaccgucaagaccauccuccgcggcuccugcuacaacguccaggagcccugggacaucgcccuccucgccaagaccugguccaccaaccucgccaacaucaagcuccccuuccucgaggagaucuccuucggcggcuccguccagcucaccaagugcaccaccaucaaggacggccuccuccccuccgccgaguccaucaagcucgagcgcgaguacgaggucaagcgccucugcaagcucaagugccaggagaacaccuccaaggagauccagcuccuccuccgcgagcgccccgccggccuccgccgcccccuccccuccaaguga

SEQ ID NO: 40597 - RNA, 288 nt, Artificial Sequence
  derived and/or modified sequence opt2 from C4orf48__Homo_sapiens__NP_001135408
auggcccccccccccgccugccgcucccccaugucccccccccccccccuccuccuccuccuccuccucucccucgcccuccucggcgcccgcgcccgcgccgagcccgccggcuccgccguccccgcccagucccgccccugcgucgacugccacgccuucgaguucaugcagcgcgcccuccaggaccuccgcaagaccgccugcucccucgacgcccgcaccgagacccuccuccuccaggccgagcgccgcgcccucugcgccugcuggcccgccggccacuga

SEQ ID NO: 40598 - RNA, 609 nt, Artificial Sequence
  derived and/or modified sequence opt2 from C4orf51__Homo_sapiens__XP_011530499
augucccacuacuucuaccucaccccccagauccuccuccccuucuccccccucaccucccaggaguucgaccucauccgccgcaaggccggcgccuccuggcaggacgagacccgcugguccgacuccuccgucaccaccuacaccggcuccuaccgcaagaagcagcucgacaaguccaugugcucccaguucuccuuccgcgccggccagcacgagcccgagugcaagcagaugucccucaccaacuccuccgccugccaccuccucugcugggccggcacccaggagaccaccgacaucaagggccucuuccccgacaucacccgccccuucaagaaguccuucgacgucaagcacggcgucgcccaccagaucugggacuucggcgacugcuuccccaccccccccaacuacggcaaguacugcguccgccccaagaagcccgcccaggaggcccucaucaacuacucccgccgcggcaagggcguccucaagcaccuccacggccgcugcgacuccgaguccaaggucugcuccuccgaggacuccgaggccgaccgcuacuccgacuacggcuggggcggccccuccucccccuucaacuga

SEQ ID NO: 40599 - RNA, 1053 nt, Artificial Sequence
  derived and/or modified sequence opt2 from C5AR1__Homo_sapiens__NP_001727
augaacuccuucaacuacaccacccccgacuacggccacuacgacgacaaggacacccucgaccucaacacccccgucgacaagaccuccaacacccuccgcguccccgacauccucgcccucgucaucuucgccgucgucuuccucgucggcguccucggcaacgcccucgucgucugggucaccgccuucgaggccaagcgcaccaucaacgccaucugguuccucaaccucgccgucgccgacuuccucuccugccucgcccuccccauccucuucaccuccaucguccagcaccaccacuggcccuucggcggcgccgccugcuccauccuccccucccucauccuccucaacauguacgccuccauccuccuccucgccaccaucuccgccgaccgcuuccuccucgucuucaagcccaucuggugccagaacuuccgcggcgccggccucgccuggaucgccugcgccgucgccuggggccucgcccuccuccucaccauccccuccuuccucuaccgcgucguccgcgaggaguacuucccccccaagguccucugcggcgucgacuacucccacgacaagcgccgcgagcgcgccgucgccaucguccgccucguccucggcuuccucuggccccuccucacccucaccaucugcuacaccuucauccuccuccgcaccuggucccgccgcgccacccgcuccaccaagacccucaaggucgucgucgccgucgucgccuccuucuucaucuucuggcuccccuaccaggucaccggcaucaugauguccuuccucgagcccuccucccccaccuuccuccuccucaacaagcucgacucccucugcgucuccuucgccuacaucaacugcugcaucaaccccaucaucuacgucgucgccggccagggcuuccagggccgccuccgcaagucccuccccucccuccuccgcaacguccucaccgaggaguccgucguccgcgaguccaaguccuucacccgcuccaccgucgacaccauggcccagaagacccaggccgucuga

SEQ ID NO: 40600 - RNA, 1014 nt, Artificial Sequence
  derived and/or modified sequence opt2 from C5AR2__Homo_sapiens__NP_001258679
augggcaacgacuccgucuccuacgaguacggcgacuacuccgaccucuccgaccgccccgucgacugccucgacggcgccugccucgccaucgacccccuccgcgucgccccccucccccucuacgccgccaucuuccucgucggcguccccggcaacgccauggucgccugggucgccggcaaggucgcccgccgccgcgucggcgccaccuggcuccuccaccucgccgucgccgaccuccucugcugccucucccuccccauccucgccguccccaucgcccgcggcggccacuggcccuacggcgccgucggcugccgcgcccuccccuccaucauccuccucaccauguacgccuccguccuccuccucgccgcccucuccgccgaccucugcuuccucgcccucggccccgccuggugguccaccguccagcgcgccugcggcguccaggucgccugcggcgccgccuggacccucgcccuccuccucaccguccccuccgccaucuaccgccgccuccaccaggagcacuuccccgcccgccuccagugcgucgucgacuacggcggcuccuccuccaccgagaacgccgucaccgccauccgcuuccucuucggcuuccucggcccccucgucgccgucgccuccugccacuccgcccuccucugcugggccgcccgccgcugccgcccccucggcaccgccaucgucgucggcuucuucgucugcugggcccccuaccaccuccucggccucguccucaccgucgccgcccccaacuccgcccuccucgcccgcgcccuccgcgccgagccccucaucgucggccucgcccucgcccacuccugccucaaccccaugcucuuccucuacuucggccgcgcccagcuccgccgcucccuccccgccgccugccacugggcccuccgcgagucccagggccaggacgaguccgucgacuccaagaaguccaccucccacgaccucgucuccgagauggaggucuga

SEQ ID NO: 40601 - RNA, 5031 nt, Artificial Sequence
  derived and/or modified sequence opt2 from C5__Homo_sapiens__NP_001726
augggccuccucggcauccucugcuuccucaucuuccucggcaagaccuggggccaggagcagaccuacgucaucuccgcccccaagaucuuccgcgucggcgccuccgagaacaucgucauccaggucuacggcuacaccgaggccuucgacgccaccaucuccaucaaguccuaccccgacaagaaguucuccuacuccuccggccacguccaccucuccuccgagaacaaguuccagaacuccgccauccucaccauccagcccaagcagcuccccggcggccagaaccccgucuccuacgucuaccucgaggucgucuccaagcacuucuccaaguccaagcgcaugcccaucaccuacgacaacggcuuccucuucauccacaccgacaagcccgucuacacccccgaccaguccgucaagguccgcgucuacucccucaacgacgaccucaagcccgccaagcgcgagaccguccucaccuucaucgaccccgagggcuccgaggucgacauggucgaggagaucgaccacaucggcaucaucuccuuccccgacuucaagauccccuccaacccccgcuacggcauguggaccaucaaggccaaguacaaggaggacuucuccaccaccggcaccgccuacuucgaggucaaggaguacguccucccccacuucuccgucuccaucgagcccgaguacaacuucaucggcuacaagaacuucaagaacuucgagaucaccaucaaggcccgcuacuucuacaacaaggucgucaccgaggccgacgucuacaucaccuucggcauccgcgaggaccucaaggacgaccagaaggagaugaugcagaccgccaugcagaacaccaugcucaucaacggcaucgcccaggucaccuucgacuccgagaccgccgucaaggagcucuccuacuacucccucgaggaccucaacaacaaguaccucuacaucgccgucaccgucaucgaguccaccggcggcuucuccgaggaggccgagauccccggcaucaaguacguccucucccccuacaagcucaaccucgucgccaccccccucuuccucaagcccggcauccccuaccccaucaagguccaggucaaggacucccucgaccagcucgucggcggcguccccgucacccucaacgcccagaccaucgacgucaaccaggagaccuccgaccucgaccccuccaaguccgucacccgcgucgacgacggcgucgccuccuucguccucaaccuccccuccggcgucaccguccucgaguucaacgucaagaccgacgcccccgaccuccccgaggagaaccaggcccgcgagggcuaccgcgccaucgccuacuccucccucucccaguccuaccucuacaucgacuggaccgacaaccacaaggcccuccucgucggcgagcaccucaacaucaucgucacccccaagucccccuacaucgacaagaucacccacuacaacuaccucauccucuccaagggcaagaucauccacuucggcacccgcgagaaguucuccgacgccuccuaccaguccaucaacauccccgucacccagaacaugguccccuccucccgccuccucgucuacuacaucgucaccggcgagcagaccgccgagcucgucuccgacuccgucuggcucaacaucgaggagaagugcggcaaccagcuccagguccaccucucccccgacgccgacgccuacucccccggccagaccgucucccucaacauggccaccggcauggacuccugggucgcccucgccgccgucgacuccgccgucuacggcguccagcgcggcgccaagaagccccucgagcgcgucuuccaguuccucgagaaguccgaccucggcugcggcgccggcggcggccucaacaacgccaacgucuuccaccucgccggccucaccuuccucaccaacgccaacgccgacgacucccaggagaacgacgagcccugcaaggagauccuccgcccccgccgcacccuccagaagaagaucgaggagaucgccgccaaguacaagcacuccgucgucaagaagugcugcuacgacggcgccugcgucaacaacgacgagaccugcgagcagcgcgccgcccgcaucucccucggcccccgcugcaucaaggccuucaccgagugcugcgucgucgccucccagcuccgcgccaacaucucccacaaggacaugcagcucggccgccuccacaugaagacccuccuccccgucuccaagcccgagauccgcuccuacuuccccgaguccuggcucugggagguccaccucgucccccgccgcaagcagcuccaguucgcccuccccgacucccucaccaccugggagauccagggcgucggcaucuccaacaccggcaucugcgucgccgacaccgucaaggccaaggucuucaaggacgucuuccucgagaugaacauccccuacuccgucguccgcggcgagcagauccagcucaagggcaccgucuacaacuaccgcaccuccggcaugcaguucugcgucaagauguccgccgucgagggcaucugcaccuccgagucccccgucaucgaccaccagggcaccaaguccuccaagugcguccgccagaaggucgagggcuccuccucccaccucgucaccuucaccguccucccccucgagaucggccuccacaacaucaacuucucccucgagaccugguucggcaaggagauccucgucaagacccuccgcgucguccccgagggcgucaagcgcgaguccuacuccggcgucacccucgacccccgcggcaucuacggcaccaucucccgccgcaaggaguuccccuaccgcaucccccucgaccucguccccaagaccgagaucaagcgcauccucuccgucaagggccuccucgucggcgagauccucuccgccguccucucccaggagggcaucaacauccucacccaccuccccaagggcuccgccgaggccgagcucauguccgucguccccgucuucuacgucuuccacuaccucgagaccggcaaccacuggaacaucuuccacuccgacccccucaucgagaagcagaagcucaagaagaagcucaaggagggcaugcucuccaucauguccuaccgcaacgccgacuacuccuacuccgucuggaagggcggcuccgccuccaccuggcucaccgccuucgcccuccgcguccucggccaggucaacaaguacgucgagcagaaccagaacuccaucugcaacucccuccucuggcucgucgagaacuaccagcucgacaacggcuccuucaaggagaacucccaguaccagcccaucaagcuccagggcacccuccccgucgaggcccgcgagaacucccucuaccucaccgccuucaccgucaucggcauccgcaaggccuucgacaucugcccccucgucaagaucgacaccgcccucaucaaggccgacaacuuccuccucgagaacacccuccccgcccaguccaccuucacccucgccaucuccgccuacgcccucucccucggcgacaagacccacccccaguuccgcuccaucgucuccgcccucaagcgcgaggcccucgucaagggcaacccccccaucuaccgcuucuggaaggacaaccuccagcacaaggacuccuccguccccaacaccggcaccgcccgcauggucgagaccaccgccuacgcccuccucaccucccucaaccucaaggacaucaacuacgucaaccccgucaucaaguggcucuccgaggagcagcgcuacggcggcggcuucuacuccacccaggacaccaucaacgccaucgagggccucaccgaguacucccuccucgucaagcagcuccgccucuccauggacaucgacgucuccuacaagcacaagggcgcccuccacaacuacaagaugaccgacaagaacuuccucggccgccccgucgagguccuccucaacgacgaccucaucgucuccaccggcuucggcuccggccucgccaccguccacgucaccaccgucguccacaagaccuccaccuccgaggaggucugcuccuucuaccucaagaucgacacccaggacaucgaggccucccacuaccgcggcuacggcaacuccgacuacaagcgcaucgucgccugcgccuccuacaagcccucccgcgaggaguccuccuccggcuccucccacgccgucauggacaucucccuccccaccggcaucuccgccaacgaggaggaccucaaggcccucgucgagggcgucgaccagcucuucaccgacuaccagaucaaggacggccacgucauccuccagcucaacuccauccccuccuccgacuuccucugcguccgcuuccgcaucuucgagcucuucgaggucggcuuccucucccccgccaccuucaccgucuacgaguaccaccgccccgacaagcagugcaccauguucuacuccaccuccaacaucaagauccagaaggucugcgagggcgccgccugcaagugcgucgaggccgacugcggccagaugcaggaggagcucgaccucaccaucuccgccgagacccgcaagcagaccgccugcaagcccgagaucgccuacgccuacaaggucuccaucaccuccaucaccgucgagaacgucuucgucaaguacaaggccacccuccucgacaucuacaagaccggcgaggccgucgccgagaaggacuccgagaucaccuucaucaagaaggucaccugcaccaacgccgagcucgucaagggccgccaguaccucaucaugggcaaggaggcccuccagaucaaguacaacuucuccuuccgcuacaucuacccccucgacucccucaccuggaucgaguacuggccccgcgacaccaccugcuccuccugccaggccuuccucgccaaccucgacgaguucgccgaggacaucuuccucaacggcugcuga

SEQ ID NO: 40602 - RNA, 1329 nt, Artificial Sequence
  derived and/or modified sequence opt2 from C5orf22__Homo_sapiens__NP_060826
auguccgacuccgccggcggccgcgccggccuccgccgcuaccccaagcuccccgucugggucgucgaggaccaccaggagguccuccccuucaucuaccgcgccaucggcuccaagcaccuccccgccuccaacgucuccuuccuccacuucgacucccaccccgaccuccucauccccgucaacaugcccgccgacaccgucuucgacaaggagacccucuucggcgagcucuccaucgagaacuggaucaugcccgccgucuacgccggccacuucucccacgucaucugguuccaccccaccugggcccagcagauccgcgagggccgccaccacuuccucgucggcaaggacaccuccaccaccaccauccgcgucaccuccaccgaccacuacuuccucuccgacggccucuacguccccgaggaccagcucgagaaccagaagccccuccagcucgacgucaucauggucaagcccuacaagcucugcaacaaccaggaggagaacgacgccgucuccuccgccaagaagcccaagcucgcccucgaggacuccgagaacaccgccuccaccaacugcgacuccuccuccgagggccucgagaaggacaccgccacccagcgcuccgaccagaccugccucgagcccuccugcuccugcuccuccgagaaccaggagugccagaccgccgccuccaccggcgagauccucgagauccucaagaagggcaaggccuucguccucgacaucgaccucgacuucuucuccgucaagaaccccuucaaggagauguucacccaggaggaguacaagauccuccaggagcucuaccaguucaagaagcccggcaccaaccucaccgaggaggaccucgucgacaucgucgacacccgcauccaccagcucgaggaccucgaggccaccuucgccgaccucugcgacggcgacgacgaggagaccguccagcgcugggccuccaaccccggcauggagucccucgucccccucguccagucccucaagaagcgcauggagguccccgacuacgagaugguccaccaggccggccucaccugcgacuacuccgagcucccccaccacaucuccaccgagcaggagaucgagugccucauccaguccguccacuaccuccucaagaaccuccccaaccccacccucgucaccaucgcccgcuccucccucgacgacuacugccccuccgaccaggucgacaccauccaggagaagguccucaacaugcuccgcgcccucuacggcaaccucgaccuccaggucuacgccgccgaguccccccccuccuga

SEQ ID NO: 40603 - RNA, 621 nt, Artificial Sequence
  derived and/or modified sequence opt2 from C5orf30__Homo_sapiens__NP_149988
auggaggucgacaucaacggcgagucccgcuccacccucaccacccuccccuuccccggcgccgaggccaacucccccggcaaggccgaggccgagaagccccgcugcuccuccacccccugcucccccaugcgccgcaccgucuccggcuaccagauccuccacauggacuccaacuaccucgucggcuucaccaccggcgaggagcuccucaagcucgcccagaagugcaccggcggcgaggaguccaaggccgaggccaugcccucccuccgcuccaagcagcucgacgccggccucgcccgcuccucccgccucuacaagacccgcucccgcuacuaccagcccuacgagauccccgccgucaacggccgccgccgccgccgcaugcccuccuccggcgacaagugcaccaagucccuccccuacgagcccuacaaggcccuccacggcccccucccccucugccuccucaagggcaagcgcgcccacuccaagucccucgacuaccucaaccucgacaagaugaucaaggagcccgccgacaccgagguccuccaguaccagcuccagcaccucacccuccgcggcgaccgcgucuucgcccgcaacaacaccuga

SEQ ID NO: 40604 - RNA, 1917 nt, Artificial Sequence
  derived and/or modified sequence opt2 from C5orf34__Homo_sapiens__NP_940968
auggccgccgagcuccgcaugauccucuacgaggacgacuccguccagguccaguacgucgacggcuccacccuccagcucucccccugcggcuccgaguuccucuucgagaaguccccccccgucuccgcccacccccucgagcagcccgagcgcauccgccagcgcacccacuucgucaucuccaccuaccgcgagcagcuccagcgcgcccucgacuuccgcaacuccuccgccaccugccccuuccucuccgagaccaucauccccuccgagcgcaagaagcacaucuucaucgacaucaccgagguccgcuggcccucccucgacaccgacggcaccaugaucuacauggaguccggcaucgucaagaucaccucccucgacggccacgccuaccucugccucccccgcucccagcacgaguucaccguccacuuccucugcaaggucucccagaaguccgacuccuccgccguccucuccgagaccaacaacaaggcccccaaggacaagcucgucgagaagaccggcaagaucugcauccgcggcaaccuccccggccagcgccucaagaacaaggagaacgaguuccacugccagaucaugaaguccaaggagacccucaagaagauguccugcgucaacggcaccgagggccgcgaggagcuccccucccccggcaccaagcacaccugcgucuacaccugggucaagcagugcugguccgucgccgccugccccgaggaguggaaguacccccucucccucgcccuccacuuccacaacaagaucuccaacauguccaagaucgacgcccacaucacccagucccgcuuccucaccuccgacaucuccgaggagcgcggcaaggucgucuccguccucccccgcgcccucucccucuccugccccgucccccaccuccaccgcuggaacuucugcgacucccuccuccagcgccaguccgacgaguacuccuaccccgagcucgucaagauggucugguacaagggcgucaccuaccgccucacccaccagaacaugaacuccaucgagaucuacuccggcgacggcuccgucuucaaguccgagggcgccuacuucggcaacuacuucaccuacuacuccauccaggagggcuccggcaagcgcgaggagaagaccuacuccgucaacaaccucccccccgaccgccccggcucccccuucaccgucggcucccucaucaagcaggccacccgcauccuccagcacugcgucaagaugcgccucucccucucccacaacuaccgcaucugcugcuggaagaugguccccggcaucaacgacuccaacauccucccccucguccucaaggagucccucauccccuccgucggccgcuuccucgccuacuccgacgacaagguccacgccaucuuccucgacggcaucacccucacccucaacuggaacuucuccucccccaucgagaagcgccaggucaaccagggccucaaccucggcuggugcaagcucaccuuccccgacggccaggagcagcucauccagaucgagcaccccgagcccuacgagcgcuacgucaccaccgucaccuccuggugccgccgccucacccagaccuccccccgcgagaugcccacccacuccuccuccuccguccuccaggagaacugguccgucgccuccgagcucgagaagauccagaaguucaaccuccuccucgagaacuccggcauccucaaccagaucuccaacaagaagaacgagcagcaguccuucgaccacuacaagcccggcuccuccgagacccuccucggcgaggucaacgagaaccgcgucuccaucgcccucaagaagaccuccgagauccuccacgacaucgacugccuccucuccaacuccaagaaguga

SEQ ID NO: 40605 - RNA, 213 nt, Artificial Sequence
  derived and/or modified sequence opt2 from C5orf38__Homo_sapiens__NP_001281266
auggucgcccccgccgcccgcgucuuccuccgcgccguccgcgccgcccucaccuccaccguccccgaccuccucugccuccucgcccgcggcuccccccgcggccucgccuccggccgccucccccucgccguccacuccgcccagcacggccccggcuccggcgcccccuggcuccgcaucgcccgccgcgcccucucccagcgcaucuga

SEQ ID NO: 40606 - RNA, 9594 nt, Artificial Sequence
  derived and/or modified sequence opt2 from C5orf42__Homo_sapiens__NP_075561
auggagauccgccucgagauccucaccuccaccggcaucaagcagaagaagcccuggccccgcgucuccuggcucggcaaggagaaggaggccgucuuccuccucgacgacaaguucaucaacgagaucaaccuccucuccggcaagaucaagaagaagauccccucccuccagcccuuccucaaggacgucaucguccucaccaccuccuccaacgacgccuggcucgccggcguccucaccaccggcgagcucuuccucuggaacaaggaccaggacugccucaagaccauccccaucaccgagaagcccaaggagaugaucaaggccaccgucgccuccucccuccgccucuaccucuacgucuccggcaacggcaagcgcaucguccucaucacccccuccggcugcaucuuccucugggaguaccucgagcucaagaacauccucuccuccaagucccucucccucgccggccgcuggucccaggucauccccgaggaggccguccuccuccccuccaccgaggacaaggaggccgucgucaacgccgucuucaucaagaacgagcucuucggcgacugcugccucugcuccuucaccuucuacuccggcgagugccucaagcucaccuuccucgccauccgcuggcacgagaacgucuucaccuccguccgcucccuccccuaccacguccacugggcccagcaggacugccaccucugcucccucauccccaagugcgaguccgucaagucccgcggcgcccucaucuccgccuucucccgcgacggccucacccucgccgucacccucaaccagaaggaccccaaggccacccagguccucuucaucaacacccucaacuucgucacccucugcggcucccucaagggcugcuccaacaagucccccgucguccccgccacccucauccgcuccuacugggucggcgacaucuccuggacccacgacucccucuuccucgccugcaugcucaagcgcggcucccucguccuccucaccugccagggcgagcuccucacccucaucaccuucggcugcuccaucgaguucggccccgccgaguucaucccccuccacccccucaucaccuaccgcccccagcaguucaccuuccaggacuccaacaacuccgucgacuccuccgccuccgacuccgaccccaugcgccagcgcuucuccaucaaggcccacucccgccuccccuaccucgucaucuccgacggcuacauggucaccacccuccgcuuccucgacucccucucccccuccguccacaugcgcucccuccuccucgacuccacccagcgccucgagaagaucuaccaguccgucauccucuccaagcccaagggcaagggccucaaccuccgcucccucaacucccuccgcuccucccuccucgagcaccagggcaacgaguccuccgccgacuucaccguccccaaguuccuccaggccgaggagaccaucaacgagaacgccgccgacuuccaggacuucgaggccgaggagaccaacgagggccgccacuuccccgacaaccucugccccuucuggaacaagcgcgacgacguccucugcuccuccaugaaggagggccgccucgaguucgccuccauguucgacaccauccacgccaaggacgacuccgaggagaccgaccgcaccaucaccgagcuccacuccauccagaagucccuccucgccgccuggaccaucggcaucuccaagaccgucaccgagaagaaccucaugcucaacuacaucgucgucugcaucacccacuucuucuacauccuccaguucaucaagugccccuuccccaagcucgaccucguccucuccaaguccucccgccacaacgccuggauccucugcaucuuccagcucuuccaccagugccucuccauccacuacugggacauccgcuacaagcaggacgucggccaccucaucaagcucaccuccaacaccgucaagcuccuccucacccagcagcagaagggccagcucuucuccgagaagcuccucgccugcuucuaccuccucaagauggucgccgacaaccucaacggcgucuacauccuccagcccgaggucaucuccgccuccgccgacggcuccaagaucaccgcccaggacucccucgucguccccaucuuccagauguuccaggacuccggcuuccagaagaacugguccuggaacuccuucuucaagauccacccccaggucgucaaccccguccagcagcccggccaccgccuccucauccucuggcgcauccucuacaagaagacccucugguaccaggcccagcucaaccgccgcguccccgaggccgacucccagcucaccgagaagaugacccacgaggccuccaccgucaagucccuccucugccaccuccaggccaaccuccaguccaccggcgacugccucaaccagacccucgagcucaaguccaucaacggcgaggagugcuuccuccucggcuccuacgagaaguccguccagcucuggaagaaggcccuccaggagaucgaggagaagggcggccgccgcaccuacuuccuccagauccgcuacuaccucucccuccucuacugccaccucuacuccuacaaccucaacgacgcccagggccucugcgaccagcucgcccgcgagauccuccgcuggucccagcuccccgucaaggagaacaaggacuucuccggcgccgccaagucccacuucgagugcggcauggucggcggcguccaccccgaggccgccguccgcgucguccaguccauggcccgcuucauggccgccuacuucaccaaccagcagcucugcauccuccccccccaccacgucaacguccuccccccccuccacaucaagaccgagcaguccuuccgccucaucccccuccagcacuccaaggucgccuccgucguccgcgaccagaaccucuccaacgucuggaccgucgaguacgcccucgagcuccucuucaucggcggccucguccccgaggccgucuggcucgccuacaagcucggcgacuggaagaccuccgucuccaucggcgucgccuuccagcucuucugcaagcgcgacuccaacuucaugcgcuccaagaagaagucccucaaccucccccuccgcaugacccccgcccagaucuuccaggagaagcuccagugcguccucggccagcccgccucccucgaggccaagaacgagaugggcuccaaguacaagcaguucaccgaccccaucgaggaggaggacgccaaccuccucuucggcuccguccaggagguccucaaggccuccgucauggccgacgccgacauccucuccgagaccuuccagcuccucaucgacuccgccaaggacuucuccaagcgccucuggggccucguccccuucggccucuaccuccccgcccccccccucuacugcccccagcccgccauccucuccgaggaggacggcgacgaccuccuccucaaggccgagaagaacaaccgccagaaggucuccggcauccuccagcgcguccuccuccucuuccgcgccgcccagugcuccuuccccgucgcccagugguacauccuccagcuccgcugggcccgcaaggucaugcagaagauccgcaugaagggcucccuccccucccucucccccuucccccagucccuccucaacuacugcaagggcggcaucgccuucuuccgccccggcgccgccggcgaccacaagcucgacgaggucuccauccgcgccaucggcugcuuccgcgagcucugcgcccucugcuggaugcuccacguccgcgacaagcucuccuacuccugccgccaguaccagaaggcccgcgagaacgucaagggcgagaaggaccucgaggucgaguucgacuccugcaugaucgagcacugccucuccgccgucgagugggccuaccgcaugcuccccuucucccgcuucuucaacauggaggagcucauccaggacaucauccucucccucaucggcgagcucccccccauccgcaaggucgccgagaucuucgucaaggccuuccccuaccccgaggacguccgcgucccccuccgcgacaaguaccacucccuccaccagcgccuccgccacugcgucgucaagggcccccagaccgaggagaugauguccgucgucaugcacuccauccagaagguccgcgucaaggcccucaagcgcguccagcgcaacaucggcuccuucgaggucaacaucugggagcccaucgaggaggagaagcccgacgaggcccccggcgucgaccgcuacucccucggcaccucccucucccgcuccacccucaccgagcucggcgacuccgucguccacuccgacgccgacaccuucuccgaggcccucuccgucgaggagaagucccgcaucaacaucuaccagcgcaacgcccccaaccacauggagcucaccuccauccacaagcccaccgacaagcgcaagaugugcaaccagaaggagaaccccaccaagaaggaggaccacgagaagcucucccagaacacccuccccgucaucggcgucugggaguucgagcgcgacgacgacgaguacaucaaguuccucgaccucuuccucuccuacauccucgagcgcgaccuccccuacucccgcgacgccgacauccccuuccucaccuccuucuccggcaagcuccgcgagcacgagcucaacucccuccucuucgacguccacaccacccucaagcgccaccaguccaagaccaagucccagaacgucuuccgcgccggcuccugcuucgucgucgcccccgaguccuacgaguccgagaaguccuccucccucaacgacgaguacggcaugcaccucgagaaccagaagcucuccuccuccguccucgucaaccagggcaucaagcccuuccuccaguaccccuccaacgaggucaacaagaacgagggcauguccggccucuucggccucaagcagcgcuccaucuacaagauccaggacgacacccgcgagaagugccucauccagcgcuccuccaaccacaucuucuggacccccaaguccaucaagacccgccgcugcaucuucaaggccauccagugcaacgacaucaacccccaggaggaccucccccucgcccucaacaccuucggcuccaucggccgccuccucgaguggaugauccgcugguccaaccgccgccuccucugcgacuccggcaucaccgaguccuccuccgaguacucccccgucauccgcgucaagaccuccaccgccgccauccucaccucccucuggcuccucgagcagcccuacuucgccaccuacaaggccaagaacgccaucaucaagauggucgagaaccgcgacaccggcugccagaucggccccaacaucgagcgcgaguccaaguccgacgccggcggcuccgucgccgucgccacccccggcggcaccgaggagcgcaacggccagaacaaguccugccagaacauccucaaccgcaugcccaccgaggccaagaaccccgacaucaaggagaucaacgacgacaucaucuccaucacccacaacaccaagaaggaguucaucgacaucgacgagaaccuccucgaggucgaggccuucaccgaggaggagauggacaugcacaucuccgacuacgaggaggacaucgaggaguccgucggcggcuuccgcucccccucccucgccaucugcaugaugacccucccccagcagcucgaggaggaguucaccgaggagguccagugccagcgcgaggagccccucgagaccaucauggaggagaaguccaccgagcagaagggcaugaucgaggccuucucccaccccggccacaccaccccccaguccaugcaggucgacaccuccuccgagaucuccuccgcccagaucuccaccuacaaggagaaguccuccuccgucccccuccucaucuccaacggcgucaacgucgccucccagccccccgcccccaccccccagaagacccagcgcaacgaguucaccgcccagcuccccgacugcuccgaguccguccgccagaugcuccaggacgagauguucaagcucguccagcuccagcagaucaacuucaugucccucaugcagaucgucggcuccuccuucgccaaccuccccgacacccagcagcucguccagcagucccaguccguccaccucggcgagucccaggaguccaaccuccgcggcugcggcgacgucgaggacuccaacaagaaccucaaggagcgcuucuucaucaagccccaguccaugggcgagaacgcccgcgagccccgcaagaacuccccccacugccacgagggcaccauccccuccggccagaacuccaccggcaacguccagaacgucccccacggcuccaucccccucugccagcucaacggccagccccgcaagaagggccccauccccuccucccagaaccuccccuccaccuccuucuaccccgcccccgccggcaacacccaccucuaccuccucuccacccccuccgucguccagaaggccccccgccucaucccccacgccaagaccuucucccccggcgacggcuucccccuccuccaguucaaguccaagcaggaguuccagccccucuuccuccacaccggcuccaucccccagguccccuuccgcccccucccccagccccgcgaggccuggggccucuccgacuccuuccagcccgcccucccccagcgcgccgcccagaccacccccgccucccaccucaacgucucccaguacaacaccgaggcccgcaagaaggaggucgagcagaagaccugggccgagaccgucaucaccgagauccccaaccacgucaaccucgaccaguacgucggccaggagaaccucaccccccagcaggacuccuccgucuucaucaagcccgagaagcucuucgacgucaagcccggcacccucgagaucuccccccaccacuccuucggccucccccuccucuaccucccccucaagccccccaacauguuccccuccaccucccgcgccuccaucaccguccccuccacccccauccagcccaucgccgaggagcgcaaguacccccgccucucccuccuccacucccaccucucccccgagaaccgcugcaagaagacccagcucaucccccucgagaaccucaucgccuucaagcagucccagcagaagcucacccacaaccucuucgagcagggcgacgccggccaccuccagcuccucaaggucaagaucgagccccccgagguccgccagggcaaggacuccaagaagcgccagcgccgccgcgccgagaaggagcuccaggagaagcgcugcgagaagcuccgccgcaagcccaacgucaccuuccgccccgagaacuccaucaucaacaacgacgacuccgagaucaucaagaagcccaaggagcagcaggagcacugcggcucccacccccucgacgacuucgacguccccuucgagaugcuccaggacgacaacaccuccgccggccuccacuucauggccuccgucaagaagaaggccaucggcucccaggacgccuccaccaacaccgaccccgagcacgagccccucaccgccccccagcuccucguccccgacgucuaccucaaccucaagcucuccuccgagauguccgagaagcccuggucccccuccaucccccacaccgucaccaaccucgagcuccccguccgcgaggagcccuccaacgacaacgucaucaagcagcaguccgaccaccucgccguccccuccuccgccgagcuccacuacauggccgccuccgucaccaacgccguccccccccacaacuucaagucccagggccuccccaagcccgaguuccgcuucaagggccaguccaccaaguccgacuccgccgaggacuaccuccucuggaagcgccuccagggcgucuccgccgccugccccgcccccuccuccgccgcccaccagcucgagcaccucuccgccaagcuccagaagaucgacgagcagcuccucgccauccagaacaucgccgagaacaucgagcaggacuuccccaagcccgagaugcucgaccuccacugcgacaagaucggccccgucgaccacaucgaguucuccuccggccccgaguucaagaagacccucgccuccaagaccaucuccaucuccgaggagguccgcuuccucacccacauggacgaggaggaccaguccgacaagaaggagaccuccgagcccgaguucuccaucaccgagaacuacuccggccagaagaccugcgucuuccccaccgccgacuccgccgucucccucuccuccuccuccgaccagaacaccaccucccccggcaugaacuccuccgacgagcucugcgaguccgucuccguccacccccuccagaugaccggccucaccgacaucgccgacaucaucgacgaccucaucaucaaggacggcgucuccuccgaggagcucggccucaccgagcaggccaugggcaccucccgcauccagcacuacuccggccgccacucccagcgcaccgacaaggagcgccgcgagauccaggccuggaugaagcgcaagcgcaaggagcgcauggccaaguaccucaacgagcucgccgagaagcgcggccaggagcacgaccccuucugcccccgcuccaacccccucuacaugaccucccgcgagauccgccuccgccagaagaugaagcacgagaaggaccgccuccuccucuccgagcacuacucccgccgcaucucccaggccuacggccucaugaacgagcuccucuccgaguccguccagcuccccacccucccccagaagccccuccccaacaagcccucccccacccaguccuccuccugccagcacugccccuccccccgcggcgagaaccagcacggccacuccuuccucaucaaccgccccggcaaggucaaguacauguccaagcccuccuacauccacaagcgcaaguccuucggccagccccagggcucccccuggccccacggcaccgccaccuucaccauccagaagaaggccggcggcgccaaggccgccguccgcaaggccacccagucccccgucaccuuccagaagggcuccaacgcccccugccacucccuccagcacaccaagaagcacggcuccgccggccucgccccccagaccaagcaggucugcgucgaguacgagcgcgaggagaccgucgucucccccuggaccauccccuccgagauccacaagauccuccacgagucccacaacucccuccuccaggaccucucccccaccgaggaggaggagcccgagcaccccuucggcgucggcggcgucgacuccgucuccgaguccaccggcuccauccucuccaagcucgacuggaacgccaucgaggacauggucgccuccgucgaggaccagggccucuccguccacugggcccucgaccucuga

SEQ ID NO: 40607 - RNA, 348 nt, Artificial Sequence
  derived and/or modified sequence opt2 from C5orf63__Homo_sapiens__NP_001157950
augcucugguuccagggcaacuccaugcagcucgcccgcuccuccuucggccucuuccuccgcaacugcuccgccuccaagaccacccuccccguccucacccucuucaccaaggaccccugcccccucugcgacgaggccaaggagguccucaagcccuacgagaaccgcuucauccuccaggaggucaacaucacccuccccgagaacuccgucugguacgagcgcuacaaguucgacauccccgucuuccaccucaacggccaguuccucaugaugcaccgcgucaacaccuccaagcucgagaagcagcuccucaagcucgagcagcaguccaccggcggcuga

SEQ ID NO: 40608 - RNA, 2805 nt, Artificial Sequence
  derived and/or modified sequence opt2 from C6__Homo_sapiens__NP_000056
auggcccgccgcuccguccucuacuucauccuccucaacgcccucaucaacaagggccaggccugcuucugcgaccacuacgccuggacccaguggaccuccugcuccaagaccugcaacuccggcacccagucccgccaccgccagaucgucgucgacaaguacuaccaggagaacuucugcgagcagaucugcuccaagcaggagacccgcgagugcaacuggcagcgcugccccaucaacugccuccucggcgacuucggccccugguccgacugcgaccccugcaucgagaagcaguccaagguccgcuccguccuccgccccucccaguucggcggccagcccugcaccgccccccucgucgccuuccagcccugcauccccuccaagcucugcaagaucgaggaggccgacugcaagaacaaguuccgcugcgacuccggccgcugcaucgcccgcaagcucgagugcaacggcgagaacgacugcggcgacaacuccgacgagcgcgacugcggccgcaccaaggccgucugcacccgcaaguacaaccccauccccuccguccagcucaugggcaacggcuuccacuuccucgccggcgagccccgcggcgagguccucgacaacuccuucaccggcggcaucugcaagaccgucaaguccucccgcaccuccaaccccuaccgcguccccgccaaccucgagaacgucggcuucgagguccagaccgccgaggacgaccucaagaccgacuucuacaaggaccucaccucccucggccacaacgagaaccagcagggcuccuucuccucccagggcggcuccuccuucuccguccccaucuucuacuccuccaagcgcuccgagaacaucaaccacaacuccgccuucaagcaggccauccaggccucccacaagaaggacuccuccuucauccgcauccacaaggucaugaagguccucaacuucaccaccaaggccaaggaccuccaccucuccgacgucuuccucaaggcccucaaccaccucccccucgaguacaacuccgcccucuacucccgcaucuucgacgacuucggcacccacuacuucaccuccggcucccucggcggcgucuacgaccuccucuaccaguucuccuccgaggagcucaagaacuccggccucaccgaggaggaggccaagcacugcguccgcaucgagaccaagaagcgcguccucuucgccaagaagaccaaggucgagcaccgcugcaccaccaacaagcucuccgagaagcacgagggcuccuucauccagggcgccgagaaguccaucucccucauccgcggcggccgcuccgaguacggcgccgcccucgccugggagaagggcuccuccggccucgaggagaagaccuucuccgaguggcucgaguccgucaaggagaaccccgccgucaucgacuucgagcucgcccccaucgucgaccucguccgcaacauccccugcgccgucaccaagcgcaacaaccuccgcaaggcccuccaggaguacgccgccaaguucgaccccugccagugcgcccccugccccaacaacggccgccccacccucuccggcaccgagugccucugcgucugccaguccggcaccuacggcgagaacugcgagaagcagucccccgacuacaaguccaacgccgucgacggccaguggggcugcugguccuccugguccaccugcgacgccaccuacaagcgcucccgcacccgcgagugcaacaaccccgccccccagcgcggcggcaagcgcugcgagggcgagaagcgccaggaggaggacugcaccuucuccaucauggagaacaacggccagcccugcaucaacgacgacgaggagaugaaggaggucgaccuccccgagaucgaggccgacuccggcugcccccagcccgucccccccgagaacggcuucauccgcaacgagaagcagcucuaccucgucggcgaggacgucgagaucuccugccucaccggcuucgagaccgucggcuaccaguacuuccgcugccuccccgacggcaccuggcgccagggcgacgucgagugccagcgcaccgagugcaucaagcccgucguccaggagguccucaccaucacccccuuccagcgccucuaccgcaucggcgaguccaucgagcucaccugccccaagggcuucgucgucgccggccccucccgcuacaccugccagggcaacuccuggaccccccccaucuccaacucccucaccugcgagaaggacacccucaccaagcucaagggccacugccagcucggccagaagcaguccggcuccgagugcaucugcaugucccccgaggaggacugcucccaccacuccgaggaccucugcgucuucgacaccgacuccaacgacuacuucaccucccccgccugcaaguuccucgccgagaagugccucaacaaccagcagcuccacuuccuccacaucggcuccugccaggacggccgccagcucgaguggggccucgagcgcacccgccucuccuccaacuccaccaagaaggaguccugcggcuacgacaccugcuacgacugggagaagugcuccgccuccaccuccaagugcgucugccuccuccccccccagugcuucaagggcggcaaccagcucuacugcgucaagaugggcuccuccaccuccgagaagacccucaacaucugcgaggucggcaccauccgcugcgccaaccgcaagauggagauccuccaccccggcaagugccucgccuga

SEQ ID NO: 40609 - RNA, 699 nt, Artificial Sequence
  derived and/or modified sequence opt2 from C6orf106__Homo_sapiens__NP_073595
auggagggcauggacgucgaccucgaccccgagcucaugcagaaguucuccugccucggcaccaccgacaaggacguccucaucuccgaguuccagcgccuccucggcuuccagcucaaccccgccggcugcgccuucuuccucgacaugaccaacuggaaccuccaggccgccaucggcgccuacuacgacuucgagucccccaacaucuccguccccuccauguccuucgucgaggacgucaccaucggcgagggcgaguccaucccccccgacacccaguucgucaagaccuggcgcauccagaacuccgacgucaucugggucauccucuccgucgaggucggcggccuccucggcgucacccagcagcucuccuccuucgagaccgaguucaacacccagccccaccgcaaggucgagggcaacuucaaccccuucgccuccccccagaagaaccgccaguccgacgagaacaaccucaaggaccccggcggcuccgaguucgacuccaucuccaagaacaccugggcccccgcccccgacaccugggcccccgcccccgaccagaccgagcaggaccagaaccgccucucccagaacuccgucaaccucucccccuccucccacgccaacaaccucuccgucgucaccuacuccaagggccuccacggccccuaccccuucggccaguccuga

SEQ ID NO: 40610 - RNA, 1692 nt, Artificial Sequence
  derived and/or modified sequence opt2 from C6orf10__Homo_sapiens__XP_011512542
augaccguccucgagaucacccucgccgucauccucacccuccucggccucgccauccucgccauccuccucacccgcugggcccgcugcaagcaguccgagauguacaucucccgcuacuccuccgagcaguccgcccgccuccucgacuacgaggacggccgcggcucccgccacgccuacuccacccaguccgacaccuccuacgacaaccgcgagcgcuccaagcgcgacuacacccccuccaccaacucccucgucuccauggccuccaaguucucccucggccagaccgagcucauccuccuccucaugugcuucauccucgcccucucccgcuccuccaucggcuccaucaagugccuccagaccaccgaggagccccccucccgcaccgccggcgccaugaugcaguucaccgcccccauccccggcgccaccggccccaucaagcucucccagaagaccaucguccagacccccggccccaucguccaguaccccggcuccaacgccggcccccccuccgccccccgcggcccccccauggcccccaucaucaucucccagcgcaccgcccgcaucccccagguccacaccauggacuccuccggcaagaucacccucacccccgucgucauccucaccggcuacauggacgaggagcucgccaagaaguccugcuccaagauccagauccucaagugcggcggcaccgcccgcucccagaacucccgcgaggagaacaaggaggcccucaagaacgacaucaucuucaccaacuccgucgagucccucaaguccgcccacaucaaggagcccgagcgcgagggcaagggcaccgaccucgagaaggacaagaucggcauggaggucaaggucgacuccgacgccggcauccccaagcgccaggagacccagcucaagaucuccgagauguccaucccccagggccagggcgcccagaucaagaaguccgucuccgacgucccccgcggccaggagucccaggucaagaaguccgaguccggcguccccaagggccaggaggcccaggucaccaaguccggccucgucguccucaagggccaggaggcccaggucgagaaguccgagaugggcgucccccgccgccaggagucccaggucaagaagucccaguccggcgucuccaagggccaggaggcccaggucaagaagcgcgaguccgucguccucaagggccaggaggcccaggucgagaaguccgagcucaagguccccaagggccaggagggccaggucgagaagaccgaggccgacguccccaaggagcaggagguccaggagaagaaguccgaggccggcguccucaagggccccgagucccaggucaagaacaccgaggucuccguccccgagacccucgagucccaggucaagaaguccgaguccggcguccucaagggccaggaggcccaggagaagaaggaguccuucgaggacaagggcaacaacgacaaggagaaggagcgcgacgccgagaaggaccccaacaagaaggagaagggcgacaagaacaccaagggcgacaagggcaaggacaaggucaagggcaagcgcgaguccgagaucaacggcgagaaguccaagggcuccaagcgcgccaaggccaacaccggccgcaaguacaacaagaaggucgaggaguga

SEQ ID NO: 40611 - RNA, 978 nt, Artificial Sequence
  derived and/or modified sequence opt2 from C6orf15__Homo_sapiens__NP_054789
augcagggccgcgucgccggcuccugcgccccccucggccuccuccucgucugccuccaccuccccggccucuucgcccgcuccaucggcgucgucgaggagaaggucucccagaaccucggcaccaaccucccccagcucggccagcccuccuccaccggccccuccaacuccgagcacccccagcccgcccucgacccccgcuccaacgaccucgcccgcgucccccucaagcucuccguccccgccuccgacggcuucccccccgccggcggcuccgccguccagcgcuggccccccuccuggggccuccccgccauggacuccuggccccccgaggaccccuggcagaugauggccgccgccgccgaggaccgccucggcgaggcccuccccgaggagcucuccuaccucuccuccgccgccgcccucgcccccggcuccggcccccuccccggcgaguccucccccgacgccaccggccucucccccaaggccucccuccuccaccaggacuccgagucccgccgccucccccgcuccaacucccucggcgccggcggcaagauccucucccagcgcccccccuggucccucauccaccgcguccuccccgaccaccccuggggcacccucaaccccuccgucuccuggggcggcggcggccccggcaccggcuggggcacccgccccaugccccaccccgagggcaucuggggcaucaacaaccagccccccggcaccuccuggggcaacaucaaccgcuaccccggcggcuccuggggcaacaucaaccgcuaccccggcggcuccuggggcaacaucaaccgcuaccccggcggcuccuggggcaacauccaccucuaccccggcaucaacaaccccuucccccccggcguccuccgcccccccggcuccuccuggaacauccccgccggcuuccccaacccccccuccccccgccuccaguggggcuga

SEQ ID NO: 40612 - RNA, 714 nt, Artificial Sequence
  derived and/or modified sequence opt2 from C6orf25__Homo_sapiens__NP_079536
auggccgucuuccuccagcuccucccccuccuccucucccgcgcccagggcaaccccggcgccucccucgacggccgccccggcgaccgcgucaaccucuccugcggcggcgucucccaccccauccgcugggucugggcccccuccuuccccgccugcaagggccucuccaagggccgccgccccauccucugggccuccuccuccggcacccccaccguccccccccuccagcccuucgucggccgccuccgcucccucgacuccggcauccgccgccucgagcuccuccucuccgccggcgacuccggcaccuucuucugcaagggccgccacgaggacgagucccgcaccguccuccacguccucggcgaccgcaccuacugcaaggcccccggccccacccacggcuccgucuacccccagcuccucaucccccuccucggcgccggccucguccucggccucggcgcccucggccucgucugguggcuccaccgccgccuccccccccagcccauccgcccccucccccgcuucgcccucucccccccccacuccuccaccugcgagaaccgcgcccccgaggccuccaagggcggccgcgcccaggacucccgcggccccggccccggcaccgagcccgcccucugcggcuccggccccuccuccccccagcaggccccccccgccguccacuccggccccugcuga

SEQ ID NO: 40613 - RNA, 885 nt, Artificial Sequence
  derived and/or modified sequence opt2 from C6orf47__Homo_sapiens__NP_067007
auguuccuccgccgccucggcggcuggcucccccgccccuggggccgccgcaagcccaugcgccccgacccccccuaccccgagccccgccgcgucgacuccuccuccgagaacuccggcuccgacugggacuccgcccccgagaccauggaggacgucggccaccccaagaccaaggacuccggcgcccuccgcgucuccggcgccgccuccgagcccuccaaggaggagccccaggucgagcagcucggcuccaagcgcauggacucccucaagugggaccagcccaucuccuccacccaggaguccggccgccucgaggccggcggcgccucccccaagcuccgcugggaccacgucgacuccggcggcacccgccgccccggcgucucccccgagggcggccucuccguccccggccccggcgccccccucgagaagcccggccgccgcgagaagcuccucggcuggcuccgcggcgagcccggcgcccccucccgcuaccucggcggccccgaggagugccuccagaucuccaccaaccucacccuccaccuccucgagcuccucgccuccgcccuccucgcccucugcucccgcccccuccgcgccgcccucgacacccucggccuccgcggcccccucggccucuggcuccacggccuccucuccuuccucgccgcccuccacggccuccacgccguccucucccuccucaccgcccacccccuccacuucgccugccucuucggccuccuccaggcccucguccucgccgucucccuccgcgagcccaacggcgacgaggccgccaccgacugggaguccgagggccucgagcgcgagggcgaggagcagcgcggcgaccccggcaagggccucuga

SEQ ID NO: 40614 - RNA, 228 nt, Artificial Sequence
  derived and/or modified sequence opt2 from C6orf48__Homo_sapiens__NP_001274413
auggagcgcuccuucgucuggcucuccugccucgacuccgacuccugcaaccucaccuuccgccucggcgaggucgagucccacgccugcucccccucccuccucuggaaccuccucacccaguaccucccccccggcgccggccacauccuccgcaccuacaacuuccccguccucuccugcgucuccuccugccaccucaucggcggcaagaugcccgagaacuga

SEQ ID NO: 40615 - RNA, 1044 nt, Artificial Sequence
  derived and/or modified sequence opt2 from C6orf89__Homo_sapiens__NP_001273564
auggaccucgccgccaacgagaucuccaucuacgacaagcucuccgagaccgucgaccucguccgccagaccggccaccagugcggcauguccgagaaggccaucgagaaguucauccgccagcuccucgagaagaacgagccccagcgcccccccccccaguacccccuccucaucgucgucuacaagguccucgccacccucggccucauccuccucaccgccuacuucgucauccagcccuucuccccccucgcccccgagcccguccucuccggcgcccacaccuggcgcucccucauccaccacauccgccucaugucccuccccaucgccaagaaguacauguccgagaacaagggcgucccccuccacggcggcgacgaggaccgccccuuccccgacuucgaccccugguggaccaacgacugcgagcagaacgaguccgagcccauccccgccaacugcaccggcugcgcccagaagcaccucaaggucaugcuccucgaggacgccccccgcaaguucgagcgccuccacccccucgucaucaagaccggcaagccccuccucgaggaggagauccagcacuuccucugccaguaccccgaggccaccgagggcuucuccgagggcuucuucgccaagugguggcgcugcuuccccgagcgcugguuccccuuccccuaccccuggcgccgcccccucaaccgcucccagaugcuccgcgagcucuuccccgucuucacccaccuccccuuccccaaggacgccucccucaacaagugcuccuuccuccaccccgagcccgucgucggcuccaagaugcacaagaugcccgaccucuucaucaucggcuccggcgaggccaugcuccagcucaucccccccuuccagugccgccgccacugccaguccgucgccaugcccaucgagcccggcgacaucggcuacgucgacaccacccacuggaaggucuacgucaucgcccgcggcguccagccccucgucaucugcgacggcaccgccuucuccgagcucuga

SEQ ID NO: 40616 - RNA, 2532 nt, Artificial Sequence
  derived and/or modified sequence opt2 from C7__Homo_sapiens__NP_000578
augaaggucaucucccucuucauccucgucggcuucaucggcgaguuccaguccuucuccuccgccuccucccccgucaacugccagugggacuucuacgcccccugguccgagugcaacggcugcaccaagacccagacccgccgccgcuccgucgccgucuacggccaguacggcggccagcccugcgucggcaacgccuucgagacccaguccugcgagcccacccgcggcugccccaccgaggagggcugcggcgagcgcuuccgcugcuucuccggccagugcaucuccaagucccucgucugcaacggcgacuccgacugcgacgaggacuccgccgacgaggaccgcugcgaggacuccgagcgccgccccuccugcgacaucgacaagcccccccccaacaucgagcucaccggcaacggcuacaacgagcucaccggccaguuccgcaaccgcgucaucaacaccaaguccuucggcggccagugccgcaaggucuucuccggcgacggcaaggacuucuaccgccucuccggcaacguccucuccuacaccuuccaggucaagaucaacaacgacuucaacuacgaguucuacaacuccaccugguccuacgucaagcacaccuccaccgagcacaccuccuccucccgcaagcgcuccuucuuccgcuccuccuccuccuccucccgcuccuacaccucccacaccaacgagauccacaagggcaaguccuaccagcuccucgucgucgagaacaccgucgaggucgcccaguucaucaacaacaaccccgaguuccuccagcucgccgagcccuucuggaaggagcucucccaccuccccucccucuacgacuacuccgccuaccgccgccucaucgaccaguacggcacccacuaccuccaguccggcucccucggcggcgaguaccgcguccucuucuacgucgacuccgagaagcucaagcagaacgacuucaacuccgucgaggagaagaagugcaaguccuccggcuggcacuucgucgucaaguucuccucccacggcugcaaggagcucgagaacgcccucaaggccgccuccggcacccagaacaacguccuccgcggcgagcccuucauccgcggcggcggcgccggcuucaucuccggccucuccuaccucgagcucgacaaccccgccggcaacaagcgccgcuacuccgccugggccgaguccgucaccaaccucccccaggucaucaagcagaagcucaccccccucuacgagcucgucaaggagguccccugcgccuccgucaagaagcucuaccucaagugggcccucgaggaguaccucgacgaguucgaccccugccacugccgccccugccagaacggcggccucgccaccgucgagggcacccacugccucugccacugcaagcccuacaccuucggcgccgccugcgagcagggcguccucgucggcaaccaggccggcggcgucgacggcggcugguccugcugguccuccuggucccccugcguccagggcaagaagacccgcucccgcgagugcaacaaccccccccccuccggcggcggccgcuccugcgucggcgagaccaccgaguccacccagugcgaggacgaggagcucgagcaccuccgccuccucgagccccacugcuucccccucucccucguccccaccgaguucugccccuccccccccgcccucaaggacggcuucguccaggacgagggcaccauguuccccgucggcaagaacgucgucuacaccugcaacgagggcuacucccucaucggcaaccccgucgcccgcugcggcgaggaccuccgcuggcucgucggcgagaugcacugccagaagaucgccugcguccuccccguccucauggacggcauccagucccacccccagaagcccuucuacaccgucggcgagaaggucaccgucuccugcuccggcggcaugucccucgagggccccuccgccuuccucugcggcuccucccucaaguggucccccgagaugaagaacgcccgcugcguccagaaggagaacccccucacccaggccguccccaagugccagcgcugggagaagcuccagaacucccgcugcgucugcaagaugcccuacgagugcggccccucccucgacgucugcgcccaggacgagcgcuccaagcgcauccucccccucaccgucugcaagaugcacguccuccacugccagggccgcaacuacacccucaccggccgcgacuccugcacccuccccgccuccgccgagaaggccugcggcgccugcccccucuggggcaagugcgacgccgaguccuccaagugcgucugccgcgaggccuccgagugcgaggaggagggcuucuccaucugcgucgaggucaacggcaaggagcagaccauguccgagugcgaggccggcgcccuccgcugccgcggccaguccaucuccgucaccuccauccgccccugcgccgccgagacccaguga

SEQ ID NO: 40617 - RNA, 309 nt, Artificial Sequence
  derived and/or modified sequence opt2 from C7orf49__Homo_sapiens__NP_001230683
augaacgaggccgagaucgucgacgucgcccucggcauccucaucgagucccgcaagcaggagaaggccugcgagcagcccgcccucgccggcgccgacaaccccgagcacuccccccccugcuccgucuccccccacaccuccuccggcuccuccuccgaggaggaggacuccggcaagcaggcccucgcccccggccucucccccucccagcgccccggcggcuccuccuccgccugcucccgcucccccgaggaggaggaggaggaggacguccucaaguacguccgcgagaucuucuucuccuga

SEQ ID NO: 40618 - RNA, 462 nt, Artificial Sequence
  derived and/or modified sequence opt2 from C7orf57__Homo_sapiens__NP_001254795
augcccgacuacaugguccacgaggaguucaaccccgaccaggccaacggcuccuacgccucccgccgcggccccuucgacuucgacaugaagaccgucuggcagcgcgaggccgaggagcucgagaaggagaagaagaagcuccgccuccccgccaucgacuccaaguaccucuccaaggccggcaccccccucggccccaagaaccccgccggcucccgccucuccuucccccccgucaacggcuacaaggacgaguggcuccagcagcagcagcgcgccgacuccgacaagcgcacccccaagaccucccgcgccuccguccucucccaguccccccgcgaccucgagggcccccaggacgccgcccgccuccaggacgccgaggccuccgagggccccgaggacacccccggccccgaggaguccgucuccgccuccacccccgccgagcucaaguga

SEQ ID NO: 40619 - RNA, 1218 nt, Artificial Sequence
  derived and/or modified sequence opt2 from C7orf60__Homo_sapiens__NP_689769
auggagcccggcgccggcggccgcaacaccgcccgcgcccagcgcgccggcucccccaacaccccccccccccgcgagcaggagcgcaagcucgagcaggagaagcucuccggcgucgucaaguccguccaccgccgccuccgcaagaaguaccgcgaggucggcgacuucgacaagaucuggcgcgagcacugcgaggacgaggagacccucugcgaguacgccgucgccaugaagaaccucgccgacaaccacugggccaagaccugcgagggcgagggccgcaucgaguggugcugcuccgucugccgcgaguacuuccagaacggcggcaagcgcaaggcccucgagaaggacgagaagcgcgccguccucgccaccaagaccacccccgcccucaacaugcacgaguccucccagcucgagggccaccucaccaaccucuccuucaccaaccccgaguucaucaccgagcuccuccaggccuccggcaagauccgccuccucgacgucggcuccugcuucaaccccuuccucaaguucgaggaguuccucaccgucggcaucgacaucguccccgccgucgaguccgucuacaagugcgacuuccucaaccuccagcuccagcagccccuccagcucgcccaggacgccaucgacgccuuccucaagcagcucaagaaccccaucgacucccuccccggcgagcucuuccacgucgucgucuucucccuccuccucuccuacuuccccucccccuaccagcgcuggaucugcugcaagaaggcccacgagcuccucguccucaacggccuccuccucaucaucacccccgacuccucccaccagaaccgccacgccaugaugaugaaguccuggaagaucgccaucgagucccucggcuucaagcgcuucaaguacuccaaguucucccacaugcaccucauggccuuccgcaagaucucccucaagaccaccuccgaccucgucucccgcaacuaccccggcaugcucuacaucccccaggacuucaacuccaucgaggacgaggaguacuccaaccccuccugcuacguccgcuccgacaucgaggacgagcagcucgccuacggcuucaccgagcuccccgacgcccccuacgacuccgacuccggcgagucccaggccuccuccauccccuucuacgagcucgaggaccccauccuccuccucuccuga

SEQ ID NO: 40620 - RNA, 762 nt, Artificial Sequence
  derived and/or modified sequence opt2 from C7orf62__Homo_sapiens__XP_011514206
auguccuucuccguccacaaccagaagggcuccaagcgcccccucccccucgagccccuccucuuccuccaggucccccgcuccaacuaccuccacuuccaggaggagaagcagcgccuccaccucaagaaguuccuccucgaccgcauguuccucgucgccaagauccaggccaacgucgagcgcaaggacgucgccgacuacuacgagcagauguuccaguccguccucaagcaccaccucggcgaggccgucaccggccuccuccucaucuaccccaccuccauccuccacauccucgaguccuccuccgacacccucuacaagguccuccucgacuacaucggccacgucaaggacgagaccgucuucuucauccagcagaugaagaucaucgucaucucccacaacauccccaugcgccucuucaugcaguggcacgucuccgucaucaagguccccgucauguaccucgacgacgucacccagucccagucccucaaggaggucaucaccgacuuccucacccagacccacaagcucucccucuaccucugccagaccaugaaggucggcaccaagggccccggcgacaaccuccaccaggucgcccccgaccuccuccuccccgagcagaucaucaaguaccucugcaaguccgaggaguucauggaccccgccaccuucaucaacauguacaaccgccccauccacaucacccucgacuccgaggucgucuggcccgcccccucccgcuucuga

SEQ ID NO: 40621 - RNA, 456 nt, Artificial Sequence
  derived and/or modified sequence opt2 from C7orf65__Homo_sapiens__NP_001116537
augcgcauggcccccaccgaguccaccgagggccgccgccucuggcccggcccccgcgagggcggcuccggcaaggagaccaccuccgagaagcucuccaaccucccccgcccccacuccuacucccccaagcgcgccgacgccgaguccuuccgcggcguccccgccgccuucaagaagugccgcgaggucuuccgcgccugcuggggcucccgcgagcuccucuuccucuucaaggccaucuccgaggccggccccgcccagaacuccugcggcaucacccucgagaaggccggcggccucgaggacaccggcucccacuggcucuccugggcccgcugcaagguccucuacaucaacggcuucaccgaccccuggaaggacgcccaggccuggauccucaucgucuccugcaagaagggcaagggcacccccgagcgcgagggccgcaacuga

SEQ ID NO: 40622 - RNA, 369 nt, Artificial Sequence
  derived and/or modified sequence opt2 from C7orf69__Homo_sapiens__NP_079307
augggcuuccacuucugcaucuggaucaucuuccuccuccccccccccugcaagaagugccucuccccccccaccaugaaccuccgcccccccaaguccugcggcaacgucuucuacuggguccucguccucaacuccggccuccucuacaaguucugccagaccaucaagugccgcgccaacuggcgccccgcccgcgccccccgcggcuggaacgaggccaccgagcgccaccaggagcgccgcacccagauggagaccgagaugggcggcaucuccaccaccuacuggcaccgccucugcaccugcaccgaccgccgcgccgagaagcucgucauggacggcaacaacugcugguuccacaaguga

SEQ ID NO: 40623 - RNA, 1317 nt, Artificial Sequence
  derived and/or modified sequence opt2 from C7orf72__Homo_sapiens__NP_001155306
auggacgucgagauccaggacacccccggcaagaucuccaucuccaagcgcuccauccucuccggcaccgucgagaacaucgacuacccccacuacugcgaccuccuccgcaagaugaacaugcccuucgucaagggccucgagaaccgccacaacuacggccgcuucgagaagaagugcaaccccgccuuccucaaguuccaccccuacccccccuccguccuccccgacuaccaccuccacgaccccuaccccccccccuacggcccccacuacccccucuucccccuccgcgacgacgucacccucggcgacuccugcuccggcuucaugucccccggcggcgacgccgaccucaaccccggcaucggccgcaccauccccacccucgucgacuucuccgacgucaagccccagcaccgcgucccccgccccgacaccggcuuccagaccaccaucaagcgccagaagauccucuccgaggagcuccagcagaaccgccgcuggaacucccgcgagguccccgacaucuccauccgcgcccgccucggcggcuggaccuccccccucaaggucaccccccuccagccccaccacgagggccgcucccucucccacaucuucaccuucgacgaggaggccaccugcaccgacgagggcgagccccucguccagaccaacaagaagugcaacgccaaggacuccuucuacaaguccuccacccagaaggccuacgaggacguccccugggacaagaugcucccccccaagcucguccccgaggagaccacccucgagaaggccgccgaccccaucucccagugcuucacccucaagcgcuacaagggcguccccgccaucacccagauggucggcgagcucugggaccgcuuccagacccgcuccuuccucgcccccgucaagcccaucaacuucgucuccuccuccucccgcuccaaguacaucccccucuacaccggccacguccaguccaccaacgccgacgacgucgacaacccccucggcgacaucgccucccucgccaagcagcgcuacuccaagccccucuacaccaacaccucccgcgccgccaacauccccggcuacaccggcaagguccacuucaccgccacccaccccgccaacuccaacauccccuccaccacccccucccccgacuccgagcuccaccgcgucuuccagaaggagauggccgucgaccucuuccgccaccaggccccccucucccgccucgucaccaccguccgccccuacaaccccuucaacaagaaggacaaggagaccaucgacuacuga

SEQ ID NO: 40624 - RNA, 1122 nt, Artificial Sequence
  derived and/or modified sequence opt2 from C8orf34__Homo_sapiens__NP_001182568
auguccuccccccucgccuccgagcucuccgagcucgccgcccuccgccccggcuuccgccucuccgccccccacgcccgcgucgccccccgcgccgccacccacgcccgcggccgcggccgcgccucccacgccggccagccccgccuccgcuccuccugccccggccccucccccggcaagcgccgcgucguccccuccggcggcgcccagccccgcguccuccccgcccucuccucccgcucccaccucuuccccauggccucccacccccagacccgcauccaggccuaccucgagaagaacaagaucggcccccucuucgaggagcucaugaccaagcucaucaccgagacccccgaccagcccauccccuuccucaucgaccaccuccaguccaagcagggcaaccgcggccagcuccagcgcacccucuccggcuccgccgcccucugggccgaguccgagaaguccgaguccaagggcacccgccgcgacuuccgcuccuacgacaagcccuggcagcucaacgccaagaagcccaagaaguccaaguccgaccucgccgucuccaacaucuccccccccucccccgacuccaagucccucccccgcuccgucgagcaccccaaguggaacuggcgcaccaagccccagucccgcgacuucgacgagcucaaccacauccuccaggaguccaagaagcucggcaaggcccucgagaaccucucccgcuccaucgccaucuccgacgagcucgacaaggagaccgucaccuucaacuccucccuccuccgcccccgcgucaucggcgaguggaucggccgcgaggagaacgacgccgacccccucgccgccgagaugcuccagccccccaucccccgcuccaagaacgaccagugggaguccgaggacuccggcuccucccccgccggcucccucaagauggagcccaagaacaagggccucaagcagcagcagcagcagcacaagaagcuccucgccgccaugcucucccaggacuccuucgaguccauccacucccccacccccuccgucaccgaggaggacaucgacaacgaggacgacgccauggagcuccucggcaacuucaagaacuga

SEQ ID NO: 40625 - RNA, 624 nt, Artificial Sequence
  derived and/or modified sequence opt2 from C8orf37__Homo_sapiens__NP_808880
auggccgaggaccucgacgagcuccucgacgaggucgaguccaaguucugcacccccgaccuccuccgccgcggcauggucgagcagcccaagggcugcggcggcggcacccacuccuccgaccgcaaccaggccaaggccaaggagacccuccgcuccaccgagaccuucaagaaggaggacgaccucgacucccucaucaacgagauccucgaggagcccaaccucgacaagaagcccuccaagcucaaguccaaguccuccggcaacaccuccguccgcgccuccaucgagggccucggcaaguccugcucccccgucuaccucggcggcuccuccauccccugcggcaucggcaccaacaucuccuggcgcgccugcgaccaccuccgcugcaucgccugcgacuuccucgucgucuccuacgacgacuacaugugggacaaguccugcgacuaccucuucuuccgcaacaacaugcccgaguuccacaagcucaaggccaagcucaucaagaagaagggcacccgcgccuacgccugccagugcuccuggcgcaccaucgaggaggucaccgaccuccagaccgaccaccagcuccgcugggucugcggcaagcacuga

SEQ ID NO: 40626 - RNA, 624 nt, Artificial Sequence
  derived and/or modified sequence opt2 from C8orf46__Homo_sapiens__NP_689978
augaugcaccagaucuacuccugcuccgacgagaacaucgaggucuucaccaccgucauccccuccaaggucuccucccccgcccgccgccgcgccaaguccucccagcaccuccucaccaagaacgucgucaucgaguccgaccucuacacccaccagccccucgagcuccucccccaccgcggcgaccgccgcgaccccggcgaccgccgccgcuucggccgccuccagaccgcccgcccccccaccgcccaccccgccaaggccuccgcccgccccgucggcaucuccgagcccaagaccuccaaccucugcggcaaccgcgccuacggcaagucccucaucccccccgucccccgcaucuccgucaagaccuccgccuccgccucccucgaggccaccgccaugggcaccgagaagggcgccguccucaugcgcggcucccgccaccucaagaagaugaccgaggaguaccccgcccucccccagggcgccgaggccucccucccccucaccggcuccgccuccugcggcguccccggcauccuccgcaagauguggacccgccacaagaagaaguccgaguacgucggcgccaccaacuccgccuucgaggccgacuga

SEQ ID NO: 40627 - RNA, 960 nt, Artificial Sequence
  derived and/or modified sequence opt2 from C8orf48__Homo_sapiens__NP_001007091
auggccaucugccccgagcucgcccagaccgacaaguccgcccucgccaaccucuccgacgagaccgagacccucaagaacuucaccgacgagguccagaccuccuccuccuucuccuccuccggcggccgccaguccuccccccucaccuccggcuccaagcucgagcgcgagaagcagacccccucccucgagcagggcgacacccaguccgagcuccucgacuacaagaacuacgagaagaagcucuccaagaaguggaucaacuaccucaagcucaaggacuccaacuucgagcgccaccagcccgacaccaagcuccccaccgagaucacccgcgucuccgacgaggagcucaacgcccuccaguccuacugcaccaugaagaucaaccucauccaccgccgcggcgacuccaagaagaagaccuccucccgccacaagaagcuccaccucggccucgacgucgaggccuccgagcgcgacgccuucuccugcaccguccccgacgagcuccucaaccgcaucuacuucaagaacaugcgcaccacccccaagcaggaggccgccgccaagcagcacaucuccuaccagugccccuacugcaaccgcaagcgcgccgagcucgcccucuccgccuuccucaagcagaagaagacccuccucgaguccuuccuccuccaggagcgcaucgacgagcaccuccacaccaaggacuuccucacccgcaucggcgaggcccaccaggacuucccccgccucuccgacgacccccgcaucaucuggaagcgccucaccgagaagucccacauccgcuacuccggcuucgagcgcuccgagaccgagcagaagaugcagcgcgacggcaacuccgccugccaccuccccuucucccuccccuuccucaagcgccucacccucaucaagcccgagcucgucaucgucaacgacaacgucuga

SEQ ID NO: 40628 - RNA, 321 nt, Artificial Sequence
  derived and/or modified sequence opt2 from C8orf4__Homo_sapiens__NP_064515
augaaggccaagcgcucccaccaggccaucaucauguccaccucccuccgcgucucccccuccauccacggcuaccacuucgacaccgccucccgcaagaaggccgucggcaacaucuucgagaacaccgaccaggagucccucgagcgccucuuccgcaacuccggcgacaagaaggccgaggagcgcgccaagaucaucuucgccaucgaccaggacgucgaggagaagacccgcgcccucauggcccucaagaagcgcaccaaggacaagcucuuccaguuccucaagcuccgcaaguacuccaucaagguccacuga

SEQ ID NO: 40629 - RNA, 672 nt, Artificial Sequence
  derived and/or modified sequence opt2 from C8orf86__Homo_sapiens__NP_997295
augcgcccccucggcaagggccuccuccccgccgaggagcucauccgcuccaaccucggcgucggccgcucccuccgcgacugccucucccaguccggcaagcucgccgaggagcucggcuccaagcgccucaagcccgccaaguucggcaccgagggcaaggagcgcgucgagcagcgcaccgagcgccagcgcaccggcuccuccaaggagccccgcaugcagaucaucugccgccgccgcuggcgcgagccccccccccgccuccucuggggcugccucaugccccgcgcccagccccuccuccacgucaccgccuacgagaacaccggccacugggagcgccucgccuccgucgucuccuccaagacccagcagcccaccgucaucucccacuccuccaucuccaucaccuucucccacuacccccccgccacccucgacuccuuccucguccucgagcccaucaagcucuuccccgucuccucccuccgcuccccccucugccucaacugcggcuccugccgcgaguccauccgcaucuccggcgagcucaucggcaacgcccacucccccgcccccccccgcacccccgagcucgagacccucggcugggacaagcaggccguccucuccggcgcccaggucauccucgucugcgccgaggucuga

SEQ ID NO: 40630 - RNA, 1680 nt, Artificial Sequence
  derived and/or modified sequence opt2 from C9__Homo_sapiens__NP_001728
auguccgccugccgcuccuucgccgucgccaucugcauccucgagaucuccauccucaccgcccaguacaccaccuccuacgaccccgagcucaccgaguccuccggcuccgccucccacaucgacugccgcaugucccccugguccgaguggucccagugcgaccccugccuccgccagauguuccgcucccgcuccaucgaggucuucggccaguucaacggcaagcgcugcaccgacgccgucggcgaccgccgccagugcguccccaccgagcccugcgaggacgccgaggacgacugcggcaacgacuuccagugcuccaccggccgcugcaucaagaugcgccuccgcugcaacggcgacaacgacugcggcgacuucuccgacgaggacgacugcgaguccgagccccgcccccccugccgcgaccgcgucgucgaggaguccgagcucgcccgcaccgccggcuacggcaucaacauccucggcauggacccccucuccacccccuucgacaacgaguucuacaacggccucugcaaccgcgaccgcgacggcaacacccucaccuacuaccgccgccccuggaacgucgccucccucaucuacgagaccaagggcgagaagaacuuccgcaccgagcacuacgaggagcagaucgaggccuucaaguccaucauccaggagaagaccuccaacuucaacgccgccaucucccucaaguucacccccaccgagaccaacaaggccgagcagugcugcgaggagaccgccuccuccaucucccuccacggcaagggcuccuuccgcuucuccuacuccaagaacgagaccuaccagcucuuccucuccuacuccuccaagaaggagaagauguuccuccacgucaagggcgagauccaccucggccgcuucgucaugcgcaaccgcgacgucguccucaccaccaccuucgucgacgacaucaaggcccuccccaccaccuacgagaagggcgaguacuucgccuuccucgagaccuacggcacccacuacuccuccuccggcucccucggcggccucuacgagcucaucuacguccucgacaaggccuccaugaagcgcaagggcgucgagcucaaggacaucaagcgcugccucggcuaccaccucgacgucucccucgccuucuccgagaucuccgucggcgccgaguucaacaaggacgacugcgucaagcgcggcgagggccgcgccgucaacaucaccuccgagaaccucaucgacgacgucgucucccucauccgcggcggcacccgcaaguacgccuucgagcucaaggagaagcuccuccgcggcaccgucaucgacgucaccgacuucgucaacugggccuccuccaucaacgacgcccccguccucaucucccagaagcucucccccaucuacaaccucguccccgucaagaugaagaacgcccaccucaagaagcagaaccucgagcgcgccaucgaggacuacaucaacgaguucuccguccgcaagugccacaccugccagaacggcggcaccgucauccucauggacggcaagugccucugcgccugccccuucaaguucgagggcaucgccugcgagaucuccaagcagaagaucuccgagggccuccccgcccucgaguuccccaacgagaaguga

SEQ ID NO: 40631 - RNA, 699 nt, Artificial Sequence
  derived and/or modified sequence opt2 from C9orf106__Homo_sapiens__NP_001012733
auggccuacgucgcccucuccgacaagccccaccucuccggcgaggucggcgaggaggccugcuccuccuggaaccccccccucuucuccccccgcccccucccccgccucuggccccuccccggcacccccuuccuccccauccgcgcccuccccuucuccgccuccuccuccggcaaguccucccucguccccucccccuccuccuccgcccacuccggcuuccgcacccccugccucggccccgacugccuccucugcacccagggcugcgagcuccacgagggccgcaaccacauggccguccacuccugcgucgcccgcgccuggcccggcgacccccaggagguccgccaccucaacccccuccucugcgaccccggcucccaggucgagcccuccuggcccuggcaccccggccucgagcaggccgccgccuccugggucggcaaccacgucucccccgcccaccgccaggcccuccgcggccacucccucggcuccgcccuccgcgcccucaugcccggcggccacugcccccucugcguccccugcaagcgcggcugcaaccuccgcggcggccgcggcaagcacggcccccgccccugcugcccccuccuccgcaaguuccccguccuccccguccaccccuggcccuuccccugcgccgucugggacuccggcugguccugccgcuga

SEQ ID NO: 40632 - RNA, 690 nt, Artificial Sequence
  derived and/or modified sequence opt2 from C9orf135__Homo_sapiens__NP_001010940
auggacucccucgaccgcuccugccaggacuggugcgaccgcaagcagcacuggcucgagaucggcccccccgaccucgucgagcgcaagggcucccucacccuccgcucccaccacaagaaguacuccaagcccguccucgucuacuccuggcaccgcgaccgcgaggccuuccccaagggcuacgacaucgagggccccgagaaggucaagaagcucugcaacuccaccuaccgccgccucggcaccgacgagucccccaucuggaccuccgagacccacgagaagcucucccagaugugccucaacaccgagugggucgagaugaaguccaaggcccuccucaacgaggagaccgucuccuccggcaucaucgagcgcgucaccggccuccccgccaccggcuucggcgccgucuucccccgccacccccccgacugguccaagaugugcgcccucaccaccuacuccgaggacuacgucccccccuacgacuaccagccccacgccuaccccugccaggacgacuacuccaucguccaccgcaagugccgcucccaguucaccgaccucaacggcuccaagcgcuucggcaucaacaccuggcacgacgaguccggcaucuacgccaacuccgacgucaagcagaagcucuacccccucaccuccggccccaucguccccaucuga

SEQ ID NO: 40633 - RNA, 720 nt, Artificial Sequence
  derived and/or modified sequence opt2 from C9orf152__Homo_sapiens__NP_001013011
auggagggccuccccugccccugccccgcccucccccacuucuggcagcuccgcucccaccucauggccgagggcucccgcacccaggcccccggcaagggccccccccucuccauccaguuccuccgcgcccaguacgagggccucaagcgccagcagcgcacccaggcccaccuccucguccuccccaagggcggcaacacccccgcccccgccgaguccauggucaacgccgucuggaucaacaaggagcgccgcuccucccucucccucgaggaggccgacuccgaggucgagggccgccucgaggaggccgcccagggcugccuccaggcccccaagucccccuggcacacccaccucgagaugcacugccucguccagaccuccccccaggacaccucccaccagguccaccaccgcggcaagcucgucggcuccgaccagcgccucccccccgagggcgacacccaccucuucgagaccaaccagaugacccagcagggcaccggcauccccgaggccgcccagcuccccugccaggucggcaacacccagaccaaggccgucgaguccggccucaaguucuccacccagugcccccucuccaucaagaacccccaccgcuccggcaagcccgccuacuaccccuucccccagcgcaagaccccccgcaucucccaggccgcccgcaaccucggccucuacggcuccgccuga

SEQ ID NO: 40634 - RNA, 1326 nt, Artificial Sequence
  derived and/or modified sequence opt2 from C9orf156__Homo_sapiens__NP_057565
augcgcggccucgaggaguccggcccccgccccaccgccacccccugcggcugcgucaagcccgcccucgagaccggcaaccuccucaccgagcccgucggcuaccucgaguccugcuucuccgccaagaacggcaccccccgccagcccuccaucugcuccuacucccgcgccugccuccgcauccgcaagcgcaucuucaacaaccccgagcacucccucaugggccucgagcaguucucccacgucuggauccucuucgucuuccacaagaacggccaccucuccugcaaggccaagguccagcccccccgccucaacggcgccaagaccggcgucuucuccacccgcuccccccaccgccccaacgccaucggccucacccucgccaagcucgagaaggucgagggcggcgccaucuaccucuccggcaucgacaugauccacggcacccccguccucgacaucaagcccuacaucgccgaguacgacuccccccagaacgucauggagccccucgccgacuucaaccuccagaacaaccagcacacccccaacaccgucucccaguccgacuccaagaccgacuccugcgaccagcgccagcucuccggcugcgacgagccccagccccaccacuccaccaagcgcaagcccaagugccccgaggaccgcaccuccgaggagaacuaccucacccacuccgacaccgcccgcauccagcaggccuuccccaugcaccgcgagaucgccgucgacuucggccucgagucccgccgcgaccaguccuccuccgucgccgaggagcagaucggccccuacugccccgagaaguccuucuccgagaagggcaccgacaagaagcucgagcgcgucgagggcgccgccguccuccagggcucccgcgccgagacccagcccauggccccccacugccccgccggccgcgccgacggcgccccccgcuccgucguccccgccugggucaccgaggcccccgucgccacccucgagguccgcuucaccccccacgccgagauggaccucggccagcucuccucccaggacgucggccaggccuccuucaaguacuuccaguccgccgaggaggccaagcgcgccaucgaggccguccucuccgccgacccccgcuccgucuaccgccgcaagcucugccaggaccgccucuucuacuucaccgucgacaucgcccacgucaccugcugguucggcgacggcuucgccgagguccuccgcaucaagcccgccuccgagcccguccacaugaccggccccgucggcucccucgucucccucggcuccuga

SEQ ID NO: 40635 - RNA, 366 nt, Artificial Sequence
  derived and/or modified sequence opt2 from C9orf170__Homo_sapiens__NP_001001709
auguggucccgccgcggccucggcgucucccgcgccccccuccaccuccuccucggcgucuggggccccuccggccgcaccggcggccagcgcaagggcgccucccucgcccgccccggccgcggcggccucgccuccugcuccgucggcgccaacggcaagcgcgacguccucuuccuccgcaagacccucaccaacaccgucgaggacauccagaucgacaacuuccgccgcaaguccgaccucggcgucggcucccccgacuggaagaaccuccucaucgacgucacccgcgaggaccacgagaacucccagaacaacuccaagcgccgcugcaaggucaacugcgagaccgaccagcgcuga

SEQ ID NO: 40636 - RNA, 855 nt, Artificial Sequence
  derived and/or modified sequence opt2 from C9orf171__Homo_sapiens__NP_001269886
augcccgaggcccgcuccuccggccccgaccucacccgcuggcgcaagcagcagcagcccguccgccgcaccgucucccaggucugcccccccccccgccgcccccucaccgucgccgacauccgcuccggcauggagaacgagcgccucggcgucguccgcgacuccauguuccagaacccccucaucgucaaggccgagcucggcaagccccgcgagcgcuccuacucccuccccggcaucaacuucaacuacggccucuacauccgcggccucgacggcggcguccccgaggccaucggccgcuggaacgucuucaagcagcagcccaccugcccccacgagcucacccgcaacuacaucgccaugaaccgcggcgccgucaaggccggccucgucaccgcccgcgagaaccuccucuaccgccagcucaacgacauccgcaucuccgaccaggacgaccgccgcaugaagaaggagccccccccccucccccccaacaugaccuucggcauccgcgcccgccccuccacccccuucuucgaccuccuccagcaccgcuaccuccagcucuggguccaggagcagaaggccacccagaaggccaucaagcucgagaagaagcagaaggucguccucggcaagcucuacgagacccgcuccucccagcuccgcaaguacaagccccccgucaagcucgacacccucuggcacaugccccacuuccagaaggucggccgccaccucgacaccuuccccaccgaggccgaccgccagcgcgcccucaaggcccaccgcgaggagugcgccguccgccagggcacccuccgcaugggcaacuacacccaccccuga

SEQ ID NO: 40637 - RNA, 1701 nt, Artificial Sequence
  derived and/or modified sequence opt2 from C9orf3__Homo_sapiens__NP_001180260
auggacauccagcucgaccccgcccgcgacgaccucccccucauggccaacaccucccacauccucgucaagcacuacguccucgaccucgacgucgacuucgagucccaggucaucgagggcaccaucguccucuuccucgaggacggcaaccgcuucaagaagcagaacuccuccaucgaggaggccugccaguccgaguccaacaaggccugcaaguucggcaugcccgagcccugccacauccccgucaccaacgcccgcaccuucuccuccgagauggaguacaacgacuucgccaucugcuccaagggcgagaaggacaccuccgacaaggacggcaaccacgacaaccaggagcacgccuccggcaucuccuccuccaaguacugcugcgacaccggcaaccacggcuccgaggacuuccuccucguccucgacugcugcgaccucuccguccucaaggucgaggaggucgacgucgccgccguccccggccucgagaaguucacccgcucccccgagcucaccgucgucuccgaggaguuccgcaaccagaucguccgcgagcucgucacccuccccgccaaccgcuggcgcgagcagcucgacuacuacgcccgcugcucccaggcccccggcugcggcgagcuccucuucgacaccgacaccuggucccuccagauccgcaagaccggcgcccagaccgccaccgacuucccccacgccauccgcaucugguacaagaccaagcccgagggccgcuccgucaccuggaccuccgaccaguccggccgccccugcgucuacaccgucggcucccccaucaacaaccgcgcccucuuccccugccaggagccccccgucgccauguccaccuggcaggccaccguccgcgccgccgccuccuucgucguccucauguccggcgagaacuccgccaagcccacccagcucugggaggagugcuccuccugguacuacuacgucaccaugcccaugcccgccuccaccuucaccaucgccgucggcugcuggaccgagaugaagauggagaccugguccuccaacgaccucgccaccgagcgccccuucucccccuccgaggccaacuuccgccacgucggcgucugcucccacauggaguaccccugccgcuuccagaacgccuccgccaccacccaggagaucaucccccaccgcgucuucgcccccgucugccucaccggcgccugccaggagacccuccuccgccucaucccccccugccucuccgccgcccacuccguccucggcgcccaccccuucucccgccucgacguccucaucguccccgccaacuuccccucccucggcauggccuccccccacaucauguuccucucccaguccauccucaccggcggcaaccaccucugcggcacccgccucugccacgagaucgcccacgccugguucggccucgccaucggcgcccgcgacuggaccgaggaguggcucuccgagggcuucgccacccaccucgaggacgucuucugggccaccgcccagcagcucgcccccuacgaggcccgcgagcagcaggagcuccgcgccugccuccgcuggcgccgccuccaggacgagaugcagugcucccccgaggagaugcagguccuccgcuucccccacgucggcggcugcuccggcuccuucuccuga

SEQ ID NO: 40638 - RNA, 1386 nt, Artificial Sequence
  derived and/or modified sequence opt2 from C9orf43__Homo_sapiens__NP_001265558
auggaccuccccgacgagucccagugggacgagaccaccugcggccucgccgucugccagcacccccagugcugggccaccauccgccgcaucgagcgcggccacccccgcauccucggcuccuccugcaagaccccccucgacgccgaggacaagcuccccguccucaccgucgucgacauccucgacuccggcuucgccgcccaccaccuccccgagugcaccuucaccaaggcccacucccuccucucccaguccuccaaguucuacuccaaguuccacggccgcccccccaagggccuccccgacaagucccucaucaacugcaccaaccgccuccccaaguuccccguccucaaccucaacgagacccagcuccccugccccgaggacguccgcaacauggucguccucuggauccccgaggagaccgagauccacgucucccagcacggcaagaagaagcgcaagaacuccgccgucaaguccaaguccuuccucggccucuccggcaaccaguccgccggcacccgcgucggcacccccggcaugaucguccccccccccacccccguccagcucuccgagcaguucuccuccgacuuccucccccucugggcccaguccgaggcccucccccaggaccuccucaaggagcuccuccccggcggcaagcagaccaugcucugccccgagaugaagaucaagcucgccaugaugaagaagaaccucccccucgagaagaaccgccccgacuccgucaucuccuccaagauguuccucuccauccaccgccucacccucgagcgccccgcccuccgcuaccccgagcgccucaagaagcuccacaaccucaagaccgagggcuaccgcaagcagcagcagcgccagcagcagcagcagcagcagcagaagaaggucaagacccccaucaagaagcaggaggccaagaagaaggccaaguccgaccccggcauccaguccaccucccacaagcaccccgucaccaccguccacgaccgccucuacggcuaccgcacccuccccggccagaacuccgacaugaagcagcagcagcagauggagaagggcaccaccuccaagcaggacuccaccgagcgccccaagaugaacuacuacgaccacgccgacuuccaccacuccgucaagucccccgagcucuacgagaccgagcccaccaacaaggacaucuccgcccccgucgacgccguccccgaggcccaggccgcccgccagaagaagaucuccuucaacuucuccgagaucauggccuccaccggcuggaacuccgagcucaagcuccuccgcauccuccaggacaccgacgacgaggacgaggaggaccaguccuccggcgccgaguga

SEQ ID NO: 40639 - RNA, 888 nt, Artificial Sequence
  derived and/or modified sequence opt2 from C9orf66__Homo_sapiens__NP_689782
augcgccacuccgucgcccgccccacccgccucccccgccgccucucccccuucugggaccccgccaccugcaagaaccucgagggcggcgccggcgaggucguccgcggccgcgacccccgccgccuccgcaccucccgcuccaccgagauccucggcgaggaccucgccggccccuccgccggcgccgccgcccgccccgccgccccccccccccagccccgcgagcccggcgcccccggccuccgccgcgcccccccccgcacccgcauggacuccuccggccucggccccugcuccgaggccccccuccacaccuccgccggccucuccggccgcaaccuccgcgccgccggcggcguccuccccgucgaccucgagcgcgagcgcgccgcccucugcgcccgccaguccggccacggcccccccgccguccgcuggcuccucggcucccgcggcgccgaguccggcggccucgcccgccgccgcgucgccgccgagcacgcccagcccuccgccaaccucgucugccgcuccgcccucgagaccuccgccuucccccccuccaagcccaaguccccccgcggccgcguccgcgcccgcuccuccgacggccgccuccgccaccccgccuggcgcgccggcuccggcggccgcggcggccgcggccccuccgccgagcucgccucccgcuacuggggccgccgccgcgcccuccccggcgccgccgaccuccgccccaagggcgcccgcgccgacgaccgccgcccccuccgcgccggccgcaagcuccaccuccccgaggccgcccgccuccccggcaacgucggcaaguccggcgagccccacaaggccggcgaggucggcaaccacccccgcgacuccuga

SEQ ID NO: 40640 - RNA, 1446 nt, Artificial Sequence
  derived and/or modified sequence opt2 from C9orf72__Homo_sapiens__NP_060795
auguccacccucugccccccccccucccccgccgucgccaagaccgagaucgcccucuccggcaaguccccccuccucgccgccaccuucgccuacugggacaacauccucggcccccgcguccgccacaucugggcccccaagaccgagcagguccuccucuccgacggcgagaucaccuuccucgccaaccacacccucaacggcgagauccuccgcaacgccgaguccggcgccaucgacgucaaguucuucguccucuccgagaagggcgucaucaucgucucccucaucuucgacggcaacuggaacggcgaccgcuccaccuacggccucuccaucauccucccccagaccgagcucuccuucuaccucccccuccaccgcgucugcgucgaccgccucacccacaucauccgcaagggccgcaucuggaugcacaaggagcgccaggagaacguccagaagaucauccucgagggcaccgagcgcauggaggaccagggccaguccaucauccccaugcucaccggcgaggucauccccgucauggagcuccucuccuccaugaagucccacuccguccccgaggagaucgacaucgccgacaccguccucaacgacgacgacaucggcgacuccugccacgagggcuuccuccucaacgccaucuccucccaccuccagaccugcggcugcuccgucgucgucggcuccuccgccgagaaggucaacaagaucguccgcacccucugccucuuccucacccccgccgagcgcaagugcucccgccucugcgaggccgaguccuccuucaaguacgaguccggccucuucguccagggccuccucaaggacuccaccggcuccuucguccuccccuuccgccaggucauguacgcccccuaccccaccacccacaucgacgucgacgucaacaccgucaagcagaugccccccugccacgagcacaucuacaaccagcgccgcuacaugcgcuccgagcucaccgccuucuggcgcgccaccuccgaggaggacauggcccaggacaccaucaucuacaccgacgaguccuucacccccgaccucaacaucuuccaggacguccuccaccgcgacacccucgucaaggccuuccucgaccaggucuuccagcucaagcccggccucucccuccgcuccaccuuccucgcccaguuccuccucguccuccaccgcaaggcccucacccucaucaaguacaucgaggacgacacccagaagggcaagaagcccuucaagucccuccgcaaccucaagaucgaccucgaccucaccgccgagggcgaccucaacaucaucauggcccucgccgagaagaucaagcccggccuccacuccuucaucuucggccgccccuucuacaccuccguccaggagcgcgacguccucaugaccuucuga

SEQ ID NO: 40641 - RNA, 474 nt, Artificial Sequence
  derived and/or modified sequence opt2 from C9orf85__Homo_sapiens__NP_872311
auguccucccagaagggcaacgucgcccgcucccgcccccagaagcaccagaacaccuucuccuucaagaacgacaaguucgacaaguccguccagaccaagaagaucaacgccaagcuccacgacggcgucugccagcgcugcaaggagguccucgaguggcgcgucaaguacuccaaguacaagccccucuccaagcccaagaagugcgucaagugccuccagaagaccgucaaggacuccuaccacaucaugugccgccccugcgccugcgagcucgaggucugcgccaagugcggcaagaaggaggacaucgucaucccccucaacaaggagaccgagaagaucgagcacaccgagaacaaccucuccuccaaccaccgccgcuccugccgccgcaacgaggaguccgacgacgaccucgacuucgacaucgaccucgaggacaccggcggcgaccaccagaugaacuga

SEQ ID NO: 40642 - RNA, 1029 nt, Artificial Sequence
  derived and/or modified sequence opt2 from C9orf91__Homo_sapiens__NP_694590
auggccugcgagccccaggucgaccccggcgccaccggcccccucccccccuccucccccggcugguccgcccuccccggcggcuccccccccggcuggggccaggagcuccacaacggccagguccucaccguccuccgcaucgacaacaccugcgcccccaucuccuucgaccucggcgccgccgaggagcagcuccagaccuggggcauccagguccccgccgaccaguaccgcucccucgccgaguccgcccuccucgagccccagguccgccgcuacaucaucuacaacucccgccccaugcgccucgccuucgccgucgucuucuacgucgucgucugggccaacaucuacuccaccucccagauguucgcccucggcaaccacugggccggcaugcuccucgucacccucgccgccgucucccucacccucacccucguccucgucuucgagcgccaccagaagaaggccaacaccaacaccgaccuccgccucgccgccgccaacggcgcccuccuccgccaccgcguccuccucggcgucaccgacaccgucgagggcugccaguccgucauccagcucugguucgucuacuucgaccucgagaacugcguccaguuccucuccgaccacguccaggagaugaagaccucccaggagucccuccuccgcucccgccucucccagcucugcgucgucauggagaccggcgucucccccgccaccgccgagggccccgagaaccucgaggacgccccccuccuccccggcaacuccugccccaacgagcgcccccucaugcagaccgagcuccaccagcucguccccgaggccgagcccgaggagauggcccgccagcuccucgccgucuucggcggcuacuacauccgccuccucgucaccucccagcucccccaggccaugggcacccgccacaccaacuccccccgcauccccugccccugccagcucaucgaggccuacauccucggcaccggcugcugccccuuccucgcccgcuga

SEQ ID NO: 40643 - RNA, 507 nt, Artificial Sequence
  derived and/or modified sequence opt2 from C9orf9__Homo_sapiens__NP_061829
augaacgaggucaaggagucccuccgcuccaucgagcagaaguacaagcucuuccagcagcagcagcucaccuucaccgccgcccucgagcacugccgcgagaacgcccacgacaagauccgccccaucuccuccaucggccagguccaguccuacauggagcacuacugcaacuccuccaccgaccgccgcguccuccucauguuccucgacaucugcuccgagcucaacaagcucugccagcacuucgaggccguccacuccggcacccccgucaccaacaaccuccucgagaagugcaagacccucgucucccaguccaacgaccucuccucccuccgcgccaaguacccccacgacgucgucaaccaccucuccugcgacgaggcccgcaaccacuacggcggcgucgucucccucaucccccucauccucgaccucaugaaggaguggaucgcccacuccgagaagcucccccgcaagguccuccagcacggcaccaccuga

SEQ ID NO: 40644 - RNA, 987 nt, Artificial Sequence
  derived and/or modified sequence opt2 from CA10__Homo_sapiens__NP_001076003
auggagaucgucugggagguccucuuccuccuccaggccaacuucaucgucugcaucuccgcccagcagaacucccccaagauccacgagggcuggugggccuacaaggaggucguccagggcuccuucguccccguccccuccuucuggggccucgucaacuccgccuggaaccucugcuccgucggcaagcgccagucccccgucaacaucgagaccucccacaugaucuucgaccccuuccucaccccccuccgcaucaacaccggcggccgcaaggucuccggcaccauguacaacaccggccgccacgucucccuccgccucgacaaggagcaccucgucaacaucuccggcggccccaugaccuacucccaccgccucgaggagauccgccuccacuucggcuccgaggacucccagggcuccgagcaccuccucaacggccaggccuucuccggcgagguccagcucauccacuacaaccacgagcucuacaccaacgucaccgaggccgccaagucccccaacggccucgucgucgucuccaucuucaucaaggucuccgacuccuccaaccccuuccucaaccgcaugcucaaccgcgacaccaucacccgcaucaccuacaagaacgacgccuaccuccuccagggccucaacaucgaggagcucuaccccgagaccuccuccuucaucaccuacgacggcuccaugaccaucccccccugcuacgagaccgccuccuggaucaucaugaacaagcccgucuacaucacccgcaugcagaugcacucccuccgccuccucucccagaaccagcccucccagaucuuccucuccauguccgacaacuuccgccccguccagccccucaacaaccgcugcauccgcaccaacaucaacuucucccuccagggcaaggacugccccaacaaccgcgcccagaagcuccaguaccgcgucaacgaguggcuccucaaguga

SEQ ID NO: 40645 - RNA, 987 nt, Artificial Sequence
  derived and/or modified sequence opt2 from CA11__Homo_sapiens__NP_001208
augggcgccgccgcccgccucuccgccccccgcgcccucguccucugggccgcccucggcgccgccgcccacaucggccccgcccccgaccccgaggacuggugguccuacaaggacaaccuccagggcaacuucguccccggcccccccuucuggggccucgucaacgccgccuggucccucugcgccgucggcaagcgccagucccccgucgacgucgagcucaagcgcguccucuacgaccccuuccuccccccccuccgccucuccaccggcggcgagaagcuccgcggcacccucuacaacaccggccgccacgucuccuuccuccccgccccccgccccgucgucaacgucuccggcggcccccuccucuacucccaccgccucuccgagcuccgccuccucuucggcgcccgcgacggcgccggcuccgagcaccagaucaaccaccagggcuucuccgccgagguccagcucauccacuucaaccaggagcucuacggcaacuucuccgccgccucccgcggccccaacggccucgccauccucucccucuucgucaacgucgccuccaccuccaaccccuuccucucccgccuccucaaccgcgacaccaucacccgcaucuccuacaagaacgacgccuacuuccuccaggaccucucccucgagcuccucuuccccgaguccuucggcuucaucaccuaccagggcucccucuccaccccccccugcuccgagaccgucaccuggauccucaucgaccgcgcccucaacaucaccucccuccagaugcacucccuccgccuccucucccagaacccccccucccagaucuuccagucccucuccggcaacucccgcccccuccagccccucgcccaccgcgcccuccgcggcaaccgcgacccccgccaccccgagcgccgcugccgcggccccaacuaccgccuccacgucgacggcgucccccacggccgcuga

SEQ ID NO: 40646 - RNA, 1065 nt, Artificial Sequence
  derived and/or modified sequence opt2 from CA12__Homo_sapiens__NP_001209
augccccgccgcucccuccacgccgccgccguccuccuccucgucauccucaaggagcagcccuccucccccgcccccgucaacggcuccaaguggaccuacuucggccccgacggcgagaacuccugguccaagaaguaccccuccugcggcggccuccuccagucccccaucgaccuccacuccgacauccuccaguacgacgccucccucaccccccucgaguuccagggcuacaaccucuccgccaacaagcaguuccuccucaccaacaacggccacuccgucaagcucaaccuccccuccgacaugcacauccagggccuccagucccgcuacuccgccacccagcuccaccuccacuggggcaaccccaacgacccccacggcuccgagcacaccgucuccggccagcacuucgccgccgagcuccacaucguccacuacaacuccgaccucuaccccgacgccuccaccgccuccaacaaguccgagggccucgccguccucgccguccucaucgagaugggcuccuucaaccccuccuacgacaagaucuucucccaccuccagcacgucaaguacaagggccaggaggccuucguccccggcuucaacaucgaggagcuccuccccgagcgcaccgccgaguacuaccgcuaccgcggcucccucaccaccccccccugcaaccccaccguccucuggaccgucuuccgcaaccccguccagaucucccaggagcagcuccucgcccucgagaccgcccucuacugcacccacauggacgaccccuccccccgcgagaugaucaacaacuuccgccagguccagaaguucgacgagcgccucgucuacaccuccuucucccagguccaggucugcaccgccgccggccucucccucggcaucauccucucccucgcccucgccggcauccucggcaucugcaucgucgucgucgucuccaucuggcucuuccgccgcaaguccaucaagaagggcgacaacaagggcgucaucuacaagcccgccaccaagauggagaccgaggcccacgccuga

SEQ ID NO: 40647 - RNA, 789 nt, Artificial Sequence
  derived and/or modified sequence opt2 from CA13__Homo_sapiens__NP_940986
augucccgccucuccuggggcuaccgcgagcacaacggccccauccacuggaaggaguucuuccccaucgccgacggcgaccagcagucccccaucgagaucaagaccaaggaggucaaguacgacuccucccuccgcccccucuccaucaaguacgaccccuccuccgccaagaucaucuccaacuccggccacuccuucaacgucgacuucgacgacaccgagaacaaguccguccuccgcggcggcccccucaccggcuccuaccgccuccgccagguccaccuccacuggggcuccgccgacgaccacggcuccgagcacaucgucgacggcgucuccuacgccgccgagcuccacgucguccacuggaacuccgacaaguaccccuccuucgucgaggccgcccacgagcccgacggccucgccguccucggcgucuuccuccagaucggcgagcccaacucccagcuccagaagaucaccgacacccucgacuccaucaaggagaagggcaagcagacccgcuucaccaacuucgaccuccucucccuccucccccccuccugggacuacuggaccuaccccggcucccucaccguccccccccuccucgaguccgucaccuggaucguccucaagcagcccaucaacaucuccucccagcagcucgccaaguuccgcucccuccucugcaccgccgagggcgaggccgccgccuuccucgucuccaaccaccgccccccccagccccucaagggccgcaagguccgcgccuccuuccacuga

SEQ ID NO: 40648 - RNA, 786 nt, Artificial Sequence
  derived and/or modified sequence opt2 from CA1__Homo_sapiens__XP_011515886
auggccucccccgacuggggcuacgacgacaagaacggccccgagcagugguccaagcucuaccccaucgccaacggcaacaaccagucccccgucgacaucaagaccuccgagaccaagcacgacaccucccucaagcccaucuccgucuccuacaaccccgccaccgccaaggagaucaucaacgucggccacuccuuccacgucaacuucgaggacaacgacaaccgcuccguccucaagggcggccccuucuccgacuccuaccgccucuuccaguuccacuuccacuggggcuccaccaacgagcacggcuccgagcacaccgucgacggcgucaaguacuccgccgagcuccacgucgcccacuggaacuccgccaaguacuccucccucgccgaggccgccuccaaggccgacggccucgccgucaucggcguccucaugaaggucggcgaggccaaccccaagcuccagaagguccucgacgcccuccaggccaucaagaccaagggcaagcgcgcccccuucaccaacuucgaccccuccacccuccuccccuccucccucgacuucuggaccuaccccggcucccucacccaccccccccucuacgaguccgucaccuggaucaucugcaaggaguccaucuccgucuccuccgagcagcucgcccaguuccgcucccuccucuccaacgucgagggcgacaacgccguccccaugcagcacaacaaccgccccacccagccccucaagggccgcaccguccgcgccuccuucuga

SEQ ID NO: 40649 - RNA, 783 nt, Artificial Sequence
  derived and/or modified sequence opt2 from CA2__Homo_sapiens__NP_000058
augucccaccacuggggcuacggcaagcacaacggccccgagcacuggcacaaggacuuccccaucgccaagggcgagcgccagucccccgucgacaucgacacccacaccgccaaguacgaccccucccucaagccccucuccgucuccuacgaccaggccaccucccuccgcauccucaacaacggccacgccuucaacgucgaguucgacgacucccaggacaaggccguccucaagggcggcccccucgacggcaccuaccgccucauccaguuccacuuccacuggggcucccucgacggccagggcuccgagcacaccgucgacaagaagaaguacgccgccgagcuccaccucguccacuggaacaccaaguacggcgacuucggcaaggccguccagcagcccgacggccucgccguccucggcaucuuccucaaggucggcuccgccaagcccggccuccagaaggucgucgacguccucgacuccaucaagaccaagggcaaguccgccgacuucaccaacuucgacccccgcggccuccuccccgagucccucgacuacuggaccuaccccggcucccucaccacccccccccuccucgagugcgucaccuggaucguccucaaggagcccaucuccgucuccuccgagcagguccucaaguuccgcaagcucaacuucaacggcgagggcgagcccgaggagcucauggucgacaacuggcgccccgcccagccccucaagaaccgccagaucaaggccuccuucaaguga

SEQ ID NO: 40650 - RNA, 783 nt, Artificial Sequence
  derived and/or modified sequence opt2 from CA3__Homo_sapiens__NP_005172
auggccaaggaguggggcuacgccucccacaacggccccgaccacuggcacgagcucuuccccaacgccaagggcgagaaccagucccccgucgagcuccacaccaaggacauccgccacgaccccucccuccagcccugguccgucuccuacgacggcggcuccgccaagaccauccucaacaacggcaagaccugccgcgucgucuucgacgacaccuacgaccgcuccaugcuccgcggcggcccccuccccggccccuaccgccuccgccaguuccaccuccacuggggcuccuccgacgaccacggcuccgagcacaccgucgacggcgucaaguacgccgccgagcuccaccucguccacuggaaccccaaguacaacaccuucaaggaggcccucaagcagcgcgacggcaucgccgucaucggcaucuuccucaagaucggccacgagaacggcgaguuccagaucuuccucgacgcccucgacaagaucaagaccaagggcaaggaggcccccuucaccaaguucgaccccuccugccucuuccccgccugccgcgacuacuggaccuaccagggcuccuucaccaccccccccugcgaggagugcaucgucuggcuccuccucaaggagcccaugaccgucuccuccgaccagauggccaagcuccgcucccuccucuccuccgccgagaacgagccccccgucccccucgucuccaacuggcgccccccccagcccaucaacaaccgcgucguccgcgccuccuucaaguga

SEQ ID NO: 40651 - RNA, 939 nt, Artificial Sequence
  derived and/or modified sequence opt2 from CA4__Homo_sapiens__NP_000708
augcgcaugcuccucgcccuccucgcccucuccgccgcccgccccuccgccuccgccgagucccacuggugcuacgagguccaggccgaguccuccaacuaccccugccucguccccgucaaguggggcggcaacugccagaaggaccgccagucccccaucaacaucgucaccaccaaggccaaggucgacaagaagcucggccgcuucuucuucuccggcuacgacaagaagcagaccuggaccguccagaacaacggccacuccgucaugaugcuccucgagaacaaggccuccaucuccggcggcggccuccccgcccccuaccaggccaagcagcuccaccuccacugguccgaccuccccuacaagggcuccgagcacucccucgacggcgagcacuucgccauggagaugcacaucguccacgagaaggagaagggcaccucccgcaacgucaaggaggcccaggaccccgaggacgagaucgccguccucgccuuccucgucgaggccggcacccaggucaacgagggcuuccagccccucgucgaggcccucuccaacauccccaagcccgagauguccaccaccauggccgaguccucccuccucgaccuccuccccaaggaggagaagcuccgccacuacuuccgcuaccucggcucccucaccacccccaccugcgacgagaaggucgucuggaccgucuuccgcgagcccauccagcuccaccgcgagcagauccucgccuucucccagaagcucuacuacgacaaggagcagaccgucuccaugaaggacaacguccgcccccuccagcagcucggccagcgcaccgucaucaaguccggcgcccccggccgcccccuccccugggcccuccccgcccuccucggccccaugcucgccugccuccucgccggcuuccuccgcuga

SEQ ID NO: 40652 - RNA, 918 nt, Artificial Sequence
  derived and/or modified sequence opt2 from CA5A__Homo_sapiens__NP_001730
augcucggccgcaacaccuggaagaccuccgccuucuccuuccucgucgagcagaugugggccccccucuggucccgcuccaugcgccccggccgcuggugcucccagcgcuccugcgccuggcagaccuccaacaacacccuccacccccucuggaccguccccgucuccguccccggcggcacccgccagucccccaucaacauccaguggcgcgacuccgucuacgacccccagcucaagccccuccgcgucuccuacgaggccgccuccugccucuacaucuggaacaccggcuaccucuuccaggucgaguucgacgacgccaccgaggccuccggcaucuccggcggcccccucgagaaccacuaccgccucaagcaguuccacuuccacuggggcgccgucaacgagggcggcuccgagcacaccgucgacggccacgccuaccccgccgagcuccaccucguccacuggaacuccgucaaguaccagaacuacaaggaggccgucgucggcgagaacggccucgccgucaucggcgucuuccucaagcucggcgcccaccaccagacccuccagcgccucgucgacauccuccccgagaucaagcacaaggacgcccgcgccgccaugcgccccuucgaccccuccacccuccuccccaccugcugggacuacuggaccuacgccggcucccucaccacccccccccucaccgaguccgucaccuggaucauccagaaggagcccgucgaggucgcccccucccagcucuccgccuuccgcacccuccucuucuccgcccucggcgaggaggagaagaugauggucaacaacuaccgcccccuccagccccucaugaaccgcaaggucugggccuccuuccaggccaccaacgagggcacccgcuccuga

SEQ ID NO: 40653 - RNA, 885 nt, Artificial Sequence
  derived and/or modified sequence opt2 from CA6__Homo_sapiens__XP_011540385
augugcuccaccaugcgcgcccucguccuccuccucucccucuuccuccucggcggccaggcccagcacgucuccgacuggaccuacuccgagggcgcccucgacgaggcccacuggccccagcacuaccccgccugcggcggccagcgccagucccccaucaaccuccagcgcaccaagguccgcuacaaccccucccucaagggccucaacaugaccggcuacgagacccaggccggcgaguuccccauggucaacaacggccacaccguccagaucucccuccccuccaccaugcgcaugaccgucgccgacggcaccgucuacaucgcccagcagaugcacuuccacuggggcggcgccuccuccgagaucuccggcuccgagcacaccgucgacggcauccgccacgucaucgagauccacaucguccacuacaacuccaaguacaaguccuacgacaucgcccaggacgcccccgacggccucgccguccucgccgccuucgucgaggucaagaacuaccccgagaacaccuacuacuccaacuucaucucccaccucgccaacaucaaguaccccggccagcgcaccacccucaccggccucgacguccaggacaugcucccccgcaaccuccagcacuacuacaccuaccacggcucccucaccaccccccccugcaccgagaacguccacugguucguccucgccgacuucgucaagcucucccgcacccaggucuggaagcucgagaacucccuccucgaccaccgcaacaagaccauccacaacgacuaccgccgcacccagccccucaaccaccgcgucgucgaguccaacuuccccaaccaggagaacugcauccccgccggccucaucuga

SEQ ID NO: 40654 - RNA, 873 nt, Artificial Sequence
  derived and/or modified sequence opt2 from CA8__Homo_sapiens__NP_004047
auggccgaccucuccuucaucgaggacaccgucgccuuccccgagaaggaggaggacgaggaggaggaggaggagggcgucgaguggggcuacgaggagggcgucgaguggggccucgucuuccccgacgccaacggcgaguaccagucccccaucaaccucaacucccgcgaggcccgcuacgaccccucccuccucgacguccgccucucccccaacuacgucgucugccgcgacugcgaggucaccaacgacggccacaccauccaggucauccucaaguccaaguccguccucuccggcggcccccucccccagggccacgaguucgagcucuacgagguccgcuuccacuggggccgcgagaaccagcgcggcuccgagcacaccgucaacuucaaggccuuccccauggagcuccaccucauccacuggaacuccacccucuucggcuccaucgacgaggccgucggcaagccccacggcaucgccaucaucgcccucuucguccagaucggcaaggagcacgucggccucaaggccgucaccgagauccuccaggacauccaguacaagggcaaguccaagaccauccccugcuucaaccccaacacccuccuccccgacccccuccuccgcgacuacugggucuacgagggcucccucaccaucccccccugcuccgagggcgucaccuggauccucuuccgcuacccccucaccaucucccagcuccagaucgaggaguuccgccgccuccgcacccacgucaagggcgccgagcucgucgagggcugcgacggcauccucggcgacaacuuccgccccacccagccccucuccgaccgcgucauccgcgccgccuuccaguga

SEQ ID NO: 40655 - RNA, 1026 nt, Artificial Sequence
  derived and/or modified sequence opt2 from CAB39__Homo_sapiens__NP_001124322
augcccuuccccuucggcaagucccacaagucccccgccgacaucgucaagaaccucaaggaguccauggccguccucgagaagcaggacaucuccgacaagaaggccgagaaggccaccgaggaggucuccaagaaccucgucgccaugaaggagauccucuacggcaccaacgagaaggagccccagaccgaggccgucgcccagcucgcccaggagcucuacaacuccggccuccucuccacccucgucgccgaccuccagcucaucgacuucgagggcaagaaggacgucgcccagaucuucaacaacauccuccgccgccagaucggcacccgcacccccaccgucgaguacaucugcacccagcagaacauccucuucaugcuccucaagggcuacgagucccccgagaucgcccucaacugcggcaucaugcuccgcgagugcauccgccacgagccccucgccaagaucauccucugguccgagcaguucuacgacuucuuccgcuacgucgagauguccaccuucgacaucgccuccgacgccuucgccaccuucaaggaccuccucacccgccacaagcuccucuccgccgaguuccucgagcagcacuacgaccgcuucuucuccgaguacgagaagcuccuccacuccgagaacuacgucaccaagcgccagucccucaagcuccucggcgagcuccuccucgaccgccacaacuucaccaucaugaccaaguacaucuccaagcccgagaaccucaagcucaugaugaaccuccuccgcgacaagucccgcaacauccaguucgaggccuuccacgucuucaaggucuucgucgccaaccccaacaagacccagcccauccucgacauccuccucaagaaccaggccaagcucaucgaguuccucuccaaguuccagaacgaccgcaccgaggacgagcaguucaacgacgagaagaccuaccucgucaagcagauccgcgaccucaagcgccccgcccagcaggaggccuga

SEQ ID NO: 40656 - RNA, 1014 nt, Artificial Sequence
  derived and/or modified sequence opt2 from CAB39L__Homo_sapiens__NP_001274268
augaagaagaugccccucuucuccaagucccacaagaaccccgccgagaucgucaagauccucaaggacaaccucgccauccucgagaagcaggacaagaagaccgacaaggccuccgaggaggucuccaagucccuccaggccaugaaggagauccucugcggcaccaacgagaaggagccccccaccgaggccgucgcccagcucgcccaggagcucuacuccuccggccuccucgucacccucaucgccgaccuccagcucaucgacuucgagggcaagaaggacgucacccagaucuucaacaacauccuccgccgccagaucggcacccgcucccccaccgucgaguacaucuccgcccacccccacauccucuucaugcuccucaagggcuacgaggccccccagaucgcccuccgcugcggcaucaugcuccgcgagugcauccgccacgagccccucgccaagaucauccucuucuccaaccaguuccgcgacuucuucaaguacgucgagcucuccaccuucgacaucgccuccgacgccuucgccaccuucaaggaccuccucacccgccacaagguccucgucgccgacuuccucgagcagaacuacgacaccaucuucgaggacuacgagaagcuccuccaguccgagaacuacgucaccaagcgccagucccucaagcuccucggcgagcucauccucgaccgccacaacuucgccaucaugaccaaguacaucuccaagcccgagaaccucaagcucaugaugaaccuccuccgcgacaagucccccaacauccaguucgaggccuuccacgucuucaaggucuucgucgccuccccccacaagacccagcccaucgucgagauccuccucaagaaccagcccaagcucaucgaguuccucuccuccuuccagaaggagcgcaccgacgacgagcaguucgccgacgagaagaacuaccucaucaagcagauccgcgaccucaagaagaccgcccccuga

SEQ ID NO: 40657 - RNA, 6663 nt, Artificial Sequence
  derived and/or modified sequence opt2 from CABIN1__Homo_sapiens__NP_036427
augauccgcaucgccgcccucaacgccuccuccaccaucgaggacgaccacgagggcuccuucaagucccacaagacccagaccaaggaggcccaggaggccgaggccuucgcccucuaccacaaggcccucgaccuccagaagcacgaccgcuucgaggaguccgccaaggccuaccacgagcuccucgaggccucccuccuccgcgaggccgucuccuccggcgacgagaaggagggccucaagcaccccggccucauccucaaguacuccaccuacaagaaccucgcccagcucgccgcccagcgcgaggaccucgagaccgccauggaguucuaccucgaggccgucaugcucgacuccaccgacgucaaccucugguacaagaucggccacgucgcccuccgccucauccgcaucccccucgcccgccacgccuucgaggagggccuccgcugcaaccccgaccacuggcccugccucgacaaccucaucaccguccucuacacccucuccgacuacaccaccugccucuacuucaucugcaaggcccucgagaaggacugccgcuacuccaagggccucguccucaaggagaagaucuucgaggagcagcccugccuccgcaaggacucccuccgcauguuccucaagugcgacauguccauccacgacgucuccgucuccgccgccgagacccaggccaucgucgacgaggcccucggccuccgcaagaagcgccaggcccucaucguccgcgagaaggagcccgaccucaagcucguccagcccauccccuucuucaccuggaagugccucggcgagucccuccucgccauguacaaccaccucaccaccugcgagcccccccgccccucccucggcaagcgcaucgaccucuccgacuaccaggaccccucccagccccucgaguccuccauggucgucacccccgucaacgucauccagcccuccaccgucuccaccaaccccgccgucgccgucgccgagcccgucgucuccuacaccuccgucgccaccaccuccuucccccuccacucccccggccuccucgagaccggcgcccccgucggcgacaucuccggcggcgacaaguccaagaagggcgucaagcgcaagaagaucuccgaggaguccggcgagaccgccaagcgccgcuccgcccgcguccgcaacaccaagugcaagaaggaggagaaggucgacuuccaggagcuccucaugaaguuccuccccucccgccuccgcaagcucgaccccgaggaggaggacgacuccuucaacaacuacgagguccaguccgaggccaagcucgaguccuuccccuccaucggcccccagcgccucuccuucgacuccgccaccuucauggaguccgagaagcaggacguccacgaguuccuccucgagaaccucaccaacggcggcauccucgagcucaugaugcgcuaccucaaggccaugggccacaaguuccucguccgcuggccccccggccucgccgaggucguccucuccgucuaccacuccuggcgccgccacuccaccucccuccccaacccccuccuccgcgacugcuccaacaagcacaucaaggacaugaugcucaugucccucuccugcauggagcuccagcucgaccaguggcuccucaccaagggccgcuccuccgccgucuccccccgcaacugccccgccggcauggucaacggccgcuucggccccgacuuccccggcacccacugccucggcgaccuccuccagcucuccuucgccuccucccagcgcgaccucuucgaggacggcuggcucgaguucgucguccgcgucuacuggcucaaggcccgcuuccucgcccuccagggcgacauggagcaggcccucgagaacuacgacaucugcaccgagaugcuccaguccuccaccgccauccaggucgaggccggcgccgagcgccgcgacaucgucauccgccuccccaaccuccacaacgacuccgucgucucccucgaggagaucgacaagaaccucaagucccucgagcgcugccagucccucgaggagauccagcgccucuacgaggccggcgacuacaaggccgucguccaccuccuccgccccacccucugcaccuccggcuucgaccgcgccaagcaccucgaguucaugaccuccauccccgagcgccccgcccagcuccuccuccuccaggacucccuccuccgccucaaggacuaccgccagugcuucgagugcuccgacgucgcccucaacgaggccguccagcagauggucaacuccggcgaggccgccgccaaggaggagugggucgccaccgucacccagcuccucaugggcaucgagcaggcccucuccgccgacuccuccggcuccauccucaaggucuccuccuccaccaccggccucguccgccucaccaacaaccucauccaggucaucgacugcuccauggccguccaggaggaggccaaggagccccacgucuccuccguccuccccuggaucauccuccaccgcaucaucuggcaggaggaggacaccuuccacucccucugccaccagcagcagcuccagaaccccgccgaggagggcauguccgagacccccaugcuccccuccucccucaugcuccucaacaccgcccacgaguaccucggccgccgcuccuggugcugcaacuccgacggcgcccuccuccgcuucuacguccgcguccuccagaaggagcucgccgccuccaccuccgaggacacccaccccuacaaggaggagcucgagaccgcccucgagcagugcuucuacugccucuacuccuuccccuccaagaaguccaaggcccgcuaccucgaggagcacuccgcccagcaggucgaccucaucugggaggacgcccucuucauguucgaguacuucaagcccaagacccuccccgaguucgacuccuacaagaccuccaccgucuccgccgaccucgccaaccuccucaagcgcaucgccaccaucgucccccgcaccgagcgccccgcccucucccucgacaaggucuccgccuacaucgagggcaccuccaccgagguccccugccuccccgagggcgccgaccccuccccccccgucgucaacgagcucuacuaccuccucgccgacuaccacuucaagaacaaggagcaguccaaggccaucaaguucuacaugcacgacaucugcaucugccccaaccgcuucgacuccugggccggcauggcccucgcccgcgccucccgcauccaggacaagcucaacuccaacgagcucaaguccgacggccccaucuggaagcacgccacccccguccucaacugcuuccgccgcgcccucgagaucgacuccuccaaccucucccucuggaucgaguacggcaccauguccuacgcccuccacuccuucgccucccgccagcucaagcaguggcgcggcgagcucccccccgagcucguccagcagauggagggccgccgcgacuccaugcucgagaccgccaagcacugcuucaccuccgccgcccgcugcgagggcgacggcgacgaggaggaguggcucauccacuacaugcucggcaaggucgccgagaagcagcagcagccccccaccgucuaccuccuccacuaccgccaggccggccacuaccuccacgaggaggccgcccgcuaccccaagaagauccacuaccacaacccccccgagcucgccauggaggcccucgaggucuacuuccgccuccacgccuccauccucaagcuccucggcaagcccgacuccggcgucggcgccgagguccucgucaacuucaugaaggaggccgccgagggccccuucgcccgcggcgaggagaagaacacccccaaggccuccgagaaggagaaggccugccucgucgacgaggacucccacuccuccgccggcacccuccccggccccggcgccucccuccccuccuccuccggccccggccucaccuccccccccuacaccgccacccccaucgaccacgacuacgucaagugcaagaagccccaccagcaggccacccccgacgaccgcucccaggacuccaccgccgucgcccucuccgacuccuccuccacccaggacuucuucaacgagcccaccucccuccucgagggcucccgcaaguccuacaccgagaagcgccuccccauccucuccucccaggccggcgccaccggcaaggaccuccagggcgccaccgaggagcgcggcaagaacgaggagucccucgaguccaccgagggcuuccgcgccgccgagcagggcguccagaagcccgccgccgagacccccgccuccgccugcauccccggcaagcccuccgccuccacccccacccucugggacggcaagaagcgcggcgaccuccccggcgagcccgucgccuucccccagggccuccccgccggcgccgaggagcagcgccaguuccucaccgagcagugcaucgccuccuuccgccucugccucucccgcuucccccagcacuacaagucccucuaccgccucgccuuccucuacaccuacuccaagacccaccgcaaccuccagugggcccgcgacguccuccucggcuccuccauccccuggcagcagcuccagcacaugcccgcccagggccucuucugcgagcgcaacaagaccaacuucuucaacggcaucuggcgcauccccgucgacgagaucgaccgccccggcuccuucgccuggcacaugaaccgcuccaucguccuccuccucaagguccucgcccagcuccgcgaccacuccacccuccucaaggucuccuccaugcuccagcgcacccccgaccagggcaagaaguaccuccgcgacgccgaccgccagguccucgcccagcgcgccuucauccucaccgucaagguccucgaggacacccucuccgagcucgccgagggcuccgagcgccccggccccaaggucugcggccuccccggcgcccgcaugaccaccgacgucucccacaaggccucccccgaggacggccaggagggccucccccagcccaagaagcccccccucgccgacggcuccggccccggccccgagcccggcggcaaggucggccuccucaaccaccgccccgucgccauggacgccggcgacuccgccgaccaguccggcgagcgcaaggacaaggaguccccccgcgccggccccaccgagcccauggacaccuccgaggccaccgucugccacuccgaccucgagcgcacccccccccuccuccccggccgccccgcccgcgaccgcggccccgagucccgccccaccgagcucucccucgaggagcucuccaucuccgcccgccagcagcccaccccccucacccccgcccagcccgcccccgcccccgcccccgccaccaccaccggcacccgcgccggcggccaccccgaggagccccucucccgccucucccgcaagcgcaagcuccucgaggacaccgaguccggcaagacccuccuccucgacgccuaccgcgucuggcagcagggccagaagggcgucgccuacgaccucggccgcgucgagcgcaucauguccgagaccuacaugcucaucaagcaggucgacgaggaggccgcccucgagcaggccgucaaguucugccagguccaccucggcgccgccgcccagcgccaggccuccggcgacacccccaccacccccaagcaccccaaggacucccgcgagaacuucuuccccgucaccgucguccccaccgcccccgaccccguccccgccgacuccguccagcgccccuccgacgcccacaccaagccccgccccgcccucgccgccgccaccaccaucaucaccugcccccccuccgccuccgccuccacccucgaccaguccaaggaccccggccccccccgcccccaccgccccgaggccacccccuccauggccucccucggccccgagggcgaggagcucgcccgcgucgccgagggcaccuccuuccccccccaggagccccgccacuccccccaggucaagauggcccccaccuccucccccgccgagccccacugcuggcccgccgaggccgcccucggcaccggcgccgagcccaccugcucccaggagggcaagcuccgccccgagccccgccgcgacggcgaggcccaggaggccgccuccgagacccagccccucuccuccccccccaccgccgccuccuccaaggcccccuccuccggcuccgcccagccccccgagggccaccccggcaagcccgagcccucccgcgccaagucccgcccccuccccaacaugcccaagcucgucauccccuccgccgccaccaaguucccccccgagaucaccgucaccccccccacccccacccuccucucccccaagggcuccaucuccgaggagaccaagcagaagcucaaguccgccauccucuccgcccaguccgccgccaacguccgcaaggagucccucugccagcccgcccucgagguccucgagaccuccucccaggaguccucccucgaguccgagaccgacgaggacgacgacuacauggacaucuga

SEQ ID NO: 40658 - RNA, 1902 nt, Artificial Sequence
  derived and/or modified sequence opt2 from CABLES1__Homo_sapiens__NP_001094089
auggccgccgccgccgccgccgccaccaccgccgccugcuccuccggcuccgccggcaccgacgccgccggcgccuccggccuccagcagccccccccccagccccagccccagcccgccgccgccgcccccgcccagcccccccccgagcccccccgcaagccccgcauggacccccgccgccgccaggccgcccucuccuuccucaccaacaucucccucgacggccgccuccccccccaggacgccgaguggggcggcggcgaggagggcggcgccgccaagcccggcgccggcggcgccugcggcgcccgcacccgcuucucccuccucgccgccgccgagcgcggcggcugcaucgcccucgccgcccccggcacccccgccgccggccucgccgccggcuccggccccugccucccccagcccuccucccuccccccccucauccccggcggccacgccaccgucuccggccccggcgucgcccgcggcuucgccuccccccucggcgccggccgcgccuccggcgagcaguggcagcccccccgccccgccccccucgccgccugcgcccagcuccagcuccucgacggcuccggcgccgccggccaggaggagcucgaggaggacgacgccuucaucuccguccagguccccgccgccgccuuccucggcuccggcacccccggcuccggcuccggcucccgcggccgccucaacuccuucacccagggcauccuccccaucgccuucucccgccccaccucccagaacuacugcucccucgagcagcccggccagggcggcuccaccuccgccuucgagcagcuccagcgcucccgccgccgccucaucucccagcgcuccucccucgagacccucgaggacaucgaggagaacgccccccuccgccgcugccgcacccucuccggcuccccccgccccaagaacuucaagaagauccacuucaucaagaacaugcgccagcacgacacccgcaacggccgcaucguccucaucuccggccgccgcuccuucugcuccaucuucuccguccuccccuaccgcgacuccacccaggucggcgaccucaagcucgacggcggccgccaguccaccggcgccgucucccucaaggagaucaucggccucgagggcgucgagcucggcgccgacggcaagaccgucuccuacacccaguuccuccuccccaccaacgccuucggcgcccgccgcaacaccaucgacuccaccuccuccuucucccaguuccgcaaccucucccaccgcucccucuccaucggccgcgccuccggcacccagggcucccucgacaccggcuccgaccucggcgacuucauggacuacgaccccaaccuccucgacgacccccaguggcccugcggcaagcacaagcgcguccucaucuuccccuccuacaugaccaccgucaucgacuacgucaagcccuccgaccucaagaaggacaugaacgagaccuucaaggagaaguucccccacaucaagcucacccucuccaagauccgcucccucaagcgcgagaugcgcaagcucgcccaggaggacugcggccucgaggagcccaccgucgccauggccuucgucuacuucgagaagcucgcccucaagggcaagcucaacaagcagaaccgcaagcucugcgccggcgccugcguccuccucgccgccaagaucggcuccgaccucaagaagcacgaggucaagcaccucaucgacaagcucgaggagaaguuccgccucaaccgccgcgagcucaucgccuucgaguuccccguccucgucgcccucgaguucgcccuccaccuccccgagcacgaggucaugccccacuaccgccgccucguccaguccuccuga

SEQ ID NO: 40659 - RNA, 663 nt, Artificial Sequence
  derived and/or modified sequence opt2 from CABP2__Homo_sapiens__NP_057450
augggcaacugcgccaagcgccccuggcgccgcggccccaaggacccccuccaguggcucggcucccccccccgcggcuccugccccucccccuccuccucccccaaggagcagggcgaccccgcccccggcguccagggcuacuccguccucaacucccucgucggccccgccugcaucuuccuccgccccuccaucgccgccacccagcucgaccgcgagcuccgccccgaggagaucgaggagcuccaggucgccuuccaggaguucgaccgcgaccgcgacggcuacaucggcugccgcgagcucggcgccugcaugcgcacccucggcuacaugcccaccgagauggagcucaucgagaucucccagcagaucuccggcggcaaggucgacuucgaggacuucgucgagcucaugggccccaagcuccucgccgagaccgccgacaugaucggcguccgcgagcuccgcgacgccuuccgcgaguucgacaccaacggcgacggccgcaucuccgucggcgagcuccgcgccgcccucaaggcccuccucggcgagcgccucucccagcgcgaggucgacgagauccuccaggacgucgaccucaacggcgacggccucgucgacuucgaggaguucguccgcaugaugucccgcuga

SEQ ID NO: 40660 - RNA, 513 nt, Artificial Sequence
  derived and/or modified sequence opt2 from CABP4__Homo_sapiens__NP_001287824
augaccgagcccuggcucgcccucggcaccuccuggacccucccccuccaggaccgcgagcucggccccgaggagcucgacgagcuccaggccgccuucgaggaguucgacaccgaccgcgacggcuacaucucccaccgcgagcucggcgacugcaugcgcacccucggcuacaugcccaccgagauggagcuccucgaggucucccagcacaucaagaugcgcaugggcggccgcgucgacuucgaggaguucgucgagcucaucggccccaagcuccgcgaggagaccgcccacaugcucggcguccgcgagcuccgcaucgccuuccgcgaguucgaccgcgaccgcgacggccgcaucaccgucgccgagcuccgcgaggccguccccgcccuccucggcgagccccucgccggccccgagcucgacgagaugcuccgcgaggucgaccucaacggcgacggcaccgucgacuucgacgaguucgucaugaugcucucccgccacuga

SEQ ID NO: 40661 - RNA, 1188 nt, Artificial Sequence
  derived and/or modified sequence opt2 from CABS1__Homo_sapiens__NP_149113
auggccgaggacggccuccccaagaucuacucccacccccccaccgaguccuccaagacccccaccgccgccaccaucuucuucggcgccgacaacgccauccccaaguccgagaccaccaucaccuccgagggcgaccacgucaccuccgucaacgaguacaugcucgaguccgacuucuccaccaccaccgacaacaagcucaccgccaagaaggagaagcucaaguccgaggacgacaugggcaccgacuucaucaaguccaccacccaccuccagaaggagaucaccucccucaccggcaccaccaacuccaucacccgcgacuccaucaccgagcacuucaugcccgucaagaucggcaacaucuccucccccgucaccaccgucucccucaucgacuucuccaccgacaucgccaaggaggacauccuccucgccaccaucgacaccggcgacgccgagaucuccaucaccuccgaggucuccggcacccucaaggacuccuccgccggcgucgccgacgcccccgccuucccccgcaagaaggacgaggccgacauguccaacuacaacuccuccaucaaguccaacguccccgccgacgaggccguccaggucaccgacuccaccauccccgaggccgagaucccccccgcccccgaggaguccuucaccaccauccccgacaucaccgcccucgaggaggagaagaucaccgagaucgaccucuccguccucgaggacgacaccuccgccgucgccacccucaccgacuccgacgagaaguucaucaccgucuucgagcucaccaccuccgccgagaaggacaaggacaagcgcgaggacacccuccucaccgacgaggagaccaccgagggcgccuccaucuggauggagcgcgacaccgccaacgaggccgagacccacuccguccuccucaccgccgucgagucccgcuacgacuucgucguccccgccuccaucgccaccaaccucgucgaggaguccuccaccgaggaggaccucuccgagaccgacaacaccgagaccguccccaagaucaccgagcccuucuccggcaccaccuccguccucgacacccccgacuacaaggaggacaccuccaccaccgagaccgacaucuucgagcuccucaaggaggagcccgacgaguucaugaucuga

SEQ ID NO: 40662 - RNA, 1482 nt, Artificial Sequence
  derived and/or modified sequence opt2 from CABYR__Homo_sapiens__NP_036321
augaucuccuccaagccccgccucgucguccccuacggccucaagacccuccucgagggcaucucccgcgccguccucaagaccaaccccuccaacaucaaccaguucgccgccgccuacuuccaggagcucaccauguaccgcggcaacaccaccauggacaucaaggaccucgucaagcaguuccaccagaucaaggucgagaagugguccgagggcaccaccccccagaagaagcucgagugccucaaggagcccggcaagaccuccgucgaguccaagguccccacccagauggagaaguccaccgacaccgacgaggacaacgucacccgcaccgaguacuccgacaagaccacccaguuccccuccgucuacgccguccccggcaccgagcagaccgaggccgucggcggccucuccuccaagcccgccacccccaagaccaccaccccccccuccucccccccccccaccgccgucucccccgaguucgccuacguccccgccgaccccgcccagcucgccgcccagaugcucggcaaggucuccuccauccacuccgaccaguccgacguccucauggucgacgucgccaccuccaugcccgucgucaucaaggagguccccuccuccgaggccgccgaggacgucauggucgccgccccccucgucugcuccggcaagguccucgagguccaggucgucaaccagaccuccguccacgucgaccucggcucccagcccaaggagaacgaggccgagcccuccaccgccuccuccgucccccuccaggacgagcaggagccccccgccuacgaccaggcccccgaggucacccuccaggccgacaucgaggucauguccaccguccacaucuccuccgucuacaacgacguccccgucaccgagggcgucgucuacaucgagcagcuccccgagcagaucgucauccccuucaccgaccaggucgccugccucaaggagaacgagcaguccaaggagaacgagcaguccccccgcgucucccccaaguccgucgucgagaagaccaccuccggcauguccaagaaguccgucgaguccgucaagcucgcccagcucgaggagaacgccaaguacuccuccgucuacauggaggccgaggccaccgcccuccucuccgacaccucccucaagggccagcccgagguccccgcccagcuccucgacgccgagggcgccaucaagaucggcuccgagaagucccuccaccucgaggucgagaucaccuccaucgucuccgacaacaccggccaggaggaguccggcgagaacuccgucccccaggagauggagggcaagcccguccucuccggcgaggccgccgaggccguccacuccggcaccuccgucaaguccuccuccggccccuucccccccgcccccgagggccucaccgcccccgagaucgagcccgagggcgaguccaccgccgaguga

SEQ ID NO: 40663 - RNA, 6786 nt, Artificial Sequence
  derived and/or modified sequence opt2 from CACNA1A__Homo_sapiens__NP_001120693
auggcccgcuucggcgacgagaugcccgcccgcuacggcggcggcggcuccggcgccgccgccggcgucgucgucggcuccggcggcggccgcggcgccggcggcucccgccagggcggccagcccggcgcccagcgcauguacaagcaguccauggcccagcgcgcccgcaccauggcccucuacaaccccauccccguccgccagaacugccucaccgucaaccgcucccucuuccucuucuccgaggacaacgucguccgcaaguacgccaagaagaucaccgaguggccccccuucgaguacaugauccucgccaccaucaucgccaacugcaucguccucgcccucgagcagcaccuccccgacgacgacaagacccccauguccgagcgccucgacgacaccgagcccuacuucaucggcaucuucugcuucgaggccggcaucaagaucaucgcccucggcuucgccuuccacaagggcuccuaccuccgcaacggcuggaacgucauggacuucgucgucguccucaccggcauccucgccaccgucggcaccgaguucgaccuccgcacccuccgcgccguccgcguccuccgcccccucaagcucgucuccggcauccccucccuccaggucguccucaaguccaucaugaaggccaugaucccccuccuccagaucggccuccuccucuucuucgccauccucaucuucgccaucaucggccucgaguucuacaugggcaaguuccacaccaccugcuucgaggagggcaccgacgacauccagggcgagucccccgcccccugcggcaccgaggagcccgcccgcaccugccccaacggcaccaagugccagcccuacugggagggccccaacaacggcaucacccaguucgacaacauccucuucgccguccucaccgucuuccagugcaucaccauggagggcuggaccgaccuccucuacaacuccaacgacgccuccggcaacaccuggaacuggcucuacuucaucccccucaucaucaucggcuccuucuucaugcucaaccucguccucggcguccucuccggcgaguucgccaaggagcgcgagcgcgucgagaaccgccgcgccuuccucaagcuccgccgccagcagcagaucgagcgcgagcucaacggcuacauggaguggaucuccaaggccgaggaggucauccucgccgaggacgagaccgacggcgagcagcgccaccccuucgacggcgcccuccgccgcaccaccaucaagaaguccaagaccgaccuccucaaccccgaggaggccgaggaccagcucgccgacaucgccuccgucggcucccccuucgcccgcgccuccaucaaguccgccaagcucgagaacuccaccuucuuccacaagaaggagcgccgcaugcgcuucuacauccgccgcauggucaagacccaggccuucuacuggaccguccucucccucgucgcccucaacacccucugcgucgccaucguccacuacaaccagcccgaguggcucuccgacuuccucuacuacgccgaguucaucuuccucggccucuucauguccgagauguucaucaagauguacggccucggcacccgccccuacuuccacuccuccuucaacugcuucgacugcggcgucaucaucggcuccaucuucgaggucaucugggccgucaucaagcccggcaccuccuucggcaucuccguccuccgcgcccuccgccuccuccgcaucuucaaggucaccaaguacugggccucccuccgcaaccucgucgucucccuccucaacuccaugaaguccaucaucucccuccucuuccuccucuuccucuucaucgucgucuucgcccuccucggcaugcagcucuucggcggccaguucaacuucgacgagggcaccccccccaccaacuucgacaccuuccccgccgccaucaugaccgucuuccagauccucaccggcgaggacuggaacgaggucauguacgacggcaucaagucccagggcggcguccagggcggcauggucuucuccaucuacuucaucguccucacccucuucggcaacuacacccuccucaacgucuuccucgccaucgccgucgacaaccucgccaacgcccaggagcucaccaaggacgagcaggaggaggaggaggccgccaaccagaagcucgcccuccagaaggccaaggaggucgccgaggucuccccccucuccgccgccaacauguccaucgccgucaaggagcagcagaagaaccagaagcccgccaaguccgucugggagcagcgcaccuccgagaugcgcaagcagaaccuccucgccucccgcgaggcccucuacaacgagauggaccccgacgagcgcuggaaggccgccuacacccgccaccuccgccccgacaugaagacccaccucgaccgcccccucgucgucgacccccaggagaaccgcaacaacaacaccaacaagucccgcgccgccgagcccaccgucgaccagcgccucggccagcagcgcgccgaggacuuccuccgcaagcaggcccgcuaccacgaccgcgcccgcgaccccuccggcuccgccggccucgacgcccgccgccccugggccggcucccaggaggccgagcucucccgcgagggccccuacggccgcgaguccgaccaccacgcccgcgagggcucccucgagcagcccggcuucugggagggcgaggccgagcgcggcaaggccggcgacccccaccgccgccacguccaccgccagggcggcucccgcgagucccgcuccggcuccccccgcaccggcgccgacggcgagcaccgccgccaccgcgcccaccgccgccccggcgaggagggccccgaggacaaggccgagcgccgcgcccgccaccgcgagggcucccgccccgcccgcggcggcgagggcgagggcgagggccccgacggcggcgagcgccgccgccgccaccgccacggcgcccccgccaccuacgagggcgacgcccgccgcgaggacaaggagcgccgccaccgccgccgcaaggagaaccagggcuccggcguccccgucuccggccccaaccucuccaccacccgccccauccagcaggaccucggccgccaggaccccccccucgccgaggacaucgacaacaugaagaacaacaagcucgccaccgccgaguccgccgccccccacggcucccucggccacgccggccucccccagucccccgccaagaugggcaacuccaccgaccccggccccaugcucgccauccccgccauggccaccaacccccagaacgccgccucccgccgcacccccaacaaccccggcaaccccuccaaccccggcccccccaagacccccgagaacucccucaucgucaccaaccccuccggcacccagaccaacuccgccaagaccgcccgcaagcccgaccacaccaccgucgacaucccccccgccugcccccccccccucaaccacaccgucguccaggucaacaagaacgccaaccccgacccccuccccaagaaggaggaggagaagaaggaggaggaggaggacgaccgcggcgaggacggccccaagcccaugccccccuacuccuccauguucauccucuccaccaccaacccccuccgccgccucugccacuacauccucaaccuccgcuacuucgagaugugcauccucauggucaucgccauguccuccaucgcccucgccgccgaggaccccguccagcccaacgccccccgcaacaacguccuccgcuacuucgacuacgucuucaccggcgucuucaccuucgagauggucaucaagaugaucgaccucggccucguccuccaccagggcgccuacuuccgcgaccucuggaacauccucgacuucaucgucgucuccggcgcccucgucgccuucgccuucaccggcaacuccaagggcaaggacaucaacaccaucaagucccuccgcguccuccgcguccuccgcccccucaagaccaucaagcgccuccccaagcucaaggccgucuucgacugcgucgucaacucccucaagaacgucuucaacauccucaucgucuacaugcucuucauguucaucuucgccgucgucgccguccagcucuucaagggcaaguucuuccacugcaccgacgaguccaaggaguucgagaaggacugccgcggcaaguaccuccucuacgagaagaacgaggucaaggcccgcgaccgcgaguggaagaaguacgaguuccacuacgacaacguccucugggcccuccucacccucuucaccgucuccaccggcgagggcuggccccagguccucaagcacuccgucgacgccaccuucgagaaccagggccccucccccggcuaccgcauggagauguccaucuucuacgucgucuacuucgucgucuuccccuucuucuucgucaacaucuucgucgcccucaucaucaucaccuuccaggagcagggcgacaagaugauggaggaguacucccucgagaagaacgagcgcgccugcaucgacuucgccaucuccgccaagccccucacccgccacaugccccagaacaagcaguccuuccaguaccgcauguggcaguucgucgucuccccccccuucgaguacaccaucauggccaugaucgcccucaacaccaucguccucaugaugaaguucuacggcgccuccgucgccuacgagaacgcccuccgcgucuucaacaucgucuucaccucccucuucucccucgagugcguccucaaggucauggccuucggcauccucaacuacuuccgcgacgccuggaacaucuucgacuucgucaccguccucggcuccaucaccgacauccucgucaccgaguucggcaacaacuucaucaaccucuccuuccuccgccucuuccgcgccgcccgccucaucaagcuccuccgccagggcuacaccauccgcauccuccucuggaccuucguccaguccuucaaggcccuccccuacgucugccuccucaucgccaugcucuucuucaucuacgccaucaucggcaugcaggucuucggcaacaucggcaucgacgucgaggacgaggacuccgacgaggacgaguuccagaucaccgagcacaacaacuuccgcaccuucuuccaggcccucaugcuccucuuccgcuccgccaccggcgaggccuggcacaacaucaugcucuccugccucuccggcaagcccugcgacaagaacuccggcauccucacccgcgagugcggcaacgaguucgccuacuucuacuucgucuccuucaucuuccucugcuccuuccucaugcucaaccucuucgucgccgucaucauggacaacuucgaguaccucacccgcgacuccuccauccucggcccccaccaccucgacgaguacguccgcgucugggccgaguacgaccccgccgccugcggccgcauccacuacaaggacauguacucccuccuccgcgucaucucccccccccucggccucggcaagaagugcccccaccgcgucgccugcaagcgccuccuccgcauggaccuccccgucgccgacgacaacaccguccacuucaacuccacccucauggcccucauccgcaccgcccucgacaucaagaucgccaagggcggcgccgacaagcagcagauggacgccgagcuccgcaaggagaugauggccaucuggcccaaccucucccagaagacccucgaccuccucgucaccccccacaaguccaccgaccucaccgucggcaagaucuacgccgccaugaugaucauggaguacuaccgccaguccaaggccaagaagcuccaggccaugcgcgaggagcaggaccgcaccccccucauguuccagcgcauggagccccccucccccacccaggagggcggccccggccagaacgcccuccccuccacccagcucgaccccggcggcgcccucauggcccacgaguccggccucaaggagucccccuccugggucacccagcgcgcccaggagauguuccagaagaccggcaccuggucccccgagcagggcccccccaccgacaugcccaacucccagcccaacucccaguccgucgagaugcgcgagaugggccgcgacggcuacuccgacuccgagcacuaccuccccauggagggccagggccgcgccgccuccaugccccgccuccccgccgagaaccagcgccgccgcggccgcccccgcggcaacaaccucuccaccaucuccgacaccucccccaugaagcgcuccgccuccguccucggccccaaggcccgccgccucgacgacuacucccucgagcgcgucccccccgaggagaaccagcgccaccaccagcgccgccgcgaccgcucccaccgcgccuccgagcgcucccucggccgcuacaccgacgucgacaccggccucggcaccgaccucuccaugaccacccaguccggcgaccuccccuccaaggagcgcgaccaggagcgcggccgccccaaggaccgcaagcaccgccagcaccaccaccaccaccaccaccaccaccacccccccccccccgacaaggaccgcuacgcccaggagcgccccgaccacggccgcgcccgcgcccgcgaccagcgcuggucccgcucccccuccgagggccgcgagcacauggcccaccgccaguga

SEQ ID NO: 40664 - RNA, 7020 nt, Artificial Sequence
  derived and/or modified sequence opt2 from CACNA1B__Homo_sapiens__NP_000709
augguccgcuucggcgacgagcucggcggccgcuacggcggccccggcggcggcgagcgcgcccgcggcggcggcgccggcggcgccggcggccccggccccggcggccuccagcccggccagcgcguccucuacaagcaguccaucgcccagcgcgcccgcaccauggcccucuacaaccccauccccgucaagcagaacugcuucaccgucaaccgcucccucuucgucuucuccgaggacaacgucguccgcaaguacgccaagcgcaucaccgaguggccccccuucgaguacaugauccucgccaccaucaucgccaacugcaucguccucgcccucgagcagcaccuccccgacggcgacaagacccccauguccgagcgccucgacgacaccgagcccuacuucaucggcaucuucugcuucgaggccggcaucaagaucaucgcccucggcuucgucuuccacaagggcuccuaccuccgcaacggcuggaacgucauggacuucgucgucguccucaccggcauccucgccaccgccggcaccgacuucgaccuccgcacccuccgcgccguccgcguccuccgcccccucaagcucgucuccggcauccccucccuccaggucguccucaaguccaucaugaaggccauggucccccuccuccagaucggccuccuccucuucuucgccauccucauguucgccaucaucggccucgaguucuacaugggcaaguuccacaaggccugcuuccccaacuccaccgacgccgagcccgucggcgacuuccccugcggcaaggaggcccccgcccgccucugcgagggcgacaccgagugccgcgaguacuggcccggccccaacuucggcaucaccaacuucgacaacauccucuucgccauccucaccgucuuccagugcaucaccauggagggcuggaccgacauccucuacaacaccaacgacgccgccggcaacaccuggaacuggcucuacuucaucccccucaucaucaucggcuccuucuucaugcucaaccucguccucggcguccucuccggcgaguucgccaaggagcgcgagcgcgucgagaaccgccgcgccuuccucaagcuccgccgccagcagcagaucgagcgcgagcucaacggcuaccucgaguggaucuucaaggccgaggaggucaugcucgccgaggaggaccgcaacgccgaggagaaguccccccucgacguccucaagcgcgccgccaccaagaagucccgcaacgaccucauccacgccgaggagggcgaggaccgcuucgccgaccucugcgccgucggcucccccuucgcccgcgccucccucaaguccggcaagaccgaguccuccuccuacuuccgccgcaaggagaagauguuccgcuucuucauccgccgcauggucaaggcccaguccuucuacugggucguccucugcgucgucgcccucaacacccucugcgucgccaugguccacuacaaccagccccgccgccucaccaccacccucuacuucgccgaguucgucuuccucggccucuuccucaccgagaugucccucaagauguacggccucggcccccgcuccuacuuccgcuccuccuucaacugcuucgacuucggcgucaucgucggcuccgucuucgaggucgucugggccgccaucaagcccggcuccuccuucggcaucuccguccuccgcgcccuccgccuccuccgcaucuucaaggucaccaaguacugguccucccuccgcaaccucgucgucucccuccucaacuccaugaaguccaucaucucccuccucuuccuccucuuccucuucaucgucgucuucgcccuccucggcaugcagcucuucggcggccaguucaacuuccaggacgagacccccaccaccaacuucgacaccuuccccgccgccauccucaccgucuuccagauccucaccggcgaggacuggaacgccgucauguaccacggcaucgagucccagggcggcgucuccaagggcauguucuccuccuucuacuucaucguccucacccucuucggcaacuacacccuccucaacgucuuccucgccaucgccgucgacaaccucgccaacgcccaggagcucaccaaggacgaggaggagauggaggaggccgccaaccagaagcucgcccuccagaaggccaaggaggucgccgaggucucccccauguccgccgccaacaucuccaucgccgcccgccagcagaacuccgccaaggcccgcuccgucugggagcagcgcgccucccagcuccgccuccagaaccuccgcgccuccugcgaggcccucuacuccgagauggaccccgaggagcgccuccgcuucgccaccacccgccaccuccgccccgacaugaagacccaccucgaccgcccccucgucgucgagcucggccgcgacggcgcccgcggccccgucggcggcaaggcccgccccgaggccgccgaggcccccgagggcgucgaccccccccgccgccaccaccgccaccgcgacaaggacaagacccccgccgccggcgaccaggaccgcgccgaggcccccaaggccgaguccggcgagcccggcgcccgcgaggagcgcccccgcccccaccgcucccacuccaaggaggccgccggcccccccgaggcccgcuccgagcgcggccgcggccccggccccgagggcggccgccgccaccaccgccgcggcucccccgaggaggccgccgagcgcgagccccgccgccaccgcgcccaccgccaccaggaccccuccaaggagugcgccggcgccaagggcgagcgccgcgcccgccaccgcggcggcccccgcgccggcccccgcgaggccgaguccggcgaggagcccgcccgccgccaccgcgcccgccacaaggcccagcccgcccacgaggccgucgagaaggagaccaccgagaaggaggccaccgagaaggaggccgagaucgucgaggccgacaaggagaaggagcuccgcaaccaccagccccgcgagccccacugcgaccucgagaccuccggcaccgucaccgucggccccaugcacacccuccccuccaccugccuccagaaggucgaggagcagcccgaggacgccgacaaccagcgcaacgucacccgcaugggcucccagccccccgaccccaacaccaucguccacauccccgucaugcucaccggcccccucggcgaggccaccgucguccccuccggcaacgucgaccucgagucccaggccgagggcaagaaggaggucgaggccgacgacgucaugcgcuccggcccccgccccaucguccccuacuccuccauguucugccucucccccaccaaccuccuccgccgcuucugccacuacaucgucaccaugcgcuacuucgaggucgucauccucgucgucaucgcccucuccuccaucgcccucgccgccgaggaccccguccgcaccgacuccccccgcaacaacgcccucaaguaccucgacuacaucuucaccggcgucuucaccuucgagauggucaucaagaugaucgaccucggccuccuccuccaccccggcgccuacuuccgcgaccucuggaacauccucgacuucaucgucgucuccggcgcccucgucgccuucgccuucuccggcuccaagggcaaggacaucaacaccaucaagucccuccgcguccuccgcguccuccgcccccucaagaccaucaagcgccuccccaagcucaaggccgucuucgacugcgucgucaacucccucaagaacguccucaacauccucaucgucuacaugcucuucauguucaucuucgccgucaucgccguccagcucuucaagggcaaguucuucuacugcaccgacgaguccaaggagcucgagcgcgacugccgcggccaguaccucgacuacgagaaggaggaggucgaggcccagccccgccaguggaagaaguacgacuuccacuacgacaacguccucugggcccuccucacccucuucaccgucuccaccggcgagggcuggcccaugguccucaagcacuccgucgacgccaccuacgaggagcagggccccucccccggcuaccgcauggagcucuccaucuucuacgucgucuacuucgucgucuuccccuucuucuucgucaacaucuucgucgcccucaucaucaucaccuuccaggagcagggcgacaaggucauguccgagugcucccucgagaagaacgagcgcgccugcaucgacuucgccaucuccgccaagccccucacccgcuacaugccccagaaccgccaguccuuccaguacaagaccuggaccuucgucgucuccccccccuucgaguacuucaucauggccaugaucgcccucaacaccgucguccucaugaugaaguucuacgacgcccccuacgaguacgagcucaugcucaagugccucaacaucgucuucaccuccauguucuccauggagugcguccucaagaucaucgccuucggcguccucaacuacuuccgcgacgccuggaacgucuucgacuucgucaccguccucggcuccaucaccgacauccucgucaccgagaucgccgagaccaacaacuucaucaaccucuccuuccuccgccucuuccgcgccgcccgccucaucaagcuccuccgccagggcuacaccauccgcauccuccucuggaccuucguccaguccuucaaggcccuccccuacgucugccuccucaucgccaugcucuucuucaucuacgccaucaucggcaugcaggucuucggcaacaucgcccucgacgacgacaccuccaucaaccgccacaacaacuuccgcaccuuccuccaggcccucaugcuccucuuccgcuccgccaccggcgaggccuggcacgagaucaugcucuccugccucuccaaccaggccugcgacgagcaggccaacgccaccgagugcggcuccgacuucgccuacuucuacuucgucuccuucaucuuccucugcuccuuccucaugcucaaccucuucgucgccgucaucauggacaacuucgaguaccucacccgcgacuccuccauccucggcccccaccaccucgacgaguucauccgcgucugggccgaguacgaccccgccgccugcggccgcaucuccuacaacgacauguucgagaugcucaagcacaugucccccccccucggccucggcaagaagugccccgcccgcgucgccuacaagcgccucguccgcaugaacaugcccaucuccaacgaggacaugaccguccacuucaccuccacccucauggcccucauccgcaccgcccucgagaucaagcucgcccccgccggcaccaagcagcaccagugcgacgccgagcuccgcaaggagaucuccgucgucugggccaaccucccccagaagacccucgaccuccucguccccccccacaagcccgacgagaugaccgucggcaaggucuacgccgcccucaugaucuucgacuucuacaagcagaacaagaccacccgcgaccagaugcagcaggcccccggcggccucucccagaugggccccgucucccucuuccacccccucaaggccacccucgagcagacccagcccgccguccuccgcggcgcccgcgucuuccuccgccagaaguccuccaccucccucuccaacggcggcgccauccagaaccaggaguccggcaucaaggaguccgucuccuggggcacccagcgcacccaggacgccccccacgaggcccgccccccccucgagcgcggccacuccaccgagauccccgucggccgcuccggcgcccucgccgucgacguccagaugcaguccaucacccgccgcggccccgacggcgagccccagcccggccucgagucccagggccgcgccgccuccaugccccgccucgccgccgagacccagcccgucaccgacgccucccccaugaagcgcuccaucuccacccucgcccagcgcccccgcggcacccaccucugcuccaccacccccgaccgccccccccccucccaggccuccucccaccaccaccaccaccgcugccaccgccgccgcgaccgcaagcagcgcucccucgagaagggccccucccucuccgccgacauggacggcgcccccuccuccgccgucggccccggccucccccccggcgagggccccaccggcugccgccgcgagcgcgagcgccgccaggagcgcggccgcucccaggagcgccgccagcccuccuccuccuccuccgagaagcagcgcuucuacuccugcgaccgcuucggcggccgcgagccccccaagcccaagcccucccucuccucccaccccaccucccccaccgccggccaggagcccggcccccacccccagggcuccggcuccgucaacggcuccccccuccucuccaccuccggcgccuccacccccggccgcggcggccgccgccagcucccccagaccccccucaccccccgccccuccaucaccuacaagaccgccaacuccucccccauccacuucgccggcgcccagaccucccuccccgccuucucccccggccgccucucccgcggccucuccgagcacaacgcccuccuccagcgcgacccccucucccagccccucgcccccggcucccgcaucggcuccgaccccuaccucggccagcgccucgacuccgaggccuccguccacgcccuccccgaggacacccucaccuucgaggaggccgucgccaccaacuccggccgcuccucccgcaccuccuacgucuccucccucaccucccagucccacccccuccgccgcguccccaacggcuaccacugcacccucggccucuccuccggcggccgcgcccgccacuccuaccaccaccccgaccaggaccacuggugcuga

SEQ ID NO: 40665 - RNA, 6417 nt, Artificial Sequence
  derived and/or modified sequence opt2 from CACNA1C__Homo_sapiens__NP_000710
auggucaacgagaacacccgcauguacauccccgaggagaaccaccagggcuccaacuacggcuccccccgccccgcccacgccaacaugaacgccaacgccgccgccggccucgcccccgagcacauccccacccccggcgccgcccucuccuggcaggccgccaucgacgccgcccgccaggccaagcucaugggcuccgccggcaacgccaccaucuccaccgucuccuccacccagcgcaagcgccagcaguacggcaagcccaagaagcagggcuccaccaccgccacccgccccccccgcgcccuccucugccucacccucaagaaccccauccgccgcgccugcaucuccaucgucgaguggaagcccuucgagaucaucauccuccucaccaucuucgccaacugcgucgcccucgccaucuacauccccuuccccgaggacgacuccaacgccaccaacuccaaccucgagcgcgucgaguaccucuuccucaucaucuucaccgucgaggccuuccucaaggucaucgccuacggccuccucuuccaccccaacgccuaccuccgcaacggcuggaaccuccucgacuucaucaucgucgucgucggccucuucuccgccauccucgagcaggccaccaaggccgacggcgccaacgcccucggcggcaagggcgccggcuucgacgucaaggcccuccgcgccuuccgcguccuccgcccccuccgccucgucuccggcguccccucccuccaggucguccucaacuccaucaucaaggccauggucccccuccuccacaucgcccuccucguccucuucgucaucaucaucuacgccaucaucggccucgagcucuucaugggcaagaugcacaagaccugcuacaaccaggagggcaucgccgacguccccgccgaggacgaccccucccccugcgcccucgagaccggccacggccgccagugccagaacggcaccgucugcaagcccggcugggacggccccaagcacggcaucaccaacuucgacaacuucgccuucgccaugcucaccgucuuccagugcaucaccauggagggcuggaccgacguccucuacugggucaacgacgccgucggccgcgacuggcccuggaucuacuucgucacccucaucaucaucggcuccuucuucguccucaaccucguccucggcguccucuccggcgaguucuccaaggagcgcgagaaggccaaggcccgcggcgacuuccagaagcuccgcgagaagcagcagcucgaggaggaccucaagggcuaccucgacuggaucacccaggccgaggacaucgaccccgagaacgaggacgagggcauggacgaggagaagccccgcaacauguccaugcccaccuccgagaccgaguccgucaacaccgagaacgucgccggcggcgacaucgagggcgagaacugcggcgcccgccucgcccaccgcaucuccaaguccaaguucucccgcuacuggcgccgcuggaaccgcuucugccgccgcaagugccgcgccgccgucaaguccaacgucuucuacuggcucgucaucuuccucgucuuccucaacacccucaccaucgccuccgagcacuacaaccagcccaacuggcucaccgagguccaggacaccgccaacaaggcccuccucgcccucuucaccgccgagaugcuccucaagauguacucccucggccuccaggccuacuucgucucccucuucaaccgcuucgacugcuucgucgucugcggcggcauccucgagaccauccucgucgagaccaagaucauguccccccucggcaucuccguccuccgcugcguccgccuccuccgcaucuucaagaucacccgcuacuggaacucccucuccaaccucgucgccucccuccucaacuccguccgcuccaucgccucccuccuccuccuccucuuccucuucaucaucaucuucucccuccucggcaugcagcucuucggcggcaaguucaacuucgacgagaugcagacccgccgcuccaccuucgacaacuucccccagucccuccucaccgucuuccagauccucaccggcgaggacuggaacuccgucauguacgacggcaucauggccuacggcggccccuccuuccccggcaugcucgucugcaucuacuucaucauccucuucaucugcggcaacuacauccuccucaacgucuuccucgccaucgccgucgacaaccucgccgacgccgagucccucaccuccgcccagaaggaggaggaggaggagaaggagcgcaagaagcucgcccgcaccgccucccccgagaagaagcaggagcucgucgagaagcccgccgucggcgaguccaaggaggagaagaucgagcucaaguccaucaccgccgacggcgaguccccccccgccaccaagaucaacauggacgaccuccagcccaacgagaacgaggacaagucccccuaccccaaccccgagaccaccggcgaggaggacgaggaggagcccgagaugcccgucggcccccgcccccgcccccucuccgagcuccaccucaaggagaaggccguccccaugcccgaggccuccgccuucuucaucuucuccuccaacaaccgcuuccgccuccagugccaccgcaucgucaacgacaccaucuucaccaaccucauccucuucuucauccuccucuccuccaucucccucgccgccgaggaccccguccagcacaccuccuuccgcaaccacauccucuucuacuucgacaucgucuucaccaccaucuucaccaucgagaucgcccucaagaugaccgccuacggcgccuuccuccacaagggcuccuucugccgcaacuacuucaacauccucgaccuccucgucgucuccgucucccucaucuccuucggcauccaguccuccgccaucaacgucgucaagauccuccgcguccuccgcguccuccgcccccuccgcgccaucaaccgcgccaagggccucaagcacgucguccagugcgucuucgucgccauccgcaccaucggcaacaucgucaucgucaccacccuccuccaguucauguucgccugcaucggcguccagcucuucaagggcaagcucuacaccugcuccgacuccuccaagcagaccgaggccgagugcaagggcaacuacaucaccuacaaggacggcgaggucgaccaccccaucauccagccccgcuccugggagaacuccaaguucgacuucgacaacguccucgccgccaugauggcccucuucaccgucuccaccuucgagggcuggcccgagcuccucuaccgcuccaucgacucccacaccgaggacaagggccccaucuacaacuaccgcgucgagaucuccaucuucuucaucaucuacaucaucaucaucgccuucuucaugaugaacaucuucgucggcuucgucaucgucaccuuccaggagcagggcgagcaggaguacaagaacugcgagcucgacaagaaccagcgccagugcgucgaguacgcccucaaggcccgcccccuccgccgcuacauccccaagaaccagcaccaguacaaggucugguacgucgucaacuccaccuacuucgaguaccucauguucguccucauccuccucaacaccaucugccucgccaugcagcacuacggccaguccugccucuucaagaucgccaugaacauccucaacaugcucuucaccggccucuucaccgucgagaugauccucaagcucaucgccuucaagcccaagcacuacuucugcgacgccuggaacaccuucgacgcccucaucgucgucggcuccaucgucgacaucgccaucaccgaggucaaccccgccgagcacacccagugcucccccuccaugaacgccgaggagaacucccgcaucuccaucaccuucuuccgccucuuccgcgucaugcgccucgucaagcuccucucccgcggcgagggcauccgcacccuccucuggaccuucaucaaguccuuccaggcccuccccuacgucgcccuccucaucgucaugcucuucuucaucuacgccgucaucggcaugcaggucuucggcaagaucgcccucaacgacaccaccgagaucaaccgcaacaacaacuuccagaccuucccccaggccguccuccuccucuuccgcugcgccaccggcgaggccuggcaggacaucaugcucgccugcaugcccggcaagaagugcgcccccgaguccgagcccuccaacuccaccgagggcgagacccccugcggcuccuccuucgccgucuucuacuucaucuccuucuacaugcucugcgccuuccucaucaucaaccucuucgucgccgucaucauggacaacuucgacuaccucacccgcgacugguccauccucggcccccaccaccucgacgaguucaagcgcaucugggccgaguacgaccccgaggccaagggccgcaucaagcaccucgacgucgucacccuccuccgccgcauccagcccccccucggcuucggcaagcucugcccccaccgcgucgccugcaagcgccucgucuccaugaacaugccccucaacuccgacggcaccgucauguucaacgccacccucuucgcccucguccgcaccgcccuccgcaucaagaccgagggcaaccucgagcaggccaacgaggagcuccgcgccaucaucaagaagaucuggaagcgcaccuccaugaagcuccucgaccaggucgucccccccgccggcgacgacgaggucaccgucggcaaguucuacgccaccuuccucauccaggaguacuuccgcaaguucaagaagcgcaaggagcagggccucgucggcaagcccucccagcgcaacgcccucucccuccaggccggccuccgcacccuccacgacaucggccccgagauccgccgcgccaucuccggcgaccucaccgccgaggaggagcucgacaaggccaugaaggaggccgucuccgccgccuccgaggacgacaucuuccgccgcgccggcggccucuucggcaaccacgucuccuacuaccaguccgacggccgcuccgccuucccccagaccuucaccacccagcgcccccuccacaucaacaaggccggcuccucccagggcgacaccgagucccccucccacgagaagcucgucgacuccaccuucacccccuccuccuacuccuccaccggcuccaacgccaacaucaacaacgccaacaacaccgcccucggccgccucccccgccccgccggcuaccccuccaccgucuccaccgucgagggccacggccccccccucucccccgccauccgcguccaggaggucgccuggaagcucuccuccaaccgcugccacucccgcgagucccaggccgccauggccggccaggaggagaccucccaggacgagaccuacgaggucaagaugaaccacgacaccgaggccugcuccgagcccucccuccucuccaccgagaugcucuccuaccaggacgacgagaaccgccagcucacccuccccgaggaggacaagcgcgacauccgccagucccccaagcgcggcuuccuccgcuccgccucccucggccgccgcgccuccuuccaccucgagugccucaagcgccagaaggaccgcggcggcgacaucucccagaagaccguccucccccuccaccucguccaccaccaggcccucgccgucgccggccucuccccccuccuccagcgcucccacucccccgccuccuucccccgccccuucgccaccccccccgccacccccggcucccgcggcuggcccccccagcccguccccacccuccgccucgagggcgucgaguccuccgagaagcucaacuccuccuuccccuccauccacugcggcuccugggccgagaccacccccggcggcggcggcuccuccgccgcccgccgcguccgccccgucucccucaugguccccucccaggccggcgcccccggccgccaguuccacggcuccgccuccucccucgucgaggccguccucaucuccgagggccucggccaguucgcccaggaccccaaguucaucgaggucaccacccaggagcucgccgacgccugcgacaugaccaucgaggagauggaguccgccgccgacaacauccucuccggcggcgccccccagucccccaacggcgcccuccuccccuucgucaacugccgcgacgccggccaggaccgcgccggcggcgaggaggacgccggcugcguccgcgcccgcggccgccccuccgaggaggagcuccaggacucccgcgucuacgucuccucccucuga

SEQ ID NO: 40666 - RNA, 6546 nt, Artificial Sequence
  derived and/or modified sequence opt2 from CACNA1D__Homo_sapiens__NP_000711
augaugaugaugaugaugaugaagaagaugcagcaccagcgccagcagcaggccgaccacgccaacgaggccaacuacgcccgcggcacccgccucccccucuccggcgagggccccaccucccagcccaacuccuccaagcagaccguccucuccuggcaggccgccaucgacgccgcccgccaggccaaggccgcccagaccauguccaccuccgcccccccccccgucggcucccucucccagcgcaagcgccagcaguacgccaaguccaagaagcagggcaacuccuccaacucccgccccgcccgcgcccucuucugccucucccucaacaaccccauccgccgcgccugcaucuccaucgucgaguggaagcccuucgacaucuucauccuccucgccaucuucgccaacugcgucgcccucgccaucuacauccccuuccccgaggacgacuccaacuccaccaaccacaaccucgagaaggucgaguacgccuuccucaucaucuucaccgucgagaccuuccucaagaucaucgccuacggccuccuccuccaccccaacgccuacguccgcaacggcuggaaccuccucgacuucgucaucgucaucgucggccucuucuccgucauccucgagcagcucaccaaggagaccgagggcggcaaccacuccuccggcaaguccggcggcuucgacgucaaggcccuccgcgccuuccgcguccuccgcccccuccgccucgucuccggcguccccucccuccaggucguccucaacuccaucaucaaggccauggucccccuccuccacaucgcccuccucguccucuucgucaucaucaucuacgccaucaucggccucgagcucuucaucggcaagaugcacaagaccugcuucuucgccgacuccgacaucgucgccgaggaggaccccgcccccugcgccuucuccggcaacggccgccagugcaccgccaacggcaccgagugccgcuccggcugggucggccccaacggcggcaucaccaacuucgacaacuucgccuucgccaugcucaccgucuuccagugcaucaccauggagggcuggaccgacguccucuacugggucaacgacgccaucggcugggaguggcccugggucuacuucgucucccucaucauccucggcuccuucuucguccucaaccucguccucggcguccucuccggcgaguucuccaaggagcgcgagaaggccaaggcccgcggcgacuuccagaagcuccgcgagaagcagcagcucgaggaggaccucaagggcuaccucgacuggaucacccaggccgaggacaucgaccccgagaacgaggaggagggcggcgaggagggcaagcgcaacaccuccaugcccaccuccgagaccgaguccgucaacaccgagaacgucuccggcgagggcgagaaccgcggcugcugcggcucccucuggugcugguggcgccgccgcggcgccgccaaggccggccccuccggcugccgccgcuggggccaggccaucuccaaguccaagcucucccgccgcuggcgccgcuggaaccgcuucaaccgccgccgcugccgcgccgccgucaaguccgucaccuucuacuggcucgucaucguccucgucuuccucaacacccucaccaucuccuccgagcacuacaaccagcccgacuggcucacccagauccaggacaucgccaacaagguccuccucgcccucuucaccugcgagaugcucgucaagauguacucccucggccuccaggccuacuucgucucccucuucaaccgcuucgacugcuucgucgucugcggcggcaucaccgagaccauccucgucgagcucgagaucauguccccccucggcaucuccgucuuccgcugcguccgccuccuccgcaucuucaaggucacccgccacuggaccucccucuccaaccucgucgccucccuccucaacuccaugaaguccaucgccucccuccuccuccuccucuuccucuucaucaucaucuucucccuccucggcaugcagcucuucggcggcaaguucaacuucgacgagacccagaccaagcgcuccaccuucgacaacuucccccaggcccuccucaccgucuuccagauccucaccggcgaggacuggaacgccgucauguacgacggcaucauggccuacggcggccccuccuccuccggcaugaucgucugcaucuacuucaucauccucuucaucugcggcaacuacauccuccucaacgucuuccucgccaucgccgucgacaaccucgccgacgccgagucccucaacaccgcccagaaggaggaggccgaggagaaggagcgcaagaagaucgcccgcaaggagucccucgagaacaagaagaacaacaagcccgaggucaaccagaucgccaacuccgacaacaaggucaccaucgacgacuaccgcgaggaggacgaggacaaggaccccuacccccccugcgacguccccgucggcgaggaggaggaggaggaggaggaggacgagcccgagguccccgccggcccccgcccccgccgcaucuccgagcucaacaugaaggagaagaucgcccccauccccgagggcuccgccuucuucauccucuccaagaccaaccccauccgcgucggcugccacaagcucaucaaccaccacaucuucaccaaccucauccucgucuucaucaugcucuccuccgccgcccucgccgccgaggaccccauccgcucccacuccuuccgcaacaccauccucggcuacuucgacuacgccuucaccgccaucuucaccgucgagauccuccucaagaugaccaccuucggcgccuuccuccacaagggcgccuucugccgcaacuacuucaaccuccucgacaugcucgucgucggcgucucccucgucuccuucggcauccaguccuccgccaucuccgucgucaagauccuccgcguccuccgcguccuccgcccccuccgcgccaucaaccgcgccaagggccucaagcacgucguccagugcgucuucgucgccauccgcaccaucggcaacaucaugaucgucaccacccuccuccaguucauguucgccugcaucggcguccagcucuucaagggcaaguucuaccgcugcaccgacgaggccaaguccaaccccgaggagugccgcggccucuucauccucuacaaggacggcgacgucgacucccccgucguccgcgagcgcaucuggcagaacuccgacuucaacuucgacaacguccucuccgccaugauggcccucuucaccgucuccaccuucgagggcuggcccgcccuccucuacaaggccaucgacuccaacggcgagaacaucggccccaucuacaaccaccgcgucgagaucuccaucuucuucaucaucuacaucaucaucgucgccuucuucaugaugaacaucuucgucggcuucgucaucgucaccuuccaggagcagggcgagaaggaguacaagaacugcgagcucgacaagaaccagcgccagugcgucgaguacgcccucaaggcccgcccccuccgccgcuacauccccaagaaccccuaccaguacaaguucugguacgucgucaacuccucccccuucgaguacaugauguucguccucaucaugcucaacacccucugccucgccaugcagcacuacgagcaguccaagauguucaacgacgccauggacauccucaacauggucuucaccggcgucuucaccgucgagaugguccucaaggucaucgccuucaagcccaagggcuacuucuccgacgccuggaacaccuucgacucccucaucgucaucggcuccaucaucgacgucgcccucuccgaggccgaccccaccgaguccgagaacguccccguccccaccgccacccccggcaacuccgaggaguccaaccgcaucuccaucaccuucuuccgccucuuccgcgucaugcgccucgucaagcuccucucccgcggcgagggcauccgcacccuccucuggaccuucaucaaguccuuccaggcccuccccuacgucgcccuccucaucgccaugcucuucuucaucuacgccgucaucggcaugcagauguucggcaaggucgccaugcgcgacaacaaccagaucaaccgcaacaacaacuuccagaccuucccccaggccguccuccuccucuuccgcugcgccaccggcgaggccuggcaggagaucaugcucgccugccuccccggcaagcucugcgaccccgaguccgacuacaaccccggcgaggaguacaccugcggcuccaacuucgccaucgucuacuucaucuccuucuacaugcucugcgccuuccucaucaucaaccucuucgucgccgucaucauggacaacuucgacuaccucacccgcgacugguccauccucggcccccaccaccucgacgaguucaagcgcaucugguccgaguacgaccccgaggccaagggccgcaucaagcaccucgacgucgucacccuccuccgccgcauccagcccccccucggcuucggcaagcucugcccccaccgcgucgccugcaagcgccucgucgccaugaacaugccccucaacuccgacggcaccgucauguucaacgccacccucuucgcccucguccgcaccgcccucaagaucaagaccgagggcaaccucgagcaggccaacgaggagcuccgcgccgucaucaagaagaucuggaagaagaccuccaugaagcuccucgaccaggucgucccccccgccggcgacgacgaggucaccgucggcaaguucuacgccaccuuccucauccaggacuacuuccgcaaguucaagaagcgcaaggagcagggccucgucggcaaguaccccgccaagaacaccaccaucgcccuccaggccggccuccgcacccuccacgacaucggccccgagauccgccgcgccaucuccugcgaccuccaggacgacgagcccgaggagaccaagcgcgaggaggaggacgacgucuucaagcgcaacggcgcccuccucggcaaccacgucaaccacgucaacuccgaccgccgcgacucccuccagcagaccaacaccacccaccgcccccuccacguccagcgccccuccaucccccccgccuccgacaccgagaagccccucuucccccccgccggcaacuccgucugccacaaccaccacaaccacaacuccaucggcaagcagguccccaccuccaccaacgccaaccucaacaacgccaacauguccaaggccgcccacggcaagcgccccuccaucggcaaccucgagcacgucuccgagaacggccaccacuccucccacaagcacgaccgcgagccccagcgccgcuccuccgucaagcgcacccgcuacuacgagaccuacauccgcuccgacuccggcgacgagcagcuccccaccaucugccgcgaggaccccgagauccacggcuacuuccgcgacccccacugccucggcgagcaggaguacuucuccuccgaggagugcuacgaggacgacuccucccccaccuggucccgccagaacuacggcuacuacucccgcuaccccggccgcaacaucgacuccgagcgcccccgcggcuaccaccacccccagggcuuccucgaggacgacgacucccccgucugcuacgacucccgccgcuccccccgccgccgccuccucccccccacccccgccucccaccgccgcuccuccuucaacuucgagugccuccgccgccaguccucccaggaggagguccccuccucccccaucuucccccaccgcaccgcccucccccuccaccucaugcagcagcagaucauggccgucgccggccucgacuccuccaaggcccagaaguacucccccucccacuccacccgcuccugggccaccccccccgccaccccccccuaccgcgacuggacccccugcuacaccccccucauccaggucgagcaguccgaggcccucgaccaggucaacggcucccuccccucccuccaccgcuccuccugguacaccgacgagcccgacaucuccuaccgcaccuucacccccgccucccucaccguccccuccuccuuccgcaacaagaacuccgacaagcagcgcuccgccgacucccucgucgaggccguccucaucuccgagggccucggccgcuacgcccgcgaccccaaguucgucuccgccaccaagcacgagaucgccgacgccugcgaccucaccaucgacgagauggaguccgccgccuccacccuccucaacggcaacguccgcccccgcgccaacggcgacgucggcccccucucccaccgccaggacuacgagcuccaggacuucggccccggcuacuccgacgaggagcccgaccccggccgcgacgaggaggaccucgccgacgagaugaucugcaucaccacccucuga

SEQ ID NO: 40667 - RNA, 6813 nt, Artificial Sequence
  derived and/or modified sequence opt2 from CACNA1E__Homo_sapiens__NP_000712
auggcccgcuucggcgaggccgucgucgcccgccccggcuccggcgacggcgacuccgaccagucccgcaaccgccagggcacccccguccccgccuccggccaggccgccgccuacaagcagaccaaggcccagcgcgcccgcaccauggcccucuacaaccccauccccguccgccagaacugcuucaccgucaaccgcucccucuucaucuucggcgaggacaacaucguccgcaaguacgccaagaagcucaucgacuggccccccuucgaguacaugauccucgccaccaucaucgccaacugcaucguccucgcccucgagcagcaccuccccgaggacgacaagacccccaugucccgccgccucgagaagaccgagcccuacuucaucggcaucuucugcuucgaggccggcaucaagaucgucgcccucggcuucaucuuccacaagggcuccuaccuccgcaacggcuggaacgucauggacuucaucgucguccucuccggcauccucgccaccgccggcacccacuucaacacccacgucgaccuccgcacccuccgcgccguccgcguccuccgcccccucaagcucgucuccggcauccccucccuccagaucguccucaaguccaucaugaaggccauggucccccuccuccagaucggccuccuccucuucuucgccauccucauguucgccaucaucggccucgaguucuacuccggcaagcuccaccgcgccugcuucaugaacaacuccggcauccucgagggcuucgaccccccccaccccugcggcguccagggcugccccgccggcuacgagugcaaggacuggaucggccccaacgacggcaucacccaguucgacaacauccucuucgccguccucaccgucuuccagugcaucaccauggagggcuggaccaccguccucuacaacaccaacgacgcccucggcgccaccuggaacuggcucuacuucaucccccucaucaucaucggcuccuucuucguccucaaccucguccucggcguccucuccggcgaguucgccaaggagcgcgagcgcgucgagaaccgccgcgccuucaugaagcuccgccgccagcagcagaucgagcgcgagcucaacggcuaccgcgccuggaucgacaaggccgaggaggucaugcucgccgaggagaacaagaacgccggcaccuccgcccucgagguccuccgccgcgccaccaucaagcgcucccgcaccgaggccaugacccgcgacuccuccgacgagcacugcgucgacaucuccuccgucggcaccccccucgcccgcgccuccaucaaguccgccaaggucgacggcgucuccuacuuccgccacaaggagcgccuccuccgcaucuccauccgccacauggucaagucccaggucuucuacuggaucguccucucccucgucgcccucaacaccgccugcgucgccaucguccaccacaaccagccccaguggcucacccaccuccucuacuacgccgaguuccucuuccucggccucuuccuccucgagaugucccucaagauguacggcaugggcccccgccucuacuuccacuccuccuucaacugcuucgacuucggcgucaccgucggcuccaucuucgaggucgucugggccaucuuccgccccggcaccuccuucggcaucuccguccuccgcgcccuccgccuccuccgcaucuucaagaucaccaaguacugggccucccuccgcaaccucgucgucucccucauguccuccaugaaguccaucaucucccuccucuuccuccucuuccucuucaucgucgucuucgcccuccucggcaugcagcucuucggcggccgcuucaacuucaacgacggcacccccuccgccaacuucgacaccuuccccgccgccaucaugaccgucuuccagauccucaccggcgaggacuggaacgaggucauguacaacggcauccgcucccagggcggcgucuccuccggcaugugguccgccaucuacuucaucguccucacccucuucggcaacuacacccuccucaacgucuuccucgccaucgccgucgacaaccucgccaacgcccaggagcucaccaaggacgagcaggaggaggaggaggccuucaaccagaagcacgcccuccagaaggccaaggaggucucccccauguccgcccccaacaugcccuccaucgagcgcgaccgccgccgccgccaccacauguccaugugggagccccgcuccucccaccuccgcgagcgccgccgccgccaccacauguccgucugggagcagcgcaccucccagcuccgcaagcacaugcagauguccucccaggaggcccucaaccgcgaggaggcccccaccaugaacccccucaacccccucaacccccucuccucccucaacccccucaacgcccaccccucccucuaccgccgcccccgcgccaucgagggccucgcccucggccucgcccucgagaaguucgaggaggagcgcaucucccgcggcggcucccucaagggcgacggcggcgaccgcuccuccgcccucgacaaccagcgcaccccccucucccucggccagcgcgagccccccuggcucgcccgccccugccacggcaacugcgaccccacccagcaggaggccggcggcggcgaggccgucgucaccuucgaggaccgcgcccgccaccgccagucccagcgccgcucccgccaccgccgcguccgcaccgagggcaaggaguccuccuccgccucccgcucccgcuccgccucccaggagcgcucccucgacgaggccaugcccaccgagggcgagaaggaccacgagcuccgcggcaaccacggcgccaaggagcccaccauccaggaggagcgcgcccaggaccuccgccgcaccaacucccucauggucucccgcggcuccggccucgccggcggccucgacgaggccgacaccccccucguccucccccaccccgagcucgaggucggcaagcacgucguccucaccgagcaggagcccgagggcuccuccgagcaggcccuccucggcaacguccagcucgacaugggccgcgucaucucccaguccgagcccgaccucuccugcaucaccgccaacaccgacaaggccaccaccgaguccaccuccgucaccgucgccauccccgacgucgacccccucgucgacuccaccgucguccacaucuccaacaagaccgacggcgaggccuccccccucaaggaggccgagauccgcgaggacgaggaggaggucgagaagaagaagcagaagaaggagaagcgcgagaccggcaaggccauggucccccacuccuccauguucaucuucuccaccaccaaccccauccgccgcgccugccacuacaucgucaaccuccgcuacuucgagaugugcauccuccucgucaucgccgccuccuccaucgcccucgccgccgaggaccccguccucaccaacuccgagcgcaacaagguccuccgcuacuucgacuacgucuucaccggcgucuucaccuucgagauggucaucaagaugaucgaccagggccucauccuccaggacggcuccuacuuccgcgaccucuggaacauccucgacuucgucgucgucgucggcgcccucgucgccuucgcccucgccaacgcccucggcaccaacaagggccgcgacaucaagaccaucaagucccuccgcguccuccgcguccuccgcccccucaagaccaucaagcgccuccccaagcucaaggccgucuucgacugcgucgucaccucccucaagaacgucuucaacauccucaucgucuacaagcucuucauguucaucuucgccgucaucgccguccagcucuucaagggcaaguucuucuacugcaccgacuccuccaaggacaccgagaaggagugcaucggcaacuacgucgaccacgagaagaacaagauggaggucaagggccgcgaguggaagcgccacgaguuccacuacgacaacaucaucugggcccuccucacccucuucaccgucuccaccggcgagggcuggccccagguccuccagcacuccgucgacgucaccgaggaggaccgcggccccucccgcuccaaccgcauggagauguccaucuucuacgucgucuacuucgucgucuuccccuucuucuucgucaacaucuucgucgcccucaucaucaucaccuuccaggagcagggcgacaagaugauggaggagugcucccucgagaagaacgagcgcgccugcaucgacuucgccaucuccgccaagccccucacccgcuacaugccccagaaccgccacaccuuccaguaccgcgucuggcacuucgucgucucccccuccuucgaguacaccaucauggccaugaucgcccucaacaccgucguccucaugaugaaguacuacuccgcccccugcaccuacgagcucgcccucaaguaccucaacaucgccuucaccauggucuucucccucgagugcguccucaaggucaucgccuucggcuuccucaacuacuuccgcgacaccuggaacaucuucgacuucaucaccgucaucggcuccaucaccgagaucauccucaccgacuccaagcucgucaacaccuccggcuucaacauguccuuccucaagcucuuccgcgccgcccgccucaucaagcuccuccgccagggcuacaccauccgcauccuccucuggaccuucguccaguccuucaaggcccuccccuacgucugccuccucaucgccaugcucuucuucaucuacgccaucaucggcaugcaggucuucggcaacaucaagcucgacgaggagucccacaucaaccgccacaacaacuuccgcuccuucuucggcucccucaugcuccucuuccgcuccgccaccggcgaggccuggcaggagaucaugcucuccugccucggcgagaagggcugcgagcccgacaccaccgcccccuccggccagaacgagaacgagcgcugcggcaccgaccucgccuacgucuacuucgucuccuucaucuucuucugcuccuuccucaugcucaaccucuucgucgccgucaucauggacaacuucgaguaccucacccgcgacuccuccauccucggcccccaccaccucgacgaguucguccgcgucugggccgaguacgaccgcgccgccugcggccgcauccacuacaccgagauguacgagaugcucacccucaugucccccccccucggccucggcaagcgcugccccuccaaggucgccuacaagcgccucguccucaugaacaugcccgucgccgaggacaugaccguccacuucaccuccacccucauggcccucauccgcaccgcccucgacaucaagaucgccaagggcggcgccgaccgccagcagcucgacuccgagcuccagaaggagacccucgccaucuggccccaccucucccagaagaugcucgaccuccucguccccaugcccaaggccuccgaccucaccgucggcaagaucuacgccgccaugaugaucauggacuacuacaagcaguccaaggucaagaagcagcgccagcagcucgaggagcagaagaacgcccccauguuccagcgcauggagcccuccucccucccccaggagaucaucgccaacgccaaggcccuccccuaccuccagcaggaccccgucuccggccucuccggccgcuccggcuaccccuccauguccccccucuccccccaggacaucuuccagcucgccugcauggaccccgccgacgacggccaguuccaggagcgccagucccucgucgucaccgaccccuccuccaugcgccgcuccuucuccaccauccgcgacaagcgcuccaacuccuccuggcucgaggaguucuccauggagcgcuccuccgagaacaccuacaagucccgccgccgcuccuaccacuccucccuccgccucuccgcccaccgccucaacuccgacuccggccacaaguccgacacccaccgcuccggcggccgcgagcgcggccgcuccaaggagcgcaagcaccuccucucccccgacgucucccgcugcaacuccgaggagcgcggcacccaggccgacugggagucccccgagcgccgccagucccgcucccccuccgagggccgcucccagacccccaaccgccagggcaccggcucccucuccgaguccuccauccccuccgucuccgacaccuccaccccccgccgcucccgccgccagcucccccccgucccccccaagccccgcccccuccucuccuacuccucccucauccgccacgccggcuccaucuccccccccgccgacggcuccgaggagggcuccccccucaccucccaggcccucgaguccaacaacgccugccucaccgaguccuccaacuccccccacccccagcagucccagcacgccuccccccagcgcuacaucuccgagcccuaccucgcccuccacgaggacucccacgccuccgacugcggcgaggaggagacccucaccuucgaggccgccgucgccaccucccucggccgcuccaacaccaucggcuccgcccccccccuccgccacuccuggcagaugcccaacggccacuaccgccgccgccgccgcggcggccccggccccggcaugaugugcggcgccgucaacaaccuccucuccgacaccgaggaggacgacaagugcuga

SEQ ID NO: 40668 - RNA, 5901 nt, Artificial Sequence
  derived and/or modified sequence opt2 from CACNA1F__Homo_sapiens__NP_001243718
auguccgaguccgagggcggcaaggacaccacccccgagcccucccccgccaacggcgccggccccggccccgaguggggccucugccccggcccccccgccgucgagggcgaguccuccggcgccuccggccucggcacccccaagcgccgcaaccagcacuccaagcacaagaccgucgccgucgccuccgcccagcgcuccccccgcgcccucuucugccucacccucgccaacccccuccgccgcuccugcaucuccaucgucgaguggaagcccuucgacauccucauccuccucaccaucuucgccaacugcgucgcccucggcgucuacauccccuuccccgaggacgacuccaacaccgccaaccacaaccucgagcaggucgaguacgucuuccucgucaucuucaccgucgagaccguccucaagaucgucgccuacggccucguccuccaccccuccgccuacauccgcaacggcuggaaccuccucgacuucaucaucgucgucgucggccucuucuccguccuccucgagcagggccccggccgccccggcgacgccccccacaccggcggcaagcccggcggcuucgacgucaaggcccuccgcgccuuccgcguccuccgcccccuccgccucgucuccggcguccccucccuccacaucguccucaacuccaucaugaaggcccucgucccccuccuccacaucgcccuccucguccucuucgucaucaucaucuacgccaucaucggccucgagcucuuccucggccgcaugcacaagaccugcuacuuccucggcuccgacauggaggccgaggaggaccccucccccugcgccuccuccggcuccggccgcgccugcacccucaaccagaccgagugccgcggccgcuggcccggccccaacggcggcaucaccaacuucgacaacuucuucuucgccaugcucaccgucuuccagugcgucaccauggagggcuggaccgacguccucuacuggaugcaggacgccaugggcuacgagcuccccugggucuacuucgucucccucgucaucuucggcuccuucuucguccucaaccucguccucggcguccucuccggcgaguucuccaaggagcgcgagaaggccaaggcccgcggcgacuuccagaagcagcgcgagaagcagcagauggaggaggaccuccgcggcuaccucgacuggaucacccaggccgaggagcucgacauggaggaccccuccgccgacgacaaccucggcccccagcucgccgagcucaccaaccgccgccgcggccgccuccgcugguucucccacuccacccgcuccacccacuccaccuccucccacgccucccuccccgccuccgacaccggcuccaugaccgagacccagggcgacgaggacgaggaggagggcgcccucgccuccugcacccgcugccucaacaagaucaugaagacccgcgucugccgccgccuccgccgcgccaaccgcguccuccgcgcccgcugccgccgcgccgucaaguccaacgccugcuacugggccguccuccuccucgucuuccucaacacccucaccaucgccuccgagcaccacggccagcccgucuggcucacccagauccaggaguacgccaacaagguccuccucugccucuucaccgucgagaugcuccucaagcucuacggccucggccccuccgccuacgucuccuccuucuucaaccgcuucgacugcuucgucgucugcggcggcauccucgagaccacccucgucgaggucggcgccaugcagccccucggcaucuccguccuccgcugcguccgccuccuccgcaucuucaaggucacccgccacugggccucccucuccaaccucgucgccucccuccucaacuccaugaaguccaucgccucccuccuccuccuccucuuccucuucaucaucaucuucucccuccucggcaugcagcucuucggcggcaaguucaacuucgaccagacccacaccaagcgcuccaccuucgacaccuucccccaggcccuccucaccgucuuccagauccucaccggcgaggacuggaacgucgucauguacgacggcaucauggccuacggcggccccuucuuccccggcaugcucgucugcaucuacuucaucauccucuucaucugcggcaacuacauccuccucaacgucuuccucgccaucgccgucgacaaccucgccuccggcgacgccggcaccgccaaggacaagggcggcgagaaguccaacgagaaggaccucccccaggagaacgagggccucguccccggcgucgagaaggaggaggaggagggcgcccgccgcgagggcgccgacauggaggaggaggaggaggaggaggaggaggaggaggaggaggaggaggaggagggcgccggcggcgucgagcuccuccaggaggucguccccaaggagaaggucguccccauccccgagggcuccgccuucuucugccucucccagaccaacccccuccgcaagggcugccacacccucauccaccaccacgucuucaccaaccucauccucgucuucaucauccucuccuccgucucccucgccgccgaggaccccauccgcgcccacuccuuccgcaaccacauccucggcuacuucgacuacgccuucaccuccaucuucaccgucgagauccuccucaagaugaccgucuucggcgccuuccuccaccgcggcuccuucugccgcuccugguucaacaugcucgaccuccucgucgucuccgucucccucaucuccuucggcauccacuccuccgccaucuccgucgucaagauccuccgcguccuccgcguccuccgcccccuccgcgccaucaaccgcgccaagggccucaagcacgucguccagugcgucuucgucgccauccgcaccaucggcaacaucaugaucgucaccacccuccuccaguucauguucgccugcaucggcguccagcucuucaagggcaaguucuacaccugcaccgacgaggccaagcacaccccccaggagugcaagggcuccuuccucgucuaccccgacggcgacgucucccgcccccucguccgcgagcgccucugggucaacuccgacuucaacuucgacaacguccucuccgccaugauggcccucuucaccgucuccaccuucgagggcuggcccgcccuccucuacaaggccaucgacgccuacgccgaggaccacggccccaucuacaacuaccgcgucgagaucuccgucuucuucaucgucuacaucaucaucaucgccuucuucaugaugaacaucuucgucggcuucgucaucaucaccuuccgcgcccagggcgagcaggaguaccagaacugcgagcucgacaagaaccagcgccagugcgucgaguacgcccucaaggcccagccccuccgccgcuacauccccaagaacccccaccaguaccgcgucugggccaccgucaacuccgccgccuucgaguaccucauguuccuccucauccuccucaacaccgucgcccucgccaugcagcacuacgagcagaccgcccccuucaacuacgccauggacauccucaacauggucuucaccggccucuucaccaucgagaugguccucaagaucaucgccuucaagcccaagcacuacuucaccgacgccuggaacaccuucgacgcccucaucgucgucggcuccaucgucgacaucgccgucaccgaggucaacaacggcggccaccucggcgaguccuccgaggacuccucccgcaucuccaucaccuucuuccgccucuuccgcgucaugcgccucgucaagcuccucuccaagggcgagggcauccgcacccuccucuggaccuucaucaaguccuuccaggcccuccccuacgucgcccuccucaucgccaugaucuucuucaucuacgccgucaucggcaugcagauguucggcaaggucgcccuccaggacggcacccagaucaaccgcaacaacaacuuccagaccuucccccaggccguccuccuccucuuccgcugcgccaccggcgaggccuggcaggagaucaugcucgccucccuccccggcaaccgcugcgaccccgaguccgacuucggccccggcgaggaguucaccugcggcuccaacuucgccaucgccuacuucaucuccuucuucaugcucugcgccuuccucaucaucaaccucuucgucgccgucaucauggacaacuucgacuaccucacccgcgacugguccauccucggcccccaccaccucgacgaguucaagcgcaucugguccgaguacgaccccggcgccaagggccgcaucaagcaccucgacgucgucgcccuccuccgccgcauccagcccccccucggcuucggcaagcucugcccccaccgcgucgccugcaagcgccucgucgccaugaacaugccccucaacuccgacggcaccgucaccuucaacgccacccucuucgcccucguccgcaccucccucaagaucaagaccgagggcaaccucgagcaggccaaccaggagcuccgcaucgucaucaagaagaucuggaagcgcaugaagcagaagcuccucgacgaggucauccccccccccgacgaggaggaggucaccgucggcaaguucuacgccaccuuccucauccaggacuacuuccgcaaguuccgccgccgcaaggagaagggccuccucggcaacgacgccgcccccuccaccuccuccgcccuccaggccggccuccgcucccuccaggaccucggccccgagaugcgccaggcccucaccugcgacaccgaggaggaggaggaggagggccaggagggcgucgaggaggaggacgagaaggaccucgagaccaacaaggccaccauggucucccagcccuccgcccgccgcggcuccggcaucuccgucucccuccccgucggcgaccgccuccccgacucccucuccuucggccccuccgacgacgaccgcggcacccccaccuccucccagcccuccgucccccaggccggcuccaacacccaccgccgcggcuccggcgcccucaucuucaccauccccgaggagggcaacucccagcccaagggcaccaagggccagaacaagcaggacgaggacgaggagguccccgaccgccucuccuaccucgacgagcaggccggcaccccccccugcuccguccuccuccccccccaccgcgcccagcgcuacauggacggccaccucgucccccgccgccgccuccucccccccacccccgccggccgcaagcccuccuucaccauccagugccuccagcgccagggcuccugcgaggaccuccccauccccggcaccuaccaccgcggccgcaacuccggccccaaccgcgcccagggcuccugggccacccccccccagcgcggccgccuccucuacgccccccuccuccucgucgaggagggcgccgccggcgagggcuaccucggccgcuccuccggcccccuccgcaccuucaccugccuccacguccccggcacccacuccgaccccucccacggcaagcgcggcuccgccgacucccucgucgaggccguccucaucuccgagggccucggccucuucgcccgcgacccccgcuucgucgcccucgccaagcaggagaucgccgacgccugccgccucacccucgacgagauggacaacgccgccuccgaccuccucgcccagggcaccuccucccucuacuccgacgaggaguccauccucucccgcuucgacgaggaggaccucggcgacgagauggccugcguccacgcccucuga

SEQ ID NO: 40669 - RNA, 6945 nt, Artificial Sequence
  derived and/or modified sequence opt2 from CACNA1G__Homo_sapiens__NP_001243253
auggacgaggaggaggacggcgccggcgccgaggaguccggccagccccgcuccuucaugcgccucaacgaccucuccggcgccggcggccgccccggccccggcuccgccgagaaggaccccggcuccgccgacuccgaggccgagggccuccccuaccccgcccucgcccccgucgucuucuucuaccucucccaggacucccgcccccgcuccuggugccuccgcaccgucugcaaccccugguucgagcgcaucuccaugcucgucauccuccucaacugcgucacccucggcauguuccgccccugcgaggacaucgccugcgacucccagcgcugccgcauccuccaggccuucgacgacuucaucuucgccuucuucgccgucgagauggucgucaagauggucgcccucggcaucuucggcaagaagugcuaccucggcgacaccuggaaccgccucgacuucuucaucgucaucgccggcaugcucgaguacucccucgaccuccagaacgucuccuucuccgccguccgcaccguccgcguccuccgcccccuccgcgccaucaaccgcguccccuccaugcgcauccucgucacccuccuccucgacacccuccccaugcucggcaacguccuccuccucugcuucuucgucuucuucaucuucggcaucgucggcguccagcucugggccggccuccuccgcaaccgcugcuuccuccccgagaacuucucccucccccucuccgucgaccucgagcgcuacuaccagaccgagaacgaggacgagucccccuucaucugcucccagccccgcgagaacggcaugcgcuccugccgcuccguccccacccuccgcggcgacggcggcggcggcccccccugcggccucgacuacgaggccuacaacuccuccuccaacaccaccugcgucaacuggaaccaguacuacaccaacugcuccgccggcgagcacaaccccuucaagggcgccaucaacuucgacaacaucggcuacgccuggaucgccaucuuccaggucaucacccucgagggcugggucgacaucauguacuucgucauggacgcccacuccuucuacaacuucaucuacuucauccuccucaucaucgucggcuccuucuucaugaucaaccucugccucgucgucaucgccacccaguucuccgagaccaagcagcgcgagucccagcucaugcgcgagcagcgcguccgcuuccucuccaacgccuccacccucgccuccuucuccgagcccggcuccugcuacgaggagcuccucaaguaccucgucuacauccuccgcaaggccgcccgccgccucgcccaggucucccgcgccgccggcguccgcgucggccuccucuccucccccgccccccucggcggccaggagacccagcccuccuccuccugcucccgcucccaccgccgccucuccguccaccaccucguccaccaccaccaccaccaccaccaccacuaccaccucggcaacggcacccuccgcgccccccgcgccucccccgagauccaggaccgcgacgccaacggcucccgccgccucaugcuccccccccccuccacccccgcccucuccggcgccccccccggcggcgccgaguccguccacuccuucuaccacgccgacugccaccucgagcccguccgcugccaggccccccccccccgcucccccuccgaggccuccggccgcaccgucggcuccggcaaggucuaccccaccguccacaccucccccccccccgagacccucaaggagaaggcccucgucgaggucgccgccuccuccggcccccccacccucaccucccucaacaucccccccggccccuacuccuccaugcacaagcuccucgagacccaguccaccggcgccugccaguccuccugcaagaucuccucccccugccucaaggccgacuccggcgccugcggccccgacuccugccccuacugcgcccgcgccggcgccggcgaggucgagcucgccgaccgcgagaugcccgacuccgacuccgaggccgucuacgaguucacccaggacgcccagcacuccgaccuccgcgacccccacucccgccgccagcgcucccucggccccgacgccgagcccuccuccguccucgccuucuggcgccucaucugcgacaccuuccgcaagaucgucgacuccaaguacuucggccgcggcaucaugaucgccauccucgucaacacccucuccaugggcaucgaguaccacgagcagcccgaggagcucaccaacgcccucgagaucuccaacaucgucuucaccucccucuucgcccucgagaugcuccucaagcuccucgucuacggccccuucggcuacaucaagaaccccuacaacaucuucgacggcgucaucgucgucaucuccgucugggagaucgucggccagcagggcggcggccucuccguccuccgcaccuuccgccucaugcgcguccucaagcucguccgcuuccuccccgcccuccagcgccagcucgucguccucaugaagaccauggacaacgucgccaccuucugcaugcuccucaugcucuucaucuucaucuucuccauccucggcaugcaccucuucggcugcaaguucgccuccgagcgcgacggcgacacccuccccgaccgcaagaacuucgacucccuccucugggccaucgucaccgucuuccagauccucacccaggaggacuggaacaagguccucuacaacggcauggccuccaccuccuccugggccgcccucuacuucaucgcccucaugaccuucggcaacuacguccucuucaaccuccucgucgccauccucgucgagggcuuccaggccgaggagaucuccaagcgcgaggacgccuccggccagcucuccugcauccagcuccccgucgacucccagggcggcgacgccaacaaguccgaguccgagcccgacuucuucucccccucccucgacggcgacggcgaccgcaagaagugccucgcccucgucucccucggcgagcaccccgagcuccgcaagucccuccuccccccccucaucauccacaccgccgccacccccaugucccuccccaaguccaccuccaccggccucggcgaggcccucggccccgccucccgccgcaccuccuccuccggcuccgccgagcccggcgccgcccacgagaugaaguccccccccuccgcccgcuccuccccccacucccccugguccgccgccuccuccuggaccucccgccgcuccucccgcaacucccucggccgcgcccccucccucaagcgccgcucccccuccggcgagcgccgcucccuccucuccggcgagggccaggagucccaggacgaggaggaguccuccgaggaggagcgcgccucccccgccggcuccgaccaccgccaccgcggcucccucgagcgcgaggccaaguccuccuucgaccuccccgacacccuccagguccccggccuccaccgcaccgccuccggccgcggcuccgccuccgagcaccaggacugcaacggcaaguccgccuccggccgccucgcccgcgcccuccgccccgacgaccccccccucgacggcgacgacgccgacgacgagggcaaccucuccaagggcgagcgcguccgcgccuggauccgcgcccgccuccccgccugcugccucgagcgcgacuccugguccgccuacaucuuccccccccagucccgcuuccgccuccucugccaccgcaucaucacccacaagauguucgaccacgucguccucgucaucaucuuccucaacugcaucaccaucgccauggagcgccccaagaucgacccccacuccgccgagcgcaucuuccucacccucuccaacuacaucuucaccgccgucuuccucgccgagaugaccgucaaggucgucgcccucggcuggugcuucggcgagcaggccuaccuccgcuccuccuggaacguccucgacggccuccucguccucaucuccgucaucgacauccucgucuccauggucuccgacuccggcaccaagauccucggcaugcuccgcguccuccgccuccuccgcacccuccgcccccuccgcgucaucucccgcgcccagggccucaagcucgucgucgagacccucauguccucccucaagcccaucggcaacaucgucgucaucugcugcgccuucuucaucaucuucggcauccucggcguccagcucuucaagggcaaguucuucgucugccagggcgaggacacccgcaacaucaccaacaaguccgacugcgccgaggccuccuaccgcuggguccgccacaaguacaacuucgacaaccucggccaggcccucaugucccucuucguccucgccuccaaggacggcugggucgacaucauguacgacggccucgacgccgucggcgucgaccagcagcccaucaugaaccacaaccccuggaugcuccucuacuucaucuccuuccuccucaucgucgccuucuucguccucaacauguucgucggcgucgucgucgagaacuuccacaagugccgccagcaccaggaggaggaggaggcccgccgccgcgaggagaagcgccuccgccgccucgagaagaagcgccgcaaggcccagugcaagcccuacuacuccgacuacucccgcuuccgccuccucguccaccaccucugcaccucccacuaccucgaccucuucaucaccggcgucaucggccucaacgucgucaccauggccauggagcacuaccagcagccccagauccucgacgaggcccucaagaucugcaacuacaucuucaccgucaucuucguccucgaguccgucuucaagcucgucgccuucggcuuccgccgcuucuuccaggaccgcuggaaccagcucgaccucgccaucguccuccucuccaucaugggcaucacccucgaggagaucgaggucaacgccucccuccccaucaaccccaccaucauccgcaucaugcgcguccuccgcaucgcccgcguccucaagcuccucaagauggccgucggcaugcgcgcccuccucgacaccgucaugcaggcccucccccaggucggcaaccucggccuccucuucaugcuccucuucuucaucuucgccgcccucggcgucgagcucuucggcgaccucgagugcgacgagacccaccccugcgagggccucggccgccacgccaccuuccgcaacuucggcauggccuuccucacccucuuccgcgucuccaccggcgacaacuggaacggcaucaugaaggacacccuccgcgacugcgaccaggaguccaccugcuacaacaccgucaucucccccaucuacuucgucuccuucguccucaccgcccaguucguccucgucaacgucgucaucgccguccucaugaagcaccucgaggaguccaacaaggaggccaaggaggaggccgagcucgaggccgagcucgagcucgagaugaagacccucuccccccagccccacuccccccucggcucccccuuccucuggcccggcgucgagggccccgacucccccgacucccccaagcccggcgcccuccaccccgccgcccacgcccgcuccgccucccacuucucccucgagcaccccaccgaccgccagcucuucgacaccaucucccuccucauccagggcucccucgagugggagcucaagcucauggacgagcucgccggccccggcggccagcccuccgccuuccccuccgcccccucccucggcggcuccgacccccagaugcagccccaccccaccgagcuccccggccccgaccuccucaccguccgcaaguccggcgucucccgcacccacucccuccccaacgacuccuacaugugccgccacggcuccaccgccgagggcccccucggccaccgcggcuggggccuccccaaggcccaguccggcuccguccucuccguccacucccagcccgccgacaccuccuacauccuccagcuccccaaggacgccccccaccuccuccagccccacuccgcccccaccuggggcaccauccccaagcuccccccccccggccgcuccccccucgcccagcgcccccuccgccgccaggccgccauccgcaccgacucccucgacguccagggccucggcucccgcgaggaccuccucgccgaggucuccggccccucccccccccucgcccgcgccuacuccuucuggggccaguccuccacccaggcccagcagcacucccgcucccacuccaagaucuccaagcacaugaccccccccgcccccugccccggccccgagcccaacuggggcaagggcccccccgagacccgcuccucccucgagcucgacaccgagcucuccuggaucuccggcgaccuccucccccccggcggccaggaggagccccccuccccccgcgaccucaagaagugcuacuccgucgaggcccaguccugccagcgccgccccaccuccuggcucgacgagcagcgccgccacuccaucgccgucuccugccucgacuccggcucccagccccaccucggcaccgaccccuccaaccucggcggccagccccucggcggccccggcucccgccccaagaagaagcucuccccccccuccaucaccaucgacccccccgagucccagggcccccgcaccccccccucccccggcaucugccuccgccgccgcgcccccuccuccgacuccaaggacccccucgccuccggcccccccgacuccauggccgccucccccucccccaagaaggacguccucucccucuccggccucuccuccgaccccgccgaccucgaccccuga

SEQ ID NO: 40670 - RNA, 7044 nt, Artificial Sequence
  derived and/or modified sequence opt2 from CACNA1H__Homo_sapiens__NP_001005407
augaccgagggcgcccgcgccgccgacgagguccgcgucccccucggcgcccccccccccggccccgccgcccucgucggcgccucccccgagucccccggcgcccccggccgcgaggccgagcgcggcuccgagcucggcgucucccccuccgagucccccgccgccgagcgcggcgccgagcucggcgccgacgaggagcagcgcguccccuaccccgcccucgccgccaccgucuucuucugccucggccagaccacccgcccccgcuccuggugccuccgccucgucugcaaccccugguucgagcacgucuccaugcucgucaucaugcucaacugcgucacccucggcauguuccgccccugcgaggacgucgagugcggcuccgagcgcugcaacauccucgaggccuucgacgccuucaucuucgccuucuucgccgucgagauggucaucaagauggucgcccucggccucuucggccagaagugcuaccucggcgacaccuggaaccgccucgacuucuucaucgucgucgccggcaugauggaguacucccucgacggccacaacgucucccucuccgccauccgcaccguccgcguccuccgcccccuccgcgccaucaaccgcguccccuccaugcgcauccucgucacccuccuccucgacacccuccccaugcucggcaacguccuccuccucugcuucuucgucuucuucaucuucggcaucgucggcguccagcucugggccggccuccuccgcaaccgcugcuuccucgacuccgccuucguccgcaacaacaaccucaccuuccuccgccccuacuaccagaccgaggagggcgaggagaaccccuucaucugcuccucccgccgcgacaacggcaugcagaagugcucccacauccccggccgccgcgagcuccgcaugcccugcacccucggcugggaggccuacacccagccccaggccgagggcgucggcgccgcccgcaacgccugcaucaacuggaaccaguacuacaacgucugccgcuccggcgacuccaacccccacaacggcgccaucaacuucgacaacaucggcuacgccuggaucgccaucuuccaggucaucacccucgagggcugggucgacaucauguacuacgucauggacgcccacuccuucuacaacuucaucuacuucauccuccucaucaucgucggcuccuucuucaugaucaaccucugccucgucgucaucgccacccaguucuccgagaccaagcagcgcgagucccagcucaugcgcgagcagcgcgcccgccaccucuccaacgacuccacccucgccuccuucuccgagcccggcuccugcuacgaggagcuccucaaguacgucggccacaucuuccgcaaggucaagcgccgcucccuccgccucuacgcccgcuggcagucccgcuggcgcaagaaggucgaccccuccgccguccagggccagggccccggccaccgccagcgccgcgccggccgccacaccgccuccguccaccaccucgucuaccaccaccaccaccaccaccaccaccacuaccacuucucccacggcuccccccgccgccccggccccgagcccggcgccugcgacacccgccucguccgcgccggcgccccccccuccccccccucccccggccgcggcccccccgacgccgaguccguccacuccaucuaccacgccgacugccacaucgagggcccccaggagcgcgcccgcgucgcccacgccgccgccaccgccgccgccucccuccgccucgccaccggccucggcaccaugaacuaccccaccauccuccccuccggcgucggcuccggcaagggcuccaccucccccggccccaagggcaagugggccggcggcccccccggcaccggcggccacggcccccucucccucaacucccccgaccccuacgagaagaucccccacgucgucggcgagcacggccucggccaggcccccggccaccucuccggccucuccguccccugcccccuccccuccccccccgccggcacccucaccugcgagcucaaguccugccccuacugcacccgcgcccucgaggaccccgagggcgagcucuccggcuccgaguccggcgacuccgacggccgcggcgucuacgaguucacccaggacguccgccacggcgaccgcugggaccccacccgccccccccgcgccaccgacacccccggccccggccccggcuccccccagcgccgcgcccagcagcgcgccgcccccggcgagcccggcuggaugggccgccucugggucaccuucuccggcaagcuccgccgcaucgucgacuccaaguacuucucccgcggcaucaugauggccauccucgucaacacccucuccaugggcgucgaguaccacgagcagcccgaggagcucaccaacgcccucgagaucuccaacaucgucuucaccuccauguucgcccucgagaugcuccucaagcuccucgccugcggcccccucggcuacauccgcaaccccuacaacaucuucgacggcaucaucgucgucaucuccgucugggagaucgucggccaggccgacggcggccucuccguccuccgcaccuuccgccuccuccgcguccucaagcucguccgcuuccuccccgcccuccgccgccagcucgucguccucgucaagaccauggacaacgucgccaccuucugcacccuccucaugcucuucaucuucaucuucuccauccucggcaugcaccucuucggcugcaaguucucccucaagaccgacaccggcgacaccguccccgaccgcaagaacuucgacucccuccucugggccaucgucaccgucuuccagauccucacccaggaggacuggaacgucguccucuacaacggcauggccuccaccuccuccugggccgcccucuacuucgucgcccucaugaccuucggcaacuacguccucuucaaccuccucgucgccauccucgucgagggcuuccaggccgagggcgacgccaaccgcuccgacaccgacgaggacaagaccuccguccacuucgaggaggacuuccacaagcuccgcgagcuccagaccaccgagcucaagaugugcucccucgccgucacccccaacggccaccucgagggccgcggcucccucucccccccccucaucaugugcaccgccgccacccccaugcccacccccaaguccucccccuuccucgacgccgcccccucccuccccgacucccgccgcggcuccuccuccuccggcgaccccccccucggcgaccagaagccccccgccucccuccgcuccucccccugcgcccccuggggccccuccggcgccugguccucccgccgcuccuccugguccucccucggccgcgcccccucccucaagcgccgcggccagugcggcgagcgcgagucccuccucuccggcgagggcaagggcuccaccgacgacgaggccgaggacggccgcgccgcccccggcccccgcgccaccccccuccgccgcgccgagucccucgacccccgcccccuccgccccgccgcccucccccccaccaagugccgcgaccgcgacggccaggucgucgcccuccccuccgacuucuuccuccgcaucgacucccaccgcgaggacgccgccgagcucgacgacgacuccgaggacuccugcugccuccgccuccacaagguccucgagcccuacaagccccaguggugccgcucccgcgaggccugggcccucuaccucuucuccccccagaaccgcuuccgcgucuccugccagaaggucaucacccacaagauguucgaccacgucguccucgucuucaucuuccucaacugcgucaccaucgcccucgagcgccccgacaucgaccccggcuccaccgagcgcgucuuccucuccgucuccaacuacaucuucaccgccaucuucgucgccgagaugauggucaaggucgucgcccucggccuccucuccggcgagcacgccuaccuccaguccuccuggaaccuccucgacggccuccucguccucgucucccucgucgacaucgucgucgccauggccuccgccggcggcgccaagauccucggcguccuccgcguccuccgccuccuccgcacccuccgcccccuccgcgucaucucccgcgcccccggccucaagcucgucgucgagacccucaucuccucccuccgccccaucggcaacaucguccucaucugcugcgccuucuucaucaucuucggcauccucggcguccagcucuucaagggcaaguucuacuacugcgagggccccgacacccgcaacaucuccaccaaggcccagugccgcgccgcccacuaccgcuggguccgccgcaaguacaacuucgacaaccucggccaggcccucaugucccucuucguccucuccuccaaggacggcugggucaacaucauguacgacggccucgacgccgucggcgucgaccagcagcccguccagaaccacaaccccuggaugcuccucuacuucaucuccuuccuccucaucgucuccuucuucguccucaacauguucgucggcgucgucgucgagaacuuccacaagugccgccagcaccaggaggccgaggaggcccgccgccgcgaggagaagcgccuccgccgccucgagcgccgccgccgcaaggcccagcgccgccccuacuacgccgacuacucccccacccgccgcuccauccacucccucugcaccucccacuaccucgaccucuucaucaccuucaucaucugcgucaacgucaucaccauguccauggagcacuacaaccagcccaagucccucgacgaggcccucaaguacugcaacuacgucuucaccaucgucuucgucuucgaggccgcccucaagcucgucgccuucggcuuccgccgcuucuucaaggaccgcuggaaccagcucgaccucgccaucguccuccucucccucaugggcaucacccucgaggagaucgagauguccgccgcccuccccaucaaccccaccaucauccgcaucaugcgcguccuccgcaucgcccgcguccucaagcuccucaagauggccaccggcaugcgcgcccuccucgacaccgucguccaggcccucccccaggucggcaaccucggccuccucuucaugcuccucuucuucaucuacgccgcccucggcgucgagcucuucggccgccucgagugcuccgaggacaaccccugcgagggccucucccgccacgccaccuucuccaacuucggcauggccuuccucacccucuuccgcgucuccaccggcgacaacuggaacggcaucaugaaggacacccuccgcgagugcucccgcgaggacaagcacugccucuccuaccuccccgcccucucccccgucuacuucgucaccuucguccucgucgcccaguucguccucgucaacgucgucgucgccguccucaugaagcaccucgaggaguccaacaaggaggcccgcgaggacgccgagcucgacgccgagaucgagcucgagauggcccagggccccggcuccgcccgccgcgucgacgccgaccgccccccccucccccaggagucccccggcgcccgcgacgcccccaaccucgucgcccgcaaggucuccgucucccgcaugcucucccuccccaacgacuccuacauguuccgccccgucguccccgccuccgccccccacccccgcccccuccaggaggucgagauggagaccuacggcgccggcaccccccucggcuccgucgccuccguccacuccccccccgccgaguccugcgccucccuccagaucccccucgccgucuccucccccgcccgcuccggcgagccccuccacgcccucuccccccgcggcaccgcccgcucccccucccucucccgccuccucugccgccaggaggccguccacaccgacucccucgagggcaagaucgacuccccccgcgacacccucgaccccgccgagcccggcgagaagacccccguccgccccgucacccagggcggcucccuccagucccccccccgcuccccccgccccgccuccguccgcacccgcaagcacaccuucggccagcgcugcgucuccucccgccccgccgcccccggcggcgaggaggccgaggccuccgaccccgccgacgaggaggucucccacaucaccuccuccgccugccccuggcagcccaccgccgagccccacggccccgaggccucccccgucgccggcggcgagcgcgaccuccgccgccucuacuccgucgacgcccagggcuuccucgacaagcccggccgcgccgacgagcaguggcgccccuccgccgagcucggcuccggcgagcccggcgaggccaaggccuggggccccgaggccgagcccgcccucggcgcccgccgcaagaagaagauguccccccccugcaucuccgucgagccccccgccgaggacgagggcuccgcccgccccuccgccgccgagggcggcuccaccacccuccgccgccgcacccccuccugcgaggccaccccccaccgcgacucccucgagcccaccgagggcuccggcgccggcggcgaccccgccgccaagggcgagcgcuggggccaggccuccugccgcgccgagcaccucaccguccccuccuucgccuucgagccccucgaccucggcguccccuccggcgaccccuuccucgacggcucccacuccgucacccccgagucccgcgccuccuccuccggcgccaucgucccccucgagccccccgaguccgagccccccaugcccgucggcgacccccccgagaagcgccgcggccucuaccucaccgucccccagugcccccucgagaagcccggcucccccuccgccacccccgcccccggcggcggcgccgacgaccccgucuga

SEQ ID NO: 40671 - RNA, 6672 nt, Artificial Sequence
  derived and/or modified sequence opt2 from CACNA1I__Homo_sapiens__NP_066919
auggccgaguccgccuccccccccuccuccuccgccgccgcccccgccgccgagcccggcgucaccaccgagcagcccggcccccgcuccccccccuccuccccccccggccucgaggagccccucgacggcgccgacccccacgucccccaccccgaccucgcccccaucgccuucuucugccuccgccagaccaccuccccccgcaacuggugcaucaagauggucugcaaccccugguucgagugcgucuccaugcucgucauccuccucaacugcgucacccucggcauguaccagcccugcgacgacauggacugccucuccgaccgcugcaagauccuccaggucuucgacgacuucaucuucaucuucuucgccauggagaugguccucaagauggucgcccucggcaucuucggcaagaagugcuaccucggcgacaccuggaaccgccucgacuucuucaucgucauggccggcauggucgaguacucccucgaccuccagaacaucaaccucuccgccauccgcaccguccgcguccuccgcccccucaaggccaucaaccgcguccccuccaugcgcauccucgucaaccuccuccucgacacccuccccaugcucggcaacguccuccuccucugcuucuucgucuucuucaucuucggcaucaucggcguccagcucugggccggccuccuccgcaaccgcugcuuccucgaggagaacuucaccauccagggcgacgucgcccucccccccuacuaccagcccgaggaggacgacgagaugcccuucaucugcucccucuccggcgacaacggcaucaugggcugccacgagauccccccccucaaggagcagggccgcgagugcugccucuccaaggacgacgucuacgacuucggcgccggccgccaggaccucaacgccuccggccucugcgucaacuggaaccgcuacuacaacgucugccgcaccggcuccgccaacccccacaagggcgccaucaacuucgacaacaucggcuacgccuggaucgucaucuuccaggucaucacccucgagggcugggucgagaucauguacuacgucauggacgcccacuccuucuacaacuucaucuacuucauccuccucaucaucgucggcuccuucuucaugaucaaccucugccucgucgucaucgccacccaguucuccgagaccaagcagcgcgagcaccgccucaugcucgagcagcgccagcgcuaccucuccuccuccaccgucgccuccuacgccgagcccggcgacugcuacgaggagaucuuccaguacgucugccacauccuccgcaaggccaagcgccgcgcccucggccucuaccaggcccuccagucccgccgccaggcccucggccccgaggcccccgcccccgccaagcccggcccccacgccaaggagccccgccacuaccacggcaagaccaagggccagggcgacgagggccgccaccucggcucccgccacugccagacccuccacggccccgccucccccggcaacgaccacuccggccgcgagcucugcccccagcacuccccccucgacgccaccccccacacccucguccagcccauccccgccacccucgccuccgaccccgccuccugccccugcugccagcacgaggacggccgccgccccuccggccucggcuccaccgacuccggccaggagggcuccggcuccggcuccuccgccggcggcgaggacgaggccgacggcgacggcgcccgcuccuccgaggacggcgccuccuccgagcucggcaaggaggaggaggaggaggagcaggccgacggcgccgucuggcucugcggcgacgucuggcgcgagacccgcgccaagcuccgcggcaucgucgacuccaaguacuucaaccgcggcaucaugauggccauccucgucaacaccgucuccaugggcaucgagcaccacgagcagcccgaggagcucaccaacauccucgagaucugcaacgucgucuucaccuccauguucgcccucgagaugauccucaagcucgccgccuucggccucuucgacuaccuccgcaaccccuacaacaucuucgacuccaucaucgucaucaucuccaucugggagaucgucggccaggccgacggcggccucuccguccuccgcaccuuccgccuccuccgcguccucaagcucguccgcuucaugcccgcccuccgccgccagcucgucguccucaugaagaccauggacaacgucgccaccuucugcaugcuccucaugcucuucaucuucaucuucuccauccucggcaugcacaucuucggcugcaaguucucccuccgcaccgacaccggcgacaccguccccgaccgcaagaacuucgacucccuccucugggccaucgucaccgucuuccagauccucacccaggaggacuggaacgucguccucuacaacggcauggccuccaccucccccugggccucccucuacuucgucgcccucaugaccuucggcaacuacguccucuucaaccuccucgucgccauccucgucgagggcuuccaggccgagggcgacgccaaccgcuccuacuccgacgaggaccaguccuccuccaacaucgaggaguucgacaagcuccaggagggccucgacuccuccggcgaccccaagcucugccccauccccaugacccccaacggccaccucgaccccucccucccccucggcggccaccucggccccgccggcgccgccggccccgccccccgccucucccuccagcccgaccccaugcucgucgcccucggcucccgcaaguccuccgucaugucccucggccgcauguccuacgaccagcgcucccucuccuccucccgcuccuccuacuacggccccuggggccgcuccgccgccugggccucccgccgcuccuccuggaacucccucaagcacaagccccccuccgccgagcacgagucccuccucuccgccgagcgcggcggcggcgcccgcgucugcgaggucgccgccgacgagggccccccccgcgccgccccccuccacaccccccacgcccaccacauccaccacggcccccaccucgcccaccgccaccgccaccaccgccgcacccucucccucgacaaccgcgacuccgucgaccucgccgagcucguccccgccgucggcgcccacccccgcgccgccuggcgcgccgccggccccgcccccggccacgaggacugcaacggccgcaugcccuccaucgccaaggacgucuucaccaagaugggcgaccgcggcgaccgcggcgaggacgaggaggagaucgacuacacccucugcuuccgcguccgcaagaugaucgacgucuacaagcccgacuggugcgagguccgcgaggacugguccgucuaccucuucucccccgagaaccgcuuccgcguccucugccagaccaucaucgcccacaagcucuucgacuacgucguccucgccuucaucuuccucaacugcaucaccaucgcccucgagcgcccccagaucgaggccggcuccaccgagcgcaucuuccucaccgucuccaacuacaucuucaccgccaucuucgucggcgagaugacccucaaggucgucucccucggccucuacuucggcgagcaggccuaccuccgcuccuccuggaacguccucgacggcuuccucgucuucgucuccaucaucgacaucgucgucucccucgccuccgccggcggcgccaagauccucggcguccuccgcguccuccgccuccuccgcacccuccgcccccuccgcgucaucucccgcgcccccggccucaagcucgucgucgagacccucaucuccucccucaagcccaucggcaacaucguccucaucugcugcgccuucuucaucaucuucggcauccucggcguccagcucuucaagggcaaguucuaccacugccucggcgucgacacccgcaacaucaccaaccgcuccgacugcauggccgccaacuaccgcuggguccaccacaaguacaacuucgacaaccucggccaggcccucaugucccucuucguccucgccuccaaggacggcugggucaacaucauguacaacggccucgacgccgucgccgucgaccagcagcccgucaccaaccacaaccccuggaugcuccucuacuucaucuccuuccuccucaucgucuccuucuucguccucaacauguucgucggcgucgucgucgagaacuuccacaagugccgccagcaccaggaggccgaggaggcccgccgccgcgaggagaagcgccuccgccgccucgagaagaagcgccgcaaggcccagcgccuccccuacuacgccaccuacugccacacccgccuccucauccacuccaugugcaccucccacuaccucgacaucuucaucaccuucaucaucugccucaacgucgucaccaugucccucgagcacuacaaccagcccaccucccucgagaccgcccucaaguacugcaacuacauguucaccaccgucuucguccucgaggccguccucaagcucgucgccuucggccuccgccgcuucuucaaggaccgcuggaaccagcucgaccucgccaucguccuccucuccgucaugggcaucacccucgaggagaucgagaucaacgccgcccuccccaucaaccccaccaucauccgcaucaugcgcguccuccgcaucgcccgcguccucaagcuccucaagauggccaccggcaugcgcgcccuccucgacaccgucguccaggcccucccccaggucggcaaccucggccuccucuucaugcuccucuucuucaucuacgccgcccucggcgucgagcucuucggcaagcucgucugcaacgacgagaaccccugcgagggcaugucccgccacgccaccuucgagaacuucggcauggccuuccucacccucuuccaggucuccaccggcgacaacuggaacggcaucaugaaggacacccuccgcgacugcacccacgacgagcgcuccugccucuccucccuccaguucgucuccccccucuacuucgucuccuucguccucaccgcccaguucguccucaucaacgucgucgucgccguccucaugaagcaccucgacgacuccaacaaggaggcccaggaggacgccgagauggacgccgagcucgagcucgagauggcccacggccucggccccggcccccgccuccccaccggcucccccggcgcccccggccgcggccccggcggcgccggcggcggcggcgacaccgagggcggccucugccgccgcugcuacucccccgcccaggagaaccucuggcucgacuccgucucccucaucaucaaggacucccucgagggcgagcucaccaucaucgacaaccucuccggcuccaucuuccaccacuacuccucccccgccggcugcaagaagugccaccacgacaagcaggagguccagcucgccgagaccgaggccuucucccucaacuccgaccgcuccuccuccauccuccucggcgacgaccucucccucgaggaccccaccgccugcccccccggccgcaaggacuccaagggcgagcucgacccccccgagcccaugcgcgucggcgaccucggcgagugcuucuucccccucuccuccaccgccgucucccccgaccccgagaacuuccucugcgagauggaggagauccccuucaaccccguccgcuccuggcucaagcacgacuccucccaggccccccccucccccuucucccccgacgccuccuccccccuccuccccaugcccgccgaguucuuccaccccgccgucuccgccucccagaagggccccgagaagggcaccggcaccggcacccuccccaagaucgcccuccagggcuccugggccucccuccgcuccccccgcgucaacugcacccuccuccgccaggccaccggcuccgacaccucccucgacgccucccccuccuccuccgccggcucccuccagaccacccucgaggacucccucacccucuccgacuccccccgccgcgcccucggcccccccgcccccgcccccggcccccgcgccggccucucccccgccgcccgccgccgccucucccuccgcggccgcggccucuucucccuccgcggccuccgcgcccaccagcgcucccacuccuccggcggcuccaccucccccggcugcacccaccacgacuccauggaccccuccgacgaggagggccgcggcggcgccggcggcggcggcgccggcuccgagcacuccgagacccucuccucccucucccucaccucccucuucugcccccccccccccccccccgcccccggccucacccccgcccgcaaguucuccuccaccuccucccucgccgcccccggccgcccccacgccgccgcccucgcccacggccucgcccgcucccccuccugggccgccgaccgcuccaaggacccccccggccgcgccccccuccccaugggccucggcccccucgccccccccccccagccccuccccggcgagcucgagcccggcgacgccgccuccaagcgcaagcgcuga

SEQ ID NO: 40672 - RNA, 5622 nt, Artificial Sequence
  derived and/or modified sequence opt2 from CACNA1S__Homo_sapiens__NP_000060
auggagcccuccuccccccaggacgagggccuccgcaagaagcagcccaagaagcccguccccgagauccucccccgccccccccgcgcccucuucugccucacccucgagaacccccuccgcaaggccugcaucuccaucgucgaguggaagcccuucgagaccaucauccuccucaccaucuucgccaacugcgucgcccucgccgucuaccuccccaugcccgaggacgacaacaacucccucaaccucggccucgagaagcucgaguacuucuuccucaucgucuucuccaucgaggccgccaugaagaucaucgccuacggcuuccucuuccaccaggacgccuaccuccgcuccggcuggaacguccucgacuucaccaucgucuuccucggcgucuucaccgucauccucgagcaggucaacgucauccagucccacaccgcccccauguccuccaagggcgccggccucgacgucaaggcccuccgcgccuuccgcguccuccgcccccuccgccucgucuccggcguccccucccuccaggucguccucaacuccaucuucaaggccaugcucccccucuuccacaucgcccuccucguccucuucauggucaucaucuacgccaucaucggccucgagcucuucaagggcaagaugcacaagaccugcuacuucaucggcaccgacaucgucgccaccgucgagaacgaggagcccucccccugcgcccgcaccggcuccggccgccgcugcaccaucaacggcuccgagugccgcggcggcuggcccggccccaaccacggcaucacccacuucgacaacuucggcuucuccaugcucaccgucuaccagugcaucaccauggagggcuggaccgacguccucuacugggucaacgacgccaucggcaacgaguggcccuggaucuacuucgucacccucauccuccucggcuccuucuucauccucaaccucguccucggcguccucuccggcgaguucaccaaggagcgcgagaaggccaagucccgcggcaccuuccagaagcuccgcgagaagcagcagcucgacgaggaccuccgcggcuacauguccuggaucacccagggcgaggucauggacgucgaggacuuccgcgagggcaagcucucccucgacgagggcggcuccgacaccgagucccucuacgagaucgccggccucaacaagaucauccaguucauccgccacuggcgccaguggaaccgcaucuuccgcuggaagugccacgacaucgucaaguccaaggucuucuacuggcucgucauccucaucgucgcccucaacacccucuccaucgccuccgagcaccacaaccagccccucuggcucacccgccuccaggacaucgccaaccgcguccuccucucccucuucaccaccgagaugcucaugaagauguacggccucggccuccgccaguacuucauguccaucuucaaccgcuucgacugcuucgucgucugcuccggcauccucgagauccuccucgucgaguccggcgccaugaccccccucggcaucuccguccuccgcugcauccgccuccuccgcaucuucaagaucaccaaguacuggaccucccucuccaaccucgucgccucccuccucaacuccauccgcuccaucgccucccuccuccuccuccucuuccucuucaucgucaucuucgcccuccucggcaugcagcucuucggcggccgcuacgacuucgaggacaccgagguccgccgcuccaacuucgacaacuucccccaggcccucaucuccgucuuccagguccucaccggcgaggacuggaccuccaugauguacaacggcaucauggccuacggcggccccuccuaccccggcaugcucgucugcaucuacuucaucauccucuucgucugcggcaacuacauccuccucaacgucuuccucgccaucgccgucgacaaccucgccgaggccgagucccucaccuccgcccagaaggccaaggccgaggagaagaagcgccgcaagauguccaagggccuccccgacaaguccgaggaggagaaguccaccauggccaagaagcucgagcagaagcccaagggcgagggcauccccaccaccgccaagcucaagaucgacgaguucgaguccaacgucaacgaggucaaggaccccuaccccuccgccgacuuccccggcgacgacgaggaggacgagcccgagaucccccucuccccccgcccccgcccccucgccgagcuccagcucaaggagaaggccguccccauccccgaggccuccuccuucuucaucuucucccccaccaacaagauccgcguccucugccaccgcaucgucaacgccaccugguucaccaacuucauccuccucuucauccuccucuccuccgccgcccucgccgccgaggaccccauccgcgccgacuccaugcgcaaccagauccucaagcacuucgacaucggcuucaccuccgucuucaccgucgagaucguccucaagaugaccaccuacggcgccuuccuccacaagggcuccuucugccgcaacuacuucaacaugcucgaccuccucgucgucgccgucucccucaucuccaugggccucgaguccuccgccaucuccgucgucaagauccuccgcguccuccgcguccuccgcccccuccgcgccaucaaccgcgccaagggccucaagcacgucguccagugcauguucgucgccaucuccaccaucggcaacaucguccucgucaccacccuccuccaguucauguucgccugcaucggcguccagcucuucaagggcaaguucuuccgcugcaccgaccucuccaagaugaccgaggaggagugccgcggcuacuacuacgucuacaaggacggcgaccccaugcagaucgagcuccgccaccgcgaguggguccacuccgacuuccacuucgacaacguccucuccgccaugaugucccucuucaccgucuccaccuucgagggcuggccccagcuccucuacaaggccaucgacuccaacgccgaggacgucggccccaucuacaacaaccgcgucgagauggccaucuucuucaucaucuacaucauccucaucgccuucuucaugaugaacaucuucgucggcuucgucaucgucaccuuccaggagcagggcgagaccgaguacaagaacugcgagcucgacaagaaccagcgccagugcguccaguacgcccucaaggcccgcccccuccgcugcuacauccccaagaaccccuaccaguaccaggucugguacaucgucaccuccuccuacuucgaguaccucauguucgcccucaucaugcucaacaccaucugccucggcaugcagcacuacaaccaguccgagcagaugaaccacaucuccgacauccucaacgucgccuucaccaucaucuucacccucgagaugauccucaagcucauggccuucaaggcccgcggcuacuucggcgaccccuggaacgucuucgacuuccucaucgucaucggcuccaucaucgacgucauccucuccgagaucgacaccuuccucgccuccuccggcggccucuacugccucggcggcggcugcggcaacgucgaccccgacgaguccgcccgcaucuccuccgccuucuuccgccucuuccgcgucaugcgccucaucaagcuccucucccgcgccgagggcguccgcacccuccucuggaccuucaucaaguccuuccaggcccuccccuacgucgcccuccucaucgucaugcucuucuucaucuacgccgucaucggcaugcagauguucggcaagaucgcccucgucgacggcacccagaucaaccgcaacaacaacuuccagaccuucccccaggccguccuccuccucuuccgcugcgccaccggcgaggccuggcaggagauccuccucgccugcuccuacggcaagcucugcgaccccgaguccgacuacgcccccggcgaggaguacaccugcggcaccaacuucgccuacuacuacuucaucuccuucuacaugcucugcgccuuccucgucaucaaccucuucgucgccgucaucauggacaacuucgacuaccucacccgcgacugguccauccucggcccccaccaccucgacgaguucaaggccaucugggccgaguacgaccccgaggccaagggccgcaucaagcaccucgacgucgucacccuccuccgccgcauccagcccccccucggcuucggcaaguucugcccccaccgcgucgccugcaagcgccucgucggcaugaacaugccccucaacuccgacggcaccgucaccuucaacgccacccucuucgcccucguccgcaccgcccucaagaucaagaccgagggcaacuucgagcaggccaacgaggagcuccgcgccaucaucaagaagaucuggaagcgcaccuccaugaagcuccucgaccaggucaucccccccaucggcgacgacgaggucaccgucggcaaguucuacgccaccuuccucauccaggagcacuuccgcaaguucaugaagcgccaggaggaguacuacggcuaccgccccaagaaggacaucguccagauccaggccggccuccgcaccaucgaggaggaggccgcccccgagaucugccgcaccgucuccggcgaccucgccgccgaggaggagcucgagcgcgccauggucgaggccgccauggaggagggcaucuuccgccgcaccggcggccucuucggccaggucgacaacuuccucgagcgcaccaacucccucccccccgucauggccaaccagcgcccccuccaguucgccgagaucgagauggaggagauggagucccccgucuuccucgaggacuucccccaggacccccgcaccaacccccucgcccgcgccaacaccaacaacgccaacgccaacgucgccuacggcaacuccaaccacuccaacucccacgucuucuccuccguccacuacgagcgcgaguuccccgaggagaccgagacccccgccacccgcggccgcgcccucggccagcccugccgcguccucggcccccacuccaagcccugcgucgagaugcucaagggccuccucacccagcgcgccaugccccgcggccaggccccccccgcccccugccagugcccccgcgucgaguccuccaugcccgaggaccgcaaguccuccacccccggcucccuccacgaggagaccccccacucccgcuccacccgcgagaacaccucccgcugcuccgcccccgccaccgcccuccucauccagaaggcccucguccgcggcggccucggcacccucgccgccgacgccaacuucaucauggccaccggccaggcccucgccgacgccugccagauggagcccgaggaggucgagaucauggccaccgagcuccucaagggccgcgaggcccccgagggcauggccuccucccucggcugccucaaccucggcuccucccucggcucccucgaccagcaccagggcucccaggagacccucauccccccccgccucuga

SEQ ID NO: 40673 - RNA, 3276 nt, Artificial Sequence
  derived and/or modified sequence opt2 from CACNA2D1__Homo_sapiens__NP_000713
auggccgccggcugccuccucgcccucacccucacccucuuccagucccuccucaucggccccuccuccgaggagcccuuccccuccgccgucaccaucaaguccugggucgacaagaugcaggaggaccucgucacccucgccaagaccgccuccggcgucaaccagcucgucgacaucuacgagaaguaccaggaccucuacaccgucgagcccaacaacgcccgccagcucgucgagaucgccgcccgcgacaucgagaagcuccucuccaaccgcuccaaggcccucguccgccucgcccucgaggccgagaagguccaggccgcccaccaguggcgcgaggacuucgccuccaacgaggucgucuacuacaacgccaaggacgaccucgaccccgagaagaacgacuccgagcccggcucccagcgcaucaagcccgucuucaucgaggacgccaacuucggccgccagaucuccuaccagcacgccgccguccacauccccaccgacaucuacgagggcuccaccaucguccucaacgagcucaacuggaccuccgcccucgacgaggucuucaagaagaaccgcgaggaggaccccucccuccucuggcaggucuucggcuccgccaccggccucgcccgcuacuaccccgccucccccugggucgacaacucccgcacccccaacaagaucgaccucuacgacguccgccgccgccccugguacauccagggcgccgccucccccaaggacaugcucauccucgucgacgucuccggcuccgucuccggccucacccucaagcucauccgcaccuccgucuccgagaugcucgagacccucuccgacgacgacuucgucaacgucgccuccuucaacuccaacgcccaggacgucuccugcuuccagcaccucguccaggccaacguccgcaacaagaagguccucaaggacgccgucaacaacaucaccgccaagggcaucaccgacuacaagaagggcuucuccuucgccuucgagcagcuccucaacuacaacgucucccgcgccaacugcaacaagaucaucaugcucuucaccgacggcggcgaggagcgcgcccaggagaucuucaacaaguacaacaaggacaagaagguccgcgucuucaccuucuccgucggccagcacaacuacgaccgcggccccauccaguggauggccugcgagaacaagggcuacuacuacgagauccccuccaucggcgccauccgcaucaacacccaggaguaccucgacguccucggccgccccaugguccucgccggcgacaaggccaagcagguccaguggaccaacgucuaccucgacgcccucgagcucggccucgucaucaccggcacccuccccgucuucaacaucaccggccaguucgagaacaagaccaaccucaagaaccagcucauccucggcgucaugggcgucgacgucucccucgaggacaucaagcgccucaccccccgcuucacccucugccccaacggcuacuacuucgccaucgaccccaacggcuacguccuccuccaccccaaccuccagcccaagaaccccaagucccaggagcccgucacccucgacuuccucgacgccgagcucgagaacgacaucaaggucgagauccgcaacaagaugaucgacggcgaguccggcgagaagaccuuccgcacccucgucaagucccaggacgagcgcuacaucgacaagggcaaccgcaccuacaccuggacccccgucaacggcaccgacuacucccucgcccucguccuccccaccuacuccuucuacuacaucaaggccaagcucgaggagaccaucacccaggcccgcuccaagaagggcaagaugaaggacuccgagacccucaagcccgacaacuucgaggaguccggcuacaccuucaucgccccccgcgacuacugcaacgaccucaagaucuccgacaacaacaccgaguuccuccucaacuucaacgaguucaucgaccgcaagacccccaacaaccccuccugcaacgccgaccucaucaaccgcguccuccucgacgccggcuucaccaacgagcucguccagaacuacugguccaagcagaagaacaucaagggcgucaaggcccgcuucgucgucaccgacggcggcaucacccgcgucuaccccaaggaggccggcgagaacuggcaggagaaccccgagaccuacgaggacuccuucuacaagcgcucccucgacaacgacaacuacgucuucaccgcccccuacuucaacaaguccggccccggcgccuacgaguccggcaucauggucuccaaggccgucgagaucuacauccagggcaagcuccucaagcccgccgucgucggcaucaagaucgacgucaacuccuggaucgagaacuucaccaagaccuccauccgcgaccccugcgccggccccgucugcgacugcaagcgcaacuccgacgucauggacugcgucauccucgacgacggcggcuuccuccucauggccaaccacgacgacuacaccaaccagaucggccgcuucuucggcgagaucgaccccucccucaugcgccaccucgucaacaucuccgucuacgccuucaacaaguccuacgacuaccaguccgucugcgagcccggcgccgcccccaagcagggcgccggccaccgcuccgccuacguccccuccgucgccgacauccuccagaucggcuggugggccaccgccgccgccugguccauccuccagcaguuccuccucucccucaccuucccccgccuccucgaggccgucgagauggaggacgacgacuucaccgccucccucuccaagcaguccugcaucaccgagcagacccaguacuucuucgacaacgacuccaaguccuucuccggcguccucgacugcggcaacugcucccgcaucuuccacggcgagaagcucaugaacaccaaccucaucuucaucauggucgaguccaagggcaccugccccugcgacacccgccuccucauccaggccgagcagaccuccgacggccccaaccccugcgacauggucaagcagccccgcuaccgcaagggccccgacgucugcuucgacaacaacguccucgaggacuacaccgacugcggcggcgucuccggccucaaccccucccucugguacaucaucggcauccaguuccuccuccucuggcucgucuccggcuccacccaccgccuccucuga

SEQ ID NO: 40674 - RNA, 3438 nt, Artificial Sequence
  derived and/or modified sequence opt2 from CACNA2D2__Homo_sapiens__NP_001005505
auggccguccccgcccgcaccugcggcgccucccgccccggccccgcccgcaccgcccgccccuggcccggcugcggcccccaccccggccccggcacccgccgccccaccuccggccccccccgcccccucuggcuccuccucccccuccucccccuccucgccgcccccggcgccuccgccuacuccuucccccagcagcacaccaugcagcacugggcccgccgccucgagcaggaggucgacggcgucaugcgcaucuucggcggcguccagcagcuccgcgagaucuacaaggacaaccgcaaccucuucgagguccaggagaacgagccccagaagcucgucgagaaggucgccggcgacaucgagucccuccucgaccgcaagguccaggcccucaagcgccucgccgacgccgccgagaacuuccagaaggcccaccgcuggcaggacaacaucaaggaggaggacaucgucuacuacgacgccaaggccgacgccgagcucgacgaccccgaguccgaggacgucgagcgcggcuccaaggccuccacccuccgccucgacuucaucgaggaccccaacuucaagaacaaggucaacuacuccuacgccgccguccagauccccaccgacaucuacaagggcuccaccgucauccucaacgagcucaacuggaccgaggcccucgagaacgucuucauggagaaccgccgccaggaccccacccuccucuggcaggucuucggcuccgccaccggcgucacccgcuacuaccccgccacccccuggcgcgcccccaagaagaucgaccucuacgacguccgccgccgccccugguacauccagggcgccuccucccccaaggacauggucaucaucgucgacgucuccggcuccgucuccggccucacccucaagcucaugaagaccuccgucugcgagaugcucgacacccucuccgacgacgacuacgucaacgucgccuccuucaacgagaaggcccagcccgucuccugcuucacccaccucguccaggccaacguccgcaacaagaaggucuucaaggaggccguccagggcauggucgccaagggcaccaccggcuacaaggccggcuucgaguacgccuucgaccagcuccagaacuccaacaucacccgcgccaacugcaacaagaugaucaugauguucaccgacggcggcgaggaccgcguccaggacgucuucgagaaguacaacuggcccaaccgcaccguccgcgucuucaccuucuccgucggccagcacaacuacgacgucaccccccuccaguggauggccugcgccaacaagggcuacuacuucgagauccccuccaucggcgccauccgcaucaacacccaggaguaccucgacguccucggccgccccaugguccucgccggcaaggaggccaagcagguccaguggaccaacgucuacgaggacgcccucggccucggccucgucgucaccggcacccuccccgucuucaaccucacccaggacggccccggcgagaagaagaaccagcucauccucggcgucaugggcaucgacgucgcccucaacgacaucaagcgccucacccccaacuacacccucggcgccaacggcuacgucuucgccaucgaccucaacggcuacguccuccuccaccccaaccucaagccccagaccaccaacuuccgcgagcccgucacccucgacuuccucgacgccgagcucgaggacgagaacaaggaggagauccgccgcuccaugaucgacggcaacaagggccacaagcagauccgcacccucgucaagucccucgacgagcgcuacaucgacgaggucacccgcaacuacaccuggguccccauccgcuccaccaacuacucccucggccucguccucccccccuacuccaccuucuaccuccaggccaaccucuccgaccagauccuccaggucaaguacuucgaguuccuccuccccuccuccuucgaguccgagggccacgucuucaucgccccccgcgaguacugcaaggaccucaacgccuccgacaacaacaccgaguuccucaagaacuucaucgagcucauggagaaggucacccccgacuccaagcagugcaacaacuuccuccuccacaaccucauccucgacaccggcaucacccagcagcucgucgagcgcgucuggcgcgaccaggaccucaacaccuacucccuccucgccgucuucgccgccaccgacggcggcaucacccgcgucuuccccaacaaggccgccgaggacuggaccgagaaccccgagcccuucaacgccuccuucuaccgccgcucccucgacaaccacggcuacgucuucaagcccccccaccaggacgcccuccuccgcccccucgagcucgagaacgacaccgucggcauccucgucuccaccgccgucgagcucucccucggccgccgcacccuccgccccgccgucgucggcgucaagcucgaccucgaggccugggccgagaaguucaagguccucgccuccaaccgcacccaccaggaccagccccagaagugcggccccaacucccacugcgagauggacugcgaggucaacaacgaggaccuccucugcguccucaucgacgacggcggcuuccucguccucuccaaccagaaccaccagugggaccaggucggccgcuucuucuccgaggucgacgccaaccucaugcucgcccucuacaacaacuccuucuacacccgcaaggaguccuacgacuaccaggccgccugcgccccccagccccccggcaaccucggcgccgccccccgcggcgucuucguccccaccgucgccgacuuccucaaccucgccugguggaccuccgccgccgccuggucccucuuccagcagcuccucuacggccucaucuaccacuccugguuccaggccgaccccgccgaggccgagggcucccccgagacccgcgaguccuccugcgucaugaagcagacccaguacuacuucggcuccgucaacgccuccuacaacgccaucaucgacugcggcaacugcucccgccucuuccacgcccagcgccucaccaacaccaaccuccucuucgucgucgccgagaagccccucugcucccagugcgaggccggccgccuccuccagaaggagacccacugccccgccgacggccccgagcagugcgagcucguccagcgcccccgcuaccgccgcggcccccacaucugcuucgacuacaacgccaccgaggacaccuccgacugcggccgcggcgccuccuucccccccucccucggcguccucgucucccuccagcuccuccuccuccucggccuccccccccgcccccagccccagguccucguccacgccucccgccgccucuga

SEQ ID NO: 40675 - RNA, 3276 nt, Artificial Sequence
  derived and/or modified sequence opt2 from CACNA2D3__Homo_sapiens__NP_060868
auggccggccccggcuccccccgccgcgccucccgcggcgccuccgcccuccucgccgccgcccuccucuacgccgcccucggcgacgucguccgcuccgagcagcagaucccccucuccgucgucaagcucugggccuccgccuucggcggcgagaucaaguccaucgccgccaaguacuccggcucccagcuccuccagaagaaguacaaggaguacgagaaggacgucgccaucgaggagaucgacggccuccagcucgucaagaagcucgccaagaacauggaggagauguuccacaagaaguccgaggccguccgccgccucgucgaggccgccgaggaggcccaccucaagcacgaguucgacgccgaccuccaguacgaguacuucaacgccguccucaucaacgagcgcgacaaggacggcaacuuccucgagcucggcaaggaguucauccucgcccccaacgaccacuucaacaaccuccccgucaacaucucccucuccgacguccagguccccaccaacauguacaacaaggaccccgccaucgucaacggcgucuacugguccgagucccucaacaaggucuucgucgacaacuucgaccgcgaccccucccucaucuggcaguacuucggcuccgccaagggcuucuuccgccaguaccccggcaucaagugggagcccgacgagaacggcgucaucgccuucgacugccgcaaccgcaagugguacauccaggccgccaccucccccaaggacgucgucauccucgucgacgucuccggcuccaugaagggccuccgccucaccaucgccaagcagaccgucuccuccauccucgacacccucggcgacgacgacuucuucaacaucaucgccuacaacgaggagcuccacuacgucgagcccugccucaacggcacccucguccaggccgaccgcaccaacaaggagcacuuccgcgagcaccucgacaagcucuucgccaagggcaucggcaugcucgacaucgcccucaacgaggccuucaacauccucuccgacuucaaccacaccggccagggcuccaucugcucccaggccaucaugcucaucaccgacggcgccgucgacaccuacgacaccaucuucgccaaguacaacuggcccgaccgcaagguccgcaucuucaccuaccucaucggccgcgaggccgccuucgccgacaaccucaaguggauggccugcgccaacaagggcuucuucacccagaucuccacccucgccgacguccaggagaacgucauggaguaccuccacguccucucccgccccaaggucaucgaccaggagcacgacgucgucuggaccgaggccuacaucgacuccacccucccccaggcccagaagcucaccgacgaccagggccccguccucaugaccaccgucgccaugcccgucuucuccaagcagaacgagacccgcuccaagggcauccuccucggcgucgucggcaccgacguccccgucaaggagcuccucaagaccauccccaaguacaagcucggcauccacggcuacgccuucgccaucaccaacaacggcuacauccucacccaccccgagcuccgccuccucuacgaggagggcaagaagcgccgcaagcccaacuacuccuccgucgaccucuccgaggucgagugggaggaccgcgacgacguccuccgcaacgccauggucaaccgcaagaccggcaaguucuccauggaggucaagaagaccgucgacaagggcaagcgcguccucgucaugaccaacgacuacuacuacaccgacaucaagggcacccccuucucccucggcgucgcccucucccgcggccacggcaaguacuucuuccgcggcaacgucaccaucgaggagggccuccacgaccucgagcaccccgacgucucccucgccgacgagugguccuacugcaacaccgaccuccaccccgagcaccgccaccucucccagcucgaggccaucaagcucuaccucaagggcaaggagccccuccuccagugcgacaaggagcucauccaggagguccucuucgacgccgucgucuccgcccccaucgaggccuacuggaccucccucgcccucaacaaguccgagaacuccgacaagggcgucgaggucgccuuccucggcacccgcaccggccucucccgcaucaaccucuucgucggcgccgagcagcucaccaaccaggacuuccucaaggccggcgacaaggagaacaucuucaacgccgaccacuucccccucugguaccgccgcgccgccgagcagauccccggcuccuucgucuacuccauccccuucuccaccggccccgucaacaaguccaacgucgucaccgccuccaccuccauccagcuccucgacgagcgcaagucccccgucgucgccgccgucggcauccagaugaagcucgaguucuuccagcgcaaguucuggaccgccucccgccagugcgccucccucgacggcaagugcuccaucuccugcgacgacgagaccgucaacugcuaccucaucgacaacaacggcuucauccucgucuccgaggacuacacccagaccggcgacuucuucggcgagaucgagggcgccgucaugaacaagcuccucaccaugggcuccuucaagcgcaucacccucuacgacuaccaggccaugugccgcgccaacaaggaguccuccgacggcgcccacggccuccucgaccccuacaacgccuuccucuccgccgucaaguggaucaugaccgagcucguccucuuccucgucgaguucaaccucugcuccugguggcacuccgacaugaccgccaaggcccagaagcucaagcagacccucgagcccugcgacaccgaguaccccgccuucgucuccgagcgcaccaucaaggagaccaccggcaacaucgccugcgaggacugcuccaaguccuucgucauccagcagauccccuccuccaaccucuucauggucgucgucgacuccuccugccucugcgaguccgucgcccccaucaccauggcccccaucgagauccgcuacaacgagucccucaagugcgagcgccucaaggcccagaagauccgccgccgccccgaguccugccacggcuuccaccccgaggagaacgcccgcgagugcggcggcgcccccucccuccaggcccagaccguccuccuccuccucccccuccuccucaugcucuucucccgcuga

SEQ ID NO: 40676 - RNA, 3414 nt, Artificial Sequence
  derived and/or modified sequence opt2 from CACNA2D4__Homo_sapiens__NP_758952
auggucugcggcugcuccgcccuccucccccuccccaacccccgccccaccaugcccgccacccccaacuuccucgccaaccccuccuccuccucccgcuggaucccccuccagcccaugcccgucgccugggccuucguccagaagaccuccgcccuccucuggcuccuccuccucggcaccucccucucccccgccuggggccaggccaagaucccccucgagaccgucaagcucugggccgacaccuucggcggcgaccucuacaacaccgucaccaaguacuccggcucccuccuccuccagaagaaguacaaggacgucgaguccucccucaagaucgaggaggucgacggccucgagcucguccgcaaguucuccgaggacauggagaacaugcuccgccgcaaggucgaggccguccagaaccucgucgaggccgccgaggaggccgaccucaaccacgaguucaacgagucccucgucuucgacuacuacaacuccguccucaucaacgagcgcgacgagaagggcaacuucgucgagcucggcgccgaguuccuccucgaguccaacgcccacuucuccaaccuccccgucaacaccuccaucuccuccguccagcuccccaccaacgucuacaacaaggaccccgacauccucaacggcgucuacauguccgaggcccucaacgccgucuucgucgagaacuuccagcgcgaccccacccucaccuggcaguacuucggcuccgccaccggcuucuuccgcaucuaccccggcaucaaguggacccccgacgagaacggcgucaucaccuucgacugccgcaaccgcggcugguacauccaggccgccaccucccccaaggacaucgucauccucgucgacgucuccggcuccaugaagggccuccgcaugaccaucgccaagcacaccaucaccaccauccucgacacccucggcgagaacgacuucaucaacaucaucgccuacaacgacuacguccacuacaucgagcccugcuucaagggcauccucguccaggccgaccgcgacaaccgcgagcacuucaagcuccucgucgaggagcucauggucaagggcgucggcgucgucgaccaggcccuccgcgaggccuuccagauccucaagcaguuccaggaggccaagcagggcucccucugcaaccaggccaucaugcucaucuccgacggcgccgucgaggacuacgagcccgucuucgagaaguacaacuggcccgacugcaagguccgcgucuucaccuaccucaucggccgcgaggucuccuucgccgaccgcaugaaguggaucgccugcaacaacaagggcuacuacacccagaucuccacccucgccgacacccaggagaacgucauggaguaccuccacguccucucccgccccauggucaucaaccacgaccacgacaucaucuggaccgaggccuacauggacuccaagcuccucuccucccaggcccagucccucacccuccucaccaccgucgccaugcccgucuucuccaagaagaacgagacccgcucccacggcauccuccucggcgucgucggcuccgacgucgcccuccgcgagcucaugaagcucgccccccgcuacaagcucggcguccacggcuacgccuuccucaacaccaacaacggcuacauccucucccaccccgaccuccgcccccucuaccgcgagggcaagaagcucaagcccaagcccaacuacaacuccgucgaccucuccgaggucgagugggaggaccaggccgagucccuccgcaccgccaugaucaaccgcgagaccggcacccucuccauggacgucaagguccccauggacaagggcaagcgcguccucuuccucaccaacgacuacuucuucaccgacaucuccgacacccccuucucccucggcgucguccucucccgcggccacggcgaguacauccuccucggcaacaccuccgucgaggagggccuccacgaccuccuccaccccgaccucgcccucgccggcgacuggaucuacugcaucaccgacaucgaccccgaccaccgcaagcucucccagcucgaggccaugauccgcuuccucacccgcaaggaccccgaccucgagugcgacgaggagcucguccgcgagguccucuucgacgccgucgucaccgcccccauggaggccuacuggaccgcccucgcccucaacauguccgaggaguccgagcacgucgucgacauggccuuccucggcacccgcgccggccuccuccgcuccucccucuucgucggcuccgagaaggucuccgaccgcaaguuccucacccccgaggacgaggccuccgucuucacccucgaccgcuucccccucugguaccgccaggccuccgagcaccccgccggcuccuucgucuucaaccuccgcugggccgagggccccgaguccgccggcgagcccauggucgucaccgccuccaccgccgucgccgucaccgucgacaagcgcaccgccaucgccgccgccgccggcguccagaugaagcucgaguuccuccagcgcaaguucugggccgccacccgccagugcuccaccgucgacggccccugcacccaguccugcgaggacuccgaccucgacugcuucgucaucgacaacaacggcuucauccucaucuccaagcgcucccgcgagaccggccgcuuccucggcgaggucgacggcgccguccucacccagcuccucuccaugggcgucuucucccaggucaccauguacgacuaccaggccaugugcaagcccuccucccaccaccacuccgccgcccagccccucgucucccccaucuccgccuuccucaccgccacccgcuggcuccuccaggagcucguccucuuccuccucgagugguccgucuggggcuccugguacgaccgcggcgccgaggccaaguccgucuuccaccacucccacaagcacaagaagcaggacccccuccagcccugcgacaccgaguaccccgucuucgucuaccagcccgccauccgcgaggccaacggcaucgucgagugcggccccugccagaaggucuucgucguccagcagauccccaacuccaaccuccuccuccucgucaccgaccccaccugcgacugcuccaucuucccccccguccuccaggaggccaccgaggucaaguacaacgccuccgucaagugcgaccgcaugcgcucccagaagcuccgccgccgccccgacuccugccacgccuuccaccccgaggagaacgcccaggacugcggcggcgccuccgacaccuccgccucccccccccuccuccuccuccccgucugcgccuggggccuccucccccagcuccuccgcuga

SEQ ID NO: 40677 - RNA, 1797 nt, Artificial Sequence
  derived and/or modified sequence opt2 from CACNB1__Homo_sapiens__NP_000714
augguccagaagaccuccaugucccgcggccccuacccccccucccaggagauccccauggaggucuucgaccccuccccccagggcaaguacuccaagcgcaagggccgcuucaagcgcuccgacggcuccaccuccuccgacaccaccuccaacuccuucguccgccagggcuccgccgaguccuacaccucccgccccuccgacuccgacgucucccucgaggaggaccgcgaggcccuccgcaaggaggccgagcgccaggcccucgcccagcucgagaaggccaagaccaagcccgucgccuucgccguccgcaccaacgucggcuacaaccccucccccggcgacgagguccccguccagggcgucgccaucaccuucgagcccaaggacuuccuccacaucaaggagaaguacaacaacgacugguggaucggccgccucgucaaggagggcugcgaggucggcuucauccccucccccgucaagcucgacucccuccgccuccuccaggagcagaagcuccgccagaaccgccucggcuccuccaaguccggcgacaacuccuccuccucccucggcgacgucgucaccggcacccgccgccccaccccccccgccuccgccaagcagaagcagaaguccaccgagcacgucccccccuacgacgucguccccuccaugcgccccaucauccucgucggccccucccucaagggcuacgaggucaccgacaugaugcagaaggcccucuucgacuuccucaagcaccgcuucgacggccgcaucuccaucacccgcgucaccgccgacaucucccucgccaagcgcuccguccucaacaaccccuccaagcacaucaucaucgagcgcuccaacacccgcuccucccucgccgagguccaguccgagaucgagcgcaucuucgagcucgcccgcacccuccagcucgucgcccucgacgccgacaccaucaaccaccccgcccagcucuccaagaccucccucgcccccaucaucgucuacaucaagaucaccucccccaagguccuccagcgccucaucaagucccgcggcaagucccaguccaagcaccucaacguccagaucgccgccuccgagaagcucgcccagugcccccccgagauguucgacaucauccucgacgagaaccagcucgaggacgccugcgagcaccucgccgaguaccucgaggccuacuggaaggccacccacccccccuccuccaccccccccaacccccuccucaaccgcaccauggccaccgccgcccucgccgccucccccgcccccgucuccaaccuccagggccccuaccucgccuccggcgaccagccccucgagcgcgccaccggcgagcacgccuccaugcacgaguaccccggcgagcucggccagccccccggccucuaccccuccucccacccccccggccgcgccggcacccuccgcgcccucucccgccaggacaccuucgacgccgacacccccggcucccgcaacuccgccuacaccgagcucggcgacuccugcgucgacauggagaccgaccccuccgagggccccggccucggcgaccccgccggcggcggcaccccccccgcccgccagggcuccugggaggacgaggaggaggacuacgaggaggagcucaccgacaaccgcaaccgcggccgcaacaaggcccgcuacugcgccgagggcggcggccccguccucggccgcaacaagaacgagcucgagggcuggggccgcggcgucuacauccgcuga

SEQ ID NO: 40678 - RNA, 1818 nt, Artificial Sequence
  derived and/or modified sequence opt2 from CACNB2__Homo_sapiens__NP_000715
augcagugcugcggccucguccaccgccgccgcguccgcgucuccuacggcuccgccgacuccuacaccucccgccccuccgacuccgacgucucccucgaggaggaccgcgaggccguccgccgcgaggccgagcgccaggcccaggcccagcucgagaaggccaagaccaagcccgucgccuucgccguccgcaccaacgucuccuacuccgccgcccacgaggacgacguccccguccccggcauggccaucuccuucgaggccaaggacuuccuccacgucaaggagaaguucaacaacgacugguggaucggccgccucgucaaggagggcugcgagaucggcuucauccccucccccgucaagcucgagaacaugcgccuccagcacgagcagcgcgccaagcagggcaaguucuacuccuccaaguccggcggcaacuccuccuccucccucggcgacaucguccccuccucccgcaaguccaccccccccuccuccgccaucgacaucgacgccaccggccucgacgccgaggagaacgacauccccgccaaccaccgcucccccaagcccuccgccaacuccgucaccuccccccacuccaaggagaagcgcaugcccuucuucaagaagaccgagcacaccccccccuacgacgucguccccuccaugcgccccgucguccucgucggccccucccucaagggcuacgaggucaccgacaugaugcagaaggcccucuucgacuuccucaagcaccgcuucgagggccgcaucuccaucacccgcgucaccgccgacaucucccucgccaagcgcuccguccucaacaaccccuccaagcacgccaucaucgagcgcuccaacacccgcuccucccucgccgagguccaguccgagaucgagcgcaucuucgagcucgcccgcacccuccagcucgucguccucgacgccgacaccaucaaccaccccgcccagcucuccaagaccucccucgcccccaucaucgucuacgucaagaucuccucccccaagguccuccagcgccucaucaagucccgcggcaagucccaggccaagcaccucaacguccagauggucgccgccgacaagcucgcccagugcccccccgagcucuucgacgucauccucgacgagaaccagcucgaggacgccugcgagcaccucgccgacuaccucgaggccuacuggaaggccacccacccccccuccuccucccuccccaacccccuccucucccgcacccucgccaccuccucccucccccucucccccacccucgccuccaacucccagggcucccagggcgaccagcgcaccgaccgcuccgcccccauccgcuccgccucccaggccgaggaggagcccuccgucgagcccgucaagaagucccagcaccgcuccuccuccuccgccccccaccacaaccaccgcuccggcaccucccgcggccucucccgccaggagaccuucgacuccgagacccaggagucccgcgacuccgccuacgucgagcccaaggaggacuacucccacgaccacgucgaccacuacgccucccaccgcgaccacaaccaccgcgacgagacccacggcuccuccgaccaccgccaccgcgagucccgccaccgcucccgcgacgucgaccgcgagcaggaccacaacgagugcaacaagcagcgcucccgccacaaguccaaggaccgcuacugcgagaaggacggcgaggucaucuccaagaagcgcaacgaggccggcgaguggaaccgcgacgucuacauccgccaguga

SEQ ID NO: 40679 - RNA, 1455 nt, Artificial Sequence
  derived and/or modified sequence opt2 from CACNB3__Homo_sapiens__NP_000716
auguacgacgacuccuacguccccggcuucgaggacuccgaggccggcuccgccgacuccuacaccucccgccccucccucgacuccgacgucucccucgaggaggaccgcgaguccgcccgccgcgaggucgagucccaggcccagcagcagcucgagcgcgccaagcacaagcccgucgccuucgccguccgcaccaacgucuccuacugcggcguccucgacgaggagugccccguccagggcuccggcgucaacuucgaggccaaggacuuccuccacaucaaggagaaguacuccaacgacugguggaucggccgccucgucaaggagggcggcgacaucgccuucauccccuccccccagcgccucgaguccauccgccucaagcaggagcagaaggcccgccgcuccggcaaccccuccucccucuccgacaucggcaaccgccgcucccccccccccucccucgccaagcagaagcagaagcaggccgagcacgucccccccuacgacgucguccccuccaugcgccccgucguccucgucggccccucccucaagggcuacgaggucaccgacaugaugcagaaggcccucuucgacuuccucaagcaccgcuucgacggccgcaucuccaucacccgcgucaccgccgaccucucccucgccaagcgcuccguccucaacaaccccggcaagcgcaccaucaucgagcgcuccuccgcccgcuccuccaucgccgagguccaguccgagaucgagcgcaucuucgagcucgccaagucccuccagcucgucguccucgacgccgacaccaucaaccaccccgcccagcucgccaagaccucccucgcccccaucaucgucuucgucaaggucuccucccccaagguccuccagcgccucauccgcucccgcggcaagucccagaugaagcaccucaccguccagaugauggccuacgacaagcucguccagugcccccccgaguccuucgacgucauccucgacgagaaccagcucgaggacgccugcgagcaccucgccgaguaccucgaggucuacuggcgcgccacccaccaccccgcccccggccccggccuccucggcccccccuccgccauccccggccuccagaaccagcagcuccucggcgagcgcggcgaggagcacuccccccucgagcgcgacucccucaugcccuccgacgaggccuccgaguccucccgccaggccuggaccggcuccucccagcgcuccucccgccaccucgaggaggacuacgccgacgccuaccaggaccucuaccagccccaccgccagcacaccuccggccuccccuccgccaacggccacgacccccaggaccgccuccucgcccaggacuccgagcacaaccacuccgaccgcaacuggcagcgcaaccgccccuggcccaaggacuccuacuga

SEQ ID NO: 40680 - RNA, 1563 nt, Artificial Sequence
  derived and/or modified sequence opt2 from CACNB4__Homo_sapiens__NP_000717
auguccuccuccuccuacgccaagaacggcaccgccgacggcccccacucccccaccucccaggucgcccgcggcaccaccacccgccgcucccgccucaagcgcuccgacggcuccaccaccuccaccuccuucauccuccgccagggcuccgccgacuccuacaccucccgccccuccgacuccgacgucucccucgaggaggaccgcgaggccauccgccaggagcgcgagcagcaggccgccauccagcucgagcgcgccaaguccaagcccgucgccuucgccgucaagaccaacgucuccuacugcggcgcccucgacgaggacguccccguccccuccaccgccaucuccuucgacgccaaggacuuccuccacaucaaggagaaguacaacaacgacugguggaucggccgccucgucaaggagggcugcgagaucggcuucauccccuccccccuccgccucgagaacauccgcauccagcaggagcagaagcgcggccgcuuccacggcggcaaguccuccggcaacuccuccuccucccucggcgagauggucuccggcaccuuccgcgccacccccaccuccaccgccaagcagaagcagaaggucaccgagcacaucccccccuacgacgucguccccuccaugcgccccgucguccucgucggccccucccucaagggcuacgaggucaccgacaugaugcagaaggcccucuucgacuuccucaagcaccgcuucgacggccgcaucuccaucacccgcgucaccgccgacaucucccucgccaagcgcuccguccucaacaaccccuccaagcgcgccaucaucgagcgcuccaacacccgcuccucccucgccgagguccaguccgagaucgagcgcaucuucgagcucgcccgcucccuccagcucgucguccucgacgccgacaccaucaaccaccccgcccagcucaucaagaccucccucgcccccaucaucguccacgucaaggucuccucccccaagguccuccagcgccucaucaagucccgcggcaagucccaguccaagcaccucaacguccagcucgucgccgccgacaagcucgcccagugcccccccgagauguucgacgucauccucgacgagaaccagcucgaggacgccugcgagcaccucggcgaguaccucgaggccuacuggcgcgccacccacaccaccuccuccacccccaugaccccccuccucggccgcaaccucggcuccaccgcccucucccccuaccccaccgccaucuccggccuccagucccagcgcaugcgccacuccaaccacuccaccgagaacucccccaucgagcgccgcucccucaugaccuccgacgagaacuaccacaacgagcgcgcccgcaagucccgcaaccgccucuccuccuccucccagcacucccgcgaccacuacccccucgucgaggaggacuaccccgacuccuaccaggacaccuacaagccccaccgcaaccgcggcucccccggcggcuacucccacgacucccgccaccgccucuga

SEQ ID NO: 40681 - RNA, 972 nt, Artificial Sequence
  derived and/or modified sequence opt2 from CACNG2__Homo_sapiens__NP_006069
augggccucuucgaccgcggcguccagaugcuccucaccaccgucggcgccuucgccgccuucucccucaugaccaucgccgucggcaccgacuacuggcucuacucccgcggcgucugcaagaccaaguccgucuccgagaacgagaccuccaagaagaacgaggaggucaugacccacuccggccucuggcgcaccugcugccucgagggcaacuucaagggccucugcaagcagaucgaccacuuccccgaggacgccgacuacgaggccgacaccgccgaguacuuccuccgcgccguccgcgccuccuccaucuuccccauccucuccgucauccuccucuucaugggcggccucugcaucgccgccuccgaguucuacaagacccgccacaacaucauccucuccgccggcaucuucuucgucuccgccggccucuccaacaucaucggcaucaucgucuacaucuccgccaacgccggcgaccccuccaaguccgacuccaagaagaacuccuacuccuacggcugguccuucuacuucggcgcccucuccuucaucaucgccgagauggucggcguccucgccguccacauguucaucgaccgccacaagcagcuccgcgccaccgcccgcgccaccgacuaccuccaggccuccgccaucacccgcauccccuccuaccgcuaccgcuaccagcgccgcucccgcuccuccucccgcuccaccgagcccucccacucccgcgacgccucccccgucggcaucaagggcuucaacacccuccccuccaccgagaucuccauguacacccucucccgcgacccccucaaggccgccaccacccccaccgccaccuacaacuccgaccgcgacaacuccuuccuccagguccacaacugcauccagaaggagaacaaggacucccuccacuccaacaccgccaaccgccgcaccacccccgucuga

SEQ ID NO: 40682 - RNA, 948 nt, Artificial Sequence
  derived and/or modified sequence opt2 from CACNG3__Homo_sapiens__NP_006530
augcgcaugugcgaccgcggcauccagaugcucaucaccaccgucggcgccuucgccgccuucucccucaugaccaucgccgucggcaccgacuacuggcucuacucccgcggcgucugccgcaccaaguccaccuccgacaacgagaccucccgcaagaacgaggaggucaugacccacuccggccucuggcgcaccugcugccucgagggcgccuuccgcggcgucugcaagaagaucgaccacuuccccgaggacgccgacuacgagcaggacaccgccgaguaccuccuccgcgccguccgcgccuccuccgucuuccccauccucuccgucacccuccucuucuucggcggccucugcgucgccgccuccgaguuccaccgcucccgccacaacgucauccucuccgccggcaucuucuucgucuccgccggccucuccaacaucaucggcaucaucgucuacaucuccgccaacgccggcgaccccggccagcgcgacuccaagaaguccuacuccuacggcugguccuucuacuucggcgccuucuccuucaucaucgccgagaucgucggcgucgucgccguccacaucuacaucgagaagcaccagcagcuccgcgccaagucccacuccgaguuccucaagaaguccaccuucgcccgccucccccccuaccgcuaccgcuuccgccgccgcuccuccucccgcuccaccgagccccgcucccgcgaccucucccccaucuccaagggcuuccacaccauccccuccaccgacaucuccauguucacccucucccgcgaccccuccaagaucaccaugggcacccuccucaacuccgaccgcgaccacgccuuccuccaguuccacaacuccacccccaaggaguucaaggagucccuccacaacaaccccgccaaccgccgcaccacccccgucuga

SEQ ID NO: 40683 - RNA, 984 nt, Artificial Sequence
  derived and/or modified sequence opt2 from CACNG4__Homo_sapiens__NP_055220
augguccgcugcgaccgcggccuccagaugcuccucaccaccgccggcgccuucgccgccuucucccucauggccaucgccaucggcaccgacuacuggcucuacuccuccgcccacaucugcaacggcaccaaccucaccauggacgacggcccccccccccgccgcgcccgcggcgaccucacccacuccggccucuggcgcgucugcugcaucgagggcaucuacaagggccacugcuuccgcaucaaccacuuccccgaggacaacgacuacgaccacgacuccuccgaguaccuccuccgcaucguccgcgccuccuccgucuuccccauccucuccaccauccuccuccuccucggcggccucugcaucggcgccggccgcaucuacucccgcaagaacaacaucguccucuccgccggcauccucuucgucgccgccggccucuccaacaucaucggcaucaucgucuacaucuccuccaacaccggcgaccccuccgacaagcgcgacgaggacaagaagaaccacuacaacuacggcugguccuucuacuucggcgcccucuccuucaucgucgccgagaccgucggcguccucgccgucaacaucuacaucgagaagaacaaggagcuccgcuucaagaccaagcgcgaguuccucaaggccuccuccuccucccccuacgcccgcaugcccuccuaccgcuaccgccgccgccgcucccgcuccuccucccgcuccaccgaggccucccccucccgcgacgucucccccaugggccucaagaucaccggcgccauccccaugggcgagcucuccauguacacccucucccgcgagccccucaaggucaccaccgccgccuccuacucccccgaccaggaggccuccuuccuccagguccacgacuucuuccagcaggaccucaaggagggcuuccacgucuccaugcucaaccgccgcaccacccccgucuga

SEQ ID NO: 40684 - RNA, 828 nt, Artificial Sequence
  derived and/or modified sequence opt2 from CACNG5__Homo_sapiens__XP_011522915
auguccgccugcggccgcaaggcccucacccuccucuccuccgucuucgccgucugcggccucggccuccucggcaucgccgucuccaccgacuacuggcucuaccucgaggagggcgucaucgucccccagaaccaguccaccgagaucaagaugucccuccacuccggccucuggcgcgucugcuuccucgccggcgaggagcgcggccgcugcuucaccaucgaguacgucaugcccaugaacacccagcucaccuccgaguccaccgucaacguccucaagaugauccgcuccgccacccccuucccccucgucucccucuucuucauguucaucggcuucauccucaacaacaucggccacauccgcccccaccgcaccauccucgccuucgucuccggcaucuucuucauccucuccggccucucccucgucgucggccucguccucuacaucuccuccaucaacgacgagaugcucaaccgcaccaaggacgccgagaccuacuucaacuacaaguacggcugguccuucgccuucgccgccaucuccuuccuccucaccgaguccgccggcgucauguccgucuaccucuucaugaagcgcuacaccgccgaggacauguaccgcccccaccccggcuucuaccgcccccgccucuccaacugcuccgacuacuccggccaguuccuccaccccgacgccuggguccgcggccgcucccccuccgacaucuccuccgaggccucccuccagaugaacuccaacuaccccgcccuccucaagugccccgacuacgaccagauguccuccucccccugcuga

SEQ ID NO: 40685 - RNA, 570 nt, Artificial Sequence
  derived and/or modified sequence opt2 from CACNG6__Homo_sapiens__NP_114103
augaugugguccaacuucuuccuccaggaggagaaccgccgccgcggcgccgccggccgccgccgcgcccacggccagggccgcuccggccucacccccgagcgcgagggcaaggucaagcucgcccuccuccucgccgccgucggcgccacccucgccguccucuccgucggcaccgaguucugggucgagcucaacaccuacaaggccaacggcuccgccgucugcgaggccgcccaccucggccucuggaaggccugcaccaagcgccucuggcaggccgacguccccgucgaccgcgacaccugcggccccgccgagcuccccggcggccuccuccuccucgucucccucgaggucuuccgccacuccguccgcgcccuccuccagcgcgucucccccgagcccccccccgccccccgccucaccuacgaguacuccuggucccucggcugcggcgucggcgccggccucauccuccuccucggcgccggcugcuuccuccuccucacccuccccuccuggcccuggggcucccucugccccaagcgcggccaccgcgccaccuga

SEQ ID NO: 40686 - RNA, 1110 nt, Artificial Sequence
  derived and/or modified sequence opt2 from CACUL1__Homo_sapiens__NP_722517
auggaggaguccauggaggaggaggagggcggcuccuacgaggccaugauggacgaccagaaccacaacaacugggaggccgccgucgacggcuuccgccagccccucccccccccccccccccccuccuccauccccgcccccgcccgcgagccccccggcggccagcuccucgccguccccgccgucuccgucgaccgcaagggccccaaggagggccuccccaugggcccccagcccccccccgaggccaacggcgucaucaugaugcucaaguccugcgacgccgccgccgccgucgccaaggccgcccccgcccccaccgccuccuccaccaucaacaucaacaccuccaccuccaaguuccucaugaacgucaucaccaucgaggacuacaaguccaccuacuggcccaagcucgacggcgccaucgaccagcuccucacccagucccccggcgacuacauccccaucuccuacgagcagaucuacuccugcgucuacaagugcgucugccagcagcacuccgagcagauguacuccgaccucaucaagaagaucaccaaccaccucgagcgcgucuccaaggagcuccaggccuccccccccgaccucuacaucgagcgcuucaacaucgcccucggccaguacaugggcgcccuccaguccaucgucccccucuucaucuacaugaacaaguucuacaucgagaccaagcucaaccgcgaccucaaggacgaccucaucaagcucuucaccgagcacgucgccgagaagcacaucuacucccucaugccccuccuccucgaggcccaguccacccccuuccaggucacccccuccaccauggccaacaucgucaagggccucuacacccuccgccccgaguggguccagauggcccccacccucuucuccaaguucauccccaacauccucccccccgccgucgaguccgagcucuccgaguacgccgcccaggaccagaaguuccagcgcgagcucauccagaacggcuucacccgcggcgaccagucccgcaagcgcgccggcgacgagcucgccuacaacuccuccuccgccugcgccuccucccgcggcuaccgcuga

SEQ ID NO: 40687 - RNA, 558 nt, Artificial Sequence
  derived and/or modified sequence opt2 from CACYBP__Homo_sapiens__NP_001007215
augcagcagaagucccagaagaaggccgagcuccucgacaacgagaagcccgccgccgucgucgcccccaucaccaccggcuacaccgucaagaucuccaacuacggcugggaccaguccgacaaguucgucaagaucuacaucacccucaccggcguccaccagguccccaccgagaacguccagguccacuucaccgagcgcuccuucgaccuccucgucaagaaccucaacggcaaguccuacuccaugaucgucaacaaccuccucaagcccaucuccgucgagggcuccuccaagaaggucaagaccgacaccguccucauccucugccgcaagaaggucgagaacacccgcugggacuaccucacccaggucgagaaggagugcaaggagaaggagaagcccuccuacgacaccgagaccgaccccuccgagggccucaugaacguccucaagaagaucuacgaggacggcgacgacgacaugaagcgcaccaucaacaaggccugggucgagucccgcgagaagcaggccaagggcgacaccgaguucuga

SEQ ID NO: 40688 - RNA, 6678 nt, Artificial Sequence
  derived and/or modified sequence opt2 from CAD__Homo_sapiens__NP_004332
auggccgcccucguccucgaggacggcuccguccuccgcggccagcccuucggcgccgccgucuccaccgccggcgaggucgucuuccagaccggcauggucggcuaccccgaggcccucaccgaccccuccuacaaggcccagauccucguccucaccuacccccucaucggcaacuacggcaucccccccgacgagauggacgaguucggccucugcaagugguucgaguccuccggcauccacgucgccgcccucgucgucggcgagugcugccccacccccucccacugguccgccacccgcacccuccacgaguggcuccagcagcacggcauccccggccuccagggcgucgacacccgcgagcucaccaagaagcuccgcgagcagggcucccuccucggcaagcucguccagaacggcaccgagcccuccucccuccccuuccucgaccccaacgcccgcccccucguccccgaggucuccaucaagaccccccgcgucuucaacaccggcggcgccccccgcauccucgcccucgacugcggccucaaguacaaccagauccgcugccucugccagcgcggcgccgaggucaccgucguccccugggaccacgcccucgacucccaggaguacgagggccucuuccucuccaacggccccggcgaccccgccuccuaccccuccgucgucuccacccucucccgcguccucuccgagcccaacccccgccccgucuucggcaucugccucggccaccagcuccucgcccucgccaucggcgccaagaccuacaagaugcgcuacggcaaccgcggccacaaccagcccugccuccucgucggcuccggccgcugcuuccucaccucccagaaccacggcuucgccgucgagaccgacucccuccccgccgacugggccccccucuucaccaacgccaacgacggcuccaacgagggcaucguccacaacucccuccccuucuucuccguccaguuccaccccgagcaccaggccggccccuccgacauggagcuccucuucgacaucuuccucgagaccgucaaggaggccaccgccggcaaccccggcggccagaccguccgcgagcgccucaccgagcgccucugcccccccggcauccccacccccggcuccggccucccccccccccgcaagguccucauccucggcuccggcggccucuccaucggccaggccggcgaguucgacuacuccggcucccaggccaucaaggcccucaaggaggagaacauccagacccuccucaucaaccccaacaucgccaccguccagaccucccagggccucgccgacaaggucuacuuccuccccaucaccccccacuacgucacccaggucauccgcaacgagcgccccgacggcguccuccucaccuucggcggccagaccgcccucaacugcggcgucgagcucaccaaggccggcguccucgcccgcuacggcguccgcguccucggcacccccgucgagaccaucgagcucaccgaggaccgccgcgccuucgccgcccgcauggccgagaucggcgagcacgucgcccccuccgaggccgccaacucccucgagcaggcccaggccgccgccgagcgccucggcuaccccguccucguccgcgccgccuucgcccucggcggccucggcuccggcuucgccuccaaccgcgaggagcucuccgcccucgucgcccccgccuucgcccacaccucccagguccucgucgacaagucccucaagggcuggaaggagaucgaguacgaggucguccgcgacgccuacggcaacugcgucaccgucugcaacauggagaaccucgacccccucggcauccacaccggcgaguccaucgucgucgcccccucccagacccucaacgaccgcgaguaccagcuccuccgccagaccgccaucaaggucacccagcaccucggcaucgucggcgagugcaacguccaguacgcccucaaccccgaguccgagcaguacuacaucaucgaggucaacgcccgccucucccgcuccuccgcccucgccuccaaggccaccggcuacccccucgccuacgucgccgccaagcucgcccucggcaucccccuccccgagcuccgcaacuccgucaccggcggcaccgccgccuucgagcccuccgucgacuacugcgucgucaagaucccccgcugggaccucuccaaguuccuccgcgucuccaccaagaucggcuccugcaugaaguccgucggcgaggucaugggcaucggccgcuccuucgaggaggccuuccagaaggcccuccgcauggucgacgagaacugcgucggcuucgaccacaccgucaagcccgucuccgacauggagcucgagacccccaccgacaagcgcaucuucgucgucgccgccgcccucugggccggcuacuccgucgaccgccucuacgagcucacccgcaucgaccgcugguuccuccaccgcaugaagcgcaucaucgcccacgcccagcuccucgagcagcaccgcggccagccccucccccccgaccuccuccagcaggccaagugccucggcuucuccgacaagcagaucgcccucgccguccucuccaccgagcucgccguccgcaagcuccgccaggagcucggcaucugccccgccgucaagcagaucgacaccgucgccgccgaguggcccgcccagaccaacuaccucuaccucaccuacuggggcaccacccacgaccucaccuuccgcaccccccacguccucguccucggcuccggcgucuaccgcaucggcuccuccgucgaguucgacuggugcgccgucggcugcauccagcagcuccgcaagaugggcuacaagaccaucauggucaacuacaaccccgagaccgucuccaccgacuacgacaugugcgaccgccucuacuucgacgagaucuccuucgaggucgucauggacaucuacgagcucgagaaccccgagggcgucauccucuccaugggcggccagcuccccaacaacauggccauggcccuccaccgccagcagugccgcguccucggcaccucccccgaggccaucgacuccgccgagaaccgcuucaaguucucccgccuccucgacaccaucggcaucucccagccccaguggcgcgagcucuccgaccucgaguccgcccgccaguucugccagaccgucggcuaccccugcgucguccgccccuccuacguccucuccggcgccgccaugaacgucgccuacaccgacggcgaccucgagcgcuuccucuccuccgccgccgccgucuccaaggagcaccccgucgucaucuccaaguucauccaggaggccaaggagaucgacgucgacgccgucgccuccgacggcgucgucgccgccaucgccaucuccgagcacgucgagaacgccggcguccacuccggcgacgccacccucgucacccccccccaggacaucaccgccaagacccucgagcgcaucaaggccaucguccacgccgucggccaggagcuccaggucaccggccccuucaaccuccagcucaucgccaaggacgaccagcucaaggucaucgagugcaacguccgcgucucccgcuccuuccccuucgucuccaagacccucggcgucgaccucgucgcccucgccacccgcgucaucaugggcgaggaggucgagcccgucggccucaugaccggcuccggcgucgucggcgucaaggucccccaguucuccuucucccgccucgccggcgccgacgucguccucggcgucgagaugaccuccaccggcgaggucgccggcuucggcgagucccgcugcgaggccuaccucaaggccaugcucuccaccggcuucaagauccccaagaagaacauccuccucaccaucggcuccuacaagaacaaguccgagcuccuccccaccguccgccuccucgagucccucggcuacucccucuacgccucccucggcaccgccgacuucuacaccgagcacggcgucaaggucaccgccgucgacuggcacuucgaggaggccgucgacggcgagugccccccccagcgcuccauccucgagcagcucgccgagaagaacuucgagcucgucaucaaccucuccaugcgcggcgccggcggccgccgccucuccuccuucgucaccaagggcuaccgcacccgccgccucgccgccgacuucuccgucccccucaucaucgacaucaagugcaccaagcucuucgucgaggcccucggccagaucggccccgcccccccccucaagguccacgucgacugcaugaccucccagaagcucguccgccuccccggccucaucgacguccacguccaccuccgcgagcccggcggcacccacaaggaggacuucgccuccggcaccgccgccgcccucgccggcggcaucaccauggucugcgccaugcccaacacccgcccccccaucaucgacgcccccgcccucgcccucgcccagaagcucgccgaggccggcgcccgcugcgacuucgcccucuuccucggcgccuccuccgagaacgccggcacccucggcaccgucgccggcuccgccgccggccucaagcucuaccucaacgagaccuucuccgagcuccgccucgacuccgucguccaguggauggagcacuucgagaccuggcccucccaccuccccaucgucgcccacgccgagcagcagaccgucgccgccguccucauggucgcccagcucacccagcgcuccguccacaucugccacgucgcccgcaaggaggagauccuccucaucaaggccgccaaggcccgcggccuccccgucaccugcgaggucgccccccaccaccucuuccucucccacgacgaccucgagcgccucggccccggcaagggcgagguccgccccgagcucggcucccgccaggacgucgaggcccucugggagaacauggccgucaucgacugcuucgccuccgaccacgccccccacacccucgaggagaagugcggcucccgccccccccccggcuuccccggccucgagaccaugcucccccuccuccucaccgccgucuccgagggccgccucucccucgacgaccuccuccagcgccuccaccacaacccccgccgcaucuuccaccuccccccccaggaggacaccuacgucgaggucgaccucgagcacgaguggaccauccccucccacaugcccuucuccaaggcccacuggacccccuucgagggccagaaggucaagggcaccguccgccgcgucguccuccgcggcgaggucgccuacaucgacggccagguccucgucccccccggcuacggccaggacguccgcaaguggccccagggcgccgucccccagcucccccccuccgcccccgccaccuccgagaugaccaccacccccgagcgcccccgccgcggcauccccggccuccccgacggccgcuuccaccuccccccccgcauccaccgcgccuccgaccccggccuccccgccgaggagcccaaggagaaguccucccgcaaggucgccgagcccgagcucaugggcacccccgacggcaccugcuacccccccccccccgucccccgccaggccuccccccagaaccucggcacccccggccuccuccacccccagaccuccccccuccuccacucccucgucggccagcacauccucuccguccagcaguucaccaaggaccagaugucccaccucuucaacgucgcccacacccuccgcaugaugguccagaaggagcgcucccucgacauccucaagggcaaggucauggccuccauguucuacgaggucuccacccgcaccuccuccuccuucgccgccgccauggcccgccucggcggcgccguccucuccuucuccgaggccaccuccuccguccagaagggcgagucccucgccgacuccguccagaccauguccugcuacgccgacgucgucguccuccgccacccccagcccggcgccgucgagcucgccgccaagcacugccgccgccccgucaucaacgccggcgacggcgucggcgagcaccccacccaggcccuccucgacaucuucaccauccgcgaggagcucggcaccgucaacggcaugaccaucaccauggucggcgaccucaagcacggccgcaccguccacucccucgccugccuccucacccaguaccgcgucucccuccgcuacgucgccccccccucccuccgcaugccccccaccguccgcgccuucgucgccucccgcggcaccaagcaggaggaguucgaguccaucgaggaggcccuccccgacaccgacguccucuacaugacccgcauccagaaggagcgcuucggcuccacccaggaguacgaggccugcuucggccaguucauccucaccccccacaucaugacccgcgccaagaagaagauggucgucaugcaccccaugccccgcgucaacgagaucuccgucgaggucgacuccgacccccgcgccgccuacuuccgccaggccgagaacggcauguacauccgcauggcccuccucgccaccguccucggccgcuucuga

SEQ ID NO: 40689 - RNA, 1245 nt, Artificial Sequence
  derived and/or modified sequence opt2 from CADM1__Homo_sapiens__NP_001091987
auggccuccgucguccuccccuccggcucccagugcgccgccgccgccgccgccgccgccccccccggccuccgccuccgccuccuccuccuccucuucuccgccgccgcccucauccccaccggcgacggccagaaccucuucaccaaggacgucaccgucaucgagggcgaggucgccaccaucuccugccaggucaacaaguccgacgacuccgucauccagcuccucaaccccaaccgccagaccaucuacuuccgcgacuuccgcccccucaaggacucccgcuuccagcuccucaacuucuccuccuccgagcucaaggucucccucaccaacgucuccaucuccgacgagggccgcuacuucugccagcucuacaccgaccccccccaggaguccuacaccaccaucaccguccucguccccccccgcaaccucaugaucgacauccagaaggacaccgccgucgagggcgaggagaucgaggucaacugcaccgccauggccuccaagcccgccaccaccauccgcugguucaagggcaacaccgagcucaagggcaaguccgaggucgaggagugguccgacauguacaccgucaccucccagcucaugcucaagguccacaaggaggacgacggcguccccgucaucugccaggucgagcaccccgccgucaccggcaaccuccagacccagcgcuaccucgagguccaguacaagccccagguccacauccagaugaccuacccccuccagggccucacccgcgagggcgacgcccucgagcucaccugcgaggccaucggcaagccccagcccgucauggucaccuggguccgcgucgacgacgagaugccccagcacgccguccucuccggccccaaccucuucaucaacaaccucaacaagaccgacaacggcaccuaccgcugcgaggccuccaacaucgucggcaaggcccacuccgacuacaugcucuacgucuacgacucccgcgccggcgaggagggcuccauccgcgccgucgaccacgccgucaucggcggcgucgucgccgucgucgucuucgccaugcucugccuccucaucauccucggccgcuacuucgcccgccacaagggcaccuacuucacccacgaggccaagggcgccgacgacgccgccgacgccgacaccgccaucaucaacgccgagggcggccagaacaacuccgaggagaagaaggaguacuucaucuga

SEQ ID NO: 40690 - RNA, 1308 nt, Artificial Sequence
  derived and/or modified sequence opt2 from CADM2__Homo_sapiens__NP_001161146
augaucuggaagcgcuccgccguccuccgcuucuacuccgucugcggccuccuccuccagggcucccagggccaguucccccucacccagaacgucaccgucgucgagggcggcaccgccauccucaccugccgcgucgaccagaacgacaacaccucccuccagugguccaaccccgcccagcagacccucuacuucgacgacaagaaggcccuccgcgacaaccgcaucgagcucguccgcgccuccuggcacgagcucuccaucuccgucuccgacgucucccucuccgacgagggccaguacaccugcucccucuucaccaugcccgucaagaccuccaaggccuaccucaccguccucggcguccccgagaagccccagaucuccggcuucuccucccccgucauggagggcgaccucaugcagcucaccugcaagaccuccggcuccaagcccgccgccgacauccgcugguucaagaacgacaaggagaucaaggacgucaaguaccucaaggaggaggacgccaaccgcaagaccuucaccgucuccuccacccucgacuuccgcgucgaccgcuccgacgacggcgucgccgucaucugccgcgucgaccacgagucccucaacgccaccccccaggucgccaugcagguccucgagauccacuacacccccuccgucaagaucauccccuccacccccuucccccaggagggccagccccucauccucaccugcgaguccaagggcaagccccuccccgagcccguccucuggaccaaggacggcggcgagcuccccgaccccgaccgcauggucgucuccggccgcgagcucaacauccucuuccucaacaagaccgacaacggcaccuaccgcugcgaggccaccaacaccaucggccaguccuccgccgaguacguccucaucguccacgacguccccaacacccuccuccccaccaccaucauccccucccucaccaccgccaccgucaccaccaccgucgccaucaccaccucccccaccaccuccgccaccaccuccuccauccgcgaccccaacgcccucgccggccagaacggccccgaccacgcccucaucggcggcaucgucgccgucgucgucuucgucacccucugcuccaucuuccuccucggccgcuaccucgcccgccacaagggcaccuaccucaccaacgaggccaagggcgccgaggacgcccccgacgccgacaccgccaucaucaacgccgagggcucccaggucaacgccgaggagaagaaggaguacuucaucuga

SEQ ID NO: 40691 - RNA, 1197 nt, Artificial Sequence
  derived and/or modified sequence opt2 from CADM3__Homo_sapiens__NP_001120645
augggcgcccccgccgccucccuccuccuccuccuccuccucuucgccugcugcugggcccccggcggcgccaaccucucccaggacgacucccagcccuggaccuccgacgagaccgucgucgccggcggcaccgucguccucaagugccaggucaaggaccacgaggacuccucccuccagugguccaaccccgcccagcagacccucuacuucggcgagaagcgcgcccuccgcgacaaccgcauccagcucgucaccuccaccccccacgagcucuccaucuccaucuccaacgucgcccucgccgacgagggcgaguacaccugcuccaucuucaccaugcccguccgcaccgccaagucccucgucaccguccucggcaucccccagaagcccaucaucaccggcuacaaguccucccuccgcgagaaggacaccgccacccucaacugccaguccuccggcuccaagcccgccgcccgccucaccuggcgcaagggcgaccaggagcuccacggcgagcccacccgcauccaggaggaccccaacggcaagaccuucaccgucuccuccuccgucaccuuccaggucacccgcgaggacgacggcgccuccaucgucugcuccgucaaccacgagucccucaagggcgccgaccgcuccaccucccagcgcaucgagguccucuacacccccaccgccaugauccgccccgaccccccccacccccgcgagggccagaagcuccuccuccacugcgagggccgcggcaaccccgucccccagcaguaccucugggagaaggagggcuccguccccccccucaagaugacccaggaguccgcccucaucuuccccuuccucaacaaguccgacuccggcaccuacggcugcaccgccaccuccaacaugggcuccuacaaggccuacuacacccucaacgucaacgaccccucccccguccccuccuccuccuccaccuaccacgccaucaucggcggcaucgucgccuucaucgucuuccuccuccucaucaugcucaucuuccucggccacuaccucauccgccacaagggcaccuaccucacccacgaggccaagggcuccgacgacgcccccgacgccgacaccgccaucaucaacgccgagggcggccaguccggcggcgacgacaagaaggaguacuucaucuga

SEQ ID NO: 40692 - RNA, 1167 nt, Artificial Sequence
  derived and/or modified sequence opt2 from CADM4__Homo_sapiens__NP_660339
augggccgcgcccgccgcuuccaguggccccuccuccuccucugggccgccgccgccggccccggcgccggccaggagguccagaccgagaacgucaccgucgccgagggcggcgucgccgagaucaccugccgccuccaccaguacgacggcuccaucgucgucauccagaaccccgcccgccagacccucuucuucaacggcacccgcgcccucaaggacgagcgcuuccagcucgaggaguucuccccccgccgcguccgcauccgccucuccgacgcccgccucgaggacgagggcggcuacuucugccagcucuacaccgaggacacccaccaccagaucgccacccucaccguccucgucgcccccgagaaccccgucgucgagguccgcgagcaggccgucgagggcggcgaggucgagcucuccugccucgucccccgcucccgccccgccgccacccuccgcugguaccgcgaccgcaaggagcucaagggcgucuccuccucccaggagaacggcaaggucugguccgucgccuccaccguccgcuuccgcgucgaccgcaaggacgacggcggcaucaucaucugcgaggcccagaaccaggcccuccccuccggccacuccaagcagacccaguacguccucgacguccaguacucccccaccgcccgcauccacgccucccaggccgucguccgcgagggcgacacccucguccucaccugcgccgucaccggcaacccccgccccaaccagauccgcuggaaccgcggcaacgagucccuccccgagcgcgccgaggccgucggcgagacccucacccuccccggccucgucuccgccgacaacggcaccuacaccugcgaggccuccaacaagcacggccacgcccgcgcccucuacguccucgucgucuacgaccccggcgccgucgucgaggcccagaccuccguccccuacgccaucgucggcggcauccucgcccuccucgucuuccucaucaucugcguccucgucggcauggucuggugcuccguccgccagaagggcuccuaccucacccacgaggccuccggccucgacgagcagggcgaggcccgcgaggccuuccucaacggcuccgacggccacaagcgcaaggaggaguucuucaucuga

SEQ ID NO: 40693 - RNA, 3768 nt, Artificial Sequence
  derived and/or modified sequence opt2 from CADPS2__Homo_sapiens__NP_001009571
augcucgaccccuccuccuccgaggaggaguccgacgagggccucgaggaggagucccgcgacguccucgucgccgccggcuccucccagcgcgccccccccgcccccacccgcgagggccgccgcgacgcccccggccgcgccggcggcggcggcgccgcccgcuccgucucccccucccccuccguccucuccgagggccgcgacgagccccagcgccagcucgacgacgagcaggagcgccgcauccgccuccagcucuacgucuucgucguccgcugcaucgccuaccccuucaacgccaagcagcccaccgacauggcccgccgccagcagaagcucaacaagcagcagcuccagcuccucaaggagcgcuuccaggccuuccucaacggcgagacccagaucgucgccgacgaggccuucugcaacgccguccgcuccuacuacgaggucuuccucaaguccgaccgcgucgcccgcaugguccaguccggcggcugcuccgccaacgacuuccgcgaggucuucaagaagaacaucgagaagcgcguccgcucccuccccgagaucgacggccucuccaaggagaccguccucuccuccuggaucgccaaguacgacgccaucuaccgcggcgaggaggaccucugcaagcagcccaaccgcauggcccucuccgccgucuccgagcucauccucuccaaggagcagcucuacgagauguuccagcagauccucggcaucaagaagcucgagcaccagcuccucuacaacgccugccagcucgacaacgccgacgagcaggccgcccagauccgccgcgagcucgacggccgccuccagcucgccgacaagauggccaaggagcgcaaguuccccaaguucaucgccaaggacauggagaacauguacaucgaggagcuccgcuccuccgucaaccuccucauggccaaccucgagucccuccccgucuccaagggcggccccgaguucaagcuccagaagcucaagcgcucccagaacuccgccuuccucgacaucggcgacgagaacgagauccagcucuccaaguccgacgucguccucuccuucacccucgagaucgucaucauggagguccagggccucaaguccgucgcccccaaccgcaucgucuacugcaccauggaggucgagggcgagaagcuccagaccgaccaggccgaggccucccgcccccaguggggcacccagggcgacuucaccaccacccacccccgccccgucgucaaggucaagcucuucaccgaguccaccggcguccucgcccucgaggacaaggagcucggccgcgucauccucuaccccaccuccaacuccuccaaguccgccgagcuccaccgcauggucguccccaagaacucccaggacuccgaccucaagaucaagcucgccguccgcauggacaagcccgcccacaugaagcacuccggcuaccucuacgcccucggccagaaggucuggaagcgcuggaagaagcgcuacuucguccucguccaggucucccaguacaccuucgccaugugcuccuaccgcgagaagaaguccgagccccaggagcucaugcagcucgagggcuacaccgucgacuacaccgacccccaccccggccuccagggcggcugcauguucuucaacgccgucaaggagggcgacaccgucaucuucgccuccgacgacgagcaggaccgcauccucuggguccaggccauguaccgcgccaccggccaguccuacaagcccguccccgccauccagacccagaagcucaaccccaagggcggcacccuccacgccgacgcccagcucuacgccgaccgcuuccagaagcacggcauggacgaguucaucuccgccaaccccugcaagcucgaccacgccuuccucuuccgcauccuccagcgccagacccucgaccaccgccucaacgacuccuacuccugccucggcugguucucccccggccaggucuucguccucgacgaguacugcgcccgcuacggcguccgcggcugccaccgccaccucugcuaccucgccgagcucauggagcacuccgagaacggcgccgucaucgaccccacccuccuccacuacuccuucgccuucugcgccucccacguccacggcaaccgccccgacggcaucggcaccgucuccgucgaggagaaggagcgcuucgaggagaucaaggagcgccucuccucccuccucgagaaccagaucucccacuuccgcuacugcuuccccuucggccgccccgagggcgcccucaaggccacccucucccuccucgagcgcguccucaugaaggacaucgccacccccauccccgccgaggaggucaagaaggucguccgcaagugccucgagaaggccgcccucaucaacuacacccgccucaccgaguacgccaagaucgaggagaccaugaaccaggccucccccgcccgcaagcucgaggagauccuccaccucgccgagcucugcaucgagguccuccagcagaacgaggagcaccacgccgaggccuucgccugguggcccgaccuccucgccgagcacgccgagaaguucugggcccucuucaccgucgacauggacaccgcccucgaggcccagccccaggacuccugggacuccuucccccucuuccagcuccucaacaacuuccuccgcaacgacacccuccucugcaacggcaaguuccacaagcaccuccaggagaucuucgucccccucgucguccgcuacgucgaccucauggaguccuccaucgcccaguccauccaccgcggcuucgagcaggagaccuggcagcccgucaacaacggcuccgccaccuccgaggaccucuucuggaagcucgacgcccuccagauguucgucuucgaccuccacuggcccgagcaggaguucgcccaccaccucgagcagcgccucaagcucauggccuccgacaugcucgaggccugcgucaagcgcacccgcaccgccuucgagcucaagcuccagaaggccuccaagaccaccgaccuccgcauccccgccuccgucugcaccauguucaacguccucgucgacgccaagaagcaguccaccaagcucugcgcccucgacggcggccaggaguucggcucccaguggcagcaguaccacuccaagaucgacgaccucaucgacaacuccgucaaggagaucaucucccuccucgucuccaaguucgucuccguccucgagggcguccucuccaagcucucccgcuacgacgagggcaccuucuucuccuccauccucuccuucaccgucaaggccgccgccaaguacgucgacguccccaagcccggcauggaccucgccgacaccuacaucauguucguccgccagaaccaggacauccuccgcgagaaggucaacgaggagauguacaucgagaagcucuucgaccagugguacuccuccuccaugaaggucaucugcgucuggcucaccgaccgccucgaccuccagcuccacaucuaccagcucaagacccucaucaagaucgucaagaagaccuaccgcgacuuccgccuccagggcguccucgagggcacccucaacuccaagaccuacgacaccguccaccgccgccucaccgucgaggaggccaccgccuccgucuccgagggcggcggccuccagggcaucaccaugaaggacuccgacgaggaggaggagggcuga

SEQ ID NO: 40694 - RNA, 4062 nt, Artificial Sequence
  derived and/or modified sequence opt2 from CADPS__Homo_sapiens__NP_003707
augcucgaccccuccuccuccgaggaggaguccgacgagaucgucgaggaggaguccggcaaggagguccucggcuccgcccccuccggcgcccgccucucccccucccgcaccuccgagggcuccgccggcuccgccggccucggcggcggcggcgccggcgccggcgccggcgucggcgccggcggcggcggcggcuccggcgccuccuccggcggcggcgccggcggccuccagcccuccucccgcgccggcggcggccgccccuccucccccucccccuccgucgucuccgagaaggagaaggaggagcucgagcgccuccagaaggaggaggaggagcgcaagaagcgccuccagcucuacgucuucgucaugcgcugcaucgccuaccccuucaacgccaagcagcccaccgacauggcccgccgccagcagaagaucuccaagcagcagcuccagaccgucaaggaccgcuuccaggccuuccucaacggcgagacccagaucauggccgacgaggccuucaugaacgccguccaguccuacuacgaggucuuccucaaguccgaccgcgucgcccgcaugguccaguccggcggcugcuccgccaacgacucccgcgaggucuucaagaagcacaucgagaagcgcguccgcucccuccccgagaucgacggccucuccaaggagaccguccucuccuccuggauggccaaguucgacgccaucuaccgcggcgaggaggacccccgcaagcagcaggcccgcaugaccgccuccgccgccuccgagcucauccucuccaaggagcagcucuacgagauguuccagaacauccucggcaucaagaaguucgagcaccagcuccucuacaacgccugccagcucgacaaccccgacgagcaggccgcccagauccgccgcgagcucgacggccgccuccagauggccgaccagaucgcccgcgagcgcaaguuccccaaguucgucuccaaggagauggagaacauguacaucgaggagcucaaguccuccgucaaccuccucauggccaaccucgaguccaugcccgucuccaagggcggcgaguucaagcuccagaagcucaagcgcucccacaacgccuccaucaucgacaugggcgaggaguccgagaaccagcucuccaaguccgacgucguccucuccuucucccucgaggucgucaucauggagguccagggccucaagucccucgcccccaaccgcaucgucuacugcaccauggaggucgagggcggcgagaagcuccagaccgaccaggccgaggccuccaagcccaccuggggcacccagggcgacuucuccaccacccacgcccuccccgccgucaaggucaagcucuucaccgaguccaccggcguccucgcccucgaggacaaggagcucggccgcgucauccuccaccccacccccaacucccccaagcaguccgaguggcacaagaugaccgucuccaagaacugccccgaccaggaccucaagaucaagcucgccguccgcauggacaagccccagaacaugaagcacuccggcuaccucugggccaucggcaagaacgucuggaagcgcuggaagaagcgcuucuucguccucguccaggucucccaguacaccuucgccaugugcuccuaccgcgagaagaaggccgagccccaggagcuccuccagcucgacggcuacaccgucgacuacaccgacccccagcccggccucgagggcggccgcgccuucuucaacgccgucaaggagggcgacaccgucaucuucgccuccgacgacgagcaggaccgcauccucuggguccaggccauguaccgcgccaccggccagucccacaagcccgucccccccacccagguccagaagcucaacgccaagggcggcaacgucccccagcucgacgcccccaucucccaguucuacgccgaccgcgcccagaagcacggcauggacgaguucaucuccuccaaccccugcaacuucgaccacgccucccucuucgagaugguccagcgccucacccucgaccaccgccucaacgacuccuacuccugccucggcugguucucccccggccaggucuucguccucgacgaguacugcgcccgcaacggcguccgcggcugccaccgccaccucugcuaccuccgcgaccuccucgagcgcgccgagaacggcgccaugaucgaccccacccuccuccacuacuccuucgccuucugcgccucccacguccacggcaaccgccccgacggcaucggcaccgucaccgucgaggagaaggagcgcuucgaggagaucaaggagcgccuccgcguccuccucgagaaccagaucacccacuuccgcuacugcuuccccuucggccgccccgagggcgcccucaaggccacccucucccuccucgagcgcguccucaugaaggacaucgucacccccgucccccaggaggaggucaagaccgucauccgcaagugccucgagcaggccgcccucgucaacuacucccgccucuccgaguacgccaagaucgaggagaaccagaaggacgccgagaacgucggccgccucaucacccccgccaagaagcucgaggacaccauccgccucgccgagcucgucaucgagguccuccagcagaacgaggagcaccacgccgagccccacgucgacaagggcgaggccuucgccuggugguccgaccucauggucgagcacgccgagaccuuccucucccucuucgccgucgacauggacgccgcccucgagguccagccccccgacaccugggacuccuucccccucuuccagcuccucaacgacuuccuccgcaccgacuacaaccucugcaacggcaaguuccacaagcaccuccaggaccucuucgccccccucgucguccgcuacgucgaccucauggaguccuccaucgcccaguccauccaccgcggcuucgagcgcgaguccugggagcccgucaagucccucaccuccaaccuccccaacgucaaccuccccaacgucaaccuccccaagguccccaaccuccccgucaacaucccccucggcaucccccagaugcccaccuucuccgcccccuccuggauggccgccaucuacgacgccgacaacggcuccggcaccuccgaggaccucuucuggaagcucgacgcccuccagaccuucauccgcgaccuccacuggcccgaggaggaguucggcaagcaccucgagcagcgccucaagcucauggccuccgacaugaucgaguccugcgucaagcgcacccgcaucgccuucgaggucaagcuccagaagaccucccgcuccaccgacuuccgcgucccccaguccaucugcaccauguucaacgucauggucgacgccaaggcccaguccaccaagcucugcuccauggagaugggccaggagcaccaguaccacuccaagaucgacgagcucaucgaggagaccgucaaggagaugaucacccuccucgucgccaaguucgucaccauccucgagggcguccucgccaagcucucccgcuacgacgagggcacccucuucuccuccuuccucuccuucaccgucaaggccgccuccaaguacgucgacguccccaagcccggcauggacgucgccgacgccuacgucaccuucguccgccacucccaggacguccuccgcgacaaggucaacgaggagauguacaucgagcgccucuucgaccagugguacaacuccuccaugaacgucaucugcaccuggcucaccgaccgcauggaccuccagcuccacaucuaccagcucaagacccucauccgcauggucaagaagaccuaccgcgacuuccgccuccagggcguccucgacuccacccucaacuccaagaccuacgagaccauccgcaaccgccucaccgucgaggaggccaccgccuccgucuccgagggcggcggccuccagggcaucuccaugaaggacuccgacgaggaggacgaggaggacgacuga

SEQ ID NO: 40695 - RNA, 2520 nt, Artificial Sequence
  derived and/or modified sequence opt2 from CAGE1__Homo_sapiens__NP_001164163
augaacaaggacuaccagaaguucugguccucccccuccgaccccguccacuucgaggucgacaccucccacgagaaggucgaguccauguccgaguccgacaccaugaacgucuccaaccucucccagggcgucaugcucucccacucccccaucugcauggagaccaccggcaccaccugcgaccucccccagaacgagaucaagaacuucgagcgcgagaacgaguacgaguccacccucugcgaggacgccuacggcacccucgacaaccuccucaacgacaacaacaucgagaacuacuccaccaacgcccucauccagcccgucgacaccaucuccaucuccucccuccgccaguucgagaccgucugcaaguuccacugggucgaggccuucgacgacgagaugaccgagaagcccgaguuccagucccaggucuacaacuacgccaaggacaacaacaucaagcaggacuccuucaaggaggagaaccccauggagaccuccgucuccgccaacaccgaccagcucggcaacgaguacuuccgccagccccccccccgcucccccccccucauccacugcuccggcgagaugcucaaguucaccgagaagucccucgccaaguccaucgccaaggaguccgcccucaaccccucccagccccccuccuuccucugcaagaccgccguccccuccaaggagauccagaacuacggcgagauccccgagauguccgucuccuacgagaaggaggucaccgccgagggcgucgagcgccccgagaucgucuccaccugguccuccgccggcaucuccuggcgcuccgaggccugccgcgagaacugcgagaugcccgacugggagcaguccgccgagucccuccagcccguccaggaggacauggcccucaacgagguccuccagaagcucaagcacaccaaccgcaagcaggagguccgcauccaggagcuccagugcuccaaccucuaccucgagaagcgcgucaaggagcuccagaugaagaucaccaagcagcaggucuucaucgacgucaucaacaagcucaaggagaacgucgaggagcucaucgaggacaaguacaagaucauccucgagaagaacgacaccaagaagacccuccagaaccucgaggagguccucgccaacacccagaagcaccuccaggagucccgcaacgacaaggagaugcuccagcuccaguucaagaagaucaaggccaacuacgucugccuccaggagcgcuacaugaccgagaugcagcagaagaacaaguccgucucccaguaccucgagauggacaagacccucuccaagaaggaggaggaggucgagcgccuccagcagcucaagaaggagcucgagaaggccaccgccuccgcccucgaccuccucaagcgcgagaaggaggcccaggagcaggaguuccucucccuccaggaggaguuccagaagcucgagaaggagaaccucgaggagcgccagaagcucaagucccgccucgagaagcuccucacccagguccgcaaccuccaguucauguccgagaacgagcgcaccaagaacaucaagcuccagcagcagaucaacgaggucaagaacgagaacgccaagcucaagcagcaggucgcccgcuccgaggagcagaacuacguccccaaguucgagaccgcccagcucaaggaccagcucgaggagguccucaaguccgacaucaccaaggacaccaagaccacccacuccaaccuccuccccgacugcucccccugcgaggagcgccucaaccccgccgacaucaagcgcgccucccagcucgccuccaagaugcacucccuccucgcccucauggucggccuccucaccugccaggacaucaucaacuccgacgccgagcacuucaaggaguccgagaaggucuccgacaucaugcuccagaagcucaagucccuccaccucaagaagaagacccucgacaaggagcuccucaagcacaaggaccgcaucaccaccuuccgcgagcucaucgccaaggagaaggccuuccaggaccacgccaucaaggucaucgacugcgacuccgacgaggccaaguccauccgcgacguccccacccuccucggcgccaagcucgacaaguaccacucccucaacgaggagcucgacuuccucaucaccaagcucggccaccuccucgaguccaaggagaaccacugcaaccgccucaucgaggagaacgacaaguaccagcgccaccucggcaaccucaucaagaaggucaccuccuacgaggagaucaucgagugcgccgaccagcgccucgccaucucccacucccagaucgcccaccucgaggagcgcaacaagcaccucgaggaccucauccgcaagccccgcgagaaggcccgcaagccccgcuccaagucccucgagaaccaccccaaguccaugaccaugaugcccgcccucuucaaggagaaccgcaacgaccucgacuga

SEQ ID NO: 40696 - RNA, 786 nt, Artificial Sequence
  derived and/or modified sequence opt2 from CALB1__Homo_sapiens__NP_004920
auggccgagucccaccuccaguccucccucaucaccgccucccaguucuucgagaucuggcuccacuucgacgccgacggcuccggcuaccucgagggcaaggagcuccagaaccucauccaggagcuccagcaggcccgcaagaaggccggccucgagcucucccccgagaugaagaccuucgucgaccaguacggccagcgcgacgacggcaagaucggcaucgucgagcucgcccacguccuccccaccgaggagaacuuccuccuccucuuccgcugccagcagcucaaguccugcgaggaguucaugaagaccuggcgcaaguacgacaccgaccacuccggcuucaucgagaccgaggagcucaagaacuuccucaaggaccuccucgagaaggccaacaagaccgucgacgacaccaagcucgccgaguacaccgaccucaugcucaagcucuucgacuccaacaacgacggcaagcucgagcucaccgagauggcccgccuccuccccguccaggagaacuuccuccucaaguuccagggcaucaagaugugcggcaaggaguucaacaaggccuucgagcucuacgaccaggacggcaacggcuacaucgacgagaacgagcucgacgcccuccucaaggaccucugcgagaagaacaagcaggaccucgacaucaacaacaucaccaccuacaagaagaacaucauggcccucuccgacggcggcaagcucuaccgcaccgaccucgcccucauccucugcgccggcgacaacuga

SEQ ID NO: 40697 - RNA, 816 nt, Artificial Sequence
  derived and/or modified sequence opt2 from CALB2__Homo_sapiens__NP_001731
auggccggcccccagcagcagccccccuaccuccaccucgccgagcucaccgccucccaguuccucgagaucuggaagcacuucgacgccgacggcaacggcuacaucgagggcaaggagcucgagaacuucuuccaggagcucgagaaggcccgcaagggcuccggcaugauguccaaguccgacaacuucggcgagaagaugaaggaguucaugcagaaguacgacaagaacuccgacggcaagaucgagauggccgagcucgcccagauccuccccaccgaggagaacuuccuccucugcuuccgccagcacgucggcuccuccgccgaguucauggaggccuggcgcaaguacgacaccgaccgcuccggcuacaucgaggccaacgagcucaagggcuuccucuccgaccuccucaagaaggccaaccgccccuacgacgagcccaagcuccaggaguacacccagaccauccuccgcauguucgaccucaacggcgacggcaagcucggccucuccgagaugucccgccuccuccccguccaggagaacuuccuccucaaguuccagggcaugaagcucaccuccgaggaguucaacgccaucuucaccuucuacgacaaggaccgcuccggcuacaucgacgagcacgagcucgacgcccuccucaaggaccucuacgagaagaacaagaaggagaugaacauccagcagcucaccaacuaccgcaaguccgucaugucccucgccgaggccggcaagcucuaccgcaaggaccucgagaucguccucugcuccgagccccccauguga

SEQ ID NO: 40698 - RNA, 387 nt, Artificial Sequence
  derived and/or modified sequence opt2 from CALCA__Homo_sapiens__NP_001029125
augggcuuccagaaguucucccccuuccucgcccucuccauccucguccuccuccaggccggcucccuccacgccgcccccuuccgcuccgcccucgaguccucccccgccgaccccgccacccucuccgaggacgaggcccgccuccuccucgccgcccucguccaggacuacguccagaugaaggccuccgagcucgagcaggagcaggagcgcgagggcucccgcaucaucgcccagaagcgcgccugcgacaccgccaccugcgucacccaccgccucgccggccuccucucccgcuccggcggcgucgucaagaacaacuucguccccaccaacgucggcuccaaggccuucggccgccgccgccgcgaccuccaggccuga

SEQ ID NO: 40699 - RNA, 384 nt, Artificial Sequence
  derived and/or modified sequence opt2 from CALCB__Homo_sapiens__NP_000719
augggcuuccgcaaguucucccccuuccucgcccucuccauccucguccucuaccaggccggcucccuccaggccgcccccuuccgcuccgcccucgaguccucccccgaccccgccacccucuccaaggaggacgcccgccuccuccucgccgcccucguccaggacuacguccagaugaaggccuccgagcucaagcaggagcaggagacccagggcuccuccuccgccgcccagaagcgcgccugcaacaccgccaccugcgucacccaccgccucgccggccuccucucccgcuccggcggcauggucaaguccaacuucguccccaccaacgucggcuccaaggccuucggccgccgccgccgcgaccuccaggccuga

SEQ ID NO: 40700 - RNA, 1821 nt, Artificial Sequence
  derived and/or modified sequence opt2 from CALCOCO1__Homo_sapiens__NP_001137154
auggaggaguccccccucucccgcgcccccucccgcggcggcgucaacuuccucaacgucgcccgcaccuacauccccaacaccaaggucgagugccacuacacccucccccccggcaccaugcccuccgccuccgacuggaucggcaucuucaaggucgaggccgccugcguccgcgacuaccacaccuucgucugguccuccguccccgaguccaccaccgacggcucccccauccacaccuccguccaguuccaggagccccgccccauggacgagcucgucacccucgaggaggccgacggcggcuccgacauccuccucgucguccccaaggccaccguccuccagaaccagcucgacgagucccagcaggagcgcaacgaccucaugcagcucaagcuccagcucgagggccaggucaccgagcuccgcucccgcguccaggagcucgagcgcgcccucgccaccgcccgccaggagcacaccgagcucauggagcaguacaagggcaucucccgcucccacggcgagaucaccgaggagcgcgacauccucucccgccagcagggcgaccacgucgcccgcauccucgagcucgaggacgacauccagaccaucuccgagaagguccucaccaaggaggucgagcucgaccgccuccgcgacaccgucaaggcccucacccgcgagcaggagaagcuccucggccagcucaaggagguccaggccgacaaggagcaguccgaggccgagcucgagccccucaaggagcagcuccgcggcgcccaggagcucgccgccuccucccagcagaaggccacccuccucggcgaggagcucgccuccgccgccgccgcccgcgaccgcaccaucgccgagcuccaccgcucccgccucgaggucgccgaggucaacggccgccucgccgagcucggccuccaccucaaggaggagaagugccagugguccaaggagcgcgccggccuccuccaguccgucgaggccgagaaggacaagauccucaagcucuccgccgagauccuccgccucgagaaggccguccaggaggagcgcacccagaaccaggucuucaagaccgagcucgcccgcgagaaggacuccucccucguccagcucuccgaguccaagcgcgagcucaccgagcuccgcuccgcccuccgcguccuccagaaggagaaggagcagcuccaggaggagaagcaggagcuccucgaguacaugcgcaagcucgaggcccgccucgagaaggucgccgacgagaaguggaacgaggacgccaccaccgaggacgaggaggccgccgucggccucuccugccccgccgcccucaccgacuccgaggacgagucccccgaggacaugcgccucccccccuacggccucugcgagcgcggcgaccccggcuccucccccgccggcccccgcgaggccuccccccucgucgucaucucccagcccgcccccaucuccccccaccucuccggccccgccgaggacuccuccuccgacuccgaggccgaggacgagaaguccguccucauggccgccguccaguccggcggcgaggaggccaaccuccuccuccccgagcucggcuccgccuucuacgacauggccuccggcuucaccgucggcacccucuccgagaccuccaccggcggccccgccacccccaccuggaaggagugccccaucugcaaggagcgcuuccccgccgaguccgacaaggacgcccucgaggaccacauggacggccacuucuucuucuccacccaggaccccuucaccuucgaguga

SEQ ID NO: 40701 - RNA, 1413 nt, Artificial Sequence
  derived and/or modified sequence opt2 from CALCOCO2__Homo_sapiens__NP_001248319
auggaggagaccaucaaggacccccccaccuccgccguccuccucgaccacugccacuucucccaggucaucuucaacuccgucgagaaguucuacauccccggcggcgacgucaccugccacuacaccuucacccagcacuucaucccccgccgcaaggacuggaucggcaucuuccgcgccuucaagugcuuccaggacaagcucgagcaggagcuccucaaguggcgcucccagggccagaagcuccaggucggcuggaagaccacccgcgaguacuacaccuucaugugggucacccuccccaucgaccucaacaacaaguccgccaagcagcaggagguccaguucaaggccuacuaccuccccaaggacgacgaguacuaccaguucugcuacgucgacgaggacggcgucguccgcggcgccuccauccccuuccaguuccgccccgagaacgaggaggacauccucgucgucaccacccagggcgaggucgaggagaucgagcagcacaacaaggagcucugcaaggagaaccaggagcucaaggacuccugcaucucccuccagaagcagaacuccgacaugcaggccgagcuccagaagaagcaggaggagcucgagacccuccaguccaucaacaagaagcucgagcucaaggucaaggagcagaaggacuacugggagaccgagcuccuccagcucaaggagcagaaccagaagauguccuccgagaacgagaagaugggcauccgcgucgaccagcuccaggcccagcucuccacccaggagaaggagauggagaagcucguccagggcgaccaggacaagaccgagcagcucgagcagcucaagaaggagaacgaccaccucuuccucucccucaccgagcagcgcaaggaccagaagaagcucgagcagaccgucgagcagaugaagcagaacgagaccaccgccaugaagaagcagcaggagcucauggacgagaacuucgaccucuccaagcgccucuccgagaacgagaucaucugcaacgcccuccagcgccagaaggagcgccucgagggcgagaacgaccuccucaagcgcgagaacucccgccuccucuccuacaugggccucgacuucaacucccuccccuaccagguccccaccuccgacgagggcggcgcccgccagaaccccggccucgccuacggcaaccccuacuccggcauccaggaguccuccucccccuccccccucuccaucaagaagugccccaucugcaaggccgacgacaucugcgaccacacccucgagcagcagcagaugcagccccucugcuucaacugccccaucugcgacaagaucuuccccgccaccgagaagcagaucuucgaggaccacgucuucugccacucccucuga

SEQ ID NO: 40702 - RNA, 1527 nt, Artificial Sequence
  derived and/or modified sequence opt2 from CALCR__Homo_sapiens__NP_001158209
augcaguucuccggcgagaagaucuccggccagcgcgaccuccagaaguccaagaugcgcuucaccuucaccucccgcugccucgcccucuuccuccuccucaaccaccccacccccauccuccccgccuucuccaaccagaccuaccccaccaucgagcccaagcccuuccucuacgucgucggccgcaagaagaugauggacgcccaguacaagugcuacgaccgcaugcagcagcuccccgccuaccagggcgagggccccuacugcaaccgcaccugggacggcuggcucugcugggacgacacccccgccggcguccucuccuaccaguucugccccgacuacuuccccgacuucgaccccuccgagaaggucaccaaguacugcgacgagaagggcgucugguucaagcaccccgagaacaaccgcaccugguccaacuacaccaugugcaacgccuucacccccgagaagcucaagaacgccuacguccucuacuaccucgccaucgucggccacucccucuccaucuucacccucgucaucucccucggcaucuucgucuucuuccgcaagcucaccaccaucuucccccucaacuggaaguaccgcaaggcccucucccucggcugccagcgcgucacccuccacaagaacauguuccucaccuacauccucaacuccaugaucaucaucauccaccucgucgaggucguccccaacggcgagcucguccgccgcgaccccgucuccugcaagauccuccacuucuuccaccaguacaugauggccugcaacuacuucuggaugcucugcgagggcaucuaccuccacacccucaucgucgucgccgucuucaccgagaagcagcgccuccgcugguacuaccuccucggcuggggcuucccccucguccccaccaccauccacgccaucacccgcgccgucuacuucaacgacaacugcuggcucuccgucgagacccaccuccucuacaucauccacggccccgucauggccgcccucgucgucaacuucuucuuccuccucaacaucguccgcguccucgucaccaagaugcgcgagacccacgaggccgagucccacauguaccucaaggccgucaaggccaccaugauccucgucccccuccucggcauccaguucgucgucuuccccuggcgccccuccaacaagaugcucggcaagaucuacgacuacgucaugcacucccucauccacuuccagggcuucuucgucgccaccaucuacugcuucugcaacaacgagguccagaccaccgucaagcgccagugggcccaguucaagauccaguggaaccagcgcuggggccgccgccccuccaaccgcuccgcccgcgccgccgccgccgccgccgaggccggcgacauccccaucuacaucugccaccaggagcuccgcaacgagcccgccaacaaccagggcgaggaguccgccgagaucaucccccucaacaucaucgagcaggaguccuccgccuga

SEQ ID NO: 40703 - RNA, 1386 nt, Artificial Sequence
  derived and/or modified sequence opt2 from CALCRL__Homo_sapiens__NP_005786
auggagaagaagugcacccucuacuuccucguccuccuccccuucuucaugauccucgucaccgccgagcucgaggagucccccgaggacuccauccagcucggcgucacccgcaacaagaucaugaccgcccaguacgagugcuaccagaagaucaugcaggaccccauccagcaggccgagggcgucuacugcaaccgcaccugggacggcuggcucugcuggaacgacgucgccgccggcaccgaguccaugcagcucugccccgacuacuuccaggacuucgaccccuccgagaaggucaccaagaucugcgaccaggacggcaacugguuccgccaccccgccuccaaccgcaccuggaccaacuacacccagugcaacgucaacacccacgagaaggucaagaccgcccucaaccucuucuaccucaccaucaucggccacggccucuccaucgccucccuccucaucucccucggcaucuucuucuacuucaagucccucuccugccagcgcaucacccuccacaagaaccucuucuucuccuucgucugcaacuccgucgucaccaucauccaccucaccgccgucgccaacaaccaggcccucgucgccaccaaccccgucuccugcaaggucucccaguucauccaccucuaccucaugggcugcaacuacuucuggaugcucugcgagggcaucuaccuccacacccucaucgucgucgccgucuucgccgagaagcagcaccucaugugguacuacuuccucggcuggggcuucccccucauccccgccugcauccacgccaucgcccgcucccucuacuacaacgacaacugcuggaucuccuccgacacccaccuccucuacaucauccacggccccaucugcgccgcccuccucgucaaccucuucuuccuccucaacaucguccgcguccucaucaccaagcucaaggucacccaccaggccgaguccaaccucuacaugaaggccguccgcgccacccucauccucgucccccuccucggcaucgaguucguccucauccccuggcgccccgagggcaagaucgccgaggaggucuacgacuacaucaugcacauccucaugcacuuccagggccuccucgucuccaccaucuucugcuucuucaacggcgagguccaggccauccuccgccgcaacuggaaccaguacaagauccaguucggcaacuccuucuccaacuccgaggcccuccgcuccgccuccuacaccgucuccaccaucuccgacggccccggcuacucccacgacugccccuccgagcaccucaacggcaaguccauccacgacaucgagaacguccuccucaagcccgagaaccucuacaacuga

SEQ ID NO: 40704 - RNA, 1617 nt, Artificial Sequence
  derived and/or modified sequence opt2 from CALD1__Homo_sapiens__NP_004333
auggacgacuucgagcgccgccgcgagcuccgccgccagaagcgcgaggagaugcgccucgaggccgagcgcaucgccuaccagcgcaacgacgacgacgaggaggaggccgcccgcgagcgccgccgccgcgcccgccaggagcgccuccgccagaagcaggaggaggagucccucggccaggucaccgaccaggucgaggucaacgcccagaacuccguccccgacgaggaggccaagaccaccaccaccaacacccaggucgagggcgacgacgaggccgccuuccucgagcgccucgcccgccgcgaggagcgccgccagaagcgccuccaggaggcccucgagcgccagaaggaguucgaccccaccaucaccgacgccucccucucccuccccucccgccgcaugcagaacgacaccgccgagaacgagaccaccgagaaggaggagaaguccgagucccgccaggagcgcuacgagaucgaggagaccgagaccgucaccaaguccuaccagaagaacgacuggcgcgacgccgaggagaacaagaaggaggacaaggagaaggaggaggaggaggaggagaagcccaagcgcggcuccaucggcgagaaccagaucaaggacgagaagaucaagaaggacaaggagcccaaggaggaggucaaguccuucauggaccgcaagaagggcuucaccgaggucaagucccagaacggcgaguucaugacccacaagcucaagcacaccgagaacaccuucucccgccccggcggccgcgccuccgucgacaccaaggaggccgagggcgccccccaggucgaggccggcaagcgccucgaggagcuccgccgccgccgcggcgagaccgaguccgaggaguucgagaagcucaagcagaagcagcaggaggccgcccucgagcucgaggagcucaagaagaagcgcgaggagcgccgcaagguccucgaggaggaggagcagcgccgcaagcaggaggaggccgaccgcaagcuccgcgaggaggaggagaagcgccgccucaaggaggagaucgagcgccgccgcgccgaggccgccgagaagcgccagaagaugcccgaggacggccucuccgacgacaagaagcccuucaagugcuucacccccaagggcuccucccucaagaucgaggagcgcgccgaguuccucaacaaguccguccagaaguccuccggcgucaaguccacccaccaggccgccaucgucuccaagaucgacucccgccucgagcaguacaccuccgccaucgagggcaccaaguccgccaagcccaccaagcccgccgccuccgaccuccccguccccgccgagggcguccgcaacaucaaguccaugugggagaagggcaacgucuucuccucccccaccgccgccggcacccccaacaaggagaccgccggccucaaggucggcgucuccucccgcaucaacgaguggcucaccaagacccccgacggcaacaagucccccgcccccaagcccuccgaccuccgccccggcgacgucuccuccaagcgcaaccucugggagaagcaguccgucgacaaggucaccucccccaccaaggucuga

SEQ ID NO: 40705 - RNA, 1041 nt, Artificial Sequence
  derived and/or modified sequence opt2 from CALHM1__Homo_sapiens__NP_001001412
augauggacaaguuccgcaugaucuuccaguuccuccaguccaaccaggaguccuucaugaacggcaucugcggcaucauggcccucgccuccgcccagauguacuccgccuucgacuucaacugccccugccuccccggcuacaacgccgccuacuccgccggcauccuccucgcccccccccucguccucuuccuccucggccucgucaugaacaacaacgucuccaugcucgccgaggaguggaagcgcccccucggccgccgcgccaaggaccccgccguccuccgcuacauguucugcuccauggcccagcgcgcccucaucgcccccgucgucugggucgccgucacccuccucgacggcaagugcuuccucugcgccuucugcaccgccguccccgucuccgcccucggcaacggcucccucgcccccggccuccccgcccccgagcucgcccgccuccucgcccgcguccccugccccgagaucuacgacggcgacuggcuccucgcccgcgaggucgccguccgcuaccuccgcugcaucucccaggcccucggcugguccuucguccuccucaccacccuccucgccuucgucguccgcuccguccgccccugcuucacccaggccgccuuccucaaguccaaguacuggucccacuacaucgacaucgagcgcaagcucuucgacgagaccugcaccgagcacgccaaggccuucgccaaggucugcauccagcaguucuucgaggccaugaaccacgaccucgagcucggccacacccacggcacccucgccaccgcccccgccuccgccgccgcccccaccacccccgacggcgccgaggaggagcgcgagaagcuccgcggcaucaccgaccagggcaccaugaaccgccuccucaccuccuggcacaagugcaagcccccccuccgccucggccaggaggagcccccccucaugggcaacggcugggccggcggcggcccccgccccccccgcaaggaggucgccaccuacuucuccaaggucuga

SEQ ID NO: 40706 - RNA, 972 nt, Artificial Sequence
  derived and/or modified sequence opt2 from CALHM2__Homo_sapiens__XP_006717946
auggccgcccucaucgccgagaacuuccgcuuccucucccucuucuucaaguccaaggacgucaugaucuucaacggccucgucgcccucggcaccgucggcucccaggagcucuucuccgucgucgccuuccacugccccugcucccccgcccgcaacuaccucuacggccucgccgccaucggcguccccgcccucguccucuucaucaucggcaucauccucaacaaccacaccuggaaccucgucgccgagugccagcaccgccgcaccaagaacugcuccgccgcccccaccuuccuccuccucuccuccauccucggccgcgccgccgucgcccccgucaccugguccgucaucucccuccuccgcggcgaggccuacgucugcgcccucuccgaguucgucgaccccuccucccucaccgcccgcgaggagcacuuccccuccgcccacgccaccgagauccucgcccgcuuccccugcaaggagaaccccgacaaccucuccgacuuccgcgaggaggucucccgccgccuccgcuacgagucccagcucuucggcuggcuccucaucggcgucgucgccauccucgucuuccucaccaagugccucaagcacuacugcuccccccucuccuaccgccaggaggccuacugggcccaguaccgcgccaacgaggaccagcucuuccagcgcaccgccgagguccacucccgcguccucgccgccaacaacguccgccgcuucuucggcuucgucgcccucaacaaggacgacgaggagcucaucgccaacuuccccgucgagggcacccagccccgcccccaguggaacgccaucaccggcgucuaccucuaccgcgagaaccagggccucccccucuacucccgccuccacaagugggcccagggccucgccggcaacggcgccgcccccgacaacgucgagauggcccuccuccccuccuga

SEQ ID NO: 40707 - RNA, 1035 nt, Artificial Sequence
  derived and/or modified sequence opt2 from CALHM3__Homo_sapiens__NP_001123214
auggacaaguuccgcaugcucuuccagcacuuccaguccuccuccgaguccgucaugaacggcaucugccuccuccucgccgccgucaccgucaagcucuacuccuccuucgacuucaacugccccugccucguccacuacaacgcccucuacggccucggccuccuccucacccccccccucgcccucuuccucugcggccuccucgccaaccgccaguccgucgucauggucgaggaguggcgccgccccgccggccaccgccgcaaggaccccggcaucauccgcuacaugugcuccuccguccuccagcgcgcccucgccgccccccucgucuggauccuccucgcccuccucgacggcaagugcuucgucugcgccuucuccuccuccgucgaccccgagaaguuccucgacuucgccaacaugacccccucccagguccagcucuuccucgccaagguccccugcaaggaggacgagcucguccgcgacucccccgcccgcaaggccgucucccgcuaccuccgcugccucucccaggccaucggcugguccgucacccuccuccucaucaucgccgccuuccucgcccgcugccuccgccccugcuucgaccagaccgucuuccuccagcgccgcuacugguccaacuacgucgaccucgagcagaagcucuucgacgagaccugcugcgagcacgcccgcgacuucgcccaccgcugcguccuccacuucuucgccuccaugcgcuccgagcuccaggcccgcggccuccgccgcggcaacgccggccgccgccucgagcuccccgccguccccgagccccccgagggccucgacuccggcuccggcaaggcccaccuccgcgccaucuccucccgcgagcaggucgaccgccuccucuccaccugguacuccuccaagcccccccucgaccucgccgccucccccggccucugcggcggcggccucucccaccgcgcccccacccucgcccucggcacccgccucucccagcacaccgacgucuga

SEQ ID NO: 40708 - RNA, 450 nt, Artificial Sequence
  derived and/or modified sequence opt2 from CALM2__Homo_sapiens__NP_001734
auggccgaccagcucaccgaggagcagaucgccgaguucaaggaggccuucucccucuucgacaaggacggcgacggcaccaucaccaccaaggagcucggcaccgucaugcgcucccucggccagaaccccaccgaggccgagcuccaggacaugaucaacgaggucgacgccgacggcaacggcaccaucgacuuccccgaguuccucaccaugauggcccgcaagaugaaggacaccgacuccgaggaggagauccgcgaggccuuccgcgucuucgacaaggacggcaacggcuacaucuccgccgccgagcuccgccacgucaugaccaaccucggcgagaagcucaccgacgaggaggucgacgagaugauccgcgaggccgacaucgacggcgacggccaggucaacuacgaggaguucguccagaugaugaccgccaaguga

SEQ ID NO: 40709 - RNA, 450 nt, Artificial Sequence
  derived and/or modified sequence opt2 from CALML3__Homo_sapiens__NP_005176
auggccgaccagcucaccgaggagcaggucaccgaguucaaggaggccuucucccucuucgacaaggacggcgacggcugcaucaccacccgcgagcucggcaccgucaugcgcucccucggccagaaccccaccgaggccgagcuccgcgacaugauguccgagaucgaccgcgacggcaacggcaccgucgacuuccccgaguuccucggcaugauggcccgcaagaugaaggacaccgacaacgaggaggagauccgcgaggccuuccgcgucuucgacaaggacggcaacggcuucgucuccgccgccgagcuccgccacgucaugacccgccucggcgagaagcucuccgacgaggaggucgacgagaugauccgcgccgccgacaccgacggcgacggccaggucaacuacgaggaguucguccgcguccucgucuccaaguga

SEQ ID NO: 40710 - RNA, 441 nt, Artificial Sequence
  derived and/or modified sequence opt2 from CALML5__Homo_sapiens__NP_059118
auggccggcgagcucacccccgaggaggaggcccaguacaagaaggccuucuccgccgucgacaccgacggcaacggcaccaucaacgcccaggagcucggcgccgcccucaaggccaccggcaagaaccucuccgaggcccagcuccgcaagcucaucuccgaggucgacuccgacggcgacggcgagaucuccuuccaggaguuccucaccgccgccaagaaggcccgcgccggccucgaggaccuccaggucgccuuccgcgccuucgaccaggacggcgacggccacaucaccgucgacgagcuccgccgcgccauggccggccucggccagccccucccccaggaggagcucgacgccaugauccgcgaggccgacgucgaccaggacggccgcgucaacuacgaggaguucgcccgcaugcucgcccaggaguga

SEQ ID NO: 40711 - RNA, 660 nt, Artificial Sequence
  derived and/or modified sequence opt2 from CALN1__Homo_sapiens__NP_001017440
augcccuuccaccacgucaccgccggccuccucuacaagggcaacuaccucaaccgcucccucuccgccggcuccgacuccgagcagcucgccaacaucuccgucgaggagcucgacgagauccgcgaggccuuccgcguccucgaccgcgacggcaacggcuucaucuccaagcaggagcucggcauggccaugcgcucccucggcuacaugcccuccgaggucgagcucgccaucaucaugcagcgccucgacauggacggcgacggccaggucgacuucgacgaguucaugaccauccucggccccaagcucgucuccuccgagggccgcgacggcuuccucggcaacaccaucgacuccaucuucuggcaguucgacaugcagcgcaucacccucgaggagcucaagcacauccucuaccacgccuuccgcgaccaccucaccaugaaggacaucgagaacaucaucaucaacgaggaggagucccucaacgagaccuccggcaacugccagaccgaguucgagggcguccacucccagaagcagaaccgccagaccugcguccgcaagucccucaucugcgccuucgccauggccuucaucaucuccgucaugcucaucgccgccaaccagauccuccgcuccggcauggaguga

SEQ ID NO: 40712 - RNA, 1155 nt, Artificial Sequence
  derived and/or modified sequence opt2 from CALR3__Homo_sapiens__NP_659483
auggcccgcgcccucguccagcucugggccaucugcaugcuccgcgucgcccucgccaccgucuacuuccaggaggaguuccucgacggcgagcacuggcgcaaccgcuggcuccaguccaccaacgacucccgcuucggccacuuccgccucuccuccggcaaguucuacggccacaaggagaaggacaagggccuccagaccacccagaacggccgcuucuacgccaucuccgcccgcuucaagcccuucuccaacaagggcaagacccucgucauccaguacaccgucaagcacgagcagaagauggacugcggcggcggcuacaucaaggucuuccccgccgacaucgaccagaagaaccucaacggcaagucccaguacuacaucauguucggccccgacaucugcggcuucgacaucaagaagguccacgucauccuccacuucaagaacaaguaccacgagaacaagaagcucauccgcugcaaggucgacggcuucacccaccucuacacccucauccuccgccccgaccucuccuacgacgucaagaucgacggccaguccaucgaguccggcuccaucgaguacgacuggaaccucaccucccucaagaaggagaccucccccgccgaguccaaggacugggagcagaccaaggacaacaaggcccaggacugggagaagcacuuccucgacgccuccaccuccaagcaguccgacuggaacggcgaccucgacggcgacuggcccgcccccaugcuccagaagccccccuaccaggacggccucaagcccgagggcauccacaaggacgucuggcuccaccgcaagaugaagaacaccgacuaccucacccaguacgaccucuccgaguucgagaacaucggcgccaucggccucgagcucuggcagguccgcuccggcaccaucuucgacaacuuccucaucaccgacgacgaggaguacgccgacaacuucggcaaggccaccuggggcgagaccaagggccccgagcgcgagauggacgccauccaggccaaggaggagaugaagaaggcccgcgaggaggaggaggaggagcuccucuccggcaagaucaaccgccacgagcacuacuucaaccaguuccaccgccgcaacgagcucuga

SEQ ID NO: 40713 - RNA, 1254 nt, Artificial Sequence
  derived and/or modified sequence opt2 from CALR__Homo_sapiens__NP_004334
augcuccucuccgucccccuccuccucggccuccucggccucgccgucgccgagcccgccgucuacuucaaggagcaguuccucgacggcgacggcuggaccucccgcuggaucgaguccaagcacaaguccgacuucggcaaguucguccucuccuccggcaaguucuacggcgacgaggagaaggacaagggccuccagaccucccaggacgcccgcuucuacgcccucuccgccuccuucgagcccuucuccaacaagggccagacccucgucguccaguucaccgucaagcacgagcagaacaucgacugcggcggcggcuacgucaagcucuuccccaacucccucgaccagaccgacaugcacggcgacuccgaguacaacaucauguucggccccgacaucugcggccccggcaccaagaagguccacgucaucuucaacuacaagggcaagaacguccucaucaacaaggacauccgcugcaaggacgacgaguucacccaccucuacacccucaucguccgccccgacaacaccuacgaggucaagaucgacaacucccaggucgaguccggcucccucgaggacgacugggacuuccucccccccaagaagaucaaggaccccgacgccuccaagcccgaggacugggacgagcgcgccaagaucgacgaccccaccgacuccaagcccgaggacugggacaagcccgagcacauccccgaccccgacgccaagaagcccgaggacugggacgaggagauggacggcgagugggagccccccgucauccagaaccccgaguacaagggcgaguggaagccccgccagaucgacaaccccgacuacaagggcaccuggauccaccccgagaucgacaaccccgaguacucccccgaccccuccaucuacgccuacgacaacuucggcguccucggccucgaccucuggcaggucaaguccggcaccaucuucgacaacuuccucaucaccaacgacgaggccuacgccgaggaguucggcaacgagaccuggggcgucaccaaggccgccgagaagcagaugaaggacaagcaggacgaggagcagcgccucaaggaggaggaggaggacaagaagcgcaaggaggaggaggaggccgaggacaaggaggacgacgaggacaaggacgaggacgaggaggacgaggaggacaaggaggaggacgaggaggaggacguccccggccaggccaaggacgagcucuga

SEQ ID NO: 40714 - RNA, 948 nt, Artificial Sequence
  derived and/or modified sequence opt2 from CALU__Homo_sapiens__NP_001124146
auggaccuccgccaguuccucaugugccucucccucugcaccgccuucgcccucuccaagcccaccgagaagaaggaccgcguccaccacgagccccagcucuccgacaagguccacaacgacgcccaguccuucgacuacgaccacgacgccuuccucggcgccgaggaggccaagaccuucgaccagcucacccccgaggaguccaaggagcgccucggcaugaucgucgacaagaucgacgccgacaaggacggcuucgucaccgagggcgagcucaaguccuggaucaagcacgcccagaagaaguacaucuacgacaacgucgagaaccaguggcaggaguucgacaugaaccaggacggccucaucuccugggacgaguaccgcaacgucaccuacggcaccuaccucgacgaccccgaccccgacgacggcuucaacuacaagcagaugaugguccgcgacgagcgccgcuucaagauggccgacaaggacggcgaccucaucgccaccaaggaggaguucaccgccuuccuccaccccgaggaguacgacuacaugaaggacaucgucguccaggagaccauggaggacaucgacaagaacgccgacggcuucaucgaccucgaggaguacaucggcgacauguacucccacgacggcaacaccgacgagcccgagugggucaagaccgagcgcgagcaguucgucgaguuccgcgacaagaaccgcgacggcaagauggacaaggaggagaccaaggacuggauccuccccuccgacuacgaccacgccgaggccgaggcccgccaccucgucuacgaguccgaccagaacaaggacggcaagcucaccaaggaggagaucgucgacaaguacgaccucuucgucggcucccaggccaccgacuucggcgaggcccucguccgccacgacgaguucuga

SEQ ID NO: 40715 - RNA, 654 nt, Artificial Sequence
  derived and/or modified sequence opt2 from CALY__Homo_sapiens__NP_056537
auggucaagcucggcugcuccuucuccggcaagcccggcaaggaccccggcgaccaggacggcgccgccauggacuccgucccccucaucuccccccucgacaucucccagcuccagcccccccuccccgaccaggucgucaucaagacccagaccgaguaccagcucuccucccccgaccagcagaacuuccccgaccucgagggccagcgccucaacugcucccaccccgaggagggccgccgccuccccaccgcccgcaugaucgccuucgccauggcccuccucggcugcguccucaucauguacaaggccaucugguacgaccaguucaccugccccgacggcuuccuccuccgccacaagaucugcaccccccucacccucgagauguacuacaccgagauggaccccgagcgccaccgcuccauccucgccgccaucggcgccuacccccucucccgcaagcacggcaccgagacccccgccgccuggggcgacggcuaccgcgccgccaaggaggagcgcaagggccccacccaggccggcgccgccgccgccgccaccgagccccccggcaagcccuccgccaaggccgagaaggaggccgcccgcaaggccgccggcuccgccgcccccccccccgcccaguga

SEQ ID NO: 40716 - RNA, 1074 nt, Artificial Sequence
  derived and/or modified sequence opt2 from CAMK1D__Homo_sapiens__NP_065130
auggcccgcgagaacggcgaguccuccuccuccuggaagaagcaggccgaggacaucaagaagaucuucgaguucaaggagacccucggcaccggcgccuucuccgaggucguccucgccgaggagaaggccaccggcaagcucuucgccgucaagugcauccccaagaaggcccucaagggcaaggaguccuccaucgagaacgagaucgccguccuccgcaagaucaagcacgagaacaucgucgcccucgaggacaucuacgagucccccaaccaccucuaccucgucaugcagcucgucuccggcggcgagcucuucgaccgcaucgucgagaagggcuucuacaccgagaaggacgccuccacccucauccgccagguccucgacgccgucuacuaccuccaccgcaugggcaucguccaccgcgaccucaagcccgagaaccuccucuacuacucccaggacgaggaguccaagaucaugaucuccgacuucggccucuccaagauggagggcaagggcgacgucauguccaccgccugcggcacccccggcuacgucgcccccgagguccucgcccagaagcccuacuccaaggccgucgacugcugguccaucggcgucaucgccuacauccuccucugcggcuacccccccuucuacgacgagaacgacuccaagcucuucgagcagauccucaaggccgaguacgaguucgacucccccuacugggacgacaucuccgacuccgccaaggacuucauccgcaaccucauggagaaggaccccaacaagcgcuacaccugcgagcaggccgcccgccaccccuggaucgccggcgacaccgcccucaacaagaacauccacgaguccgucuccgcccagauccgcaagaacuucgccaaguccaaguggcgccaggccuucaacgccaccgccgucguccgccacaugcgcaagcuccaccucggcuccucccucgacuccuccaacgccuccgucuccuccucccucucccucgccucccagaaggacugcgccuacgucgccaagcccgagucccucuccuga

SEQ ID NO: 40717 - RNA, 1431 nt, Artificial Sequence
  derived and/or modified sequence opt2 from CAMK1G__Homo_sapiens__NP_065172
augggccgcaaggaggaggacgacugcuccuccuggaagaagcagaccaccaacauccgcaagaccuucaucuucauggagguccucggcuccggcgccuucuccgaggucuuccucgucaagcagcgccucaccggcaagcucuucgcccucaagugcaucaagaagucccccgccuuccgcgacuccucccucgagaacgagaucgccguccucaagaagaucaagcacgagaacaucgucacccucgaggacaucuacgaguccaccacccacuacuaccucgucaugcagcucgucuccggcggcgagcucuucgaccgcauccucgagcgcggcgucuacaccgagaaggacgccucccucgucauccagcagguccucuccgccgucaaguaccuccacgagaacggcaucguccaccgcgaccucaagcccgagaaccuccucuaccucacccccgaggagaacuccaagaucaugaucaccgacuucggccucuccaagauggagcagaacggcaucauguccaccgccugcggcacccccggcuacgucgcccccgagguccucgcccagaagcccuacuccaaggccgucgacugcugguccaucggcgucaucaccuacauccuccucugcggcuacccccccuucuacgaggagaccgaguccaagcucuucgagaagaucaaggagggcuacuacgaguucgagucccccuucugggacgacaucuccgaguccgccaaggacuucaucugccaccuccucgagaaggaccccaacgagcgcuacaccugcgagaaggcccucucccaccccuggaucgacggcaacaccgcccuccaccgcgacaucuaccccuccgucucccuccagauccagaagaacuucgccaaguccaaguggcgccaggccuucaacgccgccgccgucguccaccacaugcgcaagcuccacaugaaccuccacucccccggcguccgccccgaggucgagaaccgcccccccgagacccaggccuccgagaccucccgccccuccucccccgagaucaccaucaccgaggcccccguccucgaccacuccgucgcccuccccgcccucacccagcuccccugccagcacggccgccgccccaccgcccccggcggccgcucccucaacugccucgucaacggcucccuccacaucuccuccucccucguccccaugcaccagggcucccucgccgccggccccugcggcugcugcuccuccugccucaacaucggcuccaagggcaaguccuccuacugcuccgagcccacccuccucaagaaggccaacaagaagcagaacuucaaguccgaggucaugguccccgucaaggccuccggcuccucccacugccgcgccggccagaccggcgucugccucaucauguga

SEQ ID NO: 40718 - RNA, 1113 nt, Artificial Sequence
  derived and/or modified sequence opt2 from CAMK1__Homo_sapiens__NP_003647
augcucggcgccgucgagggcccccgcuggaagcaggccgaggacauccgcgacaucuacgacuuccgcgacguccucggcaccggcgccuucuccgaggucauccucgccgaggacaagcgcacccagaagcucgucgccaucaagugcaucgccaaggaggcccucgagggcaaggagggcuccauggagaacgagaucgccguccuccacaagaucaagcaccccaacaucgucgcccucgacgacaucuacgaguccggcggccaccucuaccucaucaugcagcucgucuccggcggcgagcucuucgaccgcaucgucgagaagggcuucuacaccgagcgcgacgccucccgccucaucuuccagguccucgacgccgucaaguaccuccacgaccucggcaucguccaccgcgaccucaagcccgagaaccuccucuacuacucccucgacgaggacuccaagaucaugaucuccgacuucggccucuccaagauggaggaccccggcuccguccucuccaccgccugcggcacccccggcuacgucgcccccgagguccucgcccagaagcccuacuccaaggccgucgacugcugguccaucggcgucaucgccuacauccuccucugcggcuacccccccuucuacgacgagaacgacgccaagcucuucgagcagauccucaaggccgaguacgaguucgacucccccuacugggacgacaucuccgacuccgccaaggacuucauccgccaccucauggagaaggaccccgagaagcgcuucaccugcgagcaggcccuccagcaccccuggaucgccggcgacaccgcccucgacaagaacauccaccaguccgucuccgagcagaucaagaagaacuucgccaaguccaaguggaagcaggccuucaacgccaccgccgucguccgccacaugcgcaagcuccagcucggcaccucccaggagggccagggccagaccgccucccacggcgagcuccucacccccgucgccggcggccccgccgccggcugcugcugccgcgacugcugcgucgagcccggcaccgagcucucccccacccucccccaccagcucuga

SEQ ID NO: 40719 - RNA, 1470 nt, Artificial Sequence
  derived and/or modified sequence opt2 from CAMK2A__Homo_sapiens__NP_057065
auggccaccaucaccugcacccgcuucaccgaggaguaccagcucuucgaggagcucggcaagggcgccuucuccgucguccgccgcugcgucaagguccucgccggccaggaguacgccgccaagaucaucaacaccaagaagcucuccgcccgcgaccaccagaagcucgagcgcgaggcccgcaucugccgccuccucaagcaccccaacaucguccgccuccacgacuccaucuccgaggagggccaccacuaccucaucuucgaccucgucaccggcggcgagcucuucgaggacaucgucgcccgcgaguacuacuccgaggccgacgccucccacugcauccagcagauccucgaggccguccuccacugccaccagaugggcgucguccaccgcgaccucaagcccgagaaccuccuccucgccuccaagcucaagggcgccgccgucaagcucgccgacuucggccucgccaucgaggucgagggcgagcagcaggccugguucggcuucgccggcacccccggcuaccucucccccgagguccuccgcaaggaccccuacggcaagcccgucgaccucugggccugcggcgucauccucuacauccuccucgucggcuacccccccuucugggacgaggaccagcaccgccucuaccagcagaucaaggccggcgccuacgacuuccccucccccgagugggacaccgucacccccgaggccaaggaccucaucaacaagaugcucaccaucaaccccuccaagcgcaucaccgccgccgaggcccucaagcaccccuggaucucccaccgcuccaccgucgccuccugcaugcaccgccaggagaccgucgacugccucaagaaguucaacgcccgccgcaagcucaagggcgccauccucaccaccaugcucgccacccgcaacuucuccggcggcaaguccggcggcaacaagaaguccgacggcgucaagaagcgcaaguccuccuccuccguccagcucauggaguccuccgaguccaccaacaccaccaucgaggacgaggacaccaagguccgcaagcaggagaucaucaaggucaccgagcagcucaucgaggccaucuccaacggcgacuucgaguccuacaccaagaugugcgaccccggcaugaccgccuucgagcccgaggcccucggcaaccucgucgagggccucgacuuccaccgcuucuacuucgagaaccucuggucccgcaacuccaagcccguccacaccaccauccucaacccccacauccaccucaugggcgacgaguccgccugcaucgccuacauccgcaucacccaguaccucgacgccggcggcaucccccgcaccgcccaguccgaggagacccgcgucuggcaccgccgcgacggcaaguggcagaucguccacuuccaccgcuccggcgcccccuccguccucccccacuga

SEQ ID NO: 40720 - RNA, 2001 nt, Artificial Sequence
  derived and/or modified sequence opt2 from CAMK2B__Homo_sapiens__NP_001211
auggccaccaccgucaccugcacccgcuucaccgacgaguaccagcucuacgaggacaucggcaagggcgccuucuccgucguccgccgcugcgucaagcucugcaccggccacgaguacgccgccaagaucaucaacaccaagaagcucuccgcccgcgaccaccagaagcucgagcgcgaggcccgcaucugccgccuccucaagcacuccaacaucguccgccuccacgacuccaucuccgaggagggcuuccacuaccucgucuucgaccucgucaccggcggcgagcucuucgaggacaucgucgcccgcgaguacuacuccgaggccgacgccucccacugcauccagcagauccucgaggccguccuccacugccaccagaugggcgucguccaccgcgaccucaagcccgagaaccuccuccucgccuccaagugcaagggcgccgccgucaagcucgccgacuucggccucgccaucgagguccagggcgaccagcaggccugguucggcuucgccggcacccccggcuaccucucccccgagguccuccgcaaggaggccuacggcaagcccgucgacaucugggccugcggcgucauccucuacauccuccucgucggcuacccccccuucugggacgaggaccagcacaagcucuaccagcagaucaaggccggcgccuacgacuuccccucccccgagugggacaccgucacccccgaggccaagaaccucaucaaccagaugcucaccaucaaccccgccaagcgcaucaccgcccacgaggcccucaagcaccccugggucugccagcgcuccaccgucgccuccaugaugcaccgccaggagaccgucgagugccucaagaaguucaacgcccgccgcaagcucaagggcgccauccucaccaccaugcucgccacccgcaacuucuccgucggccgccagaccaccgcccccgccaccauguccaccgccgccuccggcaccaccaugggccucgucgagcaggccaagucccuccucaacaagaaggccgacggcgucaagccccagaccaacuccaccaagaacuccgccgccgccaccucccccaagggcacccucccccccgccgcccucgagccccagaccaccgucauccacaaccccgucgacggcaucaaggaguccuccgacuccgccaacaccaccaucgaggacgaggacgccaaggccccccgcguccccgacauccucuccuccguccgccgcggcuccggcgcccccgaggccgagggcccccuccccugccccucccccgcccccuucuccccccuccccgcccccuccccccgcaucuccgacauccucaacuccguccgccgcggcuccggcacccccgaggccgagggcccccucuccgccggccccccccccugccucucccccgcccuccucggcccccucuccucccccuccccccgcaucuccgacauccucaacuccguccgccgcggcuccggcacccccgaggccgagggccccucccccgucggccccccccccugccccucccccaccauccccggcccccuccccacccccucccgcaagcaggagaucaucaagaccaccgagcagcucaucgaggccgucaacaacggcgacuucgaggccuacgccaagaucugcgaccccggccucaccuccuucgagcccgaggcccucggcaaccucgucgagggcauggacuuccaccgcuucuacuucgagaaccuccucgccaagaacuccaagcccauccacaccaccauccucaacccccacguccacgucaucggcgaggacgccgccugcaucgccuacauccgccucacccaguacaucgacggccagggccgcccccgcaccucccaguccgaggagacccgcgucuggcaccgccgcgacggcaaguggcagaacguccacuuccacugcuccggcgcccccgucgccccccuccaguga

SEQ ID NO: 40721 - RNA, 1500 nt, Artificial Sequence
  derived and/or modified sequence opt2 from CAMK2D__Homo_sapiens__NP_001212
auggccuccaccaccaccugcacccgcuucaccgacgaguaccagcucuucgaggagcucggcaagggcgccuucuccgucguccgccgcugcaugaagauccccaccggccaggaguacgccgccaagaucaucaacaccaagaagcucuccgcccgcgaccaccagaagcucgagcgcgaggcccgcaucugccgccuccucaagcaccccaacaucguccgccuccacgacuccaucuccgaggagggcuuccacuaccucgucuucgaccucgucaccggcggcgagcucuucgaggacaucgucgcccgcgaguacuacuccgaggccgacgccucccacugcauccagcagauccucgaguccgucaaccacugccaccucaacggcaucguccaccgcgaccucaagcccgagaaccuccuccucgccuccaaguccaagggcgccgccgucaagcucgccgacuucggccucgccaucgagguccagggcgaccagcaggccugguucggcuucgccggcacccccggcuaccucucccccgagguccuccgcaaggaccccuacggcaagcccgucgacaugugggccugcggcgucauccucuacauccuccucgucggcuacccccccuucugggacgaggaccagcaccgccucuaccagcagaucaaggccggcgccuacgacuuccccucccccgagugggacaccgucacccccgaggccaaggaccucaucaacaagaugcucaccaucaaccccgccaagcgcaucaccgccuccgaggcccucaagcaccccuggaucugccagcgcuccaccgucgccuccaugaugcaccgccaggagaccgucgacugccucaagaaguucaacgcccgccgcaagcucaagggcgccauccucaccaccaugcucgccacccgcaacuucuccgccgccaagucccuccucaagaagcccgacggcgucaaggaguccaccgaguccuccaacaccaccaucgaggacgaggacgucaaggcccgcaagcaggagaucaucaaggucaccgagcagcucaucgaggccaucaacaacggcgacuucgaggccuacaccaagaucugcgaccccggccucaccgccuucgagcccgaggcccucggcaaccucgucgagggcauggacuuccaccgcuucuacuucgagaacgcccucuccaaguccaacaagcccauccacaccaucauccucaacccccacguccaccucgucggcgacgacgccgccugcaucgccuacauccgccucacccaguacauggacggcuccggcaugcccaagaccaugcaguccgaggagacccgcgucuggcaccgccgcgacggcaaguggcagaacguccacuuccaccgcuccggcucccccaccguccccaucaagccccccugcauccccaacggcaaggagaacuucuccggcggcaccucccucuggcagaacaucuga

SEQ ID NO: 40722 - RNA, 1488 nt, Artificial Sequence
  derived and/or modified sequence opt2 from CAMK2G__Homo_sapiens__NP_001213
auggccaccaccgccaccugcacccgcuucaccgacgacuaccagcucuucgaggagcucggcaagggcgccuucuccgucguccgccgcugcgucaagaagaccuccacccaggaguacgccgccaagaucaucaacaccaagaagcucuccgcccgcgaccaccagaagcucgagcgcgaggcccgcaucugccgccuccucaagcaccccaacaucguccgccuccacgacuccaucuccgaggagggcuuccacuaccucgucuucgaccucgucaccggcggcgagcucuucgaggacaucgucgcccgcgaguacuacuccgaggccgacgccucccacugcauccaccagauccucgaguccgucaaccacauccaccagcacgacaucguccaccgcgaccucaagcccgagaaccuccuccucgccuccaagugcaagggcgccgccgucaagcucgccgacuucggccucgccaucgagguccagggcgagcagcaggccugguucggcuucgccggcacccccggcuaccucucccccgagguccuccgcaaggaccccuacggcaagcccgucgacaucugggccugcggcgucauccucuacauccuccucgucggcuacccccccuucugggacgaggaccagcacaagcucuaccagcagaucaaggccggcgccuacgacuuccccucccccgagugggacaccgucacccccgaggccaagaaccucaucaaccagaugcucaccaucaaccccgccaagcgcaucaccgccgaccaggcccucaagcaccccugggucugccagcgcuccaccgucgccuccaugaugcaccgccaggagaccgucgagugccuccgcaaguucaacgcccgccgcaagcucaagggcgccauccucaccaccaugcucgucucccgcaacuucuccgccgccaagucccuccucaacaagaaguccgacggcggcgucaaggagccccagaccaccgucguccacaacgccaccgacggcaucaagggcuccaccgaguccugcaacaccaccaccgaggacgaggaccucaagguccgcaagcaggagaucaucaagaucaccgagcagcucaucgaggccaucaacaacggcgacuucgaggccuacaccaagaucugcgaccccggccucaccuccuucgagcccgaggcccucggcaaccucgucgagggcauggacuuccacaaguucuacuucgagaaccuccucuccaagaacuccaagcccauccacaccaccauccucaacccccacguccacgucaucggcgaggacgccgccugcaucgccuacauccgccucacccaguacaucgacggccagggccgcccccgcaccucccaguccgaggagacccgcgucuggcaccgccgcgacggcaaguggcucaacguccacuaccacugcuccggcgcccccgccgccccccuccaguga

SEQ ID NO: 40723 - RNA, 1422 nt, Artificial Sequence
  derived and/or modified sequence opt2 from CAMK4__Homo_sapiens__NP_001735
augcucaaggucaccguccccuccugcuccgccuccuccugcuccuccgucaccgccuccgccgcccccggcaccgccucccucguccccgacuacuggaucgacggcuccaaccgcgacgcccucuccgacuucuucgaggucgaguccgagcucggccgcggcgccaccuccaucgucuaccgcugcaagcagaagggcacccagaagcccuacgcccucaagguccucaagaagaccgucgacaagaagaucguccgcaccgagaucggcguccuccuccgccucucccaccccaacaucaucaagcucaaggagaucuucgagacccccaccgagaucucccucguccucgagcucgucaccggcggcgagcucuucgaccgcaucgucgagaagggcuacuacuccgagcgcgacgccgccgacgccgucaagcagauccucgaggccgucgccuaccuccacgagaacggcaucguccaccgcgaccucaagcccgagaaccuccucuacgccacccccgcccccgacgccccccucaagaucgccgacuucggccucuccaagaucgucgagcaccagguccucaugaagaccgucugcggcacccccggcuacugcgcccccgagauccuccgcggcugcgccuacggccccgaggucgacaugugguccgucggcaucaucaccuacauccuccucugcggcuucgagcccuucuacgacgagcgcggcgaccaguucauguuccgccgcauccucaacugcgaguacuacuucaucucccccuggugggacgaggucucccucaacgccaaggaccucguccgcaagcucaucguccucgaccccaagaagcgccucaccaccuuccaggcccuccagcaccccugggucaccggcaaggccgccaacuucguccacauggacaccgcccagaagaagcuccaggaguucaacgcccgccgcaagcucaaggccgccgucaaggccgucgucgccuccucccgccucggcuccgccuccuccucccacggcuccauccaggagucccacaaggccucccgcgaccccucccccauccaggacggcaacgaggacaugaaggccauccccgagggcgagaagauccagggcgacggcgcccaggccgccgucaagggcgcccaggccgagcucaugaagguccaggcccucgagaaggucaagggcgccgacaucaacgccgaggaggcccccaagaugguccccaaggccgucgaggacggcaucaaggucgccgaccucgagcucgaggagggccucgccgaggagaagcucaagaccgucgaggaggccgccgccccccgcgagggccagggcuccuccgccgucggcuucgaggucccccagcaggacgucauccuccccgaguacuga

SEQ ID NO: 40724 - RNA, 1518 nt, Artificial Sequence
  derived and/or modified sequence opt2 from CAMKK1__Homo_sapiens__NP_757343
auggagggcggccccgccgucugcugccaggacccccgcgccgagcucgucgagcgcgucgccgccaucgacgucacccaccucgaggaggccgacggcggccccgagcccacccgcaacggcgucgacccccccccccgcgcccgcgccgccuccgucauccccggcuccaccucccgccuccuccccgcccgccccucccucuccgcccgcaagcucucccuccaggagcgccccgccggcuccuaccucgaggcccaggccggccccuacgccaccggccccgccucccacaucuccccccgcgccuggcgccgccccaccaucgagucccaccacgucgccaucuccgacgccgaggacugcguccagcucaaccaguacaagcuccaguccgagaucggcaagggcgccuacggcgucguccgccucgccuacaacgaguccgaggaccgccacuacgccaugaagguccucuccaagaagaagcuccucaagcaguacggcuucccccgccgcccccccccccgcggcucccaggccgcccagggcggccccgccaagcagcuccucccccucgagcgcgucuaccaggagaucgccauccucaagaagcucgaccacgucaacgucgucaagcucaucgagguccucgacgaccccgccgaggacaaccucuaccucgucuucgaccuccuccgcaagggccccgucauggagguccccugcgacaagcccuucuccgaggagcaggcccgccucuaccuccgcgacgucauccucggccucgaguaccuccacugccagaagaucguccaccgcgacaucaagcccuccaaccuccuccucggcgacgacggccacgucaagaucgccgacuucggcgucuccaaccaguucgagggcaacgacgcccagcucuccuccaccgccggcacccccgccuucauggcccccgaggccaucuccgacuccggccaguccuucuccggcaaggcccucgacgucugggccaccggcgucacccucuacugcuucgucuacggcaagugccccuucaucgacgacuucauccucgcccuccaccgcaagaucaagaacgagcccgucgucuuccccgaggagcccgagaucuccgaggagcucaaggaccucauccucaagaugcucgacaagaaccccgagacccgcaucggcguccccgacaucaagcuccaccccugggucaccaagaacggcgaggagccccuccccuccgaggaggagcacugcuccgucgucgaggucaccgaggaggaggucaagaacuccguccgccucauccccuccuggaccaccgucauccucgucaaguccaugcuccgcaagcgcuccuucggcaaccccuucgagccccaggcccgccgcgaggagcgcuccauguccgcccccggcaaccuccucgucaaggagggcuucggcgagggcggcaagucccccgagcuccccggcguccaggaggacgaggccgccuccuga

SEQ ID NO: 40725 - RNA, 1767 nt, Artificial Sequence
  derived and/or modified sequence opt2 from CAMKK2__Homo_sapiens__NP_001257414
auguccuccugcgucuccucccagcccuccuccaaccgcgccgccccccaggacgagcucggcggccgcggcuccuccuccuccgagucccagaagcccugcgaggcccuccgcggccucuccucccucuccauccaccucggcauggaguccuucaucgucgucaccgagugcgagcccggcugcgccgucgaccucggccucgcccgcgaccgcccccucgaggccgacggccaggaggucccccucgacaccuccggcucccaggcccgcccccaccucuccggccgcaagcucucccuccaggagcgcucccagggcggccucgccgccggcggcucccucgacaugaacggccgcugcaucugccccucccuccccuacucccccgucuccuccccccaguccuccccccgccucccccgccgccccaccgucgagucccaccacgucuccaucaccggcaugcaggacugcguccagcucaaccaguacacccucaaggacgagaucggcaagggcuccuacggcgucgucaagcucgccuacaacgagaacgacaacaccuacuacgccaugaagguccucuccaagaagaagcucauccgccaggccggcuucccccgccgcccccccccccgcggcacccgccccgcccccggcggcugcauccagccccgcggccccaucgagcaggucuaccaggagaucgccauccucaagaagcucgaccaccccaacgucgucaagcucgucgagguccucgacgaccccaacgaggaccaccucuacauggucuucgagcucgucaaccagggccccgucauggagguccccacccucaagccccucuccgaggaccaggcccgcuucuacuuccaggaccucaucaagggcaucgaguaccuccacuaccagaagaucauccaccgcgacaucaagcccuccaaccuccucgucggcgaggacggccacaucaagaucgccgacuucggcgucuccaacgaguucaagggcuccgacgcccuccucuccaacaccgucggcacccccgccuucauggcccccgagucccucuccgagacccgcaagaucuucuccggcaaggcccucgacgucugggccaugggcgucacccucuacugcuucgucuucggccagugccccuucauggacgagcgcaucaugugccuccacuccaagaucaagucccaggcccucgaguuccccgaccagcccgacaucgccgaggaccucaaggaccucaucacccgcaugcucgacaagaaccccgagucccgcaucgucguccccgagaucaagcuccaccccugggucacccgccacggcgccgagccccuccccuccgaggacgagaacugcacccucgucgaggucaccgaggaggaggucgagaacuccgucaagcacauccccucccucgccaccgucauccucgucaagaccaugauccgcaagcgcuccuucggcaaccccuucgagggcucccgccgcgaggagcgcucccucuccgcccccggcaaccuccucaccaagaagcccacccgcgagugcgagucccucuccgagcucaaggaggcccgccagcgccgccagccccccggccaccgccccgccccccgcggcggcggcggcuccgcccucguccgcggcucccccugcgucgaguccugcugggcccccgcccccggcucccccgcccgcaugcacccccuccgccccgaggaggccauggagcccgaguga

SEQ ID NO: 40726 - RNA, 972 nt, Artificial Sequence
  derived and/or modified sequence opt2 from CAMKMT__Homo_sapiens__NP_079042
auggagucccgcgucgccgacgccggcaccggcgagaccgcccgcgccgccggcggcucccccgccgucggcugcaccacccgcggccccgucgucuccgccccccucggcgccgcccgcuggaagcuccuccgccagguccucaagcagaagcaccucgacgacugccuccgccacgucuccguccgccgcuucgaguccuucaaccucuucuccgucaccgagggcaaggagcgcgagaccgaggaggaggucggcgccuggguccaguacaccuccaucuucugccccgaguacuccaucucccuccgccacaacuccggcucccucaacgucgaggacguccucaccuccuucgacaacaccggcaacgucugcaucuggcccuccgaggagguccucgccuacuacugccucaagcacaacaacaucuuccgcgcccucgccgucugcgagcucggcggcggcaugaccugccucgccggccucauggucgccaucuccgccgacgucaaggagguccuccucaccgacggcaacgagaaggccauccgcaacguccaggacaucaucacccgcaaccagaaggccggcgucuucaagacccagaagaucuccuccugcguccuccgcugggacaacgagaccgacgucucccagcucgagggccacuucgacaucgucaugugcgccgacugccucuuccucgaccaguaccgcgccucccucgucgacgccaucaagcgccuccuccagccccgcggcaaggccauggucuucgccccccgccgcggcaacacccucaaccaguucugcaaccucgccgagaaggccggcuucugcauccagcgccacgagaacuacgacgagcacaucuccaacuuccacuccaagcucaagaaggagaaccccgacaucuacgaggagaaccuccacuacccccuccuccucauccucaccaagcacggcuga

SEQ ID NO: 40727 - RNA, 891 nt, Artificial Sequence
  derived and/or modified sequence opt2 from CAMLG__Homo_sapiens__NP_001736
auggaguccauggccgucgccaccgacggcggcgagcgccccggcguccccgccggcuccggccucuccgccucccagcgccgcgccgagcuccgccgccgcaagcuccucaugaacuccgagcagcgcaucaaccgcaucaugggcuuccaccgccccggcuccggcgccgaggaggagucccagaccaaguccaagcagcaggacuccgacaagcucaacucccucuccguccccuccgucuccaagcgcgucguccucggcgacuccgucuccaccggcaccaccgaccagcagggcggcgucgccgaggucaagggcacccagcucggcgacaagcucgacuccuucaucaagccccccgagugcuccuccgacgucaaccucgagcuccgccagcgcaaccgcggcgaccucaccgccgacuccguccagcgcggcucccgccacggccucgagcaguaccucucccgcuucgaggaggccaugaagcuccgcaagcagcucaucuccgagaagcccucccaggaggacggcaacaccaccgaggaguucgacuccuuccgcaucuuccgccucgucggcugcgcccuccucgcccucggcguccgcgccuucgucugcaaguaccucuccaucuucgcccccuuccucacccuccagcucgccuacaugggccucuacaaguacuuccccaaguccgagaagaagaucaagaccaccguccucaccgccgcccuccuccucuccggcauccccgccgaggucaucaaccgcuccauggacaccuacuccaagaugggcgaggucuucaccgaccucugcgucuacuucuucaccuucaucuucugccacgagcuccucgacuacuggggcuccgagguccccuga

SEQ ID NO: 40728 - RNA, 522 nt, Artificial Sequence
  derived and/or modified sequence opt2 from CAMP__Homo_sapiens__NP_004336
augggcaccaugaagacccagcgcgacggccacucccucggccgcuggucccucguccuccuccuccucggccucgucaugccccucgccaucaucgcccagguccucuccuacaaggaggccguccuccgcgccaucgacggcaucaaccagcgcuccuccgacgccaaccucuaccgccuccucgaccucgacccccgccccaccauggacggcgaccccgacacccccaagcccgucuccuucaccgucaaggagaccgucugcccccgcaccacccagcagucccccgaggacugcgacuucaagaaggacggccucgucaagcgcugcaugggcaccgucacccucaaccaggcccgcggcuccuucgacaucuccugcgacaaggacaacaagcgcuucgcccuccucggcgacuucuuccgcaaguccaaggagaagaucggcaaggaguucaagcgcaucguccagcgcaucaaggacuuccuccgcaaccucgucccccgcaccgaguccuga

SEQ ID NO: 40729 - RNA, 4809 nt, Artificial Sequence
  derived and/or modified sequence opt2 from CAMSAP1__Homo_sapiens__NP_056262
auggucgacgccuccggccgcgccgccgccgagggcuggcgcaagauggaggccccccccgacggcgccgccgaccucgucccccucgaccgcuacgacgccgcccgcgccaagaucgccgccaaccuccaguggaucugcgccaaggccuacggccgcgacaacauccccgaggaccuccgcgaccccuucuacgucgaccaguacgagcaggagcacaucaagccccccgucaucaagcuccuccucuccuccgagcucuacugccgcgucugcucccucauccucaagggcgaccaggucgccgcccuccagggccaccaguccgucauccaggcccucucccgcaagggcaucuacgucauggaguccgacgacacccccgucaccgaguccgaccucucccgcgcccccaucaagauguccgcccacauggccauggucgacgcccucaugauggccuacaccgucgagaugaucuccaucgagaaggucgucgccuccgucaagcgcuucuccaccuucuccgccuccaaggagcuccccuacgaccucgaggacgccauggucuucuggaucaacaaggucaaccucaagaugcgcgagaucaccgagaaggaggucaagcucaagcagcagcuccucgagucccccgcccaccagaagguccgcuaccgccgcgagcaccucuccgcccgccagucccccuacuucccccuccucgaggaccucaugcgcgacggcuccgacggcgccgcccuccucgccgucauccacuacuacugccccgagcagaugaagcucgacgacaucugccucaaggaggucaccuccauggccgacucccucuacaacauccgccuccuccgcgaguucuccaacgaguaccucaacaagugcuucuaccucacccucgaggacaugcucuacgccccccucguccucaagcccaacgucauggucuucaucgccgagcucuucuggugguucgagaacgucaagcccgacuucguccagccccgcgacguccaggagcucaaggacgccaagaccguccuccaccagaaguccucccgcccccccguccccaucuccaacgccaccaagcgcuccuuccucggcucccccgccgccggcacccucgccgagcuccagccccccguccagcuccccgccgagggcugccaccgccacuaccuccaccccgaggagcccgaguaccucggcaagggcaccgccgccuucucccccucccacccccuccucccccuccgccagaagcagcagaaguccauccagggcgaggacauccccgaccagcgccaccgcuccaacucccucacccgcgucgacggccagccccgcggcgccgccaucgccuggcccgagaagaagacccgccccgccucccagcccacccccuucgcccuccaccacgccgccuccugcgaggucgaccccuccuccggcgacuccaucucccucgcccgcuccaucuccaaggacucccucgccuccaacaucgucaaccucaccccccagaaccagccccaccccaccgccaccaagucccacggcaagucccuccucuccaacgucuccaucgaggacgaggaggaggagcucgucgccaucguccgcgccgacgucgucccccagcaggccgaccccgaguucccccgcgccuccccccgcgcccucggccucaccgccaacgcccgcuccccccagggccagcucgacaccuccgaguccaagcccgacuccuucuuccucgagccccucaugcccgccguccucaagcccgccaaggagaagcaggucaucaccaaggaggacgagcgcggcgagggccgcccccgcuccaucgucucccgccgccccuccgagggcccccagccccucguccgccgcaagaugaccggcucccgcgaccucaaccgcaccuucacccccauccccugcuccgaguuccccaugggcaucgaccccaccgagaccggcccccucuccgucgagaccgccggcgaggucugcggcggcccccucgcccucggcggcuucgaccccuucccccagggccccuccaccgacggcuucuuccuccacgucggccgcgccgacgaggacaccgagggccgccucuacgucuccugcuccaagucccccaacucccacgacuccgagcccuggacccuccuccgccaggacuccgacuccgacgucgucgacaucgaggaggccgagcacgacuucaugggcgaggcccaccccgucgucuucucccgcuacaucggcgaggaggaguccgccaagcuccaggaggacaugaaggucaaggagcacgaggacaaggacgacgccuccggccgcuccucccccugccucuccaccgccucccagauguccuccgucuccauggccuccggcuccgucaagaugaccuccuucgccgagcgcaagcuccagcgccucaacuccugcgagaccaaguccuccaccuccuccucccagaagaccacccccgacgccuccgaguccugccccgccccccucaccaccuggcgccagaagcgcgagcagucccccucccagcacggcaaggaccccgccucccuccucgccuccgagcucguccagcuccacaugcagcucgaggagaagcgccgcgccaucgaggcccagaagaagaagauggaggcccucuccgcccgccagcgccucaagcucggcaaggccgccuuccuccacgucgucaagaagggcaaggccgaggccgcccccccccuccgccccgagcacuucgccaaggaguacucccagcacaacggcgaggacugcggcgacgccgucuccaagaccgaggacuuccucgucaaggaggagcagcgcgaggagcuccuccacgagccccaggacgucgacaaggagucccucgccuucgcccagcagcacaaggccaaggaccccgucgcccuccacgagcucgagcgcaacaaggucaucuccgccgcccuccucgaggacaccgucggcgaggucgucgacgucaacgagugcgaccucuccaucgagaagcucaacgagaccaucuccacccuccagcaggccauccucaagaucucccagcagcaggagcagcuccucaugaagucccccaccguccccguccccggcuccaagaacaacucccaggaccacaaggucaaggcccccguccacuucgucgagccccucucccccaccggcgucgccggccaccgcaaggccccccgccucggccagggccgcaacucccgcuccggccgccccgccgagcucaagguccccaaggaccgcccccagggcuccucccgcuccaagacccccacccccuccgucgagacccucccccaccuccgccccuuccccgccuccucccacccccgcacccccaccgaccccggccucgacuccgcccucgagcccuccggcgacccccacggcaagugccucuucgacuccuaccgccuccacgacgaguccaaccagcgcacccucacccucuccuccuccaaggacgccaacauccucuccgagcagaugucccucaaggagguccucgacgccuccgucaaggaggucggcuccuccuccuccgacgucuccggcaaggaguccguccccgucgaggagccccuccgcucccgcgccucccucaucgaggucgaccucuccgaccucaaggcccccgacgaggacggcgagcucgucucccucgacggcuccgccgaccucgucuccgagggcgaccagaagcccggcgucggcuucuucuucaaggacgagcagaaggccgaggacgagcucgccaagaagcgcgccgccuuccuccucaagcagcagcgcaaggccgaggaggcccgcguccgcaagcagcagcucgaggccgaggucgagcucaagcgcgacgaggcccgccgcaaggccgaggaggaccgcguccgcaaggaggaggagaaggcccgccgcgagcucaucaagcaggaguaccuccgccgcaagcagcagcagauccucgaggagcagggccucggcaagcccaaguccaagcccaagaagccccgccccaaguccguccaccgcgaggaguccugcuccgacuccggcaccaagugcuccuccacccccgacaaccucucccgcacccaguccggcuccucccucucccucgccuccgccgccaccaccgagcccgaguccguccacuccggcggcacccccucccagcgcgucgaguccauggaggcccuccccauccucucccgcaaccccucccgcuccaccgaccgcgacugggagaccgccuccgccgccuccucccucgccuccgucgccgaguacaccggccccaagcucuucaaggagcccuccuccaaguccaacaagcccaucauccacaacgccaucucccacugcugccucgccggcaaggucaacgagccccacaagaacuccauccucgaggagcucgagaagugcgacgccaaccacuacaucauccucuuccgcgacgccggcugccaguuccgcgcccucuacugcuacuaccccgacaccgaggagaucuacaagcucaccggcaccggccccaagaacaucaccaagaagaugaucgacaagcucuacaaguacuccuccgaccgcaagcaguucaaccucauccccgccaagaccauguccgucuccgucgacgcccucaccauccacaaccaccucuggcagcccaagcgccccgccguccccaagaaggcccagacccgcaaguga

SEQ ID NO: 40730 - RNA, 4470 nt, Artificial Sequence
  derived and/or modified sequence opt2 from CAMSAP2__Homo_sapiens__NP_001284636
augggcgacgccgccgacccccgcgagaugcgcaagaccuucaucguccccgccaucaagcccuucgaccacuacgacuucucccgcgccaagaucgccugcaaccucgccuggcucgucgccaaggccuucggcaccgagaacguccccgaggagcuccaggagcccuucuacaccgaccaguacgaccaggagcacaucaagccccccgucgucaaccuccuccucuccgccgagcucuacugccgcgccggcucccucauccucaaguccgacgccgccaagccccuccucggccacgacgccgucauccaggcccucgcccagaagggccucuacgucaccgaccaggagaagcucgucaccgagcgcgaccuccacaagaagcccauccagauguccgcccaccucgccaugaucgacacccucaugauggccuacaccgucgagauggucuccaucgagaaggucaucgccugcgcccagcaguacuccgccuucuuccaggccaccgaccuccccuacgacaucgaggacgccgucauguacuggaucaacaaggucaacgagcaccucaaggacaucauggagcaggagcagaagcucaaggagcaccacaccgucgaggcccccggcggccagaagucccccuccaagugguucuggaagcucguccccgcccgcuaccgcaaggagcagacccuccucaagcagcuccccugcaucccccucgucgagaaccuccucaaggacggcaccgacggcugcgcccucgccgcccucauccacuucuacugccccgacgucguccgccucgaggacaucugccucaaggagaccaugucccucgccgacucccucuacaaccuccagcucauccaggaguucugccaggaguaccucaaccagugcugccacuucacccucgaggacaugcucuacgccgccuccuccaucaaguccaacuaccucgucuucauggccgagcucuucuggugguucgaggucgucaagcccuccuucguccagccccgcgucguccgcccccagggcgccgagcccgucaaggacaugcccuccauccccguccucaacgccgccaagcgcaacguccucgacuccuccuccgacuuccccuccuccggcgagggcgccaccuucacccagucccaccaccaccuccccucccgcuacucccgcccccaggcccacuccuccgccuccggcggcauccgccgcuccuccuccauguccuacgucgacggcuucaucggcaccuggcccaaggagaagcgcuccuccguccacggcgucuccuucgacaucuccuucgacaaggaggacuccguccagcgcuccacccccaaccgcggcaucacccgcuccaucuccaacgagggccucacccucaacaacucccacgucuccaagcacauccgcaagaaccucuccuucaagcccaucaacggcgaggaggaggccgaguccaucgaggaggagcucaacaucgacucccacuccgaccucaaguccugcgucccccucaacaccaacgagcucaacuccaacgagaacauccacuacaagcuccccaacggcgcccuccagaaccgcauccuccucgacgaguucggcaaccagaucgagacccccuccaucgaggaggcccuccagaucauccacgacaccgagaaguccccccacaccccccagcccgaccagaucgccaacggcuucuuccuccacucccaggagauguccauccucaacuccaacaucaagcucaaccaguccucccccgacaacgucaccgacaccaagggcgcccucucccccaucaccgacaacaccgaggucgacaccggcauccacguccccuccgaggacauccccgagaccauggacgaggacuccucccuccgcgacuacaccgucucccucgacuccgacauggacgacgccuccaaguuccuccaggacuacgacauccgcaccggcaacacccgcgaggcccucucccccugccccuccaccgucuccaccaagucccagcccggcuccuccgccuccuccuccuccggcgucaagaugaccuccuucgccgagcagaaguuccgcaagcucaaccacaccgacggcaaguccuccggcuccuccucccagaagaccacccccgagggcuccgagcucaacaucccccacgucgucgccugggcccagauccccgaggagaccggccucccccagggccgcgacaccacccagcuccucgccuccgagaugguccaccuccgcaugaagcucgaggagaagcgccgcgccaucgaggcccagaagaagaagauggaggccgccuucaccaagcagcgccagaagaugggccgcaccgccuuccucaccgucgucaagaagaagggcgacggcaucuccccccuccgcgaggaggccgccggcgccgaggacgagaaggucuacaccgaccgcgccaaggagaaggagucccagaagaccgacggccagcgcuccaagucccucgccgacaucaaggaguccauggagaacccccaggccaaguggcucaagucccccaccacccccaucgaccccgagaagcaguggaaccucgccucccccuccgaggagacccucaacgagggcgagauccucgaguacaccaaguccaucgagaagcucaacuccucccuccacuuccuccagcaggagaugcagcgccucucccuccagcaggagaugcucaugcagaugcgcgagcagcaguccugggucaucucccccccccagcccuccccccagaagcagauccgcgacuucaagcccuccaagcaggccggccucuccuccgccaucgcccccuucuccuccgacuccccccgccccacccaccccuccccccaguccuccaaccgcaaguccgccuccuucuccgucaagucccagcgcaccccccgccccaacgagcucaagaucaccccccucaaccgcacccucacccccccccgcuccgucgacucccucccccgccuccgccgcuucucccccucccagguccccauccagacccgcuccuucgucugcuucggcgacgacggcgagccccagcucaaggaguccaagcccaaggaggaggucaagaaggaggagcucgaguccaagggcacccucgagcagcgcggccacaaccccgaggagaaggagaucaagcccuucgaguccaccgucuccgagguccucucccuccccgucaccgagaccgucugccucacccccaacgaggaccagcucaaccagcccaccgagcccccccccaagcccgucuucccccccaccgcccccaagaacgucaaccucaucgaggucucccucuccgaccucaagccccccgagaaggccgacguccccgucgagaaguacgacggcgaguccgacaaggagcaguucgacgacgaccagaaggucugcugcggcuucuucuucaaggacgaccagaaggccgagaacgacauggccaugaagcgcgccgcccuccucgagaagcgccuccgccgcgagaaggagacccagcuccgcaagcagcagcucgaggccgagauggagcacaagaaggaggagacccgccgcaagaccgaggaggagcgccagaagaaggaggacgagcgcgcccgccgcgaguucauccgccaggaguacaugcgccgcaagcagcucaagcucauggaggacauggacaccgucaucaagccccgcccccaggucgucaagcagaagaagcagcgccccaaguccauccaccgcgaccacaucgagucccccaagacccccaucaagggcccccccgucuccucccucucccucgccucccucaacaccggcgacaacgaguccguccacuccggcaagcgcaccccccgcuccgaguccgucgagggcuuccucucccccucccgcugcggcucccgcaacggcgagaaggacugggagaacgccuccaccaccuccuccgucgccuccggcaccgaguacaccggccccaagcucuacaaggagcccuccgccaaguccaacaagcacaucauccagaacgcccucgcccacugcugccucgccggcaaggucaacgagggccagaagaagaagauccucgaggagauggagaaguccgacgccaacaacuuccucauccucuuccgcgacuccggcugccaguuccgcucccucuacaccuacugccccgagaccgaggagaucaacaagcucaccggcaucggccccaaguccaucaccaagaagaugaucgagggccucuacaaguacaacuccgaccgcaagcaguucucccacauccccgccaagacccucuccgccuccgucgacgccaucaccauccacucccaccucuggcagaccaagcgccccgucacccccaagaagcuccuccccaccaaggccuga

SEQ ID NO: 40731 - RNA, 5022 nt, Artificial Sequence
  derived and/or modified sequence opt2 from CAMTA1__Homo_sapiens__XP_011539388
auguggcgcgccgagggcaaguggcuccccaagaccucccgcaaguccgucucccaguccgucuucugcggcaccuccaccuacugcguccucaacaccgucccccccaucgaggacgaccacggcaacuccaacuccucccacgucaagaucuuccuccccaagaagcuccucgagugccuccccaagugcuccucccuccccaaggagcgccaccgcuggaacaccaacgaggagaucgccgccuaccucaucaccuucgagaagcacgaggaguggcucaccaccucccccaagacccgcccccagaacggcuccaugauccucuacaaccgcaagaaggucaaguaccgcaaggacggcuacugcuggaagaagcgcaaggacggcaagaccacccgcgaggaccacaugaagcucaagguccagggcgucgagugccucuacggcugcuacguccacuccuccaucauccccaccuuccaccgccgcugcuacuggcuccuccagaaccccgacaucguccucguccacuaccucaacguccccgccaucgaggacugcggcaagcccugcggccccauccucugcuccaucaacaccgacaagaaggagugggccaaguggaccaaggaggagcucaucggccagcucaagcccauguuccacggcaucaaguggaccugcuccaacggcaacuccuccuccggcuucuccgucgagcagcucguccagcagauccucgacucccaccagaccaagccccagccccgcacccacaacugccucugcaccggcucccucggcgccggcggcuccguccaccacaagugcaacuccgccaagcaccgcaucaucucccccaaggucgagccccgcaccggcggcuacggcucccacuccgagguccagcacaacgacgucuccgagggcaagcacgagcacucccacuccaagggcuccucccgcgagaagcgcaacggcaaggucgccaagcccguccuccuccaccaguccuccaccgaggucuccuccaccaaccaggucgagguccccgacaccacccaguccucccccgucuccaucuccuccggccucaacuccgaccccgacauggucgacucccccgucgucaccggcgucuccggcauggccgucgccuccgucaugggcucccucucccaguccgccaccgucuucauguccgaggucaccaacgaggccgucuacaccaugucccccaccgccggccccaaccaccaccuccucucccccgacgccucccagggccucguccucgccgucuccuccgacggccacaaguucgccuuccccaccaccggcuccuccgagucccucuccaugcuccccaccaacgucuccgaggagcucguccucuccaccacccucgacggcggccgcaagauccccgagaccaccaugaacuucgaccccgacugcuuccucaacaaccccaagcagggccagaccuacggcggcggcggccucaaggccgagauggucuccuccaacauccgccacuccccccccggcgagcgcuccuucuccuucaccaccguccucaccaaggagaucaagaccgaggacaccuccuucgagcagcagauggccaaggaggccuacuccuccuccgccgccgccgucgccgccuccucccucacccucaccgccggcuccucccuccuccccuccggcggcggccucucccccuccaccacccucgagcagauggacuucuccgccaucgacuccaacaaggacuacaccuccuccuucucccagaccggccacuccccccacauccaccagacccccucccccuccuucuuccuccaggacgccuccaagccccuccccgucgagcagaacacccacuccucccucuccgacuccggcggcaccuucgucaugcccaccgucaagaccgaggccuccucccagaccuccuccugcuccggccacgucgagacccgcaucgaguccaccuccucccuccaccucaugcaguuccaggccaacuuccaggccaugaccgccgagggcgaggucaccauggagaccucccaggccgccgagggcuccgagguccuccucaaguccggcgagcuccaggccugcuccuccgagcacuaccuccagcccgagaccaacggcgucauccgcuccgccggcggcguccccauccuccccggcaacgucguccagggccucuaccccgucgcccagcccucccucggcaacgccuccaacauggagcucucccucgaccacuucgacaucuccuucuccaaccaguucuccgaccucaucaacgacuucaucuccgucgagggcggcuccuccaccaucuacggccaccagcucgucuccggcgacuccaccgcccucucccaguccgaggacggcgcccgcgcccccuucacccaggccgagaugugccuccccugcugcuccccccagcagggcucccuccagcucuccuccuccgagggcggcgccuccaccauggccuacaugcacgucgccgaggucgucuccgccgccuccgcccagggcacccucggcaugcuccagcaguccggccgcgucuucauggucaccgacuacucccccgagugguccuaccccgagggcggcgucaagguccucaucaccggccccuggcaggaggccuccaacaacuacuccugccucuucgaccagaucuccguccccgccucccucauccagcccggcguccuccgcugcuacugccccgcccacgacaccggccucgucacccuccaggucgccuucaacaaccagaucaucuccaacuccgucgucuucgaguacaaggcccgcgcccuccccacccuccccuccucccagcacgacuggcucucccucgacgacaaccaguuccgcauguccauccucgagcgccucgagcagauggagcgccgcauggccgagaugaccggcucccagcagcacaagcaggccuccggcggcggcuccuccggcggcggcuccggcuccggcaacggcggcucccaggcccagugcgccuccggcaccggcgcccucggcuccugcuucgagucccgcgucgucgucgucugcgagaagaugaugucccgcgccugcugggccaaguccaagcaccucauccacuccaagaccuuccgcggcaugacccuccuccaccucgccgccgcccagggcuacgccacccucauccagacccucaucaaguggcgcaccaagcacgccgacuccaucgaccucgagcucgaggucgacccccucaacgucgaccacuucuccugcaccccccucaugugggccugcgcccucggccaccucgaggccgccgucguccucuacaagugggaccgccgcgccaucuccauccccgacucccucggccgccucccccucggcaucgcccgcucccgcggccacgucaagcucgccgagugccucgagcaccuccagcgcgacgagcaggcccagcucggccagaacccccgcauccacugccccgccuccgaggagcccuccaccgaguccuggauggcccaguggcacuccgaggccaucuccucccccgagauccccaagggcgucaccgucaucgccuccaccaaccccgagcuccgccgcccccgcuccgagcccuccaacuacuacuccuccgagucccacaaggacuaccccgcccccaagaagcacaagcucaaccccgaguacuuccagacccgccaggagaagcuccuccccaccgcccucucccucgaggagcccaacauccgcaagcagucccccuccuccaagcaguccguccccgagacccucucccccuccgagggcguccgcgacuucucccgcgagcucuccccccccacccccgagaccgccgccuuccaggccuccggcucccagcccgucggcaaguggaacuccaaggaccucuacaucggcgucuccaccguccaggucaccggcaaccccaagggcaccuccgucggcaaggaggccgcccccucccagguccgcccccgcgagcccauguccguccucaugauggccaaccgcgaggucgucaacaccgagcucggcuccuaccgcgacuccgccgagaacgaggagugcggccagcccauggacgacauccaggucaacaugaugacccucgccgagcacaucaucgaggccacccccgaccgcaucaagcaggagaacuucguccccauggaguccuccggccucgagcgcaccgaccccgccaccaucuccuccaccauguccuggcucgccuccuaccucgccgacgccgacugccuccccuccgccgcccagauccgcuccgccuacaacgagccccucacccccuccuccaacaccucccucucccccgucggcucccccgucuccgagaucgccuucgagaagcccaaccuccccuccgccgccgacugguccgaguuccucuccgccuccaccuccgagaaggucgagaacgaguucgcccagcucacccucuccgaccacgagcagcgcgagcucuacgaggccgcccgccucguccagaccgccuuccgcaaguacaagggccgcccccuccgcgagcagcaggaggucgccgccgccgucauccagcgcugcuaccgcaaguacaagcaguacgcccucuacaagaagaugacccaggccgccauccucauccaguccaaguuccgcuccuacuacgagcagaagaaguuccagcagucccgccgcgccgccguccucauccagaaguacuaccgcuccuacaagaagugcggcaagcgccgccaggcccgccgcaccgccgucaucguccagcagaagcuccgcuccucccuccucaccaagaagcaggaccaggccgcccgcaagaucaugcgcuuccuccgccgcugccgccaccgcgucaaggagcucaagaaggccaaggagcucgaggacauccagcagcacccccucgccauguga

SEQ ID NO: 40732 - RNA, 3693 nt, Artificial Sequence
  derived and/or modified sequence opt2 from CAND1__Homo_sapiens__NP_060918
auggccuccgccuccuaccacaucuccaaccuccucgagaagaugaccuccuccgacaaggacuuccgcuucauggccaccaacgaccucaugaccgagcuccagaaggacuccaucaagcucgacgacgacuccgagcgcaaggucgucaagaugauccucaagcuccucgaggacaagaacggcgagguccagaaccucgccgucaagugccucggcccccucgucuccaaggucaaggaguaccaggucgagaccaucgucgacacccucugcaccaacaugcucuccgacaaggagcagcuccgcgacaucuccuccaucggccucaagaccgucaucggcgagcucccccccgccuccuccggcuccgcccucgccgccaacgucugcaagaagaucaccggccgccucaccuccgccaucgccaagcaggaggacgucuccguccagcucgaggcccucgacaucauggccgacaugcucucccgccagggcggccuccucgucaacuuccaccccuccauccucaccugccuccucccccagcucaccuccccccgccucgccguccgcaagcgcaccaucaucgcccucggccaccucgucauguccugcggcaacaucgucuucgucgaccucaucgagcaccuccucuccgagcucuccaagaacgacuccauguccaccacccgcaccuacauccagugcaucgccgccaucucccgccaggccggccaccgcaucggcgaguaccucgagaagaucaucccccucgucgucaaguucugcaacgucgacgacgacgagcuccgcgaguacugcauccaggccuucgaguccuucguccgccgcugccccaaggaggucuacccccacgucuccaccaucaucaacaucugccucaaguaccucaccuacgaccccaacuacaacuacgacgacgaggacgaggacgagaacgccauggacgccgacggcggcgacgacgacgaccagggcuccgacgacgaguacuccgacgacgacgacauguccuggaagguccgccgcgccgccgccaagugccucgacgccgucgucuccacccgccacgagaugcuccccgaguucuacaagaccgucucccccgcccucaucucccgcuucaaggagcgcgaggagaacgucaaggccgacgucuuccacgccuaccucucccuccucaagcagacccgccccguccaguccuggcucugcgaccccgacgccauggagcagggcgagaccccccucaccaugcuccagucccagguccccaacaucgucaaggcccuccacaagcagaugaaggagaaguccgucaagacccgccagugcugcuucaacaugcucaccgagcucgucaacguccuccccggcgcccucacccagcacauccccguccucguccccggcaucaucuucucccucaacgacaaguccuccuccuccaaccucaagaucgacgcccucuccugccucuacgucauccucugcaaccacuccccccaggucuuccacccccacguccaggcccucgucccccccgucgucgccugcgucggcgaccccuucuacaagaucaccuccgaggcccuccucgucacccagcagcucgucaaggucauccgcccccucgaccagcccuccuccuucgacgccacccccuacaucaaggaccucuucaccugcaccaucaagcgccucaaggccgccgacaucgaccaggaggucaaggagcgcgccaucuccugcaugggccagaucaucugcaaccucggcgacaaccucggcuccgaccuccccaacacccuccagaucuuccucgagcgccucaagaacgagaucacccgccucaccaccgucaaggcccucacccucaucgccggcuccccccucaagaucgaccuccgccccguccucggcgagggcguccccauccucgccuccuuccuccgcaagaaccagcgcgcccucaagcucggcacccucuccgcccucgacauccucaucaagaacuacuccgacucccucaccgccgccaugaucgacgccguccucgacgagcuccccccccucaucuccgaguccgacaugcacgucucccagauggccaucuccuuccucaccacccucgccaaggucuaccccuccucccucuccaagaucuccggcuccauccucaacgagcucaucggccucguccgcuccccccuccuccagggcggcgcccucuccgccaugcucgacuucuuccaggcccucgucgucaccggcaccaacaaccucggcuacauggaccuccuccgcaugcucaccggccccgucuacucccaguccaccgcccucacccacaagcaguccuacuacuccaucgccaagugcgucgccgcccucacccgcgccugccccaaggagggccccgccgucgucggccaguucauccaggacgucaagaacucccgcuccaccgacuccauccgccuccucgcccuccucucccucggcgaggucggccaccacaucgaccucuccggccagcucgagcucaaguccgucauccucgaggccuucuccucccccuccgaggaggucaaguccgccgccuccuacgcccucggcuccaucuccgucggcaaccuccccgaguaccuccccuucguccuccaggagaucaccucccagcccaagcgccaguaccuccuccuccacucccucaaggagaucaucuccuccgccuccgucgucggccucaagcccuacgucgagaacaucugggcccuccuccucaagcacugcgagugcgccgaggagggcacccgcaacgucgucgccgagugccucggcaagcucacccucaucgaccccgagacccuccucccccgccucaagggcuaccucaucuccggcuccuccuacgcccgcuccuccgucgucaccgccgucaaguucaccaucuccgaccacccccagcccaucgacccccuccucaagaacugcaucggcgacuuccucaagacccucgaggaccccgaccucaacguccgccgcgucgcccucgucaccuucaacuccgccgcccacaacaagcccucccucauccgcgaccuccucgacaccguccucccccaccucuacaacgagaccaagguccgcaaggagcucauccgcgaggucgagaugggccccuucaagcacaccgucgacgacggccucgacauccgcaaggccgccuucgagugcauguacacccuccucgacuccugccucgaccgccucgacaucuucgaguuccucaaccacgucgaggacggccucaaggaccacuacgacaucaagaugcucaccuuccucaugcucguccgccucuccacccucugccccuccgccguccuccagcgccucgaccgccucgucgagccccuccgcgccaccugcaccaccaaggucaaggccaacuccgucaagcaggaguucgagaagcaggacgagcucaagcgcuccgccaugcgcgccgucgccgcccuccucaccauccccgaggccgagaaguccccccucauguccgaguuccagucccagaucuccuccaaccccgagcucgccgccaucuucgaguccauccagaaggacuccuccuccaccaaccucgaguccauggacaccuccuga

SEQ ID NO: 40733 - RNA, 3711 nt, Artificial Sequence
  derived and/or modified sequence opt2 from CAND2__Homo_sapiens__NP_001155971
auguccaccgccgccuuccacaucuccucccuccucgagaagaugaccuccuccgacaaggacuuccgcuucauggccaccuccgaccucauguccgagcuccagaaggacuccauccagcucgacgaggacuccgagcgcaaggucgucaagaugcuccuccgccuccucgaggacaagaacggcgagguccagaaccucgccgucaagugccucggcccccucgucgucaaggucaaggaguaccaggucgagaccaucgucgacacccucugcaccaacaugcgcuccgacaaggagcagcuccgcgacaucgccggcaucggccucaagaccguccucuccgagcucccccccgccgccaccggcuccggccucgccaccaacgucugccgcaagaucaccggccagcucaccuccgccaucgcccagcaggaggacgucgccguccagcucgaggcccucgacauccucuccgacaugcucucccgccucggcgucccccucggcgccuuccacgccucccuccuccacugccuccucccccagcucuccuccccccgccucgccguccgcaagcgcgccgucggcgcccucggccaccucgccgccgccugcuccaccgaccucuucgucgagcucgccgaccaccuccucgaccgccuccccggcccccgcguccccaccucccccaccgccauccgcacccucauccagugccucggcuccgucggccgccaggccggccaccgccucggcgcccaccucgaccgccucgucccccucgucgaggacuucugcaaccucgacgacgacgagcuccgcgaguccugccuccaggccuucgaggccuuccuccgcaagugccccaaggagaugggcccccacguccccaacgucaccucccucugccuccaguacaucaagcacgaccccaacuacaacuacgacuccgacgaggacgaggagcagauggagaccgaggacuccgaguucuccgagcaggaguccgaggacgaguacuccgacgacgacgacauguccuggaagguccgccgcgccgccgccaagugcaucgccgcccucaucuccucccgccccgaccuccuccccgacuuccacugcacccucgcccccguccucauccgccgcuucaaggagcgcgaggagaacgucaaggccgacgucuucaccgccuacaucguccuccuccgccagacccagccccccaagggcuggcucgaggccauggaggagcccacccagaccggcuccaaccuccacaugcuccgcggccaggucccccucgucgucaaggcccuccagcgccagcucaaggaccgcuccguccgcgcccgccagggcugcuucucccuccucaccgagcucgccggcguccuccccggcucccucgccgagcacaugcccguccucgucuccggcaucaucuucucccucgccgaccgcuccuccuccuccaccauccgcauggacgcccucgccuuccuccagggccuccucggcaccgagcccgccgaggccuuccacccccaccuccccauccuccucccccccgucauggccugcgucgccgacuccuucuacaagaucgccgccgaggcccucgucguccuccaggagcucguccgcgcccucuggccccuccaccgcccccgcaugcucgaccccgagcccuacgucggcgagauguccgccgucacccucgcccgccuccgcgccaccgaccucgaccaggaggucaaggagcgcgccaucuccugcaugggccaccucgucggccaccucggcgaccgccucggcgacgaccucgagcccacccuccuccuccuccucgaccgccuccgcaacgagaucacccgccuccccgccaucaaggcccucacccucgucgccgucuccccccuccagcucgaccuccagcccauccucgccgaggcccuccacauccucgccuccuuccuccgcaagaaccagcgcgcccuccgccucgccacccucgccgcccucgacgcccucgcccagucccagggccucucccucccccccuccgccguccaggccguccucgccgagcuccccgcccucgucaacgaguccgacaugcacgucgcccagcucgccgucgacuuccucgccaccgucacccaggcccagcccgccucccucgucgaggucuccggccccguccucuccgagcuccuccgccuccuccgcuccccccuccuccccgccggcguccucgccgccgccgagggcuuccuccaggcccucgucggcacccgcccccccugcgucgacuacgccaagcucaucucccuccucaccgcccccgucuacgagcaggccgucgacggcggccccggccuccacaagcaggucuuccacucccucgcccgcugcgucgccgcccucuccgccgccugcccccaggaggccgccuccaccgccucccgccucgucugcgacgcccgcuccccccacuccuccaccggcgucaagguccucgccuuccucucccucgccgaggucggccaggucgccggccccggccaccagcgcgagcucaaggccguccuccucgaggcccucggcucccccuccgaggacguccgcgccgccgccuccuacgcccucggccgcgucggcgccggcucccuccccgacuuccuccccuuccuccucgagcagaucgaggccgagccccgccgccaguaccuccuccuccacucccuccgcgaggcccucggcgccgcccagcccgacucccucaagcccuacgccgaggacaucugggcccuccucuuccagcgcugcgagggcgccgaggagggcacccgcggcgucgucgccgagugcaucggcaagcucguccucgucaaccccuccuuccuccucccccgccuccgcaagcagcucgccgccggccgcccccacacccgcuccaccgucaucaccgccgucaaguuccucaucuccgaccagccccaccccaucgacccccuccucaaguccuucaucggcgaguucauggagucccuccaggaccccgaccucaacguccgccgcgccacccucgccuucuucaacuccgccguccacaacaagcccucccucguccgcgaccuccucgacgacauccucccccuccucuaccaggagaccaagauccgccgcgaccucauccgcgaggucgagaugggccccuucaagcacaccgucgacgacggccucgacguccgcaaggccgccuucgagugcauguacucccuccucgaguccugccucggccagcucgacaucugcgaguuccucaaccacgucgaggacggccucaaggaccacuacgacauccgcaugcucaccuucaucauggucgcccgccucgccacccucugccccgcccccguccuccagcgcgucgaccgccucaucgagccccuccgcgccaccugcaccgccaaggucaaggccggcuccgucaagcaggaguucgagaagcaggacgagcucaagcgcuccgccaugcgcgccgucgccgcccuccucaccauccccgaggucggcaagucccccaucauggccgacuucuccucccagauccgcuccaaccccgagcucgccgcccucuucgaguccauccagaaggacuccgccuccgcccccuccaccgacuccauggagcucuccuga

SEQ ID NO: 40734 - RNA, 1206 nt, Artificial Sequence
  derived and/or modified sequence opt2 from CANT1__Homo_sapiens__XP_005257079
augcccguccagcucuccgagcaccccgaguggaacgaguccaugcacucccuccgcaucuccgucggcggccuccccguccucgccuccaugaccaaggccgccgacccccgcuuccgcccccgcuggaaggucauccucaccuucuucgucggcgccgccauccucuggcuccucugcucccaccgccccgcccccggccgcccccccacccacaacgcccacaacuggcgccucggccaggcccccgccaacugguacaacgacaccuacccccucucccccccccagcgcacccccgccggcauccgcuaccgcaucgccgucaucgccgaccucgacaccgagucccgcgcccaggaggagaacaccugguucuccuaccucaagaagggcuaccucacccucuccgacuccggcgacaaggucgccgucgagugggacaaggaccacggcguccucgagucccaccucgccgagaagggccgcggcauggagcucuccgaccucaucgucuucaacggcaagcucuacuccgucgacgaccgcaccggcgucgucuaccagaucgagggcuccaaggccguccccugggucauccucuccgacggcgacggcaccgucgagaagggcuucaaggccgaguggcucgccgucaaggacgagcgccucuacgucggcggccucggcaaggaguggaccaccaccaccggcgacgucgucaacgagaaccccgagugggucaaggucgucggcuacaagggcuccgucgaccacgagaacugggucuccaacuacaacgcccuccgcgccgccgccggcauccagccccccggcuaccucauccacgaguccgccugcugguccgacacccuccagcgcugguucuuccucccccgccgcgccucccaggagcgcuacuccgagaaggacgacgagcgcaagggcgccaaccuccuccucuccgccucccccgacuucggcgacaucgccgucucccacgucggcgccgucguccccacccacggcuucuccuccuucaaguucauccccaacaccgacgaccagaucaucgucgcccucaaguccgaggaggacuccggccgcgucgccuccuacaucauggccuucacccucgacggccgcuuccuccuccccgagaccaagaucggcuccgucaaguacgagggcaucgaguucaucuga

SEQ ID NO: 40735 - RNA, 1941 nt, Artificial Sequence
  derived and/or modified sequence opt2 from CANX__Homo_sapiens__XP_011532966
auguaccagaaggagaacacccaguggcuccgcaaccucgccgucaccgcccccauccucgaggccuccaaccccgucggcgagggccagggcgucaagucccgcaaggcccccgaguccuccuccaagugcaucuccuuccacaccggcggccucgagaucauggagggcaaguggcuccucugcaugcuccucguccucggcaccgccaucgucgaggcccacgacggccacgacgacgacgucaucgacaucgaggacgaccucgacgacgucaucgaggaggucgaggacuccaagcccgacaccaccgccccccccuccucccccaaggucaccuacaaggcccccguccccaccggcgaggucuacuucgccgacuccuucgaccgcggcacccucuccggcuggauccucuccaaggccaagaaggacgacaccgacgacgagaucgccaaguacgacggcaagugggaggucgaggagaugaaggaguccaagcuccccggcgacaagggccucguccucaugucccgcgccaagcaccacgccaucuccgccaagcucaacaagcccuuccucuucgacaccaagccccucaucguccaguacgaggucaacuuccagaacggcaucgagugcggcggcgccuacgucaagcuccucuccaagacccccgagcucaaccucgaccaguuccacgacaagacccccuacaccaucauguucggccccgacaagugcggcgaggacuacaagcuccacuucaucuuccgccacaagaaccccaagaccggcaucuacgaggagaagcacgccaagcgccccgacgccgaccucaagaccuacuucaccgacaagaagacccaccucuacacccucauccucaaccccgacaacuccuucgagauccucgucgaccaguccgucgucaacuccggcaaccuccucaacgacaugaccccccccgucaaccccucccgcgagaucgaggaccccgaggaccgcaagcccgaggacugggacgagcgccccaagauccccgaccccgaggccgucaagcccgacgacugggacgaggacgcccccgccaagauccccgacgaggaggccaccaagcccgagggcuggcucgacgacgagcccgaguacguccccgaccccgacgccgagaagcccgaggacugggacgaggacauggacggcgagugggaggccccccagaucgccaacccccgcugcgaguccgcccccggcugcggcgucuggcagcgccccgucaucgacaaccccaacuacaagggcaaguggaagccccccaugaucgacaaccccuccuaccagggcaucuggaagccccgcaagauccccaaccccgacuucuucgaggaccucgagcccuuccgcaugacccccuucuccgccaucggccucgagcucugguccaugaccuccgacaucuucuucgacaacuucaucaucugcgccgaccgccgcaucgucgacgacugggccaacgacggcuggggccucaagaaggccgccgacggcgccgccgagcccggcgucgucggccagaugaucgaggccgccgaggagcgccccuggcucugggucgucuacauccucaccgucgcccuccccgucuuccucgucauccucuucugcugcuccggcaagaagcagaccuccggcauggaguacaagaagaccgacgccccccagcccgacgucaaggaggaggaggaggagaaggaggaggagaaggacaagggcgacgaggaggaggagggcgaggagaagcucgaggagaagcagaaguccgacgccgaggaggacggcggcaccgucucccaggaggaggaggaccgcaagcccaaggccgaggaggacgagauccucaaccgcuccccccgcaaccgcaagccccgccgcgaguga

SEQ ID NO: 40736 - RNA, 1428 nt, Artificial Sequence
  derived and/or modified sequence opt2 from CAP1__Homo_sapiens__XP_011538812
auggccgacaugcagaaccucgucgagcgccucgagcgcgccgucggccgccucgaggccgucucccacaccuccgacaugcaccgcggcuacgccgacucccccuccaaggccggcgccgcccccuacguccaggccuucgacucccuccucgccggccccgucgccgaguaccucaagaucuccaaggagaucggcggcgacguccagaagcacgccgagaugguccacaccggccucaagcucgagcgcgcccuccucgucaccgccucccagugccagcagcccgccgagaacaagcucuccgaccuccucgcccccaucuccgagcagaucaaggaggucaucaccuuccgcgagaagaaccgcggcuccaagcucuucaaccaccucuccgccgucuccgaguccauccaggcccucggcugggucgccauggcccccaagcccggccccuacgucaaggagaugaacgacgccgccauguucuacaccaaccgcguccucaaggaguacaaggacgucgacaagaagcacgucgacugggucaaggccuaccucuccaucuggaccgagcuccaggccuacaucaaggaguuccacaccaccggccucgccugguccaagaccggccccgucgccaaggagcucuccggccuccccuccggccccuccgccggcuccugcccccccccccccccccccugccccccccccccccccgucuccaccaucuccugcuccuacgaguccgccucccgcuccucccucuucgcccagaucaaccagggcgaguccaucacccacgcccucaagcacgucuccgacgacaugaagacccacaagaaccccgcccucaaggcccaguccggccccguccgcuccggccccaagcccuucuccgcccccaagccccagaccucccccucccccaagcgcgccaccaagaaggagcccgccguccucgagcucgagggcaagaaguggcgcgucgagaaccaggagaacgucuccaaccucgucaucgaggacaccgagcucaagcaggucgccuacaucuacaagugcgucaacaccacccuccagaucaagggcaagaucaacuccaucaccgucgacaacugcaagaagcucggccucgucuucgacgacgucgucggcaucgucgagaucaucaacuccaaggacgucaagguccaggucaugggcaagguccccaccaucuccaucaacaagaccgacggcugccacgccuaccucuccaagaacucccucgacugcgagaucgucuccgccaaguccuccgagaugaacguccucauccccaccgagggcggcgacuucaacgaguuccccguccccgagcaguucaagacccucuggaacggccagaagcucgucaccaccgucaccgagaucgccggcuga

SEQ ID NO: 40737 - RNA, 1434 nt, Artificial Sequence
  derived and/or modified sequence opt2 from CAP2__Homo_sapiens__NP_006357
auggccaacaugcagggccucgucgagcgccucgagcgcgccgucucccgccucgagucccucuccgccgagucccaccgcccccccggcaacugcggcgaggucaacggcgucaucgccggcgucgcccccuccgucgaggccuucgacaagcucauggacuccauggucgccgaguuccucaagaacucccgcauccucgccggcgacgucgagacccacgccgagaugguccacuccgccuuccaggcccagcgcgccuuccuccucauggccucccaguaccagcagccccacgagaacgacgucgccgcccuccucaagcccaucuccgagaagauccaggagauccagaccuuccgcgagcgcaaccgcggcuccaacauguucaaccaccucuccgccgucuccgaguccauccccgcccucggcuggaucgccgucucccccaagcccggccccuacgucaaggagaugaacgacgccgccaccuucuacaccaaccgcguccucaaggacuacaagcacuccgaccuccgccacgucgacugggucaaguccuaccucaacaucugguccgagcuccaggccuacaucaaggagcaccacaccaccggccucaccugguccaagaccggccccgucgccuccaccgucuccgccuucuccguccucuccuccggccccggccuccccccccccccccccccccuccccccccccggcccccccccccucuucgagaacgagggcaagaaggaggaguccucccccucccgcuccgcccucuucgcccagcucaaccagggcgaggccaucaccaagggccuccgccacgucaccgacgaccagaagaccuacaagaaccccucccuccgcgcccagggcggccagacccagucccccaccaagucccacacccccucccccaccucccccaaguccuaccccucccagaagcacgcccccguccucgagcucgagggcaagaaguggcgcgucgaguaccaggaggaccgcaacgaccucgucaucuccgagaccgagcucaagcaggucgccuacaucuucaagugcgagaaguccaccauccagaucaagggcaaggucaacuccaucaucaucgacaacugcaagaagcucggccucgucuucgacaacgucgucggcaucgucgaggucaucaacucccaggacauccagauccaggucaugggccgcguccccaccaucuccaucaacaagaccgagggcugccacaucuaccucuccgaggacgcccucgacugcgagaucgucuccgccaaguccuccgagaugaacauccucaucccccaggacggcgacuaccgcgaguuccccauccccgagcaguucaagaccgccugggacggcuccaagcucaucaccgagcccgccgagaucauggccuga

SEQ ID NO: 40738 - RNA, 1002 nt, Artificial Sequence
  derived and/or modified sequence opt2 from CAPG__Homo_sapiens__NP_001243069
auguacaccgccaucccccaguccggcucccccuuccccggcuccguccaggaccccggccuccacgucuggcgcgucgagaagcucaagcccguccccgucgcccaggagaaccagggcgucuucuucuccggcgacuccuaccucguccuccacaacggccccgaggaggucucccaccuccaccucuggaucggccagcaguccucccgcgacgagcagggcgccugcgccguccucgccguccaccucaacacccuccucggcgagcgccccguccagcaccgcgagguccagggcaacgaguccgaccucuucauguccuacuucccccgcggccucaaguaccaggagggcggcgucgaguccgccuuccacaagaccuccaccggcgcccccgccgccaucaagaagcucuaccaggucaagggcaagaagaacauccgcgccaccgagcgcgcccucaacugggacuccuucaacaccggcgacugcuucauccucgaccucggccagaacaucuucgccuggugcggcggcaaguccaacauccucgagcgcaacaaggcccgcgaccucgcccucgccauccgcgacuccgagcgccagggcaaggcccagguccucggccccaagcccgcccucaaggagggcaaccccgaggaggaccucaccgccgacaaggccaacgcccaggccgccgcccucuacaaggucuccgacgccaccggccagaugaaccucaccaaggucgccgacuccucccccuucgcccucgagcuccucaucuccgacgacugcuucguccucgacaacggccucugcggcaagaucuacaucuggaagggccgcaaggccaacgagaaggagcgccaggccgcccuccaggucgccgagggcuucaucucccgcaugcaguacgcccccaacacccaggucgagauccucccccagggccacgagucccccaucuucaagcaguucuucaaggacuggaaguga

SEQ ID NO: 40739 - RNA, 2019 nt, Artificial Sequence
  derived and/or modified sequence opt2 from CAPN10__Homo_sapiens__NP_075571
augcgcgccggccgcggcgccacccccgcccgcgagcucuuccgcgacgccgccuuccccgccgccgacuccucccucuucugcgaccucuccaccccccucgcccaguuccgcgaggacaucaccuggcgccgcccccaggagaucugcgccaccccccgccucuuccccgacgacccccgcgagggccaggucaagcagggccuccucggcgacugcugguuccucugcgccugcgccgcccuccagaagucccgccaccuccucgaccaggucaucccccccggccagcccuccugggccgaccaggaguaccgcggcuccuucaccugccgcaucuggcaguucggccgcugggucgaggucaccaccgacgaccgccuccccugccucgccggccgccucugcuucucccgcugccagcgcgaggacgucuucuggcucccccuccucgagaaggucuacgccaagguccacggcuccuacgagcaccucugggccggccaggucgccgacgcccucgucgaccucaccggcggccucgccgagcgcuggaaccucaagggcgucgccggcuccggcggccagcaggaccgccccggccgcugggagcaccgcaccugccgccagcuccuccaccucaaggaccagugccucaucuccugcugcguccucuccccccgcgccggcgcccgcgagcucggcgaguuccacgccuucaucgucuccgaccuccgcgagcuccagggccaggccggccagugcauccuccuccuccgcauccagaaccccuggggccgccgcugcuggcagggccucuggcgcgagggcggcgagggcuggucccaggucgacgccgccgucgccuccgagcuccucucccagcuccaggagggcgaguucugggucgaggaggaggaguuccuccgcgaguucgacgagcucaccgucggcuaccccgucaccgaggccggccaccuccagucccucuacaccgagcgccuccucugccacacccgcgcccuccccggcgccugggucaagggccaguccgccggcggcugccgcaacaacuccggcuuccccuccaaccccaaguucuggcuccgcgucuccgagcccuccgaggucuacaucgccguccuccagcgcucccgccuccacgccgccgacugggccggccgcgcccgcgcccucgucggcgacucccacaccuccuggucccccgccuccauccccggcaagcacuaccaggccgucggccuccaccucuggaaggucgagaagcgccgcgucaaccucccccgcguccucuccaugccccccgucgccggcaccgccugccacgccuacgaccgcgagguccaccuccgcugcgagcucucccccggcuacuaccucgccguccccuccaccuuccucaaggacgcccccggcgaguuccuccuccgcgucuucuccaccggccgcgucucccucuccgccauccgcgccgucgccaagaacaccacccccggcgccgcccuccccgccggcgaguggggcaccguccagcuccgcggcuccuggcgcgucggccagaccgccggcggcucccgcaacuucgccuccuaccccaccaaccccugcuuccccuucuccguccccgagggccccggcccccgcugcguccgcaucacccuccaccagcacugccgccccuccgacaccgaguuccaccccaucggcuuccacaucuuccagguccccgagggcggccgcucccaggacgcccccccccuccuccuccaggagccccuccucuccugcgucccccaccgcuacgcccaggaggucucccgccucugccuccuccccgccggcaccuacaaggucguccccuccaccuaccuccccgacaccgagggcgccuucaccgucaccaucgccacccgcaucgaccgccccuccauccacucccaggagaugcucggccaguuccuccaggaggucuccgucauggccgucaugaagaccuga

SEQ ID NO: 40740 - RNA, 2010 nt, Artificial Sequence
  derived and/or modified sequence opt2 from CAPN13__Homo_sapiens__NP_653176
auggccuacuaccaggagcccuccgucgagaccuccaucaucaaguucaaggaccaggacuucaccacccuccgcgaccacugccucuccaugggccgcaccuucaaggacgagaccuuccccgccgccgacuccuccaucggccagaagcuccuccaggagaagcgccucuccaacgucaucuggaagcgcccccaggaccuccccggcggccccccccacuucauccucgacgacaucucccgcuucgacauccagcagggcggcgccgccgacugcugguuccucgccgcccucggcucccucacccagaacccccaguaccgccagaagauccucaugguccaguccuucucccaccaguacgccggcaucuuccgcuuccgcuucuggcagugcggccagugggucgaggucgucaucgacgaccgccuccccguccagggcgacaagugccucuucguccgcccccgccaccagaaccaggaguucuggcccugccuccucgagaaggccuacgccaagcuccucggcuccuacuccgaccuccacuacggcuuccucgaggacgcccucgucgaccucaccggcggcgucaucaccaacauccaccuccacuccucccccgucgaccucgucaaggccgucaagaccgccaccaaggccggcucccucaucaccugcgccacccccuccggccccaccgacaccgcccaggccauggagaacggccucgucucccuccacgccuacaccgucaccggcgccgagcagauccaguaccgccgcggcugggaggagaucaucucccucuggaaccccuggggcuggggcgaggccgaguggcgcggccgcugguccgacggcucccaggagugggaggagaccugcgacccccgcaagucccagcuccacaagaagcgcgaggacggcgaguucuggauguccugccaggacuuccagcagaaguucaucgccauguucaucugcuccgagauccccaucacccucgaccacggcaacacccuccacgagggcuggucccagaucauguuccgcaagcaggucauccucggcaacaccgccggcggcccccgcaacgacgcccaguucaacuucuccguccaggagcccauggagggcaccaacgucgucgucugcgucaccgucgccgucacccccuccaaccucaaggccgaggacgccaaguucccccucgacuuccaggucauccucgccggcucccagcgcuuccgcgagaaguucccccccgucuucuucuccuccuuccgcaacaccguccaguccuccaacaacaaguuccgccgcaacuucaccaugaccuaccaccucucccccggcaacuacgucgucgucgcccagacccgccgcaaguccgccgaguuccuccuccgcaucuuccucaagaugcccgacuccgaccgccaccucuccucccacuucaaccuccgcaugaagggcucccccuccgagcacggcucccagcaguccaucuucaaccgcuacgcccagcagcgccucgacaucgacgccacccagcuccagggccuccucaaccaggagcuccucaccggcccccccggcgacauguucucccucgacgagugccgcucccucgucgcccucauggagcucaaggucaacggccgccucgaccaggaggaguucgcccgccucuggaagcgccucguccacuaccagcacgucuuccagaagguccagaccucccccggcguccuccucuccuccgaccucuggaaggccaucgagaacaccgacuuccuccgcggcaucuucaucucccgcgagcuccuccaccucgucacccuccgcuacuccgacuccgucggccgcgucuccuuccccucccucgucugcuuccucaugcgccucgaggccauggccaagaccuuccgcaaccucuccaaggacggcaagggccucuaccucaccgagauggaguggaugucccucgucauguacaacuga

SEQ ID NO: 40741 - RNA, 2055 nt, Artificial Sequence
  derived and/or modified sequence opt2 from CAPN14__Homo_sapiens__NP_001138594
augucccucuggccccccuuccgcugccgcuggaagcucgccccccgcuacucccgccgcgccuccccccagcagccccagcaggacuucgaggcccuccucgccgagugccuccgcaacggcugccucuucgaggacaccuccuuccccgccacccucuccuccaucggcuccggcucccuccuccagaagcuccccccccgccuccaguggaagcgcccccccgagcuccacuccaacccccaguucuacuucgccaaggccaagcgccucgaccucugccagggcaucgucggcgacugcugguuccucgccgcccuccaggcccucgcccuccaccaggacauccucucccgcgucgucccccucaaccaguccuucaccgagaaguacgccggcaucuuccgcuucugguucuggcacuacggcaacuggguccccgucgucaucgacgaccgccuccccgucaacgaggccggccagcucgucuucgucuccuccaccuacaagaaccucuucuggggcgcccuccucgagaaggccuacgccaagcucuccggcuccuacgaggaccuccaguccggccaggucuccgaggcccucgucgacuucaccggcggcgucaccaugaccaucaaccucgccgaggcccacggcaaccucugggacauccucaucgaggccaccuacaaccgcacccucaucggcugccagacccacuccggcgagaagauccucgagaacggccucgucgagggccacgccuacacccucaccggcauccgcaaggucaccugcaagcaccgccccgaguaccucgucaagcuccgcaaccccuggggcaaggucgaguggaagggcgacugguccgacuccuccuccaagugggagcuccucucccccaaggagaagauccuccuccuccgcaaggacaacgacggcgaguucuggaugacccuccaggacuucaagacccacuucguccuccucgucaucugcaagcucacccccggccuccucucccaggaggccgcccagaaguggaccuacaccaugcgcgagggccgcugggagaagcgcuccaccgccggcggccagcgccagcuccuccaggacaccuucuggaagaacccccaguuccuccucuccgucuggcgccccgaggagggccgccgcucccuccgccccugcuccguccucgucucccuccuccagaagccccgccaccgcugccgcaagcgcaagccccuccucgccaucggcuucuaccucuaccgcaugaacaaguaccacgacgaccagcgccgccucccccccgaguucuuccagcgcaacaccccccucucccagcccgaccgcuuccucaaggagaaggaggucucccaggagcucugccucgagcccggcaccuaccucaucguccccugcauccucgaggcccaccagaaguccgaguucguccuccgcgucuucucccgcaagcacaucuucuacgagaucggcuccaacuccggcgucgucuucuccaaggagaucgaggaccagaacgagcgccaggacgaguucuucaccaaguucuucgagaagcaccccgagaucaacgccguccagcuccagaaccuccucaaccagaugaccugguccucccucggcucccgccagcccuucuucucccucgaggccugccagggcauccucgcccuccucgaccucaacgccuccggcaccauguccauccaggaguuccgcgaccucuggaagcagcucaagcucucccagaaggucuuccacaagcaggaccgcggcuccggcuaccucaacugggagcagcuccacgccgccaugcgcgaggccggcaucaugcucuccgacgacgucugccagcucaugcucauccgcuacggcggcccccgccuccagauggacuucgucuccuucauccaccucaugcuccgcgucgagaacauggaggacgucuuccagaaccucacccaggacggcaagggcaucuaccuccagaagcccgaguggaugaugauggcccucuacuccuga

SEQ ID NO: 40742 - RNA, 2145 nt, Artificial Sequence
  derived and/or modified sequence opt2 from CAPN1__Homo_sapiens__XP_011543594
auguccgaggagaucaucacccccgucuacugcaccggcgucuccgcccagguccagaagcagcgcgcccgcgagcucggccucggccgccacgagaacgccaucaaguaccucggccaggacuacgagcagcuccgcguccgcugccuccaguccggcacccucuuccgcgacgaggccuucccccccgucccccagucccucggcuacaaggaccucggccccaacuccuccaagaccuacggcaucaaguggaagcgccccaccgagcuccucuccaacccccaguucaucgucgacggcgccacccgcaccgacaucugccagggcgcccucggcgacugcuggcuccucgccgccaucgccucccucacccucaacgacacccuccuccaccgcgucgucccccacggccaguccuuccagaacggcuacgccggcaucuuccacuuccagcucuggcaguucggcgagugggucgacgucgucgucgacgaccuccuccccaucaaggacggcaagcucgucuucguccacuccgccgagggcaacgaguucugguccgcccuccucgagaaggccuacgccaaggucaacggcuccuacgaggcccucuccggcggcuccaccuccgagggcuucgaggacuucaccggcggcgucaccgagugguacgagcuccgcaaggcccccuccgaccucuaccagaucauccucaaggcccucgagcgcggcucccuccucggcugcuccaucgacaucuccuccguccucgacauggaggccaucaccuucaagaagcucgucaagggccacgccuacuccgucaccggcgccaagcaggucaacuaccgcggccaggucgucucccucauccgcaugcgcaaccccuggggcgaggucgaguggaccggcgccugguccgacuccuccuccgaguggaacaacgucgaccccuacgagcgcgaccagcuccgcgucaagauggaggacggcgaguucuggauguccuuccgcgacuucaugcgcgaguucacccgccucgagaucugcaaccucacccccgacgcccucaagucccgcaccauccgcaaguggaacaccacccucuacgagggcaccuggcgccgcggcuccaccgccggcggcugccgcaacuaccccgccaccuucugggucaacccccaguucaagauccgccucgacgagaccgacgaccccgacgacuacggcgaccgcgaguccggcugcuccuucguccucgcccucaugcagaagcaccgccgccgcgagcgccgcuucggccgcgacauggagaccaucggcuucgccgucuacgaggucccccccgagcucgucggccagcccgccguccaccucaagcgcgacuucuuccucgccaacgccucccgcgcccgcuccgagcaguucaucaaccuccgcgaggucuccacccgcuuccgccucccccccggcgaguacgucgucguccccuccaccuucgagcccaacaaggagggcgacuucguccuccgcuucuucuccgagaaguccgccggcaccgucgagcucgacgaccagauccaggccaaccuccccgacgagcagguccucuccgaggaggagaucgacgagaacuucaaggcccucuuccgccagcucgccggcgaggacauggagaucuccgucaaggagcuccgcaccauccucaaccgcaucaucuccaagcacaaggaccuccgcaccaagggcuucucccucgaguccugccgcuccauggucaaccucauggaccgcgacggcaacggcaagcucggccucgucgaguucaacauccucuggaaccgcauccgcaacuaccucuccaucuuccgcaaguucgaccucgacaaguccggcuccauguccgccuacgagaugcgcauggccaucgaguccgccggcuucaagcucaacaagaagcucuacgagcucaucaucacccgcuacuccgagcccgaccucgccgucgacuucgacaacuucgucugcugccucguccgccucgagaccauguuccgcuucuucaagacccucgacaccgaccucgacggcgucgucaccuucgaccucuucaaguggcuccagcucaccauguucgccuga

SEQ ID NO: 40743 - RNA, 1869 nt, Artificial Sequence
  derived and/or modified sequence opt2 from CAPN2__Homo_sapiens__NP_001139540
auggagaucugcgccgacccccaguucaucaucggcggcgccacccgcaccgacaucugccagggcgcccucggcgacugcuggcuccucgccgccaucgccucccucacccucaacgaggagauccucgcccgcgucgucccccucaaccaguccuuccaggagaacuacgccggcaucuuccacuuccaguucuggcaguacggcgagugggucgaggucgucgucgacgaccgccuccccaccaaggacggcgagcuccucuucguccacuccgccgagggcuccgaguucugguccgcccuccucgagaaggccuacgccaagaucaacggcugcuacgaggcccucuccggcggcgccaccaccgagggcuucgaggacuucaccggcggcaucgccgagugguacgagcucaagaagcccccccccaaccucuucaagaucauccagaaggcccuccagaagggcucccuccucggcugcuccaucgacaucaccuccgccgccgacuccgaggccaucaccuuccagaagcucgucaagggccacgccuacuccgucaccggcgccgaggaggucgaguccaacggcucccuccagaagcucauccgcauccgcaaccccuggggcgaggucgaguggaccggccgcuggaacgacaacugccccuccuggaacaccaucgaccccgaggagcgcgagcgccucacccgccgccacgaggacggcgaguucuggauguccuucuccgacuuccuccgccacuacucccgccucgagaucugcaaccucacccccgacacccucaccuccgacaccuacaagaaguggaagcucaccaagauggacggcaacuggcgccgcggcuccaccgccggcggcugccgcaacuaccccaacaccuucuggaugaacccccaguaccucaucaagcucgaggaggaggacgaggacgaggaggacggcgaguccggcugcaccuuccucgucggccucauccagaagcaccgccgccgccagcgcaagaugggcgaggacaugcacaccaucggcuucggcaucuacgagguccccgaggagcucuccggccagaccaacauccaccucuccaagaacuucuuccucaccaaccgcgcccgcgagcgcuccgacaccuucaucaaccuccgcgagguccucaaccgcuucaagcucccccccggcgaguacauccucguccccuccaccuucgagcccaacaaggacggcgacuucugcauccgcgucuucuccgagaagaaggccgacuaccaggccgucgacgacgagaucgaggccaaccucgaggaguucgacaucuccgaggacgacaucgacgacggcuuccgccgccucuucgcccagcucgccggcgaggacgccgagaucuccgccuucgagcuccagaccauccuccgccgcguccucgccaagcgccaggacaucaaguccgacggcuucuccaucgagaccugcaagaucauggucgacaugcucgacuccgacggcuccggcaagcucggccucaaggaguucuacauccucuggaccaagauccagaaguaccagaagaucuaccgcgagaucgacgucgaccgcuccggcaccaugaacuccuacgagaugcgcaaggcccucgaggaggccggcuucaagaugcccugccagcuccaccaggucaucgucgcccgcuucgccgacgaccagcucaucaucgacuucgacaacuucguccgcugccucguccgccucgagacccucuucaagaucuucaagcagcucgaccccgagaacaccggcaccaucgagcucgaccucaucuccuggcucugcuucuccguccucuga

SEQ ID NO: 40744 - RNA, 2466 nt, Artificial Sequence
  derived and/or modified sequence opt2 from CAPN3__Homo_sapiens__NP_000061
augcccaccgucaucuccgccuccgucgccccccgcaccgccgccgagccccgcucccccggccccgucccccaccccgcccaguccaaggccaccgaggccggcggcggcaaccccuccggcaucuacuccgccaucaucucccgcaacuuccccaucaucggcgucaaggagaagaccuucgagcagcuccacaagaagugccucgagaagaagguccucuacgucgaccccgaguucccccccgacgagaccucccucuucuacucccagaaguuccccauccaguucgucuggaagcgcccccccgagaucugcgagaacccccgcuucaucaucgacggcgccaaccgcaccgacaucugccagggcgagcucggcgacugcugguuccucgccgccaucgccugccucacccucaaccagcaccuccucuuccgcgucaucccccacgaccaguccuucaucgagaacuacgccggcaucuuccacuuccaguucuggcgcuacggcgagugggucgacgucgucaucgacgacugccuccccaccuacaacaaccagcucgucuucaccaaguccaaccaccgcaacgaguucugguccgcccuccucgagaaggccuacgccaagcuccacggcuccuacgaggcccucaagggcggcaacaccaccgaggccauggaggacuucaccggcggcgucgccgaguucuucgagauccgcgacgcccccuccgacauguacaagaucaugaagaaggccaucgagcgcggcucccucaugggcugcuccaucgacgacggcaccaacaugaccuacggcaccucccccuccggccucaacaugggcgagcucaucgcccgcaugguccgcaacauggacaacucccuccuccaggacuccgaccucgacccccgcggcuccgacgagcgccccacccgcaccaucauccccguccaguacgagacccgcauggccugcggccucguccgcggccacgccuacuccgucaccggccucgacgagguccccuucaagggcgagaaggucaagcucguccgccuccgcaaccccuggggccaggucgaguggaacggcuccugguccgaccgcuggaaggacugguccuucgucgacaaggacgagaaggcccgccuccagcaccaggucaccgaggacggcgaguucuggauguccuacgaggacuucaucuaccacuucaccaagcucgagaucugcaaccucaccgccgacgcccuccaguccgacaagcuccagaccuggaccgucuccgucaacgagggccgcuggguccgcggcugcuccgccggcggcugccgcaacuuccccgacaccuucuggaccaacccccaguaccgccucaagcuccucgaggaggacgacgaccccgacgacuccgaggucaucugcuccuuccucgucgcccucaugcagaagaaccgccgcaaggaccgcaagcucggcgccucccucuucaccaucggcuucgccaucuacgagguccccaaggagaugcacggcaacaagcagcaccuccagaaggacuucuuccucuacaacgccuccaaggcccgcuccaagaccuacaucaacaugcgcgaggucucccagcgcuuccgccucccccccuccgaguacgucaucguccccuccaccuacgagccccaccaggagggcgaguucauccuccgcgucuucuccgagaagcgcaaccucuccgaggaggucgagaacaccaucuccgucgaccgccccgucaagaagaagaagaccaagcccaucaucuucgucuccgaccgcgccaacuccaacaaggagcucggcgucgaccaggaguccgaggagggcaagggcaagaccucccccgacaagcagaagcaguccccccagccccagcccggcuccuccgaccaggaguccgaggagcagcagcaguuccgcaacaucuucaagcagaucgccggcgacgacauggagaucugcgccgacgagcucaagaagguccucaacaccgucgucaacaagcacaaggaccucaagacccacggcuucacccucgaguccugccgcuccaugaucgcccucauggacaccgacggcuccggcaagcucaaccuccaggaguuccaccaccucuggaacaagaucaaggccuggcagaagaucuucaagcacuacgacaccgaccaguccggcaccaucaacuccuacgagaugcgcaacgccgucaacgacgccggcuuccaccucaacaaccagcucuacgacaucaucaccaugcgcuacgccgacaagcacaugaacaucgacuucgacuccuucaucugcugcuucguccgccucgagggcauguuccgcgccuuccacgccuucgacaaggacggcgacggcaucaucaagcucaacguccucgaguggcuccagcucaccauguacgccuga

SEQ ID NO: 40745 - RNA, 1923 nt, Artificial Sequence
  derived and/or modified sequence opt2 from CAPN5__Homo_sapiens__NP_004046
auguucuccugcgucaagcccuacgaggaccagaacuacuccgcccuccgccgcgacugccgccgccgcaagguccucuucgaggacccccucuuccccgccaccgacgacucccucuacuacaagggcacccccggccccgccguccgcuggaagcgccccaagggcaucugcgaggacccccgccucuucgucgacggcaucuccucccacgaccuccaccagggccaggucggcaacugcugguucgucgccgccugcuccucccucgccucccgcgagucccucuggcagaaggucauccccgacuggaaggagcaggagugggaccccgagaagcccaacgccuacgccggcaucuuccacuuccacuucuggcgcuucggcgagugggucgacgucgucaucgacgaccgccuccccaccgucaacaaccagcucaucuacugccacuccaacucccgcaacgaguucuggugcgcccucgucgagaaggccuacgccaagcucgccggcugcuaccaggcccucgacggcggcaacaccgccgacgcccucgucgacuucaccggcggcgucuccgagcccaucgaccucaccgagggcgacuucgccaacgacgagaccaagcgcaaccagcucuucgagcgcaugcucaagguccacucccgcggcggccucaucuccgccuccaucaaggccgucaccgccgccgacauggaggcccgccucgccugcggccucgucaagggccacgccuacgccgucaccgacguccgcaagguccgccucggccacggccuccucgccuucuucaaguccgagaagcucgacaugauccgccuccgcaaccccuggggcgagcgcgaguggaacggccccugguccgacaccuccgaggaguggcagaaggucuccaaguccgagcgcgagaagaugggcgucaccguccaggacgacggcgaguucuggaugaccuucgaggacgucugccgcuacuucaccgacaucaucaagugccgcgucaucaacaccucccaccucuccauccacaagaccugggaggaggcccgccuccacggcgccuggacccuccacgaggacccccgccagaaccgcggcggcggcugcaucaaccacaaggacaccuucuuccagaacccccaguacaucuucgaggucaagaagcccgaggacgagguccucaucugcauccagcagcgccccaagcgcuccacccgccgcgagggcaagggcgagaaccucgccaucggcuucgacaucuacaaggucgaggagaaccgccaguaccgcaugcacucccuccagcacaaggccgccuccuccaucuacaucaacucccgcuccgucuuccuccgcaccgaccagcccgagggccgcuacgucaucauccccaccaccuucgagcccggccacaccggcgaguuccuccuccgcgucuucaccgacguccccuccaacugccgcgagcuccgccucgacgagcccccccacaccugcugguccucccucugcggcuacccccagcucgucacccagguccacguccucggcgccgccggccucaaggacucccccaccggcgccaacuccuacgucaucaucaagugcgagggcgacaagguccgcuccgccguccagaagggcaccuccacccccgaguacaacgucaagggcaucuucuaccgcaagaagcucucccagcccaucaccguccaggucuggaaccaccgcguccucaaggacgaguuccucggccagguccaccucaaggccgaccccgacaaccuccaggcccuccacacccuccaccuccgcgaccgcaacucccgccagcccuccaaccuccccggcaccgucgccguccacauccucuccuccaccucccucauggccgucuga

SEQ ID NO: 40746 - RNA, 1926 nt, Artificial Sequence
  derived and/or modified sequence opt2 from CAPN6__Homo_sapiens__NP_055104
augggccccccccucaagcucuucaagaaccagaaguaccaggagcucaagcaggagugcaucaaggacucccgccucuucugcgaccccaccuuccuccccgagaacgacucccucuucuacaaccgccuccuccccggcaaggucgucuggaagcgcccccaggacaucugcgacgacccccaccucaucgucggcaacaucuccaaccaccagcucacccagggccgccucggccacaagcccauggucuccgccuucuccugccucgccguccaggagucccacuggaccaagaccauccccaaccacaaggagcaggagugggacccccagaagaccgagaaguacgccggcaucuuccacuuccgcuucuggcacuucggcgaguggaccgaggucgucaucgacgaccuccuccccaccaucaacggcgaccucgucuucuccuucuccaccuccaugaacgaguucuggaacgcccuccucgagaaggccuacgccaagcuccucggcugcuacgaggcccucgacggccucaccaucaccgacaucaucgucgacuucaccggcacccucgccgagaccgucgacaugcagaagggccgcuacaccgagcucgucgaggagaaguacaagcucuucggcgagcucuacaagaccuucaccaagggcggccucaucugcugcuccaucgagucccccaaccaggaggagcaggaggucgagaccgacuggggccuccucaagggccacaccuacaccaugaccgacauccgcaagauccgccucggcgagcgccucgucgaggucuucuccgccgagaaggucuacaugguccgccuccgcaacccccucggccgccaggagugguccggccccugguccgagaucuccgaggaguggcagcagcucaccgccuccgaccgcaagaaccucggccucgucauguccgacgacggcgaguucuggaugucccucgaggacuucugccgcaacuuccacaagcucaacgucugccgcaacgucaacaaccccaucuucggccgcaaggagcucgaguccguccucggcugcuggaccgucgacgacgacccccucaugaaccgcuccggcggcugcuacaacaaccgcgacaccuuccuccagaacccccaguacaucuucaccguccccgaggacggccacaaggucaucaugucccuccagcagaaggaccuccgcaccuaccgccgcaugggccgccccgacaacuacaucaucggcuucgagcucuucaaggucgagaugaaccgcaaguuccgccuccaccaccucuacauccaggagcgcgccggcaccuccaccuacaucgacacccgcaccgucuuccucuccaaguaccucaagaagggcaacuacguccucguccccaccauguuccagcacggccgcaccuccgaguuccuccuccgcaucuucuccgagguccccguccagcuccgcgagcucacccucgacaugcccaagauguccugcuggaaccucgcccgcggcuaccccaaggucgucacccagaucaccguccacuccgccgaggaccucgagaagaaguacgccaacgagaccgucaaccccuaccucgucaucaagugcggcaaggaggagguccgcucccccguccagaagaacaccguccacgccaucuucgacacccaggccaucuucuaccgccgcaccaccgacauccccaucaucguccaggucuggaacucccgcaaguucugcgaccaguuccucggccaggucacccucgacgccgaccccuccgacugccgcgaccucaagucccucuaccuccgcaagaagggcggccccaccgccaaggucaagcagggccacaucuccuucaaggucaucuccuccgacgaccucaccgagcucuga

SEQ ID NO: 40747 - RNA, 2442 nt, Artificial Sequence
  derived and/or modified sequence opt2 from CAPN7__Homo_sapiens__NP_055111
auggacgccaccgcccucgagcgcgacgccguccaguucgcccgccucgccguccagcgcgaccacgagggccgcuacuccgaggccgucuucuacuacaaggaggccgcccaggcccucaucuacgccgagauggccggcuccucccucgagaacauccaggagaagaucaccgaguaccucgagcgcguccaggcccuccacuccgccguccaguccaaguccgccgacccccucaaguccaagcaccagcucgaccucgagcgcgcccacuuccucgucacccaggccuucgacgaggacgagaaggagaacgucgaggacgccaucgagcucuacaccgaggccgucgaccucugccucaagaccuccuacgagaccgccgacaagguccuccagaacaagcucaagcagcucgcccgccaggcccucgaccgcgccgaggcccucuccgagccccucaccaagcccgucggcaagaucuccuccaccuccgucaagcccaagcccccccccguccgcgcccacuucccccucggcgccaaccccuuccucgagcgcccccaguccuucaucuccccccaguccugcgacgcccagggccagcgcuacaccgccgaggagaucgagguccuccgcaccaccuccaagaucaacggcaucgaguacguccccuucaugaacgucgaccuccgcgagcgcuucgccuaccccaugcccuucugcgaccgcuggggcaagcucccccucucccccaagcagaagaccaccuucuccaaguggguccgccccgaggaccucaccaacaaccccaccaugaucuacaccgucuccuccuucuccaucaagcagaccaucgucuccgacugcuccuucgucgccucccucgccaucuccgccgccuacgagcgccgcuucaacaagaagcucaucaccggcaucaucuacccccagaacaaggacggcgagcccgaguacaaccccugcggcaaguacauggucaagcuccaccucaacggcgucccccgcaaggucaucaucgacgaccagcuccccgucgaccacaagggcgagcuccucugcuccuacuccaacaacaaguccgagcucugggucucccucaucgagaaggccuacaugaaggucaugggcggcuacgacuuccccggcuccaacuccaacaucgaccuccacgcccucaccggcuggauccccgagcgcaucgccaugcacuccgacucccagaccuucuccaaggacaacuccuuccgcaugcucuaccagcgcuuccacaagggcgacguccucaucaccgccuccaccggcaugaugaccgaggccgagggcgagaaguggggccucguccccacccacgccuacgccguccucgacauccgcgaguucaagggccuccgcuucauccagcucaagaaccccuggucccaccuccgcuggaagggccgcuacuccgagaacgacgucaagaacuggacccccgagcuccagaaguaccucaacuucgacccccgcaccgcccagaagaucgacaacggcaucuucuggaucuccugggacgaccucugccaguacuacgacgucaucuaccucuccuggaaccccggccucuucaaggaguccaccugcauccacuccaccugggacgccaagcagggccccgucaaggacgccuacucccucgccaacaacccccaguacaagcucgagguccagugcccccagggcggcgccgccgucuggguccuccucucccgccacaucaccgacaaggacgacuucgccaacaaccgcgaguucaucaccauggucgucuacaagaccgacggcaagaaggucuacuaccccgccgaccccccccccuacaucgacggcauccgcaucaacuccccccacuaccucaccaagaucaagcucaccacccccggcacccacaccuucacccucgucgucucccaguacgagaagcagaacaccauccacuacaccguccgcgucuacuccgccugcuccuucaccuucuccaagauccccucccccuacacccucuccaagcgcaucaacggcaagugguccggccaguccgccggcggcugcggcaacuuccaggagacccacaagaacaaccccaucuaccaguuccacaucgagaagaccggcccccuccucaucgagcuccgcggcccccgccaguacuccgucggcuucgaggucgucaccgucuccacccucggcgaccccggcccccacggcuuccuccgcaaguccuccggcgacuaccgcugcggcuucugcuaccucgagcucgagaacauccccuccggcaucuucaacaucauccccuccaccuuccuccccaagcaggagggccccuucuuccucgacuucaacuccaucauccccaucaagaucacccagcuccaguga

SEQ ID NO: 40748 - RNA, 2073 nt, Artificial Sequence
  derived and/or modified sequence opt2 from CAPN9__Homo_sapiens__NP_006606
augcccuaccucuaccgcgcccccggcccccaggcccaccccguccccaaggacgcccgcaucacccacuccuccggccaguccuucgagcagaugcgccaggagugccuccagcgcggcacccucuucgaggacgccgacuuccccgccuccaacuccucccucuucuacuccgagcgcccccagauccccuucgucuggaagcgccccggcgagaucgucaagaaccccgaguucauccucggcggcgccacccgcaccgacaucugccagggcgagcucggcgacugcuggcuccucgccgccaucgccucccucacccucaaccagaaggcccucgcccgcgucaucccccaggaccaguccuucggccccggcuacgccggcaucuuccacuuccaguucuggcagcacuccgaguggcucgacgucgucaucgacgaccgccuccccaccuuccgcgaccgccucgucuuccuccacuccgccgaccacaacgaguucugguccgcccuccucgagaaggccuacgccaagcucaacggcuccuacgaggcccucaagggcggcuccgccaucgaggccauggaggacuucaccggcggcgucgccgagaccuuccagaccaaggaggcccccgagaacuucuacgagauccucgagaaggcccucaagcgcggcucccuccucggcugcuucaucgacacccgcuccgccgccgaguccgaggcccgcacccccuucggccucaucaagggccacgccuacuccgucaccggcaucgaccaggucuccuuccgcggccagcgcaucgagcucauccgcauccgcaaccccuggggccaggucgaguggaacggcuccugguccgacuccucccccgaguggcgcuccgucggccccgccgagcagaagcgccucugccacaccgcccucgacgacggcgaguucuggauggccuucaaggacuucaaggcccacuucgacaaggucgagaucugcaaccucacccccgacgcccucgaggaggacgccauccacaagugggaggucaccguccaccagggcuccuggguccgcggcuccaccgccggcggcugccgcaacuuccucgacaccuucuggaccaacccccagaucaagcucucccucaccgagaaggacgagggccaggaggagugcuccuuccucgucgcccucaugcagaaggaccgccgcaagcucaagcgcuucggcgccaacguccucaccaucggcuacgccaucuacgagugccccgacaaggacgagcaccucaacaaggacuucuuccgcuaccacgccucccgcgcccgcuccaagaccuucaucaaccuccgcgaggucuccgaccgcuucaagcucccccccggcgaguacauccucauccccuccaccuucgagccccaccaggaggccgacuucugccuccgcaucuucuccgagaagaaggccaucacccgcgacauggacggcaacgucgacaucgaccuccccgagccccccaagcccaccccccccgaccaggagaccgaggaggagcagcgcuuccgcgcccucuucgagcaggucgccggcgaggacauggaggucaccgccgaggagcucgaguacguccucaacgccguccuccagaagaagaaggacaucaaguucaagaagcucucccucaucuccugcaagaacaucaucucccucauggacaccuccggcaacggcaagcucgaguucgacgaguucaaggucuucugggacaagcucaagcaguggaucaaccucuuccuccgcuucgacgccgacaaguccggcaccauguccaccuacgagcuccgcaccgcccucaaggccgccggcuuccagcucuccucccaccuccuccagcucaucguccuccgcuacgccgacgaggagcuccagcucgacuucgacgacuuccucaacugccucguccgccucgagaacgccucccgcgucuuccaggcccucuccaccaagaacaaggaguucauccaccucaacaucaacgaguucauccaccucaccaugaacaucuga

SEQ ID NO: 40749 - RNA, 807 nt, Artificial Sequence
  derived and/or modified sequence opt2 from CAPNS1__Homo_sapiens__NP_001289561
auguuccucgucaacuccuuccucaagggcggcggcggcggcggcggcggcggcggcggccucggcggcggccucggcaacguccucggcggccucaucuccggcgccggcggcggcggcggcggcggcggcggcggcggcggcggcggcggcggcggcggcggcggcaccgccaugcgcauccucggcggcgucaucuccgccaucuccgaggccgccgcccaguacaaccccgagcccccccccccccgcacccacuacuccaacaucgaggccaacgaguccgaggagguccgccaguuccgccgccucuucgcccagcucgccggcgacgacauggaggucuccgccaccgagcucaugaacauccucaacaaggucgucacccgccaccccgaccucaagaccgacggcuucggcaucgacaccugccgcuccauggucgccgucauggacuccgacaccaccggcaagcucggcuucgaggaguucaaguaccucuggaacaacaucaagcgcuggcaggccaucuacaagcaguucgacaccgaccgcuccggcaccaucugcuccuccgagcuccccggcgccuucgaggccgccggcuuccaccucaacgagcaccucuacaacaugaucauccgccgcuacuccgacgaguccggcaacauggacuucgacaacuucaucuccugccucguccgccucgacgccauguuccgcgccuucaagucccucgacaaggacggcaccggccagauccaggucaacauccaggaguggcuccagcucaccauguacuccuga

SEQ ID NO: 40750 - RNA, 2130 nt, Artificial Sequence
  derived and/or modified sequence opt2 from CAPRIN1__Homo_sapiens__NP_005889
augcccuccgccaccucccacuccggcuccggcuccaaguccuccggcccccccccccccuccggcuccuccggcuccgaggccgccgccggcgccggcgccgccgcccccgccucccagcaccccgccaccggcaccggcgccguccagaccgaggccaugaagcagauccucggcgucaucgacaagaagcuccgcaaccucgagaagaagaagggcaagcucgacgacuaccaggagcgcaugaacaagggcgagcgccucaaccaggaccagcucgacgccgucuccaaguaccaggaggucaccaacaaccucgaguucgccaaggagcuccagcgcuccuucauggcccucucccaggacauccagaagaccaucaagaagaccgcccgccgcgagcagcucaugcgcgaggaggccgagcagaagcgccucaagaccguccucgagcuccaguacguccucgacaagcucggcgacgacgagguccgcaccgaccucaagcagggccucaacggcguccccauccucuccgaggaggagcucucccuccucgacgaguucuacaagcucgucgaccccgagcgcgacaugucccuccgccucaacgagcaguacgagcacgccuccauccaccucugggaccuccucgagggcaaggagaagcccgucugcggcaccaccuacaagguccucaaggagaucgucgagcgcgucuuccaguccaacuacuucgacuccacccacaaccaccagaacggccucugcgaggaggaggaggccgccuccgcccccgccgucgaggaccagguccccgaggccgagcccgagcccgccgaggaguacaccgagcaguccgaggucgaguccaccgaguacgucaaccgccaguucauggccgagacccaguucaccuccggcgagaaggagcaggucgacgaguggaccgucgagaccgucgaggucgucaacucccuccagcagcagccccaggccgccucccccuccguccccgagccccacucccucacccccgucgcccaggccgacccccucguccgccgccagcgcguccaggaccucauggcccagaugcagggccccuacaacuucauccaggacuccaugcucgacuucgagaaccagacccucgaccccgccaucgucuccgcccagcccaugaaccccacccagaacauggacaugccccagcucgucugcccccccguccacuccgagucccgccucgcccagcccaaccagguccccguccagcccgaggccacccaggucccccucgucuccuccaccuccgagggcuacaccgccucccagccccucuaccagcccucccacgccaccgagcagcgcccccagaaggagcccaucgaccagauccaggccaccaucucccucaacaccgaccagaccaccgccuccuccucccuccccgccgccucccagccccaggucuuccaggccggcaccuccaagccccuccacuccuccggcaucaacgucaacgccgcccccuuccaguccaugcagaccgucuucaacaugaacgcccccgucccccccgucaacgagcccgagacccucaagcagcagaaccaguaccaggccuccuacaaccaguccuucuccucccagccccaccaggucgagcagaccgagcuccagcaggagcagcuccagaccgucgucggcaccuaccacggcucccccgaccagucccaccaggucaccggcaaccaccagcagcccccccagcagaacaccggcuucccccgcuccaaccagcccuacuacaacucccgcggcgucucccgcggcggcucccgcggcgcccgcggccucaugaacggcuaccgcggccccgccaacggcuuccgcggcggcuacgacggcuaccgccccuccuucuccaacacccccaacuccggcuacacccagucccaguucuccgccccccgcgacuacuccggcuaccagcgcgacggcuaccagcagaacuucaagcgcggcuccggccaguccggcccccgcggcgccccccgcggccgcggcggccccccccgccccaaccgcggcaugccccagaugaacacccagcaggucaacuga

SEQ ID NO: 40751 - RNA, 3384 nt, Artificial Sequence
  derived and/or modified sequence opt2 from CAPRIN2__Homo_sapiens__NP_001002259
auggagguccaggucucccaggccucccucggcuucgagcucaccuccgucgagaagucccuccgcgaguggucccgccucucccgcgaggucaucgccuggcucugccccuccucccccaacuucauccucaacuucccccccccccccuccgccuccuccgucuccaugguccagcucuucuccucccccuucggcuaccagucccccuccggccacuccgaggaggagcgcgagggcaacaugaaguccgccaagccccaggucaaccacucccagcacggcgagucccagcgcgcccucuccccccuccaguccacccucuccuccgccgccucccccucccaggccuacgagaccuacaucgagaacggccucaucugccucaagcacaagauccgcaacaucgagaagaagaagcucaagcucgaggacuacaaggaccgccucaaguccggcgagcaccucaaccccgaccagcucgaggccgucgagaaguacgaggagguccuccacaaccucgaguucgccaaggagcuccagaagaccuucuccggccucucccucgaccuccucaaggcccagaagaaggcccagcgccgcgagcacaugcucaagcucgaggccgagaagaagaagcuccgcaccauccuccagguccaguacguccuccagaaccucacccaggagcacguccagaaggacuucaagggcggccucaacggcgccgucuaccuccccuccaaggagcucgacuaccucaucaaguucuccaagcucaccugccccgagcgcaacgagucccucuccgucgaggaccagauggagcaguccucccucuacuucugggaccuccucgagggcuccgagaaggccgucgucggcaccaccuacaagcaccucaaggaccuccucuccaagcuccucaacuccggcuacuucgaguccauccccguccccaagaacgccaaggagaaggaggucccccucgaggaggagaugcucauccaguccgagaagaagacccagcucuccaagaccgaguccgucaaggaguccgagucccucauggaguucgcccagcccgagauccagccccaggaguuccucaaccgccgcuacaugaccgaggucgacuacuccaacaagcagggcgaggagcagcccugggaggccgacuacgcccgcaagcccaaccuccccaagcgcugggacaugcucaccgagcccgacggccaggagaagaagcaggaguccuucaaguccugggaggccuccggcaagcaccaggaggucuccaagcccgccgucucccucgagcagcgcaagcaggacaccuccaagcuccgcuccacccuccccgaggagcagaagaagcaggagaucuccaaguccaagcccucccccucccaguggaagcaggacacccccaaguccaaggccggcuacguccaggaggagcagaagaagcaggagacccccaagcucuggcccguccagcuccagaaggagcaggaccccaagaagcagacccccaaguccuggacccccuccaugcaguccgagcagaacaccaccaaguccuggaccacccccaugugcgaggagcaggacuccaagcagcccgagacccccaaguccugggagaacaacgucgagucccagaagcacucccucaccucccagucccagaucucccccaaguccuggggcgucgccaccgccucccucauccccaacgaccagcuccucccccgcaagcucaacaccgagcccaaggacguccccaagcccguccaccagcccgucggcuccuccuccacccuccccaaggaccccguccuccgcaaggagaagcuccaggaccucaugacccagauccagggcaccugcaacuucaugcaggaguccguccucgacuucgacaagcccuccuccgccauccccaccucccagccccccuccgccacccccggcucccccgucgccuccaaggagcagaaccucuccucccaguccgacuuccuccaggagccccuccaggccaccuccucccccgucaccugcuccuccaacgccugccucgucaccaccgaccaggccuccuccggcuccgagaccgaguucaugaccuccgagacccccgaggccgccaucccccccggcaagcagcccuccucccucgccucccccaacccccccauggccaagggcuccgagcagggcuuccaguccccccccgccuccuccuccuccgucaccaucaacaccgcccccuuccaggccaugcagaccgucuucaacgucaacgccccccuccccccccgcaaggagcaggagaucaaggagucccccuacucccccggcuacaaccaguccuucaccaccgccuccacccagacccccccccagugccagcuccccuccauccacgucgagcagaccguccacucccaggagaccgccgccaacuaccaccccgacggcaccauccaggucuccaacggcucccucgccuucuaccccgcccagaccaacgucuucccccgccccacccagcccuucgucaacucccgcggcuccguccgcggcugcacccgcggcggccgccucaucaccaacuccuaccgcucccccggcggcuacaagggcuucgacaccuaccgcggccuccccuccaucuccaacggcaacuacucccagcuccaguuccaggcccgcgaguacuccggcgcccccuacucccagcgcgacaacuuccagcagugcuacaagcgcggcggcaccuccggcggcccccgcgccaacucccgcgccggcugguccgacuccucccaggucuccucccccgagcgcgacaacgagaccuucaacuccggcgacuccggccagggcgacucccgcuccaugacccccgucgacguccccgucaccaaccccgccgccaccauccuccccguccacgucuacccccucccccagcagaugcgcgucgccuucuccgccgcccgcaccuccaaccucgcccccggcacccucgaccagcccaucgucuucgaccuccuccucaacaaccucggcgagaccuucgaccuccagcucggccgcuucaacugccccgucaacggcaccuacgucuucaucuuccacaugcucaagcucgccgucaacgucccccucuacgucaaccucaugaagaacgaggagguccucgucuccgccuacgccaacgacggcgcccccgaccacgagaccgccuccaaccacgccauccuccagcucuuccagggcgaccagaucuggcuccgccuccaccgcggcgccaucuacggcuccuccuggaaguacuccaccuucuccggcuaccuccucuaccaggacuga

SEQ ID NO: 40752 - RNA, 1428 nt, Artificial Sequence
  derived and/or modified sequence opt2 from CAPS2__Homo_sapiens__NP_001273476
augaucaacaccggcacccagauggaccucgaggucaagggcgucgccgccaccucccgcucccagauccagcccuucuucggccgcaagaagccccuccagcagcgcuggaccuccgaguccuggaccaaccagaacuccugcccccccgucgucccccgccucgaccucggcucccucgucgacuccgacgacgaggaccagaacaucauccccgagaaccuccccgcccccaccgacaagugcaagcucaaguaccagcagugcaagaccgagaucaaggagggcuacaagcaguacucccagcgcaacgccgagaacaccaaguccaacgucacccacaagcaguccccccgcaacaagaucgacgagaagugcguccaggacgaggaggccaacaccgacgaccucaccacccucgaccgcaaggccauccuccagcagggcuacgccgacaacuccugcgacaagcagcagcgcgcccgcaagcucgacgccgagaucgucgccgccgagaagaagaagcagaucgucgccgagcaggucaugaucgaccaccucucccgcgccgucaucuccgaccccgagcagaaccucgccaucgagcagaaggaguccgaccacauccuccccgacuccaagaugaccccccuccgcuuccgcaagcgcacccuccacgagaccaagauccgcacccacuccacccucaccgagaacguccucucccacaagcuccaguucgacggccgcaucgucucccgcaccaacguccuccccuucauccagaaguccaucuacucccaccagugcggccgccgcaagggcaagcaguaccgccucggcgacuucuacgucggcgccacccucaccuuccucuccuccgaccaccucucccuccccgaguccaucaaggagaacacccuccucaagcuccgcaucaccaacaucgaccagaucgcccucgacucccucaagaccgccuccauggagcaggaggacgacaucaucauccaggagaccaacgaccgccucgucuucaaggccauccaggacguccucaaggagaagcuccacaagcgcggcguccgcauccucaccggccucggcaaguacuuccagcagcucgacaaggagggcaacggccuccucgacaaggccgacuucaagcaggcccucaaggucuuccaccucgaggucuccgagaaggacuucgaguccgccuggcucauccucaacgacaacggcaacggcaaggucgacuacggcgaguucaagcgcggcaucaucggcgagaugaacgaguaccgcaaguccuacguccgcaaggccuucaugaagcucgacuucaacaaguccggcuccguccccaucaucaacauccgcaagugcuacugcgccaagaagcacucccaggucaucuccggcuga

SEQ ID NO: 40753 - RNA, 828 nt, Artificial Sequence
  derived and/or modified sequence opt2 from CAPS__Homo_sapiens__NP_004049
augcagugccaccgcgaccucgcccucucccaggcccucuggggcuggcagcucuccaagcaguccggcugggcccaccccucccucccccacuccccccuccccuccaccguccacuccugcuccugggcccccccccaccuccagcgccaccucccccucgccaccgucucccccggcaccacccagcucacccagggccccgccggccgcacccucggccagacccaggccuccugccccgagccccgccccuccauggacgccgucgacgccaccauggagaagcuccgcgcccagugccucucccgcggcgccuccggcauccagggccucgcccgcuucuuccgccagcucgaccgcgacggcucccgcucccucgacgccgacgaguuccgccagggccucgccaagcucggccucguccucgaccaggccgaggccgagggcgucugccgcaagugggaccgcaacggcuccggcacccucgaccucgaggaguuccuccgcgcccuccgcccccccaugucccaggcccgcgaggccgucaucgccgccgccuucgccaagcucgaccgcuccggcgacggcgucgucaccgucgacgaccuccgcggcgucuacuccggccgcgcccaccccaagguccgcuccggcgaguggaccgaggacgagguccuccgccgcuuccucgacaacuucgacuccuccgagaaggacggccaggucacccucgccgaguuccaggacuacuacuccggcgucuccgccuccaugaacaccgacgaggaguucgucgccaugaugaccuccgccuggcagcucuga

SEQ ID NO: 40754 - RNA, 627 nt, Artificial Sequence
  derived and/or modified sequence opt2 from CAPSL__Homo_sapiens__NP_001036090
auggccggcaccgcccgccacgaccgcgagauggccauccaggccaagaagaagcucaccaccgccaccgaccccaucgagcgccuccgccuccagugccucgcccgcggcuccgccggcaucaagggccucggccgcgucuuccgcaucauggacgacgacaacaaccgcacccucgacuucaaggaguucaugaagggccucaacgacuacgccgucgucauggagaaggaggaggucgaggagcucuuccgccgcuucgacaaggacggcaacggcaccaucgacuucaacgaguuccuccucacccuccgcccccccaugucccgcgcccgcaaggaggucaucaugcaggccuuccgcaagcucgacaagaccggcgacggcgucaucaccaucgaggaccuccgcgaggucuacaacgccaagcaccaccccaaguaccagaacggcgagugguccgaggagcaggucuuccgcaaguuccucgacaacuucgacucccccuacgacaaggacggccucgucacccccgaggaguucaugaacuacuacgccggcgucuccgccuccaucgacaccgacgucuacuucaucaucaugaugcgcaccgccuggaagcucuga

SEQ ID NO: 40755 - RNA, 861 nt, Artificial Sequence
  derived and/or modified sequence opt2 from CAPZA2__Homo_sapiens__NP_006127
auggccgaccucgaggagcagcucuccgacgaggagaagguccgcaucgccgccaaguucaucauccacgccccccccggcgaguucaacgaggucuucaacgacguccgccuccuccucaacaacgacaaccuccuccgcgagggcgccgcccacgccuucgcccaguacaaccucgaccaguucacccccgucaagaucgagggcuacgaggaccagguccucaucaccgagcacggcgaccucggcaacggcaaguuccucgaccccaagaaccgcaucugcuucaaguucgaccaccuccgcaaggaggccaccgacccccgccccugcgaggucgagaacgccgucgaguccuggcgcaccuccgucgagaccgcccuccgcgccuacgucaaggagcacuaccccaacggcgucugcaccgucuacggcaagaagaucgacggccagcagaccaucaucgccugcaucgagucccaccaguuccaggccaagaacuucuggaacggccgcuggcgcuccgaguggaaguucaccaucacccccuccaccacccaggucgucggcauccucaagauccagguccacuacuacgaggacggcaacguccagcucgucucccacaaggacauccaggacucccucaccgucuccaacgagguccagaccgccaaggaguucaucaagaucgucgaggccgccgagaacgaguaccagaccgccaucuccgagaacuaccagaccauguccgacaccaccuucaaggcccuccgccgccagcuccccgucacccgcaccaagaucgacuggaacaagauccucuccuacaagaucggcaaggagaugcagaacgccuga

SEQ ID NO: 40756 - RNA, 900 nt, Artificial Sequence
  derived and/or modified sequence opt2 from CAPZA3__Homo_sapiens__NP_201585
augacccucuccguccucucccgcaaggacaaggagcgcgucauccgccgccuccuccuccaggccccccccggcgaguucgucaacgccuucgacgaccucugccuccucauccgcgacgagaagcucaugcaccaccagggcgagugcgccggccaccagcacugccagaaguacuccgucccccucugcaucgacggcaaccccguccuccucucccaccacaacgucaugggcgacuaccgcuucuucgaccaccaguccaagcucuccuucaaguacgaccuccuccagaaccagcucaaggacauccagucccacggcaucauccagaacgaggccgaguaccuccgcgucguccuccucugcgcccucaagcucuacgucaacgaccacuaccccaagggcaacugcaacaugcuccgcaagaccgucaaguccaaggaguaccucaucgccugcaucgaggaccacaacuacgagaccggcgagugcuggaacggccucuggaaguccaaguggaucuuccaggucaaccccuuccucacccaggucaccggccgcaucuucguccaggcccacuucuuccgcugcgucaaccuccacaucgagaucuccaaggaccucaaggagucccucgagaucgucaaccaggcccagcucgcccucuccuucgcccgccucgucgaggagcaggagaacaaguuccaggccgccguccucgaggagcuccaggagcucuccaacgaggcccuccgcaagauccuccgccgcgaccuccccgucacccgcacccucaucgacuggcaccgcauccucuccgaccucaaccucgucauguaccccaagcucggcuacgucaucuacucccgcuccguccucugcaacuggaucaucuga

SEQ ID NO: 40757 - RNA, 3099 nt, Artificial Sequence
  derived and/or modified sequence opt2 from CARD10__Homo_sapiens__NP_055365
augcccggccgcgccgaggccggcgaggccgaggaggaggccggcgccggcuccggcuccgaggccgaggaggacgcccucugggagcgcaucgagggcguccgccaccgccucgcccgcgcccucaaccccgccaagcucacccccuaccuccgccagugccgcgucaucgacgagcaggacgaggaggagguccucuccaccuaccgcuuccccugccgcgucaaccgcaccggccgccucauggacauccuccgcugccgcggcaagcgcggcuacgaggccuuccucgaggcccucgaguucuacuaccccgagcacuucacccuccucaccggccaggagcccgcccagcgcugcuccaugauccucgacgaggagggccccgagggccucacccaguuccucaugaccgagguccgccgccuccgcgaggcccgcaagucccagcuccagcgcgagcagcagcuccaggcccgcggccgcguccucgaggaggagcgcgccggccucgagcagcgccuccgcgaccagcagcaggcccaggagcgcugccagcgccuccgcgaggacugggaggccggcucccucgagcuccuccgccucaaggacgagaacuacaugaucgccaugcgccucgcccagcucuccgaggagaagaacuccgccguccuccgcucccgcgaccuccagcucgccgucgaccagcucaagcucaaggucucccgccucgaggaggagugcgcccuccuccgccgcgcccgcggccccccccccggcgccgaggagaaggagaaggagaaggagaaggagaaggagcccgacaacgucgaccucgucuccgagcuccgcgccgagaaccagcgccucaccgccucccuccgcgagcuccaggagggccuccagcaggaggccucccgccccggcgcccccggcuccgagcgcauccuccucgacauccucgagcacgacuggcgcgaggcccaggacucccgccaggagcucugccagaagcuccacgccguccagggcgagcuccagugggccgaggagcuccgcgaccaguaccuccaggagauggaggaccuccgccucaagcaccgcacccuccagaaggacugcgaccucuacaagcaccgcauggccaccguccucgcccagcucgaggagaucgagaaggagcgcgaccaggccauccagucccgcgaccgcauccagcuccaguacucccagucccucaucgagaaggaccaguaccgcaagcagguccgcggccucgaggccgagcgcgacgagcuccucaccacccucaccucccucgagggcaccaaggcccuccucgagguccagcuccagcgcgcccagggcggcaccugccucaaggccugcgccuccucccacucccucugcuccaaccucuccuccaccuggucccucuccgaguuccccuccccccucggcggccccgaggccaccggcgaggccgccgucaugggcggccccgagccccacaacuccgaggaggccaccgacuccgagaaggagaucaaccgccucuccauccuccccuucccccccuccgccggcuccauccuccgccgccagcgcgaggaggaccccgccccccccaagcgcuccuucuccuccauguccgacaucaccggcuccgucacccucaagcccuggucccccggccucuccuccuccuccuccuccgacuccgucuggccccucggcaagcccgagggccuccucgcccgcggcugcggccucgacuuccucaaccgcucccucgccauccgcgucuccggccgcuccccccccggcggccccgagccccaggacaagggccccgacggccucuccuucuacggcgaccgcugguccggcgccgucguccgccgcguccucuccggccccggcuccgcccgcauggagccccgcgagcagcgcgucgaggccgccggccucgagggcgccugccucgaggccgaggcccagcagcgcacccuccucuggaaccagggcuccacccuccccucccucauggacuccaaggccugccaguccuuccacgaggcccucgaggccugggccaagggccccggcgccgagcccuucuacauccgcgccaaccucacccuccccgagcgcgccgacccccacgcccucugcgucaaggcccaggagauccuccgccucgucgacuccgccuacaagcgccgccaggagugguucugcacccgcgucgacccccucacccuccgcgaccucgaccgcggcaccguccccaacuaccagcgcgcccagcagcuccucgagguccaggagaagugccuccccuccucccgccaccgcggcccccgcuccaaccucaagaagcgcgcccucgaccagcuccgccucguccgccccaagcccgucggcgcccccgccggcgacucccccgaccagcuccuccucgagcccugcgccgagcccgagcgcucccuccgccccuacucccucguccgcccccuccucgucuccgcccuccgccccgucguccuccuccccgagugccucgccccccgccucauccgcaaccuccucgaccuccccuccucccgccucgacuuccaggucugccccgccgagucccucuccggcgaggagcucugccccuccuccgcccccggcgcccccaaggcccagcccgccacccccggccucggcucccgcauccgcgccauccaggaguccgucggcaagaagcacugccuccucgagcucggcgcccgcggcguccgcgagcucguccagaacgagaucuaccccaucgucauccacgucgaggucaccgagaagaacguccgcgagguccgcggccuccucggccgccccggcuggcgcgacuccgagcuccuccgccagugccgcggcuccgagcagguccucuggggccuccccugcuccuggguccagguccccgcccacgaguggggccacgccgaggagcucgccaaggucguccgcggccgcauccuccaggagcaggcccgccucgucugggucgagugcggcuccucccgcggcugccccuccuccuccgaggccuga

SEQ ID NO: 40758 - RNA, 3465 nt, Artificial Sequence
  derived and/or modified sequence opt2 from CARD11__Homo_sapiens__NP_115791
augcccggcggcggccccgagauggacgacuacauggagacccucaaggacgaggaggacgcccucugggagaacgucgagugcaaccgccacaugcucucccgcuacaucaaccccgccaagcucacccccuaccuccgccagugcaaggucaucgacgagcaggacgaggacgagguccucaacgcccccaugcuccccuccaagaucaaccgcgccggccgccuccucgacauccuccacaccaagggccagcgcggcuacgucgucuuccucgagucccucgaguucuacuaccccgagcucuacaagcucgucaccggcaaggagcccacccgccgcuucuccaccaucgucgucgaggagggccacgagggccucacccacuuccucaugaacgaggucaucaagcuccagcagcagaugaaggccaaggaccuccagcgcugcgagcuccucgcccgccuccgccagcucgaggacgagaagaagcagaugacccucacccgcgucgagcuccucaccuuccaggagcgcuacuacaagaugaaggaggagcgcgacuccuacaacgacgagcucgucaaggucaaggacgacaacuacaaccucgccaugcgcuacgcccagcucuccgaggagaagaacauggccgucaugcgcucccgcgaccuccagcucgagaucgaccagcucaagcaccgccucaacaagauggaggaggagugcaagcucgagcgcaaccagucccucaagcucaagaacgacaucgagaaccgccccaagaaggagcagguccucgagcucgagcgcgagaacgagaugcucaagaccaagaaccaggagcuccaguccaucauccaggccggcaagcgcucccuccccgacuccgacaaggccauccucgacauccucgagcacgaccgcaaggaggcccucgaggaccgccaggagcucgucaaccgcaucuacaaccuccaggaggaggcccgccaggccgaggagcuccgcgacaaguaccucgaggagaaggaggaccucgagcucaagugcuccacccucggcaaggacugcgagauguacaagcaccgcaugaacaccgucaugcuccagcucgaggaggucgagcgcgagcgcgaccaggccuuccacucccgcgacgaggcccagacccaguacucccagugccucaucgagaaggacaaguaccgcaagcagauccgcgagcucgaggagaagaacgacgagaugcgcaucgagaugguccgccgcgaggccugcaucgucaaccucgaguccaagcuccgccgccucuccaaggacuccaacaaccucgaccagucccucccccgcaaccuccccgucaccaucaucucccaggacuucggcgacgccuccccccgcaccaacggccaggaggccgacgacuccuccaccuccgaggagucccccgaggacuccaaguacuuccuccccuaccaccccccccagcgccgcaugaaccucaagggcauccagcuccagcgcgccaagucccccaucucccucaagcgcaccuccgacuuccaggccaagggccacgaggaggagggcaccgacgccucccccuccuccugcggcucccuccccaucaccaacuccuucaccaagaugcagcccccccgcucccgcuccuccaucauguccaucaccgccgagccccccggcaacgacuccaucguccgccgcuacaaggaggacgccccccaccgcuccaccgucgaggaggacaacgacuccggcggcuucgacgcccucgaccucgacgacgacucccacgagcgcuacuccuucggccccuccuccauccacuccuccuccuccucccaccaguccgagggccucgacgccuacgaccucgagcaggucaaccucauguuccgcaaguucucccucgagcgccccuuccgccccuccgucaccuccgucggccacguccgcggccccggccccuccguccagcacaccacccucaacggcgacucccucaccucccagcucacccuccucggcggcaacgcccgcggcuccuucguccacuccgucaagcccggcucccucgccgagaaggccggccuccgcgagggccaccagcuccuccuccucgagggcugcauccgcggcgagcgccaguccgucccccucgacaccugcaccaaggaggaggcccacuggaccauccagcgcugcuccggccccgucacccuccacuacaaggucaaccacgagggcuaccgcaagcucgucaaggacauggaggacggccucaucaccuccggcgacuccuucuacauccgccucaaccucaacaucuccucccagcucgacgccugcaccaugucccucaagugcgacgacgucguccacguccgcgacaccauguaccaggaccgccacgaguggcucugcgcccgcgucgaccccuucaccgaccacgaccucgacaugggcaccauccccuccuacucccgcgcccagcagcuccuccucgucaagcuccagcgccucaugcaccgcggcucccgcgaggaggucgacggcacccaccacacccuccgcgcccuccgcaacacccuccagcccgaggaggcccucuccaccuccgacccccgcgucuccccccgccucucccgcgccuccuuccucuucggccagcuccuccaguucgucucccgcuccgagaacaaguacaagcgcaugaacuccaacgagcgcguccgcaucaucuccggcuccccccucggcucccucgcccgcuccucccucgacgccaccaagcuccucaccgagaagcaggaggagcucgaccccgaguccgagcucggcaagaaccucucccucauccccuacucccucguccgcgccuucuacugcgagcgccgccgccccguccucuucacccccaccguccucgccaagacccucguccagcgccuccucaacuccggcggcgccauggaguucaccaucugcaaguccgacaucgucacccgcgacgaguuccuccgccgccagaagaccgagaccaucaucuacucccgcgagaagaaccccaacgccuucgagugcaucgcccccgccaacaucgaggccgucgccgccaagaacaagcacugccuccucgaggccggcaucggcugcacccgcgaccucaucaaguccaacaucuaccccaucguccucuucauccgcgucugcgagaagaacaucaagcgcuuccgcaagcuccucccccgccccgagaccgaggaggaguuccuccgcgucugccgccucaaggagaaggagcucgaggcccuccccugccucuacgccaccgucgagcccgacauguggggcuccgucgaggagcuccuccgcgucgucaaggacaagaucggcgaggagcagcgcaagaccaucugggucgacgaggaccagcucuga

SEQ ID NO: 40759 - RNA, 2223 nt, Artificial Sequence
  derived and/or modified sequence opt2 from CARD14__Homo_sapiens__NP_001244899
augggcgagcucugccgccgcgacuccgcccucaccgcccucgacgaggagacccucugggagaugauggagucccaccgccaccgcaucguccgcugcaucugccccucccgccucacccccuaccuccgccaggccaagguccucugccagcucgacgaggaggagguccuccacuccccccgccucaccaacuccgccaugcgcgccggccaccuccucgaccuccucaagacccgcggcaagaacggcgccaucgccuuccucgagucccucaaguuccacaaccccgacgucuacacccucgucaccggccuccagcccgacgucgacuucuccaacuucuccggccucauggagaccuccaagcucaccgagugccucgccggcgccaucggcucccuccaggaggagcucaaccaggagaagggccagaaggagguccuccuccgccgcugccagcagcuccaggagcaccucggccucgccgagacccgcgccgagggccuccaccagcucgaggccgaccacucccgcaugaagcgcgaggucuccgcccacuuccacgagguccuccgccucaaggacgagaugcucucccucucccuccacuacuccaacgcccuccaggagaaggagcucgccgccucccgcugccgcucccuccaggaggagcucuaccuccucaagcaggagcuccagcgcgccaacauggucuccuccugcgagcucgagcuccaggagcagucccuccgcaccgccuccgaccaggaguccggcgacgaggagcucaaccgccucaaggaggagaacgagaagcuccgcucccucaccuucucccucgccgagaaggacauccucgagcagucccucgacgaggcccgcggcucccgccaggagcucgucgagcgcauccacucccuccgcgagcgcgccgucgccgccgagcgccagcgcgagcaguacugggaggagaaggagcagacccuccuccaguuccagaaguccaagauggccugccagcucuaccgcgagaaggucaacgcccuccaggcccaggucugcgagcuccagaaggagcgcgaccaggccuacuccgcccgcgacuccgcccagcgcgagaucucccagucccucgucgagaaggacucccuccgccgccaggucuucgagcucaccgaccaggucugcgagcuccgcacccagcuccgccagcuccaggccgagccccccggcguccucaagcaggaggcccgcacccgcgagcccugcccccgcgagaagcagcgccucguccgcaugcacgccaucugcccccgcgacgacuccgacugcucccucgucuccuccaccgagucccagcuccucuccgaccucuccgccaccuccucccgcgagcucgucgacuccuuccgcuccuccucccccgccccccccucccagcagucccucuacaagcgcgucgccgaggacuucggcgaggagcccugguccuucuccuccugccucgagauccccgagggcgaccccggcgcccuccccggcgccaaggccggcgacccccaccucgacuacgagcuccucgacaccgccgaccucccccagcucgaguccucccuccagcccgucucccccggccgccucgacgucuccgaguccggcguccucaugcgccgccgccccgcccgccgcauccucucccaggucaccaugcucgccuuccagggcgacgcccuccucgagcagaucuccgucaucggcggcaaccucaccggcaucuucauccaccgcgucacccccggcuccgccgccgaccagauggcccuccgccccggcacccagaucgucauggucgacuacgaggccuccgagccccucuucaaggccguccucgaggacaccacccucgaggaggccgucggccuccuccgccgcgucgacggcuucugcugccucuccgucaaggucaacaccgacggcuacaagcgccuccuccaggaccucgaggccaaggucgccaccuccggcgacuccuucuacauccgcgucaaccucgccauggagggccgcgccaagggcgagcuccagguccacugcaacgagguccuccacgucaccgacaccauguuccagggcugcggcugcuggcacgcccaccgcgucaacuccuacaccaugaaggacaccgccgcccacggcaccauccccaacuacucccgcuga

SEQ ID NO: 40760 - RNA, 594 nt, Artificial Sequence
  derived and/or modified sequence opt2 from CARD16__Homo_sapiens__NP_001017534
auggccgacaagguccucaaggagaagcgcaagcucuucauccacuccaugggcgagggcaccaucaacggccuccucgacgagcuccuccagacccgcguccucaaccaggaggagauggagaaggucaagcgcgagaacgccaccgucauggacaagacccgcgcccucaucgacuccgucauccccaagggcgcccaggccugccagaucugcaucaccuacaucugcgaggaggacuccuaccucgccgagacccucggccucuccgccgcccuccaggccguccaggacaaccccgccaugcccaccugcuccucccccgagggccgcaucaagcucugcuuccucgaggacgcccagcgcaucuggaagcagaagcuccagcgcugccacguccagaacaccaucaucaagugguccgagcgcuacaccuccggcuccuucgagaugcaguggcucuuccuccgcaccaacuucaucgagcgcuucuggcgcaacauccuccuccucccccuccacaagggcucccucuacccccgcauccccggccucggcaaggagcuccagaccggcacccacaagcucuccuga

SEQ ID NO: 40761 - RNA, 3114 nt, Artificial Sequence
  derived and/or modified sequence opt2 from CARD6__Homo_sapiens__NP_115976
auggccaccgaguccacccccuccgagaucaucgagcgcgagcgcaagaagcuccucgagauccuccagcacgaccccgacuccauccucgacacccucaccucccgccgccucaucuccgaggaggaguacgagacccucgagaacgucaccgaccuccucaagaagucccgcaagcuccucauccucguccagaagaagggcgaggccaccugccagcacuuccucaagugccucuucuccaccuucccccaguccgccgccaucugcggccuccgccacgagguccucaagcacgagaacaccguccccccccaguccaugggcgccuccuccaacuccgaggacgccuucucccccggcaucaagcagcccgaggcccccgagaucaccgucuucuucuccgagaaggagcaccucgaccucgagaccuccgaguucuuccgcgacaagaagaccuccuaccgcgagaccgcccucuccgcccgcaagaacgagaaggaguacgacacccccgaggucacccucuccuacuccgucgagaaggucggcugcgagguccccgccaccaucaccuacaucaaggacggccagcgcuacgaggagcucgacgacucccucuaccucggcaaggaggaguaccucggcuccgucgacacccccgaggacgccgaggccaccgucgaggaggaggucuacgacgaccccgagcacgucggcuacgacggcgaggaggacuucgagaacuccgagaccaccgaguucuccggcgaggagcccuccuacgagggcuccgagaccucccucucccucgaggaggagcaggagaaguccaucgaggagcgcaagaaggucuucaaggacguccuccucugccucaacauggaccgcucccgcaagguccuccccgacuucgucaagcaguucucccucgaccgcggcugcaaguggacccccgagucccccggcgaccucgccuggaacuuccucaugaagguccaggcccgcgacgucaccgcccgcgacuccauccucucccacaagguccucgacgaggacuccaaggaggaccuccucgccggcgucgagaaccucgagauccgcgacauccagaccaucaacccccucgacguccucugcgccaccaugcucugcuccgacuccucccuccagcgccaggucauguccaacauguaccagugccaguucgcccucccccuccuccuccccgacgccgagaacaacaaguccauccucaugcucggcgccaugaaggacaucgucaagaagcaguccacccaguucuccggcggccccaccgaggacaccgagaaguuccucacccucaugaagaugcccgucaucuccuucguccgccucggcuacugcuccuucuccaagucccgcauccucaacacccuccucucccccgcccagcucaagcuccacaagaucuuccuccaccaggaccucccccuccucguccucccccgccagaucuccgacggccucgucgagaucaccuggugcuuccccgacuccgacgaccgcaaggagaaccccuucuuccagaagcccgucgcccucgccaaccuccgcggcaaccucgaguccuucuggacccaguucggcuuccucauggaggucuccuccgccgucuucuucuucaccgacugccucggcgagaaggagugggaccuccucauguuccucggcgaggccgccaucgagcgcugcuacuucguccucuccucccaggcccgcgaguccgaggaggcccagaucuuccagcgcauccucaaccucaagcccgcccagcuccucuucugggagcgcggcgacgccggcgaccgccgcaagaacauggagggccuccaggccgcccuccaggaggucauguucuccuccugccuccgcugcgucuccgucgaggacauggccgcccucgcccgcgagcucggcauccaggucgacgaggacuucgagaacacccagcgcauccaggucuccuccggcgagaacauggccggcaccgccgagggcgagggccagcagcgccacucccagcucaaguccuccuccaagucccaggcccucaugcccauccaggagcccggcacccagugcgagcucucccagaaccuccagaaccucuacggcacccccgucuuccgccccguccucgagaacuccuggcucuuccccacccgcaucggcggcaacuucaaccacgucucccucaaggccuccugggucaugggccgccccuucggcuccgagcagcgccccaagugguuccacccccuccccuuccagaacgccggcgcccagggccgcggcaaguccuucggcauccaguccuuccacccccagaucuucuacuccggcgagcgcuucaugaaguucucccgcgucgcccgcggcugccacuccaacggcaccuucggccgccucccccgccccaucugccagcacguccaggccugccccgagcgcccccagaugaugggcacccucgagcgcucccgcgccgucgccuccaagaucggccacuccuacucccucgacucccagcccgcccgcgccgucggcaagcccuggccccagcaggccugcacccgcgucaccgagcucaccgaggccaccggcaagcucauccgcaccucccacaucggcaagccccacccccaguccuuccagcccgccgccgccacccagaagcuccgccccgccucccagcagggcguccagaugaagacccagggcggcgccuccaaccccgcccuccagaucggcucccaccccaugugcaaguccucccaguucaaguccgaccaguccaaccccuccaccgucaagcacucccagcccaagcccuuccacuccguccccucccagcccaaguccucccagaccaaguccugccagucccagcccucccagaccaagcccucccccugcaaguccacccagcccaagcccucccagcccuggcccccccaguccaagcccucccagccccgccccccccagcccaaguccuccuccaccaaccccucccaggccaaggcccaccacuccaaggccggccagaagcgcggcggcaagcacuga

SEQ ID NO: 40762 - RNA, 1614 nt, Artificial Sequence
  derived and/or modified sequence opt2 from CARD8__Homo_sapiens__NP_001171829
auggagaagaaggagugccccgagaaguccuccuccuccgaggaggagcucccccgccgcgacuccggcuccucccgcaacaucgacgccuccaagcucauccgccuccagggcucccgcaagcuccucgucgacaacuccauccgcgagcuccaguacaccaagaccggcaucuucuuccaggccgaggccugcgucaccaacgacaccgucuaccgcgagcuccccugcgucuccgagacccucugcgacaucucccacuucuuccaggaggacgacgagaccgaggccgagccccuccucuuccgcgccguccccgagugccagcucuccggcggcgacauccccuccgucuccgaggagcaggaguccuccgagggccaggacuccggcgacaucugcuccgaggagaaccagaucgucuccuccuacgccuccaaggucugcuucgagaucgaggaggacuacaagaaccgccaguuccucggccccgagggcaacgucgacgucgagcucaucgacaaguccaccaaccgcuacuccgucugguuccccaccgccggcugguaccucugguccgccaccggccucggcuuccucguccgcgacgaggucaccgucaccaucgccuucggcuccuggucccagcaccucgcccucgaccuccagcaccacgagcaguggcucgucggcggcccccucuucgacgucaccgccgagcccgaggaggccgucgccgagauccaccucccccacuucaucucccuccaggccggcgaggucgacgucuccugguuccucgucgcccacuucaagaacgagggcaugguccucgagcaccccgcccgcgucgagcccuucuacgccguccucgagucccccuccuucucccucaugggcauccuccuccgcaucgccuccggcacccgccucuccauccccaucaccuccaacacccucaucuacuaccacccccaccccgaggacaucaaguuccaccucuaccucguccccuccgacgcccuccucaccaaggccaucgacgacgaggaggaccgcuuccacggcguccgccuccagaccuccccccccauggagccccucaacuucggcuccuccuacaucgucuccaacuccgccaaccucaaggucaugcccaaggagcucaagcucuccuaccgcucccccggcgagauccagcacuucuccaaguucuacgccggccagaugaaggagcccauccagcucgagaucaccgagaagcgccacggcacccucgucugggacaccgaggucaagcccgucgaccuccagcucgucgccgccuccgcccccccccccuucuccggcgccgccuucgucaaggagaaccaccgccagcuccaggcccgcaugggcgaccucaagggcguccucgacgaccuccaggacaacgagguccucaccgagaacgagaaggagcucgucgagcaggagaagacccgccaguccaagaacgaggcccuccucuccauggucgagaagaagggcgaccucgcccucgacguccucuuccgcuccaucuccgagcgcgaccccuaccucgucuccuaccuccgccagcagaaccucuga

SEQ ID NO: 40763 - RNA, 1611 nt, Artificial Sequence
  derived and/or modified sequence opt2 from CARD9__Homo_sapiens__NP_434700
auguccgacuacgagaacgacgacgagugcugguccguccucgagggcuuccgcgucacccucaccuccgucaucgaccccucccgcaucacccccuaccuccgccagugcaagguccucaaccccgacgacgaggagcagguccucuccgaccccaaccucgucauccgcaagcgcaaggucggcguccuccucgacauccuccagcgcaccggccacaagggcuacgucgccuuccucgagucccucgagcucuacuacccccagcucuacaagaaggucaccggcaaggagcccgcccgcgucuucuccaugaucaucgacgccuccggcgaguccggccucacccagcuccucaugaccgaggucaugaagcuccagaagaagguccaggaccucaccgcccuccucuccuccaaggacgacuucaucaaggagcuccgcgucaaggacucccuccuccgcaagcaccaggagcgcguccagcgccucaaggaggagugcgaggccggcucccgcgagcucaagcgcugcaaggaggagaacuacgaccucgccaugcgccucgcccaccaguccgaggagaagggcgccgcccucaugcgcaaccgcgaccuccagcucgagaucgaccagcucaagcacucccucaugaaggccgaggacgacugcaaggucgagcgcaagcacacccucaagcuccgccacgccauggagcagcgccccucccaggagcuccucugggagcuccagcaggagaaggcccuccuccaggcccgcguccaggagcucgaggccuccguccaggagggcaagcucgaccgcuccucccccuacauccagguccucgaggaggacuggcgccaggcccuccgcgaccaccaggagcaggccaacaccaucuucucccuccgcaaggaccuccgccagggcgaggcccgccgccuccgcugcauggaggagaaggagauguucgagcuccagugccucgcccuccgcaaggacuccaagauguacaaggaccgcaucgaggccauccuccuccagauggaggaggucgccaucgagcgcgaccaggccaucgccacccgcgaggagcuccacgcccagcacgcccgcggccuccaggagaaggacgcccuccgcaagcagguccgcgagcucggcgagaaggccgacgagcuccagcuccaggucuuccagugcgaggcccagcuccucgccgucgagggccgccuccgccgccagcagcucgagacccucguccucuccuccgaccucgaggacggcuccccccgccgcucccaggagcucucccucccccaggaccucgaggacacccagcucuccgacaagggcugccucgccggcggcggcucccccaagcagcccuucgccgcccuccaccaggagcagguccuccgcaacccccacgacgccggccucuccuccggcgagccccccgagaaggagcgccgccgccucaaggaguccuucgagaacuaccgccgcaagcgcgcccuccgcaagaugcagaagggcuggcgccagggcgaggaggaccgcgagaacaccaccggcuccgacaacaccgacaccgagggcuccuga

SEQ ID NO: 40764 - RNA, 2178 nt, Artificial Sequence
  derived and/or modified sequence opt2 from CARF__Homo_sapiens__NP_001098056
auggagcaguccaacgacucccuccgcgucaaccacaacgacggcgaggaguccaagaccuccgcccaggucuucgagcaccucaucugcauggacucccgcgacuccuccuucggccagaacgacucccccaccguccuccccaucaccacccgcgaggccaacaacucccucaucucccagaacauccccggcccccucacccagacccagacccucuccgccgagcaguuccaccucgucgaccagaacggccaggccauccaguacgagcuccagucccucggcgaguccaacgcccagaugaugaucgucgccucccccaccgagaacggccagguccuccgcgucaucccccccacccagaccggcauggcccaggucaucaucccccagggccagcucgucgacgucaacuccccccgcgacguccccgaggagaagcccuccaaccgcaaccuccccaccguccgcgucgacacccucgccgacaacaccuccaacuacauccuccacccccagaccuccuucccccuccccaagaaguccgucaccggcaugcucgaggagccccuccucggcccccuccagccccucuccuccaacacccccaucugggccugccgccuccgcuccugcgagaagaucggcgacuccuaccgcggcuacugcgucuccgagaccgagcucgaguccguccucaccuuccacaagcagcagacccaguccgucuggggcacccgccagucccccucccccgccaagcccgccacccgccucauguggaagucccaguacguccccuacgacggcauccccuucgucaacgccggcucccgcgccgucgucauggagugccaguacggcccccgccgcaagggcuuccagcucaagaaggucuccgagcaggagucccgcuccugccagcucuacaaggccaccugccccgcccgcaucuacaucaagaagguccagaaguuccccgaguaccgcguccccaccgaccccaagaucgacaagaagaucauccgcauggagcaggagaaggccuucaacaugcucaagaagaaccucgucgacgccggcggcguccuccgcugguacguccagcuccccacccagcaggcccaccaguaccacgagcucgagacccccugccucacccucucccccucccccuuccccgucuccucccucgaggaggaggagaccgccguccgcgacgagaacugcgcccuccccucccgccuccacccccaggucgcccacaagauccaggagcucgucucccagggcaucgagcaggucuacgccguccgcaagcagcuccgcaaguucgucgagcgcgagcucuucaagcccgacgagguccccgagcgccacaaccucuccuucuuccccaccgucaacgacaucaagaaccacauccacgagguccagaagucccuccgcaacggcgacaccgucuacaacuccgagaucauccccgccacccuccaguggaccaccgacuccggcaacauccucaaggagaccaugaccgucaccuucgccgagggcaacucccccggcgaguccaucaccaccaaggucgagaccaaccagacccgcggcucccucucccccgagcccacccaccuccucuccucccucuccuccuuccagcccaagaucuucacccagcuccagggccuccagcuccagccccgcuacaccucccccgacgagucccccgccgucgucuccgucaacaaccagcccuccuccucccccuccggccuccucgacaccaucggcuccgccgucaugaacaacaacucccuccuccucggccagucccacucccuccagcgcgacaccugccucacccagaacaacuccaccgccuccaccaugggcaaccuccccgagcccgaccagaaccucgucgccauggacgagcucgucgaggucggcgacgucgaggacaccggcaaccucgagggcaccguccaccgcauccuccucggcgacguccagaccauccccauccagaucaucgacaaccacuccgcccucaucgaggagaaccccgaguccaccaucuccgucucccaggucaagcaggagcccaaggagcccgcccucuccauggaggccaagaagaccgucgacuacaagaagcucuccgccaccuga

SEQ ID NO: 40765 - RNA, 1044 nt, Artificial Sequence
  derived and/or modified sequence opt2 from CARKD__Homo_sapiens__NP_001229810
auggucacccgcgccggcgccggcaccgccgucgccggcgccgucgucgucgcccuccucuccgccgcccucgcccucuacggccccccccucgacgccguccucgagcgcgccuucucccuccgcaaggcccacuccaucaaggacauggagaacacccuccagcucguccgcaacaucauccccccccucuccuccaccaagcacaagggccaggacggccgcaucggcgucgucggcggcugccaggaguacaccggcgcccccuacuucgccgccaucuccgcccucaaggucggcgccgaccucucccacgucuucugcgccuccgccgccgcccccgucaucaaggccuacucccccgagcucaucguccaccccguccucgacucccccaacgccguccacgaggucgagaaguggcucccccgccuccacgcccucgucgucggccccggccucggccgcgacgacgcccuccuccgcaacguccagggcauccucgaggucuccaaggcccgcgacauccccgucgucaucgacgccgacggccucuggcucgucgcccagcagcccgcccucauccacggcuaccgcaaggccguccucacccccaaccacgucgaguucucccgccucuacgacgccguccuccgcggccccauggacuccgacgacucccacggcuccguccuccgccucucccaggcccucggcaacgucaccgucguccagaagggcgagcgcgacauccucuccaacggccagcagguccucgucugcucccaggagggcuccucccgccgcugcggcggccagggcgaccuccucuccggcucccucggcguccucguccacugggcccuccucgccggcccccagaagaccaacggcuccuccccccuccucgucgccgccuucggcgccugcucccucacccgccagugcaaccaccaggccuuccagaagcacggccgcuccaccaccaccuccgacaugaucgccgaggucggcgccgccuucuccaagcucuucgagaccuga

SEQ ID NO: 40766 - RNA, 1827 nt, Artificial Sequence
  derived and/or modified sequence opt2 from CARM1__Homo_sapiens__NP_954592
auggccgccgccgccgccgccgucggccccggcgccggcggcgccggcuccgccguccccggcggcgccggccccugcgccaccgucuccgucuuccccggcgcccgccuccucaccaucggcgacgccaacggcgagauccagcgccacgccgagcagcaggcccuccgccucgagguccgcgccggccccgacuccgccggcaucgcccucuacucccacgaggacgucugcgucuucaagugcuccgucucccgcgagaccgagugcucccgcgucggcaagcaguccuucaucaucacccucggcugcaacuccguccucauccaguucgccacccccaacgacuucugcuccuucuacaacauccucaagaccugccgcggccacacccucgagcgcuccgucuucuccgagcgcaccgaggaguccuccgccguccaguacuuccaguucuacggcuaccucucccagcagcagaacaugaugcaggacuacguccgcaccggcaccuaccagcgcgccauccuccagaaccacaccgacuucaaggacaagaucguccucgacgucggcugcggcuccggcauccucuccuucuucgccgcccaggccggcgcccgcaagaucuacgccgucgaggccuccaccauggcccagcacgccgagguccucgucaaguccaacaaccucaccgaccgcaucgucgucauccccggcaaggucgaggaggucucccuccccgagcaggucgacaucaucaucuccgagcccaugggcuacaugcucuucaacgagcgcaugcucgaguccuaccuccacgccaagaaguaccucaagcccuccggcaacauguuccccaccaucggcgacguccaccucgcccccuucaccgacgagcagcucuacauggagcaguucaccaaggccaacuucugguaccagcccuccuuccacggcgucgaccucuccgcccuccgcggcgccgccgucgacgaguacuuccgccagcccgucgucgacaccuucgacauccgcauccucauggccaaguccgucaaguacaccgucaacuuccucgaggccaaggagggcgaccuccaccgcaucgagauccccuucaaguuccacaugcuccacuccggccucguccacggccucgccuucugguucgacgucgccuucaucggcuccaucaugaccgucuggcucuccaccgcccccaccgagccccucacccacugguaccagguccgcugccucuuccaguccccccucuucgccaaggccggcgacacccucuccggcaccugccuccucaucgccaacaagcgccaguccuacgacaucuccaucgucgcccaggucgaccagaccggcuccaaguccuccaaccuccucgaccucaagaaccccuucuuccgcuacaccggcaccacccccucccccccccccggcucccacuacaccucccccuccgagaacauguggaacaccggcuccaccuacaaccucuccuccggcauggccgucgccggcaugcccaccgccuacgaccucuccuccgucaucgccuccggcuccuccgucggccacaacaaccucaucccccucgccaacaccggcaucgucaaccacacccacucccgcaugggcuccaucauguccaccggcaucguccagggcuccuccggcgcccagggcuccggcggcggcuccaccuccgcccacuacgccgucaacucccaguucaccaugggcggccccgccaucuccauggccucccccauguccauccccaccaacaccaugcacuacggcuccuga

SEQ ID NO: 40767 - RNA, 2496 nt, Artificial Sequence
  derived and/or modified sequence opt2 from CARS__Homo_sapiens__NP_001014437
auggccgacuccuccggccagcaggcccccgacuaccgcuccauccucuccaucuccgacgaggccgcccgcgcccaggcccucaacgagcaccucuccacccgcuccuacguccagggcuacucccucucccaggccgacgucgacgccuuccgccagcucuccgccccccccgccgacccccagcucuuccacgucgcccgcugguuccgccacaucgaggcccuccucggcucccccugcggcaagggccagcccugccgccuccaggccuccaagggccgccgcguccagccccagugguccccccccgccggcacccagcccugccgccuccaccucuacaacucccucacccgcaacaaggaggucuucaucccccaggacggcaagaaggucaccugguacugcugcggccccaccgucuacgacgccucccacaugggccacgcccgcuccuacaucuccuucgacauccuccgccgcguccucaaggacuacuucaaguucgacgucuucuacugcaugaacaucaccgacaucgacgacaagaucaucaagcgcgcccgccagaaccaccucuucgagcaguaccgcgagaagcgccccgaggccgcccagcuccucgaggacguccaggccgcccucaagcccuucuccgucaagcucaacgagaccaccgaccccgacaagaagcagaugcucgagcgcauccagcacgccguccagcucgccaccgagccccucgagaaggccguccagucccgccucaccggcgaggaggucaacuccugcgucgagguccuccucgaggaggccaaggaccuccucuccgacuggcucgacuccacccucggcugcgacgucaccgacaacuccaucuucuccaagcuccccaaguucugggagggcgacuuccaccgcgacauggaggcccucaacguccucccccccgacguccucacccgcgucuccgaguacguccccgagaucgucaacuucguccagaagaucgucgacaacggcuacggcuacgucuccaacggcuccgucuacuucgacaccgccaaguucgccuccuccgagaagcacuccuacggcaagcucguccccgaggccgucggcgaccagaaggcccuccaggagggcgagggcgaccucuccaucuccgccgaccgccucuccgagaagcgcucccccaacgacuucgcccucuggaaggccuccaagcccggcgagcccuccuggcccugccccuggggcaagggccgccccggcuggcacaucgagugcuccgccauggccggcacccuccucggcgccuccauggacauccacggcggcggcuucgaccuccgcuucccccaccacgacaacgagcucgcccaguccgaggccuacuucgagaacgacugcuggguccgcuacuuccuccacaccggccaccucaccaucgccggcugcaagauguccaagucccucaagaacuucaucaccaucaaggacgcccucaagaagcacuccgcccgccagcuccgccucgccuuccucaugcacuccuggaaggacacccucgacuacuccuccaacaccauggaguccgcccuccaguacgagaaguuccucaacgaguucuuccucaacgucaaggacauccuccgcgcccccgucgacaucaccggccaguucgagaaguggggcgaggaggaggccgagcucaacaagaacuucuacgacaagaagaccgccauccacaaggcccucugcgacaacgucgacacccgcaccgucauggaggagaugcgcgcccucgucucccagugcaaccucuacauggccgcccgcaaggccguccgcaagcgccccaaccaggcccuccucgagaacaucgcccucuaccucacccacaugcucaagaucuucggcgccgucgaggaggacuccucccucggcuuccccgucggcggccccggcaccucccucucccucgaggccaccgucaugcccuaccuccagguccucuccgaguuccgcgagggcguccgcaagaucgcccgcgagcagaagguccccgagauccuccagcucuccgacgcccuccgcgacaacauccuccccgagcucggcguccgcuucgaggaccacgagggccuccccaccgucgucaagcucgucgaccgcaacacccuccucaaggagcgcgaggagaagcgccgcgucgaggaggagaagcgcaagaagaaggaggaggccgcccgccgcaagcaggagcaggaggccgccaagcucgccaagaugaagaucccccccuccgagauguuccucuccgagaccgacaaguacuccaaguucgacgagaacggccuccccacccacgacauggagggcaaggagcucuccaagggccaggccaagaagcucaagaagcucuucgaggcccaggagaagcucuacaaggaguaccuccagauggcccagaacggcuccuuccaguga

SEQ ID NO: 40768 - RNA, 351 nt, Artificial Sequence
  derived and/or modified sequence opt2 from CARTPT__Homo_sapiens__NP_004282
auggaguccucccgcguccgccuccucccccuccucggcgccgcccuccuccucaugcucccccuccucggcacccgcgcccaggaggacgccgagcuccagccccgcgcccucgacaucuacuccgccgucgacgacgccucccacgagaaggagcucaucgaggcccuccaggagguccucaagaagcucaaguccaagcgcguccccaucuacgagaagaaguacggccagguccccaugugcgacgccggcgagcagugcgccguccgcaagggcgcccgcaucggcaagcucugcgacugcccccgcggcaccuccugcaacuccuuccuccucaagugccucuga

SEQ ID NO: 40769 - RNA, 2073 nt, Artificial Sequence
  derived and/or modified sequence opt2 from CASC1__Homo_sapiens__NP_001076441
augcgccagaccggcggcggcgccaccaccgacuccgccucccccguccucaacaacgucaucaagucccaguccuacuucaccgccaagcgcgucggccucggcaacaacuccuaccucggcgucggccgccccuccucccagcaguggcucucccuccccggccccggcggccagggccccaaggccaagaaguccggcuccaagaagaagaaggucaccaaggccgagcgccucaagcuccuccaggaggaggaggagcgccgccucaaggaggaggaggaggcccgccucaaguacgagaaggaggagauggagcgccucgagauccagcgcaucgagaaggagaaguggcaccgccucgaggccaaggaccucgagcgccgcaacgaggagcucgaggagcucuaccuccucgagcgcugcuuccccgaggccgagaagcucaagcaggagaccaagcuccucucccaguggaagcacuacauccagugcgacggcucccccgaccccuccgucgcccaggagaugaacaccuucaucucccucuggaaggagaagaccaacgagaccuucgaggaggucaucgagaaguccaaggucguccucaaccucaucgagaagcucaaguucauccuccucgagaccccccccugcgaccuccaggacaagaacaucauccaguaccaggaguccauccuccagcuccaggagcuccuccaccucaaguucggcgucgccaccgagauccuccucaagcaggccuccacccucgccgaccucgacuccggcaacauggagaaggucaucaaggacgagaacgucacccucuacgucugggccaaccucaagaagaacccccgccaccgcuccguccgcuucuccgagacccagaucggcuucgagaucccccgcauccucgccaccuccgacaucgccguccgccuccuccacacccacuacgaccacgucuccgcccuccaccccgucuccacccccuccaaggaguacaccuccgccgucaccgagcucgucaaggacgacgucaagaacgucgagaaggccaucuccaaggaggucgaggaggaguccaagcagcaggagcgcggcucccaccucauccaggaggaggagaucaaggucgaggaggagcagggcgacaucgaggucaagauguccuccgccgaggaggaguccgaggccaucaagugcgagcgcgagaugaagguccucuccgagaccgucuccgccgcccagcuccuccucgucgagaacuccuccgagaagcccgacuucuucgaggacaacgucgucgaccucugccaguucaccacccucggcggcgucuaccaccucgacauccucgagcuccccccccagugcaagcccgucaagggcuggaugaucgucgagauccucaaggagggccuccagaaguacaccuacccccccgagaccaccgaggaguucgagaccgagaacgccuucccccccaucgaggucacccucgagguccacgagaacgucaucuucuucgaggaccccgucgucguccgcugggacgccgagggcaagcacuggcgcaccgacggcaucuccaacgucuccuacaagcccaaggagcgccucgucaccuucucccucgacaccuucggccccgucacccucauccaggacgcccacaucaacaugcccuaccaguccugggagcuccgcccccucgacgucaacaagguccuccucaccgucaccaccgucuucaccgagauccagauccagaucaaggagaaccucugcaugcucuccuccaucaagcucaaggacaagaagcacaucuccauccucgagggcaccuggaugacccccauccccuucaucaucgcccucaaggaggccggccucaacaucuuccccacccgccacucccacuucuacgucaucaucaacaacaaggucccccucgucgaggucaaggccuaccgccagauggcccuccucuccuccgccuucgccuucggcugguccaaguggaaccuccucugcaacuccaccaaggucgucuucaagugguga

SEQ ID NO: 40770 - RNA, 2112 nt, Artificial Sequence
  derived and/or modified sequence opt2 from CASC3__Homo_sapiens__XP_005257220
auggccgaccgccgccgccagcgcgccucccaggacaccgaggacgaggaguccggcgccuccggcuccgacuccggcggcuccccccuccgcggcggcggcuccugcuccggcuccgccggcggcggcggcuccggcucccuccccucccagcgcggcggccgcaccggcgcccuccaccuccgccgcgucgaguccggcggcgccaaguccgccgaggaguccgagugcgaguccgaggacggcaucgagggcgacgccguccucuccgacuacgaguccgccgaggacuccgagggcgaggagggcgaguacuccgaggaggagaacuccaaggucgagcucaaguccgaggccaacgacgccgucaacuccuccaccaaggaggagaagggcgaggagaagcccgacaccaaguccaccgucaccggcgagcgccaguccggcgacggccaggaguccaccgagcccgucgagaacaaggucggcaagaagggccccaagcaccucgacgacgacgaggaccgcaagaaccccgccuacaucccccgcaagggccucuucuucgagcacgaccuccgcggccagacccaggaggaggagguccgccccaagggccgccagcgcaagcucuggaaggacgagggccgcugggagcacgacaaguuccgcgaggacgagcaggcccccaagucccgccaggagcucaucgcccucuacggcuacgacauccgcuccgcccacaaccccgacgacaucaagccccgccgcauccgcaagccccgcuacggcucccccccccagcgcgaccccaacuggaacggcgagcgccucaacaagucccaccgccaccagggccucggcggcacccuccccccccgcaccuucaucaaccgcaacgccgccggcaccggccgcauguccgccccccgcaacuacucccgcuccggcggcuucaaggagggccgcgccggcuuccgccccgucgaggccggcggccagcacggcggccgcuccggcgagaccgucaagcacgagaucuccuaccgcucccgccgccucgagcagaccuccguccgcgaccccucccccgaggccgacgcccccguccucggcucccccgagaaggaggaggccgccuccgagccccccgccgccgcccccgacgccgccccccccccccccgaccgccccaucgagaagaaguccuacucccgcgcccgccgcacccgcaccaaggucggcgacgccgucaagcucgccgaggaggucccccccccccccgagggccucauccccgccccccccguccccgagaccacccccaccccccccaccaagaccggcaccugggaggcccccgucgacuccuccaccuccggccucgagcaggacgucgcccagcucaacaucgccgagcagaacuggucccccggccagcccuccuuccuccagccccgcgagcuccgcggcaugcccaaccacauccacaugggcgccggcccccccccccaguucaaccgcauggaggagaugggcguccagggcggccgcgccaagcgcuacuccucccagcgccagcgccccguccccgagccccccgccccccccguccacaucuccaucauggagggccacuacuacgacccccuccaguuccagggccccaucuacacccacggcgacucccccgccccccuccccccccagggcaugcucguccagcccggcaugaaccucccccaccccggccuccacccccaccagacccccgccccccuccccaaccccggccucuaccccccccccgucuccaugucccccggccagccccccccccagcagcuccucgcccccaccuacuucuccgcccccggcgucaugaacuucggcaaccccuccuaccccuacgcccccggcgcccuccccccccccccccccccccaccucuaccccaacacccaggcccccucccaggucuacggcggcgucaccuacuacaaccccgcccagcagcagguccagcccaagcccucccccccccgccgcaccccccagcccgucaccaucaagccccccccccccgaggucgucucccgcggcuccuccuga

SEQ ID NO: 40771 - RNA, 1311 nt, Artificial Sequence
  derived and/or modified sequence opt2 from CASC4__Homo_sapiens__NP_612432
auggucggcuucggcgccaaccgccgcgccggccgccuccccucccucguccucgucguccuccucgucgucaucgucguccucgccuucaacuacugguccaucuccucccgccacguccuccuccaggaggaggucgccgagcuccagggccagguccagcgcaccgaggucgcccgcggccgccucgagaagcgcaacuccgaccuccuccuccucgucgacacccacaagaagcagaucgaccagaaggaggccgacuacggccgccucuccucccgccuccaggcccgcgagggccucggcaagcgcugcgaggacgacaaggucaagcuccagaacaacaucuccuaccagauggccgacauccaccaccucaaggagcagcucgccgagcuccgccaggaguuccuccgccaggaggaccagcuccaggacuaccgcaagaacaacaccuaccucgucaagcgccucgaguacgaguccuuccagugcggccagcagaugaaggagcuccgcgcccagcacgaggagaacaucaagaagcucgccgaccaguuccucgaggagcagaagcaggagacccagaagauccaguccaacgacggcaaggagcucgacaucaacaaccaggucguccccaagaacauccccaaggucgccgagaacgucgccgacaagaacgaggagcccuccuccaaccacaucccccacggcaaggagcagaucaagcgcggcggcgacgccggcaugcccggcaucgaggagaacgaccucgccaaggucgacgaccucccccccgcccuccgcaagccccccaucuccgucucccagcacgagucccaccaggccaucucccaccuccccaccggccagccccucucccccaacaugccccccgacucccacaucaaccacaacggcaaccccggcaccuccaagcagaaccccuccuccccccuccagcgccucauccccggcuccaaccucgacuccgagccccgcauccagaccgacauccucaagcaggccaccaaggaccgcgucuccgacuuccacaagcucaagcagucccgcuucuucgacgagaacgagucccccgucgacccccagcacggcuccaagcucgccgacuacaacggcgacgacggcaacgucggcgaguacgaggccgacaagcaggccgagcucgccuacaacgaggaggaggacggcgacggcggcgaggaggacguccaggacgacgaggagcgcgagcuccagauggaccccgccgacuacggcaagcagcacuucaacgacguccucuga

SEQ ID NO: 40772 - RNA, 6951 nt, Artificial Sequence
  derived and/or modified sequence opt2 from CASC5__Homo_sapiens__NP_653091
auggacggcgucuccuccgaggccaacgaggagaacgacaacaucgagcgccccguccgccgccgccacuccuccauccucaagcccccccgcuccccccuccaggaccuccgcggcggcaacgagcgcguccaggaguccaacgcccuccgcaacaagaagaacucccgccgcgucuccuucgccgacaccaucaaggucuuccagaccgagucccacaugaagaucguccgcaaguccgagauggaggagaccgagaccggcgagaaccuccuccucauccagaacaagaagcucgaggacaacuacugcgagaucaccggcaugaacacccuccucuccgcccccauccacacccagaugcagcagaaggaguucuccaucaucgagcacacccgcgagcgcaagcacgccaacgaccagaccgucaucuucuccgacgagaaccagauggaccucaccuccucccacaccgucaugaucaccaagggccuccucgacaaccccaucuccgagaaguccaccaagaucgacaccaccuccuuccucgccaaccucaagcuccacaccgaggacucccgcaugaagaaggaggucaacuucuccgucgaccagaacaccuccuccgagaacaagaucgacuucaacgacuucaucaagcgccucaagaccggcaagugcuccgccuuccccgacguccccgacaaggagaacuucgagauccccaucuacuccaaggagcccaacuccgccuccuccacccaccagaugcacgucucccucaaggaggacgagaacaacuccaacaucacccgccucuuccgcgagaaggacgacggcaugaacuucacccagugccacaccgccaacauccagacccucauccccaccuccuccgagaccaacucccgcgaguccaagggcaacgacaucaccaucuacggcaacgacuucauggaccucaccuucaaccacacccuccagauccuccccgccaccggcaacuucuccgagaucgagaaccagacccagaacgccauggacgucaccaccggcuacggcaccaaggccuccggcaacaagaccgucuucaaguccaagcagaacaccgccuuccaggaccucuccaucaacuccgccgacaagauccacaucacccgcucccacaucaugggcgccgagacccacaucgucucccagaccugcaaccaggacgcccgcauccucgccaugacccccgaguccaucuacuccaaccccuccauccagggcugcaagaccgucuucuacuccuccugcaacgacgccauggagaugaccaagugccucuccaacaugcgcgaggagaagaaccuccucaagcacgacuccaacuacgccaagauguacugcaaccccgacgccauguccucccucaccgagaagaccaucuacuccggcgaggagaacauggacaucaccaagucccacaccgucgccaucgacaaccagaucuucaagcaggaccaguccaacguccagaucgccgccgcccccacccccgagaaggagaugaugcuccagaaccucaugaccaccuccgaggacggcaagaugaacgucaacugcaacuccgucccccacgucuccaaggagcgcauccagcagucccucuccaacccccucuccaucucccucaccgaccgcaagaccgagcuccucuccggcgagaacauggaccucaccgagucccacaccuccaaccucggcucccaggucccccucgccgccuacaaccucgcccccgaguccaccuccgagucccacucccaguccaaguccuccuccgacgagugcgaggagaucaccaagucccgcaacgagcccuuccagcgcuccgacaucaucgccaagaacucccucaccgacaccuggaacaaggacaaggacuggguccucaagauccuccccuaccucgacaaggacuccccccaguccgccgacugcaaccaggagaucgccaccucccacaacaucgucuacugcggcggcguccucgacaagcagaucaccaaccgcaacaccgucuccugggagcagucccucuucuccaccaccaagccccucuucuccuccggccaguucuccaugaagaaccacgacaccgccaucuccucccacaccgucaaguccguccucggccagaacuccaagcucgccgagccccuccgcaagucccucuccaaccccacccccgacuacugccacgacaagaugaucaucugcuccgaggaggagcagaacauggaccucaccaagucccacaccgucgucaucggcuucggccccuccgagcuccaggagcucggcaagaccaaccucgagcacaccaccggccagcucaccaccaugaaccgccagaucgccgucaaggucgagaagugcggcaagucccccaucgagaaguccggcguccucaaguccaacugcaucauggacguccucgaggacgaguccguccagaagcccaaguuccccaaggagaagcagaacgucaagaucuggggccgcaaguccgucggcggccccaagaucgacaagaccaucgucuucuccgaggacgacaagaacgacauggacaucaccaaguccuacaccaucgagaucaaccaccgcccccuccucgagaagcgcgacugccaccucgucccccucgccggcaccuccgagaccauccucuacaccugccgccaggacgacauggagaucacccgcucccacaccaccgcccucgagugcaagaccgucucccccgacgagaucaccacccgccccauggacaagaccgucgucuucgucgacaaccacgucgagcucgagaugaccgagucccacaccgucuucaucgacuaccaggagaaggagcgcaccgaccgccccaacuucgagcucucccagcgcaagucccucggcacccccaccgucaucugcacccccaccgaggaguccgucuucuuccccggcaacggcgaguccgaccgccucgucgccaacgacucccagcucaccccccucgaggagugguccaacaaccgcggccccgucgaggucgccgacaacauggagcucuccaaguccgccaccugcaagaacaucaaggacguccagucccccggcuuccucaacgagccccucuccuccaagucccagcgccgcaagucccucaagcucaagaacgacaagaccaucgucuucuccgagaaccacaagaacgacauggacaucacccaguccugcauggucgagaucgacaacgaguccgcccucgaggacaaggaggacuuccaccucgccggcgccuccaagaccauccucuacuccugcggccaggacgacauggagaucacccgcucccacaccaccgcccucgagugcaagacccuccuccccaacgagaucgccauccgccccauggacaagaccguccucuucaccgacaacuacuccgaccucgaggucaccgacucccacaccgucuucaucgacugccaggccaccgagaagauccucgaggagaaccccaaguucggcaucggcaagggcaagaaccucggcgucuccuuccccaaggacaacuccugcguccaggagaucgccgagaagcaggcccucgccgucggcaacaagaucguccuccacaccgagcagaagcagcagcucuucgccgccaccaaccgcaccaccaacgagaucaucaaguuccacuccgccgccauggacgagaaggucaucggcaaggucgucgaccaggccugcacccucgagaaggcccaggucgaguccugccagcucaacaaccgcgaccgccgcaacgucgacuucaccuccucccacgccaccgccgucugcggcuccuccgacaacuacuccugccuccccaacgucaucuccugcaccgacaaccucgagggcuccgccaugcuccucugcgacaaggacgaggagaaggccaacuacugccccguccagaacgaccucgccuacgccaacgacuucgccuccgaguacuaccucgaguccgagggccagccccucuccgcccccugcccccuccucgagaaggaggaggucauccagaccuccaccaagggccagcucgacugcgucaucacccuccacaaggaccaggaccucaucaaggacccccgcaaccuccucgccaaccagacccucgucuacucccaggaccucggcgagaugaccaagcucaacuccaagcgcgucuccuucaagcuccccaaggaccagaugaaggucuacgucgacgacaucuacgucaucccccagccccacuucuccaccgaccagcccccccuccccaagaagggccaguccuccaucaacaaggaggaggucauccucuccaaggccggcaacaagucccucaacaucaucgagaacuccuccgcccccaucugcgagaacaagcccaagauccucaacuccgaggagugguucgccgccgccugcaagaaggagcucaaggagaacauccagaccaccaacuacaacaccgcccucgacuuccacuccaacuccgacgucaccaagcaggucauccagacccacgucaacgccggcgaggcccccgaccccgucaucaccuccaacguccccugcuuccacuccaucaagcccaaccucaacaaccucaacggcaagaccggcgaguuccucgccuuccagaccguccaccuccccccccuccccgagcagcuccucgagcucggcaacaaggcccacaacgacaugcacaucguccaggccaccgagauccacaacaucaacaucaucuccuccaacgccaaggacucccgcgacgaggagaacaagaagucccacaacggcgccgagaccaccucccucccccccaagaccgucuucaaggacaagguccgccgcugcucccucggcaucuuccucccccgccuccccaacaagcgcaacugcuccgucaccggcaucgacgaccucgagcagauccccgccgacaccaccgacaucaaccaccucgagacccagcccgucuccuccaaggacuccggcaucggcuccgucgccggcaagcucaaccucucccccucccaguacaucaacgaggagaaccuccccgucuaccccgacgagaucaacuccuccgacuccaucaacaucgagaccgaggagaaggcccucaucgagaccuaccagaaggagaucucccccuacgagaacaagaugggcaagaccugcaacucccagaagcgcaccuggguccaggaggaggaggacauccacaaggagaagaagauccgcaagaacgagaucaaguucuccgacaccacccaggaccgcgagaucuucgaccaccacaccgaggaggacaucgacaaguccgccaacuccguccucaucaagaaccucucccgcacccccuccuccugcuccuccucccucgacuccaucaaggccgacggcaccucccucgacuucuccaccuaccgcuccucccagauggagucccaguuccuccgcgacaccaucugcgaggagucccuccgcgagaagcuccaggacggccgcaucaccauccgcgaguucuucauccuccuccagguccacauccucauccagaagccccgccaguccaaccuccccggcaacuucaccgucaacaccccccccacccccgaggaccucaugcucucccaguacgucuaccgccccaagauccagaucuaccgcgaggacugcgaggcccgccgccagaagaucgaggagcucaagcucuccgccuccaaccaggacaagcuccucgucgacaucaacaagaaccucugggagaagaugcgccacugcuccgacaaggagcucaaggccuucggcaucuaccucaacaagaucaaguccugcuucaccaagaugaccaaggucuucacccaccagggcaaggucgcccucuacggcaagcucguccaguccgcccagaacgagcgcgagaagcuccagaucaagaucgacgagauggacaagauccucaagaagaucgacaacugccucaccgagauggagaccgagaccaagaaccucgaggacgaggagaagaacaaccccgucgaggagugggacuccgagaugcgcgccgccgagaaggagcucgagcagcucaagaccgaggaggaggagcuccagcgcaaccuccucgagcucgagguccagaaggagcagacccucgcccagaucgacuucaugcagaagcagcgcaaccgcaccgaggagcuccucgaccagcucucccucuccgagugggacgucgucgagugguccgacgaccaggccgucuucaccuucgucuacgacaccauccagcucaccaucaccuucgaggaguccgucgucggcuuccccuuccucgacaagcgcuaccgcaagaucgucgacgucaacuuccagucccuccucgacgaggaccaggccccccccuccucccuccucguccacaagcucaucuuccaguacgucgaggagaaggaguccuggaagaagaccugcaccacccagcaccagcuccccaagaugcucgaggaguucucccucgucguccaccacugccgccuccucggcgaggagaucgaguaccucaagcgcuggggccccaacuacaaccucaugaacaucgacaucaacaacaacgagcuccgccuccucuucuccuccuccgccgccuucgccaaguucgagaucacccucuuccucuccgccuacuaccccuccgucccccuccccuccaccauccagaaccacgucggcaacaccucccaggacgacaucgccaccauccucuccaaggucccccucgagaacaacuaccucaagaacgucgucaagcagaucuaccaggaccucuuccaggacugccacuucuaccacuga

SEQ ID NO: 40773 - RNA, 2394 nt, Artificial Sequence
  derived and/or modified sequence opt2 from CASD1__Homo_sapiens__NP_075051
auggccgcccucgccuacaaccucggcaagcgcgagaucaaccacuacuucuccguccgcuccgccaagguccucgcccucgucgccguccuccuccucgccgccugccaccucgccucccgccgcuaccgcggcaacgacuccugcgaguaccuccucuccuccggccgcuuccucggcgagaaggucuggcagccccacuccugcaugaugcacaaguacaagaucuccgaggccaagaacugccucgucgacaagcacaucgccuucaucggcgacucccgcauccgccagcucuucuacuccuucgucaagaucaucaacccccaguucaaggaggagggcaacaagcacgagaacauccccuucgaggacaagaccgccuccgucaaggucgacuuccucuggcaccccgaggucaacggcuccaugaagcagugcaucaaggucuggaccgaggacuccaucgccaagccccacgucaucgucgccggcgccgccaccugguccaucaagauccacaacggcuccuccgaggcccucucccaguacaagaugaacaucaccuccaucgccccccuccucgagaagcucgccaagaccuccgacgucuacuggguccuccaggaccccgucuacgaggaccuccucuccgagaaccgcaagaugaucaccaacgagaagaucgacgccuacaacgaggccgccgucuccauccucaacuccuccacccgcaacuccaaguccaacgucaagauguucuccgucuccaagcucaucgcccaggagaccaucauggagucccucgacggccuccaccuccccgaguccucccgcgagaccaccgccaugauccucaugaacgucuacugcaacaagauccucaagcccgucgacggcuccugcugccagccccgcccccccgucacccucauccagaagcucgccgccugcuucuucacccucuccaucaucggcuaccucaucuucuacaucauccaccgcaacgcccaccgcaagaacaagcccugcaccgaccucgaguccggcgaggagaagaagaacaucaucaacacccccgucuccucccucgagauccuccuccaguccuucugcaagcucggccucaucauggccuacuucuacaugugcgaccgcgccaaccucuucaugaaggagaacaaguucuacacccacuccuccuucuucauccccaucaucuacauccucguccucggcgucuucuacaacgagaacaccaaggagaccaagguccucaaccgcgagcagaccgacgaguggaagggcuggaugcagcucgucauccucaucuaccacaucuccggcgccuccaccuuccuccccgucuacaugcacauccgcguccucgucgccgccuaccucuuccagaccggcuacggccacuucuccuacuucuggaucaagggcgacuucggcaucuaccgcgucugccagguccucuuccgccucaacuuccucgucgucguccucugcaucgucauggaccgccccuaccaguucuacuacuucgucccccucgucaccgucugguucauggucaucuacgucacccucgcccucuggccccagaucauccagaagaaggccaacggcaacugcuucuggcacuucggccuccuccucaagcucggcuuccuccuccucuucaucugcuuccucgccuacucccagggcgccuucgagaagaucuucucccucuggccccucuccaagugcuucgagcucaagggcaacgucuacgaguggugguuccgcuggcgccucgaccgcuacgucgucuuccacggcaugcucuucgccuucaucuaccucgcccuccagaagcgccagauccucuccgagggcaagggcgagccccucuucuccaacaagaucuccaacuuccuccucuucaucuccgucgucuccuuccucaccuacuccaucugggccuccuccugcaagaacaaggccgagugcaacgagcuccaccccuccgucuccgucguccagauccucgccuucauccucauccgcaacauccccggcuacgcccgcuccgucuacuccuccuucuucgccugguucggcaagaucucccucgagcucuucaucugccaguaccacaucuggcucgccgccgacacccgcggcauccucguccucauccccggcaaccccaugcucaacaucaucgucuccaccuucaucuucgucugcgucgcccacgagaucucccagaucaccaacgaccucgcccagaucaucauccccaaggacaacuccucccuccucaagcgccucgccugcaucgccgccuucuucugcggccuccucauccucuccuccauccaggacaaguccaagcacuga

SEQ ID NO: 40774 - RNA, 2697 nt, Artificial Sequence
  derived and/or modified sequence opt2 from CASK__Homo_sapiens__NP_001119526
auggccgacgacgacguccucuucgaggacgucuacgagcucugcgaggucaucggcaagggccccuucuccgucguccgccgcugcaucaaccgcgagaccggccagcaguucgccgucaagaucgucgacgucgccaaguucaccuccucccccggccucuccaccgaggaccucaagcgcgaggccuccaucugccacaugcucaagcacccccacaucgucgagcuccucgagaccuacuccuccgacggcaugcucuacauggucuucgaguucauggacggcgccgaccucugcuucgagaucgucaagcgcgccgacgccggcuucgucuacuccgaggccgucgccucccacuacaugcgccagauccucgaggcccuccgcuacugccacgacaacaacaucauccaccgcgacgucaagccccacugcguccuccucgccuccaaggagaacuccgcccccgucaagcucggcggcuucggcgucgccauccagcucggcgaguccggccucgucgccggcggccgcgucggcaccccccacuucauggcccccgaggucgucaagcgcgagcccuacggcaagcccgucgacgucuggggcugcggcgucauccucuucauccuccucuccggcugccuccccuucuacggcaccaaggagcgccucuucgagggcaucaucaagggcaaguacaagaugaacccccgccaguggucccacaucuccgaguccgccaaggaccucguccgccgcaugcucaugcucgaccccgccgagcgcaucaccgucuacgaggcccucaaccaccccuggcucaaggagcgcgaccgcuacgccuacaagauccaccuccccgagaccgucgagcagcuccgcaaguucaacgcccgccgcaagcucaagggcgccguccucgccgccgucuccucccacaaguucaacuccuucuacggcgacccccccgaggagcuccccgacuucuccgaggaccccaccuccuccggccuccucgccgccgagcgcgccgucucccagguccucgacucccucgaggagauccacgcccucaccgacugcuccgagaaggaccucgacuuccuccacuccgucuuccaggaccagcaccuccacacccuccucgaccucuacgacaagaucaacaccaaguccuccccccagauccgcaacccccccuccgacgccguccagcgcgccaaggagguccucgaggagaucuccugcuaccccgagaacaacgacgccaaggagcucaagcgcauccucacccagccccacuucauggcccuccuccagacccacgacgucgucgcccacgaggucuacuccgacgaggcccuccgcgucacccccccccccaccucccccuaccucaacggcgacucccccgaguccgccaacggcgacauggacauggagaacgucacccgcguccgccucguccaguuccagaagaacaccgacgagcccaugggcaucacccucaagaugaacgagcucaaccacugcaucgucgcccgcaucaugcacggcggcaugauccaccgccagggcacccuccacgucggcgacgagauccgcgagaucaacggcaucuccgucgccaaccagaccgucgagcagcuccagaagaugcuccgcgagaugcgcggcuccaucaccuucaagaucguccccuccuaccgcacccaguccuccuccugcgaggaccuccccuccaccacccagcccaagggccgccagaucuacguccgcgcccaguucgaguacgaccccgccaaggacgaccucauccccugcaaggaggccggcauccgcuuccgcgucggcgacaucauccagaucaucuccaaggacgaccacaacugguggcagggcaagcucgagaacuccaagaacggcaccgccggccucauccccucccccgagcuccaggaguggcgcgucgccugcaucgccauggagaagaccaagcaggagcagcaggccuccugcaccugguucggcaagaagaagaagcaguacaaggacaaguaccucgccaagcacaacgccgaccucgucaccuacgaggaggucgucaagcuccccgccuucaagcgcaagacccucguccuccucggcgcccacggcgucggccgccgccacaucaagaacacccucaucaccaagcaccccgaccgcuucgccuaccccaucccccacaccacccgcccccccaagaaggacgaggagaacggcaagaacuacuacuucgucucccacgaccagaugaugcaggacaucuccaacaacgaguaccucgaguacggcucccacgaggacgccauguacggcaccaagcucgagaccauccgcaagauccacgagcagggccucaucgccauccucgacgucgagccccaggcccucaagguccuccgcaccgccgaguucgcccccuucgucgucuucaucgccgcccccaccaucacccccggccucaacgaggacgagucccuccagcgccuccagaaggaguccgacauccuccagcgcaccuacgcccacuacuucgaccucaccaucaucaacaacgagaucgacgagaccauccgccaccucgaggaggccgucgagcucgucugcaccgccccccaguggguccccgucuccugggucuacuga

SEQ ID NO: 40775 - RNA, 1368 nt, Artificial Sequence
  derived and/or modified sequence opt2 from CASP10__Homo_sapiens__NP_001193453
augaagucccagggccagcacugguacuccuccuccgacaagaacugcaaggucuccuuccgcgagaagcuccucaucaucgacuccaaccucggcguccaggacgucgagaaccucaaguuccucugcaucggccucguccccaacaagaagcucgagaaguccuccuccgccuccgacgucuucgagcaccuccucgccgaggaccuccucuccgaggaggaccccuucuuccucgccgagcuccucuacaucauccgccagaagaagcuccuccagcaccucaacugcaccaaggaggaggucgagcgccuccuccccacccgccagcgcgucucccucuuccgcaaccuccucuacgagcucuccgagggcaucgacuccgagaaccucaaggacaugaucuuccuccucaaggacucccuccccaagaccgagaugaccucccucuccuuccucgccuuccucgagaagcagggcaagaucgacgaggacaaccucaccugccucgaggaccucugcaagaccgucguccccaagcuccuccgcaacaucgagaaguacaagcgcgagaaggccauccagaucgucaccccccccgucgacaaggaggccgaguccuaccagggcgaggaggagcucgucucccagaccgacgucaagaccuuccucgaggcccucccccaggaguccuggcagaacaagcacgccggcuccaacgagauccucucccacgucuuccaguggcucggcuucaccguccacauccacaacaacgucaccaaggucgagauggagaugguccuccagaagcagaagugcaaccccgcccacgccgacggcgacugcuucgucuucugcauccucacccacggccgcuucggcgccgucuacuccuccgacgaggcccucauccccauccgcgagaucaugucccacuucaccgcccuccagugcccccgccucgccgagaagcccaagcucuucuucauccaggccugccagggcgaggagauccagcccuccgucuccaucgaggccgacgcccucaaccccgagcaggcccccaccucccuccaggacuccauccccgccgaggccgacuuccuccucggccucgccaccguccccggcuacgucuccuuccgccacgucgaggagggcuccugguacauccagucccucugcaaccaccucaagaagcucgucccccgccacgaggacauccucuccauccucaccgccgucaacgacgacgucucccgccgcgucgacaagcagggcaccaagaagcagaugccccagcccgccuucacccuccgcaagaagcucgucuuccccgucccccucgacgcccucucccucuga

SEQ ID NO: 40776 - RNA, 729 nt, Artificial Sequence
  derived and/or modified sequence opt2 from CASP14__Homo_sapiens__NP_036246
auguccaacccccgcucccucgaggaggagaaguacgacauguccggcgcccgccucgcccucauccucugcgucaccaaggcccgcgagggcuccgaggaggaccucgacgcccucgagcacauguuccgccagcuccgcuucgaguccaccaugaagcgcgaccccaccgccgagcaguuccaggaggagcucgagaaguuccagcaggccaucgacucccgcgaggaccccgucuccugcgccuucgucguccucauggcccacggccgcgagggcuuccucaagggcgaggacggcgagauggucaagcucgagaaccucuucgaggcccucaacaacaagaacugccaggcccuccgcgccaagcccaaggucuacaucauccaggccugccgcggcgagcagcgcgaccccggcgagaccgucggcggcgacgagaucgucauggucaucaaggacuccccccagaccauccccaccuacaccgacgcccuccacgucuacuccaccgucgagggcuacaucgccuaccgccacgaccagaagggcuccugcuucauccagacccucgucgacgucuucaccaagcgcaagggccacauccucgagcuccucaccgaggucacccgccgcauggccgaggccgagcucguccaggagggcaaggcccgcaagaccaaccccgagauccaguccacccuccgcaagcgccucuaccuccaguga

SEQ ID NO: 40777 - RNA, 1152 nt, Artificial Sequence
  derived and/or modified sequence opt2 from CASP1__Homo_sapiens__NP_001244048
auggccgacaagguccucaaggagaagcgcaagcucuucauccgcuccaugggcgagggcaccaucaacggccuccucgacgagcuccuccagacccgcguccucaacaaggaggagauggagaaggucaagcgcgagaacgccaccgucauggacaagacccgcgcccucaucgacuccgucauccccaagggcgcccaggccugccagaucugcaucaccuacaucugcgaggaggacuccuaccucgccggcacccucggccucuccgccgccccccaggccguccaggacaaccccgccaugcccaccuccuccggcuccgagggcaacgucaagcucugcucccucgaggaggcccagcgcaucuggaagcagaaguccgccgagaucuaccccaucauggacaaguccucccgcacccgccucgcccucaucaucugcaacgaggaguucgacuccaucccccgccgcaccggcgccgaggucgacaucaccggcaugaccaugcuccuccagaaccucggcuacuccgucgacgucaagaagaaccucaccgccuccgacaugaccaccgagcucgaggccuucgcccaccgccccgagcacaagaccuccgacuccaccuuccucgucuucaugucccacggcauccgcgagggcaucugcggcaagaagcacuccgagcagguccccgacauccuccagcucaacgccaucuucaacaugcucaacaccaagaacugccccucccucaaggacaagcccaaggucaucaucauccaggccugccgcggcgacucccccggcgucgucugguucaaggacuccgucggcgucuccggcaaccucucccuccccaccaccgaggaguucgaggacgacgccaucaagaaggcccacaucgagaaggacuucaucgccuucugcuccuccacccccgacaacgucuccuggcgccaccccaccaugggcuccgucuucaucggccgccucaucgagcacaugcaggaguacgccugcuccugcgacgucgaggagaucuuccgcaagguccgcuucuccuucgagcagcccgacggccgcgcccagaugcccaccaccgagcgcgucacccucacccgcugcuucuaccucuuccccggccacuga

SEQ ID NO: 40778 - RNA, 939 nt, Artificial Sequence
  derived and/or modified sequence opt2 from CASP2__Homo_sapiens__NP_001215
augcacccccaccaccaggagacccucaagaagaaccgcgucguccucgccaagcagcuccuccucuccgagcuccucgagcaccuccucgagaaggacaucaucacccucgagaugcgcgagcucauccaggccaaggucggcuccuucucccagaacgucgagcuccucaaccuccuccccaagcgcggcccccaggccuucgacgccuucugcgaggcccuccgcgagaccaagcagggccaccucgaggacaugcuccucaccacccucuccggccuccagcacguccuccccccccucuccugcgacuacgaccucucccuccccuuccccgucugcgaguccugcccccucuacaagaagcuccgccucuccaccgacaccgucgagcacucccucgacaacaaggacggccccgucugccuccaggucaagcccugcacccccgaguucuaccagacccacuuccagcucgccuaccgccuccagucccgcccccgcggccucgcccucguccucuccaacguccacuucaccggcgagaaggagcucgaguuccgcuccggcggcgacgucgaccacuccacccucgucacccucuucaagcuccucggcuacgacguccacguccucugcgaccagaccgcccaggagaugcaggagaagcuccagaacuucgcccagcuccccgcccaccgcgucaccgacuccugcaucgucgcccuccucucccacggcgucgagggcgccaucuacggcgucgacggcaagcuccuccagcuccaggaggucuuccagcucuucgacaacgccaacugccccucccuccagaacaagcccaagauguucuucauccaggccugccgcggcggcgccaucggcucccucggccaccuccuccucuucaccgccgccaccgccucccucgcccucuga

SEQ ID NO: 40779 - RNA, 834 nt, Artificial Sequence
  derived and/or modified sequence opt2 from CASP3__Homo_sapiens__XP_011530603
auggagaacaccgagaacuccgucgacuccaaguccaucaagaaccucgagcccaagaucauccacggcuccgaguccauggacuccggcaucucccucgacaacuccuacaagauggacuaccccgagaugggccucugcaucaucaucaacaacaagaacuuccacaaguccaccggcaugaccucccgcuccggcaccgacgucgacgccgccaaccuccgcgagaccuuccgcaaccucaaguacgagguccgcaacaagaacgaccucacccgcgaggagaucgucgagcucaugcgcgacgucuccaaggaggaccacuccaagcgcuccuccuucgucugcguccuccucucccacggcgaggagggcaucaucuucggcaccaacggccccgucgaccucaagaagaucaccaacuucuuccgcggcgaccgcugccgcucccucaccggcaagcccaagcucuucaucauccaggccugccgcggcaccgagcucgacugcggcaucgagaccgacuccggcgucgacgacgacauggccugccacaagauccccgucgaggccgacuuccucuacgccuacuccaccgcccccggcuacuacuccuggcgcaacuccaaggacggcuccugguucauccagucccucugcgccaugcucaagcaguacgccgacaagcucgaguucaugcacauccucacccgcgucaaccgcaaggucgccaccgaguucgaguccuucuccuucgacgccaccuuccacgccaagaagcagauccccugcaucgucuccaugcucaccaaggagcucuacuucuaccacuga

SEQ ID NO: 40780 - RNA, 1134 nt, Artificial Sequence
  derived and/or modified sequence opt2 from CASP4__Homo_sapiens__NP_001216
auggccgagggcaaccaccgcaagaagccccucaagguccucgagucccucggcaaggacuuccucaccggcguccucgacaaccucgucgagcagaacguccucaacuggaaggaggaggagaagaagaaguacuacgacgccaagaccgaggacaagguccgcgucauggccgacuccaugcaggagaagcagcgcauggccggccagaugcuccuccagaccuucuucaacaucgaccagaucucccccaacaagaaggcccaccccaacauggaggccggcccccccgaguccggcgaguccaccgacgcccucaagcucugcccccacgaggaguuccuccgccucugcaaggagcgcgccgaggagaucuaccccaucaaggagcgcaacaaccgcacccgccucgcccucaucaucugcaacaccgaguucgaccaccuccccccccgcaacggcgccgacuucgacaucaccggcaugaaggagcuccucgagggccucgacuacuccgucgacgucgaggagaaccucaccgcccgcgacauggaguccgcccuccgcgccuucgccacccgccccgagcacaaguccuccgacuccaccuuccucguccucaugucccacggcauccucgagggcaucugcggcaccguccacgacgagaagaagcccgacguccuccucuacgacaccaucuuccagaucuucaacaaccgcaacugccucucccucaaggacaagcccaaggucaucaucguccaggccugccgcggcgccaaccgcggcgagcucuggguccgcgacucccccgccucccucgaggucgccuccucccaguccuccgagaaccucgaggaggacgccgucuacaagacccacgucgagaaggacuucaucgccuucugcuccuccaccccccacaacgucuccuggcgcgacuccaccaugggcuccaucuucaucacccagcucaucaccugcuuccagaaguacuccuggugcugccaccucgaggaggucuuccgcaagguccagcaguccuucgagaccccccgcgccaaggcccagaugcccaccaucgagcgccucuccaugacccgcuacuucuaccucuuccccggcaacuga

SEQ ID NO: 40781 - RNA, 1131 nt, Artificial Sequence
  derived and/or modified sequence opt2 from CASP5__Homo_sapiens__NP_001129581
auggccgaggacaaccacaagaagaagaccgucaagaugcucgaguaccucggcaaggacguccuccacggcgucuucaacuaccucgccaagcacgacguccucacccucaaggaggaggagaagaagaaguacuacgacaccaagaucgaggacaaggcccucauccucgucgacucccuccgcaagaaccgcgucgcccaccagauguucacccagacccuccucaacauggaccagaagaucaccuccgucaagccccuccuccagaucgaggccggcccccccgaguccgccgaguccaccaacauccucaagcucugcccccgcgaggaguuccuccgccucugcaagaagaaccacgacgagaucuaccccaucaagaagcgcgaggaccgccgccgccucgcccucaucaucugcaacaccaaguucgaccaccuccccgcccgcaacggcgcccacuacgacaucgucggcaugaagcgccuccuccagggccucggcuacaccgucgucgacgagaagaaccucaccgcccgcgacauggaguccguccuccgcgccuucgccgcccgccccgagcacaaguccuccgacuccaccuuccucguccucaugucccacggcauccucgagggcaucugcggcaccgcccacaagaagaagaagcccgacguccuccucuacgacaccaucuuccagaucuucaacaaccgcaacugccucucccucaaggacaagcccaaggucaucaucguccaggccugccgcggcgagaagcacggcgagcucuggguccgcgacucccccgccucccucgcccucaucuccucccaguccuccgagaaccucgaggccgacuccgucugcaagauccacgaggagaaggacuucaucgccuucugcuccuccaccccccacaacgucuccuggcgcgaccgcacccgcggcuccaucuucaucaccgagcucaucaccugcuuccagaaguacuccugcugcugccaccucauggagaucuuccgcaagguccagaaguccuucgaggucccccaggccaaggcccagaugcccaccaucgagcgcgccacccucacccgcgacuucuaccucuuccccggcaacuga

SEQ ID NO: 40782 - RNA, 882 nt, Artificial Sequence
  derived and/or modified sequence opt2 from CASP6__Homo_sapiens__NP_001217
auguccuccgccuccggccuccgccgcggccaccccgccggcggcgaggagaacaugaccgagaccgacgccuucuacaagcgcgagauguucgaccccgccgagaaguacaagauggaccaccgccgccgcggcaucgcccucaucuucaaccacgagcgcuucuucuggcaccucacccuccccgagcgccgcggcaccugcgccgaccgcgacaaccucacccgccgcuucuccgaccucggcuucgaggucaagugcuucaacgaccucaaggccgaggagcuccuccucaagauccacgaggucuccaccgucucccacgccgacgccgacugcuucgucugcgucuuccucucccacggcgagggcaaccacaucuacgccuacgacgccaagaucgagauccagacccucaccggccucuucaagggcgacaagugccacucccucgucggcaagcccaagaucuucaucauccaggccugccgcggcaaccagcacgacguccccgucaucccccucgacgucgucgacaaccagaccgagaagcucgacaccaacaucaccgaggucgacgccgccuccgucuacacccuccccgccggcgccgacuuccucaugugcuacuccgucgccgagggcuacuacucccaccgcgagaccgucaacggcuccugguacauccaggaccucugcgagaugcucggcaaguacggcuccucccucgaguucaccgagcuccucacccucgucaaccgcaaggucucccagcgccgcgucgacuucugcaaggaccccuccgccaucggcaagaagcagguccccugcuucgccuccaugcucaccaagaagcuccacuucuuccccaaguccaacuga

SEQ ID NO: 40783 - RNA, 912 nt, Artificial Sequence
  derived and/or modified sequence opt2 from CASP7__Homo_sapiens__NP_001218
auggccgacgaccagggcugcaucgaggagcagggcgucgaggacuccgccaacgaggacuccgucgacgccaagcccgaccgcuccuccuucguccccucccucuucuccaagaagaagaagaacgucaccaugcgcuccaucaagaccacccgcgaccgcguccccaccuaccaguacaacaugaacuucgagaagcucggcaagugcaucaucaucaacaacaagaacuucgacaaggucaccggcaugggcguccgcaacggcaccgacaaggacgccgaggcccucuucaagugcuuccgcucccucggcuucgacgucaucgucuacaacgacugcuccugcgccaagaugcaggaccuccucaagaaggccuccgaggaggaccacaccaacgccgccugcuucgccugcauccuccucucccacggcgaggagaacgucaucuacggcaaggacggcgucacccccaucaaggaccucaccgcccacuuccgcggcgaccgcugcaagacccuccucgagaagcccaagcucuucuucauccaggccugccgcggcaccgagcucgacgacggcauccaggccgacuccggccccaucaacgacaccgacgccaacccccgcuacaagauccccgucgaggccgacuuccucuucgccuacuccaccguccccggcuacuacuccuggcgcucccccggccgcggcuccugguucguccaggcccucugcuccauccucgaggagcacggcaaggaccucgagaucaugcagauccucacccgcgucaacgaccgcgucgcccgccacuucgagucccaguccgacgacccccacuuccacgagaagaagcagauccccugcgucgucuccaugcucaccaaggagcucuacuucucccaguga

SEQ ID NO: 40784 - RNA, 5949 nt, Artificial Sequence
  derived and/or modified sequence opt2 from CASP8AP2__Homo_sapiens__NP_001131140
auggccgccgacgacgacaacggcgacggcaccucccucuucgacgucuucuccgccuccccccucaagaacaacgacgagggcucccucgacaucuacgccggccucgacuccgccgucuccgacuccgccuccaaguccugcguccccucccgcaacugccucgaccucuacgaggagauccucaccgaggagggcaccgccaaggaggccaccuacaacgaccuccaggucgaguacggcaagugccagcuccagaugaaggagcucaugaagaaguucaaggagauccagacccagaacuucucccucaucaacgagaaccagucccucaagaagaacaucuccgcccucaucaagaccgcccgcgucgagaucaaccgcaaggacgaggagaucuccaaccuccaccagcgccucuccgaguucccccacuuccgcaacaaccacaagaccgcccgcaccuucgacaccgucaagaccaaggaccucaagucccgcuccccccaccucgacgacugcuccaagaccgaccaccgcgccaaguccgacgucuccaaggacguccaccacuccaccucccuccccaaccucgagaaggagggcaagccccacuccgacaagcgcuccaccucccaccuccccaccuccgucgagaagcacugcaccaacggcgucuggucccgcucccacuaccaggucggcgagggcuccuccaacgaggacucccgccgcggccgcaaggacauccgccacucccaguucaaccgcggcaccgagcgcguccgcaaggaccucuccaccggcugcggcgacggcgagccccgcauccucgaggccucccagcgccuccagggccaccccgagaaguacggcaagggcgagcccaagaccgaguccaaguccuccaaguucaaguccaacuccgacuccgacuacaagggcgagcgcaucaacuccuccugggagaaggagacccccggcgagcgcucccacucccgcgucgacucccaguccgacaagaagcucgagcgccaguccgagcgcucccagaacaucaaccgcaaggaggucaagucccaggacaaggaggagcgcaaggucgaccagaagcccaaguccgucgucaaggaccaggaccacuggcgccgcuccgagcgcgccucccucccccacuccaagaacgagaucaccuucucccacaacuccuccaaguaccaccucgaggagcgccgcggcugggaggacugcaagcgcgacaaguccgucaacucccacuccuuccaggacggccgcugccccuccucccucuccaacucccgcacccacaagaacaucgacuccaaggaggucgacgccaugcaccagugggagaacaccccccucaaggccgagcgccaccgcaccgaggacaagcgcaagcgcgagcaggaguccaaggaggagaaccgccacauccgcaacgagaagcgcguccccaccgagcaccuccagaagaccaacaaggagaccaagaagaccaccaccgaccucaagaagcagaacgagcccaagaccgacaagggcgagguccucgacaacggcgucuccgagggcgccgacaacaaggagcucgccaugaaggccgaguccggccccaacgagaccaagaacaaggaccucaagcucuccuucaugaagaagcucaaccucacccucucccccgccaagaagcagcccgucucccaggacaaccagcacaagaucaccgacauccccaaguccuccggcgucugcgacuccgaguccuccaugcaggucaagaccgucgccuacguccccuccaucuccgagcacauccucggcgaggccgccgucuccgagcacaccaugggcgagaccaaguccacccuccucgagcccaaggucgcccuccucgccgucaccgagccccgcaucggcaucuccgagaccaacaaggaggacgagaacucccuccucguccgcuccgucgacaacaccaugcacugcgaggagcccaucugcggcaccgagaccuccuuccccucccccauggagauccagcagaccgagucccucuuccccuccaccggcaugaagcagaccaucaacaacggccgcgccgccgcccccgucgucauggacguccuccagaccgacgucucccagaacuucggccucgagcucgacaccaagcgcaacgacaacuccgacuacugcggcaucuccgagggcauggagaugaaggucgcccucuccaccaccgucuccgagaccaccgaguccauccuccagcccuccaucgaggaggccgacauccuccccaucaugcucuccgaggacaacaaccccaaguucgagcccuccgucaucgucaccccccucgucgaguccaaguccugccaccucgagcccugccuccccaaggagacccucgacuccucccuccagcagaccgagcucauggaccaccgcauggccaccggcgagaccaacuccgucuaccacgacgacgacaacuccguccucuccaucgaccucaaccaccuccgccccauccccgaggccaucuccccccucaacucccccguccgccccgucgccaagguccuccgcaacgagucccccccccagguccccgucuacaacaacucccacaaggacgucuuccuccccaacuccgcccacuccaccuccaagucccaguccgaccucaacaaggagaaccagaagcccaucuacaaguccgacaagugcaccgaggccgacaccugcaagaacuccccccucgacgagcucgaggagggcgagauccgcuccgacuccgagaccuccaagccccaggaguccuucgagaagaacuccaagcgccgcgucuccgccgacguccgcaaguccaagaccaucccccgccgcggcaaguccaccgucugccucgacaaggacucccgcaagacccacguccgcauccaccagaccaacaacaaguggaacaagcgccccgacaaguccucccgcuccuccaagaccgagaagaaggacaaggucauguccaccuccucccucgagaagaucguccccaucaucgccguccccuccuccgagcaggagaucaugcacaugcuccgcaugauccgcaagcacguccgcaagaacuacaugaaguucaaggccaaguucucccucauccaguuccaccgcaucaucgaguccgccauccucuccuucaccucccucaucaagcaccucaaccuccacaagaucuccaaguccgucaccacccuccagaagaaccucugcgacaucaucgaguccaagcucaagcaggucaagaagaacggcaucgucgaccgccucuucgagcagcagcuccccgacaugaagaagaagcucuggaaguucgucgacgaccagcucgacuaccucuucgccaagcucaagaagauccucgucugcgacuccaaguccuucggccgcgacuccgacgagggcaagcucgagaagaccuccaagcagaacgcccaguacuccaacucccagaagcgcuccgucgacaacuccaaccgcgagcuccucaaggagaagcucuccaaguccgaggaccccguccacuacaagucccucgucggcugcaagaaguccgaggagaacuaccaggaccagaacaacuccuccaucaacaccgucaagcacgacaucaagaagaacuucaacaucugcuucgacaacaucaagaacucccaguccgaggagcgcucccucgagguccacugccccuccacccccaaguccgagaagaacgagggcuccuccaucgaggacgcccagaccucccagcacgccacccucaagcccgagcgcuccuucgagauccucaccgagcagcaggccuccucccucaccuucaaccucgucuccgacgcccagaugggcgagaucuucaagucccuccuccagggcuccgaccuccucgacuccuccgucaacugcaccgagaaguccgagugggagcucaagacccccgagaagcagcuccucgagacccucaagugcgaguccauccccgccugcaccaccgaggagcucgucuccggcgucgccucccccugccccaagaugaucuccgacgacaacuggucccuccucuccuccgagaagggccccucccucuccuccggccucucccuccccguccaccccgacguccucgacgaguccugcauguucgaggucuccaccaaccucccccucuccaaggacaacgucugcuccgucgagaaguccaagcccugcgucuccuccauccuccucgaggaccucgccgucucccucaccguccccuccccccucaaguccgacggccaccucuccuuccucaagcccgacauguccuccuccuccacccccgaggaggucaucuccgcccacuucuccgaggacgcccuccucgaggaggaggacgccuccgagcaggacauccaccucgcccucgaguccgacaacuccuccuccaaguccuccugcuccuccuccuggaccucccgcuccgucgcccccggcuuccaguaccaccccaaccuccccaugcacgccgucaucauggagaaguccaacgaccacuucaucgucaagauccgccgcgccacccccuccaccuccuccggccucaagcaguccaugaugcccgacgagcuccucaccucccucccccgccacggcaaggaggccgacgagggccccgagaaggaguacaucuccugccagaacaccgucuucaaguccgucgaggagcucgagaacuccaacaagaacgucgacggcuccaaguccacccacgaggagcaguccuccaugauccagacccagguccccgacaucuacgaguuccucaaggacgccuccgacaagaugggccacuccgacgaggucgccgacgagugcuucaagcuccaccaggucugggagaccaagguccccgaguccaucgaggagcuccccuccauggaggagaucucccacuccgucggcgagcaccuccccaacaccuacgucgaccucaccaaggaccccgucaccgagaccaagaaccucggcgaguucaucgaggucaccguccuccacaucgaccagcucggcugcuccggcggcaaccucaaccaguccgcccagauccucgacaacucccuccaggccgacaccgucggcgccuucaucgaccucacccaggacgccuccuccgaggccaaguccgagggcaaccaccccgcccucgccgucgaggaccucggcugcggcgucauccaggucgacgaggacaacugcaaggaggagaaggcccaggucgccaaccgcccccucaagugcaucgucgaggagaccuacaucgaccucaccaccgagucccccuccuccugcgaggucaagaaggacgagcucaaguccgagcccggcuccaacugcgacaacuccgagcuccccggcacccuccacaacucccacaagaagcgccgcaacaucuccgaccucaaccacccccacaagaagcagcgcaaggagaccgaccucaccaacaaggagaagaccaagaagcccacccaggacuccugcgagaacaccgaggcccaccagaagaaggccuccaagaagaaggccccccccgucaccaaggaccccuccucccucaaggccacccccggcaucaaggacuccuccgccgcccucgccaccuccaccucccucuccgccaagaacgucaucaagaagaagggcgagaucaucauccucuggacccgcaacgacgaccgcgagauccuccucgagugccagaagcgcggccccuccuucaagaccuucgccuaccucgccgccaagcucgacaagaaccccaaccaggucuccgagcgcuuccagcagcucaugaagcucuucgagaaguccaagugccgcuga

SEQ ID NO: 40785 - RNA, 1617 nt, Artificial Sequence
  derived and/or modified sequence opt2 from CASP8__Homo_sapiens__NP_001073594
auggagggcggccgccgcgcccgcgucgucaucgaguccaagcgcaacuucuuccucggcgccuuccccacccccuuccccgccgagcacgucgagcucggccgccucggcgacuccgagaccgccaugguccccggcaagggcggcgccgacuacauccuccuccccuucaagaagauggacuucucccgcaaccucuacgacaucggcgagcagcucgacuccgaggaccucgccucccucaaguuccucucccucgacuacaucccccagcgcaagcaggagcccaucaaggacgcccucaugcucuuccagcgccuccaggagaagcgcaugcucgaggaguccaaccucuccuuccucaaggagcuccucuuccgcaucaaccgccucgaccuccucaucaccuaccucaacacccgcaaggaggagauggagcgcgagcuccagacccccggccgcgcccagaucuccgccuaccgcgucaugcucuaccagaucuccgaggaggucucccgcuccgagcuccgcuccuucaaguuccuccuccaggaggagaucuccaagugcaagcucgacgacgacaugaaccuccucgacaucuucaucgagauggagaagcgcgucauccucggcgagggcaagcucgacauccucaagcgcgucugcgcccagaucaacaagucccuccucaagaucaucaacgacuacgaggaguucuccaaggagcgcuccuccucccucgagggcucccccgacgaguucuccaacggcgaggagcucugcggcgucaugaccaucuccgacuccccccgcgagcaggacuccgagucccagacccucgacaaggucuaccagaugaaguccaagccccgcggcuacugccucaucaucaacaaccacaacuucgccaaggcccgcgagaagguccccaagcuccacuccauccgcgaccgcaacggcacccaccucgacgccggcgcccucaccaccaccuucgaggagcuccacuucgagaucaagccccacgacgacugcaccgucgagcagaucuacgagauccucaagaucuaccagcucauggaccacuccaacauggacugcuucaucugcugcauccucucccacggcgacaagggcaucaucuacggcaccgacggccaggaggcccccaucuacgagcucaccucccaguucaccggccucaagugccccucccucgccggcaagcccaaggucuucuucauccaggccugccagggcgacaacuaccagaagggcauccccgucgagaccgacuccgaggagcagcccuaccucgagauggaccucuccuccccccagacccgcuacauccccgacgaggccgacuuccuccucggcauggccaccgucaacaacugcgucuccuaccgcaaccccgccgagggcaccugguacauccagucccucugccagucccuccgcgagcgcugcccccgcggcgacgacauccucaccauccucaccgaggucaacuacgaggucuccaacaaggacgacaagaagaacaugggcaagcagaugccccagcccaccuucacccuccgcaagaagcucgucuuccccuccgacuga

SEQ ID NO: 40786 - RNA, 1089 nt, Artificial Sequence
  derived and/or modified sequence opt2 from CASP9__Homo_sapiens__XP_011540572
auggacgaggccgaccgccgccuccuccgccgcugccgccuccgccucgucgaggagcuccaggucgaccagcucugggacgcccuccucucccgcgagcucuuccgcccccacaugaucgaggacauccagcgcgccggcuccggcucccgccgcgaccaggcccgccagcucaucaucgaccucgagacccgcggcucccaggcccucccccucuucaucuccugccucgaggacaccggccaggacaugcucgccuccuuccuccgcaccaaccgccaggccgccaagcucuccaagcccacccucgagaaccucacccccgucguccuccgccccgagauccgcaagcccgagguccuccgccccgagaccccccgccccgucgacaucggcuccggcggcuucggcgacgucggcgcccucgagucccuccgcggcaacgccgaccucgccuacauccucuccauggagcccugcggccacugccucaucaucaacaacgucaacuucugccgcgaguccggccuccgcacccgcaccggcuccaacaucgacugcgagaagcuccgccgccgcuucuccucccuccacuucauggucgaggucaagggcgaccucaccgccaagaagaugguccucgcccuccucgagcucgcccagcaggaccacggcgcccucgacugcugcgucgucgucauccucucccacggcugccaggccucccaccuccaguuccccggcgccgucuacggcaccgacggcugccccgucuccgucgagaagaucgucaacaucuucaacggcaccuccugccccucccucggcggcaagcccaagcucuucuucauccaggccugcggcggcggcugccaggccgaccccgcccccucccacucccgccuccgcccccccugcugcgccgucucccgccacucccagacccccggcgccgacuccggcgucuccaccaagaagaccacccgcuccaacgagccccagaaccucgagaagaacauggccgucaccgaccagcgcggccccccccucgaggccggcggccuccgcgagaagcagugggacuccuga

SEQ ID NO: 40787 - RNA, 1191 nt, Artificial Sequence
  derived and/or modified sequence opt2 from CASQ1__Homo_sapiens__NP_001222
auguccgccaccgaccgcaugggcccccgcgccguccccggccuccgccucgcccuccuccuccuccucguccucggcacccccaaguccggcguccagggccaggagggccucgacuuccccgaguacgacggcgucgaccgcgucaucaacgucaacgccaagaacuacaagaacgucuucaagaaguacgagguccucgcccuccucuaccacgagccccccgaggacgacaaggccucccagcgccaguucgagauggaggagcucauccucgagcucgccgcccagguccucgaggacaagggcgucggcuucggccucgucgacuccgagaaggacgccgccgucgccaagaagcucggccucaccgaggucgacuccauguacgucuucaagggcgacgaggucaucgaguacgacggcgaguucuccgccgacaccaucgucgaguuccuccucgacguccucgaggaccccgucgagcucaucgagggcgagcgcgagcuccaggccuucgagaacaucgaggacgagaucaagcucaucggcuacuucaaguccaaggacuccgagcacuacaaggccuucgaggacgccgccgaggaguuccaccccuacauccccuucuucgccaccuucgacuccaaggucgccaagaagcucacccucaagcucaacgagaucgacuucuacgaggccuucauggaggagcccgucaccauccccgacaagcccaacuccgaggaggagaucgucaacuucgucgaggagcaccgccgcuccacccuccgcaagcucaagcccgaguccauguacgagaccugggaggacgacauggacggcauccacaucgucgccuucgccgaggaggccgaccccgacggcuucgaguuccucgagacccucaaggccgucgcccaggacaacaccgagaaccccgaccucuccaucaucuggaucgaccccgacgacuucccccuccucguccccuacugggagaagaccuucgacaucgaccucuccgccccccagaucggcgucgucaacgucaccgacgccgacuccgucuggauggagauggacgacgaggaggaccuccccuccgccgaggagcucgaggacuggcucgaggacguccucgagggcgagaucaacaccgaggacgacgacgacgacgacgacgacuga

SEQ ID NO: 40788 - RNA, 3267 nt, Artificial Sequence
  derived and/or modified sequence opt2 from CASR__Homo_sapiens__NP_001171536
auggccuucuacuccugcugcuggguccuccucgcccucaccuggcacaccuccgccuacggccccgaccagcgcgcccagaagaagggcgacaucauccucggcggccucuuccccauccacuucggcgucgccgccaaggaccaggaccucaagucccgccccgaguccgucgagugcauccgcuacaacuuccgcggcuuccgcuggcuccaggccaugaucuucgccaucgaggagaucaacuccucccccgcccuccuccccaaccucacccucggcuaccgcaucuucgacaccugcaacaccgucuccaaggcccucgaggccacccucuccuucgucgcccagaacaagaucgacucccucaaccucgacgaguucugcaacugcuccgagcacauccccuccaccaucgccgucgucggcgccaccggcuccggcgucuccaccgccgucgccaaccuccucggccucuucuacaucccccaggucuccuacgccuccuccucccgccuccucuccaacaagaaccaguucaaguccuuccuccgcaccauccccaacgacgagcaccaggccaccgccauggccgacaucaucgaguacuuccgcuggaacugggucggcaccaucgccgccgacgacgacuacggccgccccggcaucgagaaguuccgcgaggaggccgaggagcgcgacaucugcaucgacuucuccgagcucaucucccaguacuccgacgaggaggagauccagcacgucgucgaggucauccagaacuccaccgccaaggucaucgucgucuucuccuccggccccgaccucgagccccucaucaaggagaucguccgccgcaacaucaccggcaagaucuggcucgccuccgaggccugggccuccuccucccucaucgccaugccccaguacuuccacgucgucggcggcaccaucggcuucgcccucaaggccggccagauccccggcuuccgcgaguuccucaagaagguccacccccgcaaguccguccacaacggcuucgccaaggaguucugggaggagaccuucaacugccaccuccaggagggcgccaagggcccccuccccgucgacaccuuccuccgcggccacgaggaguccggcgaccgcuucuccaacuccuccaccgccuuccgcccccucugcaccggcgacgagaacaucuccuccgucgagacccccuacaucgacuacacccaccuccgcaucuccuacaacgucuaccucgccgucuacuccaucgcccacgcccuccaggacaucuacaccugccuccccggccgcggccucuucaccaacggcuccugcgccgacaucaagaaggucgaggccuggcagguccucaagcaccuccgccaccucaacuucaccaacaacaugggcgagcaggucaccuucgacgagugcggcgaccucgucggcaacuacuccaucaucaacuggcaccucucccccgaggacggcuccaucgucuucaaggaggucggcuacuacaacgucuacgccaagaagggcgagcgccucuucaucaacgaggagaagauccucugguccggcuucucccgcgagccccucaccuucguccucuccguccuccagguccccuucuccaacugcucccgcgacugccucgccggcacccgcaagggcaucaucgagggcgagcccaccugcugcuucgagugcgucgagugccccgacggcgaguacuccgacgagaccgacgccuccgccugcaacaagugccccgacgacuucugguccaacgagaaccacaccuccugcaucgccaaggagaucgaguuccucuccuggaccgagcccuucggcaucgcccucacccucuucgccguccucggcaucuuccucaccgccuucguccucggcgucuucaucaaguuccgcaacacccccaucgucaaggccaccaaccgcgagcucuccuaccuccuccucuucucccuccucugcugcuucuccuccucccucuucuucaucggcgagccccaggacuggaccugccgccuccgccagcccgccuucggcaucuccuucguccucugcaucuccugcauccucgucaagaccaaccgcguccuccucgucuucgaggccaagauccccaccuccuuccaccgcaagugguggggccucaaccuccaguuccuccucgucuuccucugcaccuucaugcagaucgucaucugcgucaucuggcucuacaccgccccccccuccuccuaccgcaaccaggagcucgaggacgagaucaucuucaucaccugccacgagggcucccucauggcccucggcuuccucaucggcuacaccugccuccucgccgccaucugcuucuucuucgccuucaagucccgcaagcuccccgagaacuucaacgaggccaaguucaucaccuucuccaugcucaucuucuucaucgucuggaucuccuucauccccgccuacgccuccaccuacggcaaguucgucuccgccgucgaggucaucgccauccucgccgccuccuucggccuccucgccugcaucuucuucaacaagaucuacaucauccucuucaagcccucccgcaacaccaucgaggagguccgcugcuccaccgccgcccacgccuucaaggucgccgcccgcgccacccuccgccgcuccaacgucucccgcaagcgcuccuccucccucggcggcuccaccggcuccacccccuccuccuccaucuccuccaaguccaacuccgaggaccccuucccccagcccgagcgccagaagcagcagcagccccucgcccucacccagcaggagcagcagcagcagccccucacccucccccagcagcagcgcucccagcagcagccccgcugcaagcagaaggucaucuucggcuccggcaccgucaccuucucccucuccuucgacgagccccagaagaacgccauggcccaccgcaacuccacccaccagaacucccucgaggcccagaaguccuccgacacccucacccgccaccagccccuccucccccuccagugcggcgagaccgaccucgaccucaccguccaggagaccggccuccagggccccgucggcggcgaccagcgccccgaggucgaggaccccgaggagcucucccccgcccucgucgucuccuccucccaguccuucgucaucuccggcggcggcuccaccgucaccgagaacgucgucaacuccuga

SEQ ID NO: 40789 - RNA, 1050 nt, Artificial Sequence
  derived and/or modified sequence opt2 from CASS4__Homo_sapiens__NP_001157587
augaagggcaccggcaucauggacugcgcccccaaggcccuccucgcccgcgcccucuacgacaacugccccgacugcuccgacgagcucgccuucucccgcggcgacauccucaccauccucgagcagcacguccccgaguccgagggcugguggaagugccuccuccacggccgccagggccucgcccccgccaaccgccuccagauccucaccgaggucgccgccgaccgccccugcccccccuuccuccgcggccucgaggaggcccccgccuccuccgaggagaccuaccagguccccacccucccccgcccccccacccccggccccgucuacgagcagaugcgcuccugggccgagggcccccagccccccaccgcccaggucuacgaguuccccgacccccccaccuccgcccgcaucaucugcgagaagacccucuccuuccccaagcaggccauccucacccucccccgccccguccgcgccucccuccccacccuccccucccaggucuacgacguccccacccagcaccgcggccccgucguccucaaggagcccgagaagcagcagcucuacgacauccccgccucccccaagaaggccggccuccacccccccgacucccaggccuccaaccccggcccccucaucccccagcccuccucccagcagacccccgagcgcaagccccgccucuccgagcacugccgccucuacuucggcgcccucuucaaggccaucuccgccuuccacggcucccucuccuccucccagcccgccgagaucaucacccaguccaagcucgucaucauggucggccagaagcucgucgacacccucugcauggagacccaggagcgcgacguccgcaacgagauccuccgcggcuccucccaccucugcucccuccucaaggacgucgcccucgccaccaagaacgccguccucaccuaccccucccccgccgcccucggccaccuccaggccgaggccgagaagcucgagcagcacacccgccaguuccgcggcacccucggcuga

SEQ ID NO: 40790 - RNA, 2253 nt, Artificial Sequence
  derived and/or modified sequence opt2 from CAST__Homo_sapiens__NP_001035905
augucccagcccggccagaagcccgccgccuccccccgcccccgccgcgccgccgccgcccgccgcacccacgagcacgucuccgagaagaccuccgagucccccuccaagcccggcgagaagaagggcuccgacgagaagaaggccgccucccucggcuccucccaguccucccgcaccuacgccggcggcaccgccuccgccaccaaggucuccgccuccuccggcgccaccuccaaguccuccuccaugaaccccaccgagaccaaggccgucaagaccgagcccgagaagaagucccaguccaccaagcccaagucccuccccaagcaggccuccgacaccggcuccaacgacgcccacaacaagaaggccgucucccgcuccgccgagcagcagcccuccgagaaguccaccgagcccaagaccaagccccaggacaugaucuccgccggcggcgaguccgucgccggcaucaccgccaucuccggcaagcccggcgacaagaagaaggagaagaagucccucacccccgccguccccgucgaguccaagcccgacaagcccuccggcaaguccggcauggacgccgcccucgacgaccucaucgacacccucggcggccccgaggagaccgaggaggagaacaccaccuacaccggccccgaggucuccgaccccauguccuccaccuacaucgaggagcucggcaagcgcgaggucaccaucccccccaaguaccgcgagcuccucgccaagaaggagggcaucaccggcccccccgccgacuccuccaagcccaucggccccgacgacgccaucgacgcccucuccuccgacuucaccugcggcucccccaccgccgccggcaagaagaccgagaaggaggaguccaccgagguccucaaggcccaguccgccggcaccguccgcuccgccgcccccccccaggagaagaagcgcaaggucgagaaggacaccauguccgaccaggcccucgaggcccucuccgccucccucggcacccgccaggccgagcccgagcucgaccuccgcuccaucaaggaggucgacgaggccaaggccaaggaggagaagcucgagaagugcggcgaggacgacgagaccauccccuccgaguaccgccucaagcccgccaccgacaaggacggcaagccccuccuccccgagcccgaggagaagcccaagccccgcuccgaguccgagcucaucgacgagcucuccgaggacuucgaccgcuccgagugcaaggagaagcccuccaagcccaccgagaagaccgaggaguccaaggccgccgcccccgcccccgucuccgaggccgucugccgcaccuccaugugcuccauccaguccgccccccccgagcccgccacccucaagggcaccguccccgacgacgccgucgaggcccucgccgacucccucggcaagaaggaggccgaccccgaggacggcaagcccgucauggacaaggucaaggagaaggccaaggaggaggaccgcgagaagcucggcgagaaggaggagaccaucccccccgacuaccgccucgaggaggucaaggacaaggacggcaagccccuccuccccaaggaguccaaggagcagcucccccccauguccgaggacuuccuccucgacgcccucuccgaggacuucuccggcccccagaacgccuccucccucaaguucgaggacgccaagcucgccgccgccaucuccgaggucgucucccagacccccgccuccaccacccaggccggcgcccccccccgcgacaccucccaguccgacaaggaccucgacgacgcccucgacaagcucuccgacucccucggccagcgccagcccgaccccgacgagaacaagcccauggaggacaaggucaaggagaaggccaaggccgagcaccgcgacaagcucggcgagcgcgacgacaccaucccccccgaguaccgccaccuccucgacgacaacggccaggacaagcccgucaagccccccaccaagaaguccgaggacuccaagaagcccgccgacgaccaggaccccaucgacgcccucuccggcgaccucgacuccugccccuccaccaccgagaccucccagaacaccgccaaggacaagugcaagaaggccgccuccuccuccaaggcccccaagaacggcggcaaggccaaggacuccgccaagaccaccgaggagaccuccaagcccaaggacgacuga

SEQ ID NO: 40791 - RNA, 3573 nt, Artificial Sequence
  derived and/or modified sequence opt2 from CASZ1__Homo_sapiens__XP_011539937
augaaggucgacuaccucuccgaguucggcuuccgccucuccgacuacgaguucggcaccaaggagaagcgcauggaccucggcaccgccgagggcacccgcugcaccgacccccccgccggcaagcccgccauggcccccaagcgcaagggcggccucaagcucaacgccaucugcgccaagcucucccgccaggucgucgucgagaagcgcgccgacgccggcucccacaccgagggcucccccucccagccccgcgaccaggagcgcuccggccccgaguccggcgccgcccgcgccccccgcuccgaggaggacaagcgccgcgccgucaucgagaagugggucaacggcgaguacuccgaggagcccgcccccacccccguccucggccgcaucgcccgcgagggccucgagcucccccccgagggcgucuacaugguccagccccagggcugcuccgacgaggaggaccacgccgaggagcccuccaaggacggcggcgcccucgaggagaaggacuccgacggcgccgccuccaaggaggacuccggccccuccacccgccaggccuccggcgaggccuccucccuccgcgacuacgccgccuccaccaugaccgaguuccucggcauguucggcuacgacgaccagaacacccgcgacgagcucgcccgcaagaucuccuucgagaagcuccacgccggcuccacccccgaggccgccaccuccuccaugcuccccaccuccgaggacacccucuccaagcgcgcccgcuucuccaaguacgaggaguacauccgcaagcucaaggccggcgagcagcucuccuggcccgcccccuccaccaagaccgaggagcgcgucggcaaggaggucgucggcacccuccccggccuccgccuccccuccuccaccgcccaccucgagaccaaggccaccauccucccccuccccucccacuccuccguccagaugcagaaccucgucgcccgcgccuccaaguacgacuucuucauccagaagcucaagaccggcgagaaccuccgcccccagaacggcuccaccuacaagaagcccuccaaguacgaccucgagaacgucaaguaccuccaccucuucaagcccggcgagggcucccccgacaugggcggcgccaucgccuucaagaccggcaaggucggccgccccuccaaguacgacguccgcggcauccagaagcccggccccgccaaggucccccccacccccucccucgcccccgccccccucgccuccguccccuccgcccccuccgcccccggccccggccccgagccccccgccucccucuccuucaacacccccgaguaccucaaguccaccuucuccaagaccgacuccaucaccaccggcaccgucuccaccgucaagaacggccuccccaccgacaagcccgccgucaccgaggacgucaacaucuaccagaaguacaucgcccgcuucuccggcucccagcacugcggccacauccacugcgccuaccaguaccgcgagcacuaccacugccucgaccccgagugcaacuaccagcgcuucaccuccaagcaggacgucauccgccacuacaacaugcacaagaagcgcgacaacucccuccagcacggcuucaugcgcuucuccccccucgacgacugcuccgucuacuaccacggcugccaccucaacggcaaguccacccacuaccacugcaugcaggucggcugcaacaaggucuacaccuccaccuccgacgucaugacccacgagaacuuccacaagaagaacacccagcucaucaacgacggcuuccagcgcuuccgcgccaccgaggacugcggcaccgccgacugccaguucuacggccagaagaccacccacuuccacugccgccgccccggcugcaccuucaccuucaagaacaagugcgacaucgagaagcacaaguccuaccacaucaaggacgacgccuacgccaaggacggcuucaagaaguucuacaaguacgaggagugcaaguacgagggcugcgucuacuccaaggccaccaaccacuuccacugcauccgcgccggcugcggcuucaccuucaccuccaccucccagaugaccucccacaagcgcaagcacgagcgccgccacauccgcuccuccggcgcccucggccucccccccucccuccucggcgccaaggacaccgagcacgaggaguccuccaacgacgaccucgucgacuucuccgcccucuccuccaagaacuccucccucuccgccucccccaccucccagcaguccuccgccucccucgccgccgccaccgccgccaccgaggccggccccuccgccaccaagccccccaacuccaagaucuccggccuccucccccagggccuccccggcuccaucccccucgcccucgcccucuccaacuccggccuccccacccccacccccuacuuccccauccucgccggccgcggcuccaccucccuccccgucggcacccccucccuccucggcgccgucuccuccggcuccgccgccuccgccacccccgacacccccacccucgucgccuccggcgccggcgacuccgcccccgucgccgccgccuccguccccgccccccccgccuccaucauggagcgcaucuccgccuccaagggccucaucucccccaugauggcccgccucgccgccgccgcccucaagcccuccgccaccuucgaccccggcuccggccagcaggucacccccgcccgcuucccccccgcccaggucaagcccgagcccggcgaguccaccggcgcccccggcccccacgaggccucccaggaccgcucccucgaccucaccgucaaggagcccuccaacgaguccaacggccacgccguccccgccaacuccucccuccucuccucccucaugaacaagaugucccagggcaaccccggccucggcucccuccucaacaucaaggccgaggccgagggcucccccgccgccgagcccucccccuuccucggcaaggccgucaaggcccucguccaggagaagcucgccgagcccuggaaggucuaccuccgccgcuucggcaccaaggacuucugcgacggccagugcgacuuccuccacaaggcccacuuccacugcgucgucgaggagugcggcgcccucuucuccacccucgacggcgccaucaagcacgccaacuuccacuuccgcaccgagggcggcgccgccaagggcaacaccgaggccgccuuccccgccuccgccgccgagaccaagccccccauggcccccuccuccccccccgucccccccgucaccaccgccaccgucuccucccucgagggccccgcccccucccccgccuccguccccuccacccccacccuccucgccuggaagcagcucgccuccaccaucccccagaugccccagauccccgccuccgucccccaccuccccgccuccccccucgccaccaccucccucgagaacgccaagccccaggucaagcccggcuuccuccaguuccaggagaaguga

SEQ ID NO: 40792 - RNA, 1584 nt, Artificial Sequence
  derived and/or modified sequence opt2 from CAT__Homo_sapiens__NP_001743
auggccgacucccgcgaccccgccuccgaccagaugcagcacuggaaggagcagcgcgccgcccagaaggccgacguccucaccaccggcgccggcaaccccgucggcgacaagcucaacgucaucaccgucggcccccgcggcccccuccucguccaggacgucgucuucaccgacgagauggcccacuucgaccgcgagcgcauccccgagcgcgucguccacgccaagggcgccggcgccuucggcuacuucgaggucacccacgacaucaccaaguacuccaaggccaaggucuucgagcacaucggcaagaagacccccaucgccguccgcuucuccaccgucgccggcgaguccggcuccgccgacaccguccgcgacccccgcggcuucgccgucaaguucuacaccgaggacggcaacugggaccucgucggcaacaacacccccaucuucuucauccgcgaccccauccucuuccccuccuucauccacucccagaagcgcaacccccagacccaccucaaggaccccgacauggucugggacuucuggucccuccgccccgagucccuccaccaggucuccuuccucuucuccgaccgcggcauccccgacggccaccgccacaugaacggcuacggcucccacaccuucaagcucgucaacgccaacggcgaggccgucuacugcaaguuccacuacaagaccgaccagggcaucaagaaccucuccgucgaggacgccgcccgccucucccaggaggaccccgacuacggcauccgcgaccucuucaacgccaucgccaccggcaaguaccccuccuggaccuucuacauccaggucaugaccuucaaccaggccgagaccuuccccuucaaccccuucgaccucaccaaggucuggccccacaaggacuacccccucauccccgucggcaagcucguccucaaccgcaaccccgucaacuacuucgccgaggucgagcagaucgccuucgaccccuccaacaugccccccggcaucgaggccucccccgacaagaugcuccagggccgccucuucgccuaccccgacacccaccgccaccgccucggccccaacuaccuccacauccccgucaacugccccuaccgcgcccgcgucgccaacuaccagcgcgacggccccaugugcaugcaggacaaccagggcggcgcccccaacuacuaccccaacuccuucggcgcccccgagcagcagcccuccgcccucgagcacuccauccaguacuccggcgagguccgccgcuucaacaccgccaacgacgacaacgucacccagguccgcgccuucuacgucaacguccucaacgaggagcagcgcaagcgccucugcgagaacaucgccggccaccucaaggacgcccagaucuucauccagaagaaggccgucaagaacuucaccgagguccaccccgacuacggcucccacauccaggcccuccucgacaaguacaacgccgagaagcccaagaacgccauccacaccuucguccaguccggcucccaccucgccgcccgcgagaaggccaaccucuga

SEQ ID NO: 40793 - RNA, 2343 nt, Artificial Sequence
  derived and/or modified sequence opt2 from CATSPER1__Homo_sapiens__NP_444282
auggaccagaacuccguccccgagaaggcccagaacgaggccgacaccaacaacgccgaccgcuucuuccgcucccacuccucccccccccaccaccgccccggccacucccgcgcccuccaccacuacgagcuccaccaccacggcgucccccaccagcgcggcgagucccaccacccccccgaguuccaggacuuccacgaccaggcccucuccucccacguccaccagucccaccaccacuccgaggcccgcaaccacggccgcgcccacggccccaccggcuucggccucgcccccucccagggcgccguccccucccaccgcuccuacggcgaggacuaccacgacgagcuccagcgcgacggccgccgccaccacgacggcucccaguacggcggcuuccaccagcaguccgacucccacuaccaccgcggcucccaccacggccgcccccaguaccucggcgagaaccucucccacuacuccuccggcgucccccaccacggcgaggccucccaccacggcggcuccuaccucccccacggccccaaccccuacuccgaguccuuccaccacuccgaggccucccaccucuccggccuccagcacgacgagucccagcaccaccaggucccccaccgcggcuggccccaccaccaccagguccaccaccacggccgcucccgccaccacgaggcccaccagcacggcaaguccccccaccacggcgagaccaucuccccccacuccuccgucggcuccuaccagcgcggcaucuccgacuaccacuccgaguaccaccagggcgaccaccaccccuccgaguaccaccacggcgaccacccccaccacacccagcaccacuaccaccagacccaccgccaccgcgacuaccaccagcaccaggaccaccacggcgccuaccacuccuccuaccuccacggcgacuacguccaguccaccucccagcucuccaucccccacaccucccgcucccucauccacgacgcccccggccccgccgccucccgcaccggcgucuuccccuaccacgucgcccacccccgcggcuccgcccacuccaugacccgcuccuccuccaccauccgcucccgcgucacccagauguccaagaagguccacacccaggacaucuccaccaagcacuccgaggacuggggcaaggaggagggccaguuccagaagcgcaagaccggccgccuccagcgcacccgcaagaagggccacuccaccaaccucuuccaguggcucugggagaagcucaccuuccucauccagggcuuccgcgagaugauccgcaaccucacccagucccucgccuucgagaccuucaucuucuucgucgucugccucaacaccgucaugcucgucgcccagaccuucgccgaggucgagauccgcggcgagugguacuucauggcccucgacuccaucuucuucugcaucuacgucgucgaggcccuccucaagaucaucgcccucggccucuccuacuucuucgacuucuggaacaaccucgacuucuucaucauggccauggccguccucgacuuccuccucaugcagacccacuccuucgccaucuaccaccagucccucuuccgcauccucaaggucuucaagucccuccgcgcccuccgcgccauccgcguccuccgccgccucuccuuccucaccuccguccaggaggucaccggcacccucggccagucccuccccuccaucgccgccauccucauccucauguucaccugccucuuccucuucuccgccguccuccgcgcccucuuccgcaaguccgaccccaagcgcuuccagaacaucuucaccaccaucuucacccucuucacccuccucacccucgacgacuggucccucaucuacauggacucccgcgcccagggcgccugguacaucauccccauccucgucaucuacaucaucauccaguacuucaucuuccucaaccucgucaucaccguccucgucgacuccuuccagaccgcccucuucaagggccucgagaaggccaagcaggagcgcgccgcccgcauccaggagaagcuccucgaggacucccucaccgagcuccgcgccgccgagcccaaggaggucgccuccgagggcaccaugcucaagcgccucaucgagaagaaguucggcaccaugaccgagaagcagcaggagcuccucuuccacuaccuccagcucgucgccuccgucgagcaggagcagcagaaguuccgcucccaggccgccgucaucgacgagaucgucgacaccaccuucgaggccggcgaggaggacuuccgcaacuga

SEQ ID NO: 40794 - RNA, 1587 nt, Artificial Sequence
  derived and/or modified sequence opt2 from CATSPER2__Homo_sapiens__NP_001269238
auggccgccuaccagcaggaggagcagaugcagcucccccgcgccgacgccauccgcucccgccucaucgacaccuucucccucaucgagcaccuccagggccucucccaggccgucccccgccacaccauccgcgagcuccucgaccccucccgccagaagaagcucguccucggcgaccagcaccagcucguccgcuucuccaucaagccccagcgcaucgagcagaucucccacgcccagcgccuccucucccgccuccacguccgcugcucccagcgccccccccucucccucugggccggcuggguccucgagugcccccucuucaagaacuucaucaucuuccucgucuuccucaacaccaucauccucauggucgagaucgagcuccucgaguccaccaacaccaagcucuggccccucaagcucacccucgaggucgccgccugguucauccuccucaucuucauccucgagauccuccucaaguggcucuccaacuucuccgucuucuggaaguccgccuggaacgucuucgacuucgucgucaccaugcucucccuccuccccgaggucgucguccucgucggcgucaccggccaguccgucuggcuccagcuccuccgcaucugccgcguccuccgcucccucaagcuccucgcccaguuccgccagauccagaucaucauccucguccucguccgcgcccucaaguccaugaccuuccuccucaugcuccuccucaucuucuucuacaucuucgccgucaccggcgucuacgucuucuccgaguacacccgcuccccccgccaggaccucgaguaccacgucuucuucuccgaccuccccaacucccucgucaccgucuucauccucuucacccucgaccacugguacgcccuccuccaggacgucuggaagguccccgaggucucccgcaucuucuccuccaucuacuucauccucuggcuccuccucggcuccaucaucuuccgcuccaucaucgucgccaugauggucaccaacuuccagaacauccgcaaggagcucaacgaggagauggcccgccgcgagguccagcucaaggccgacauguucaagcgccagaucauccagcgccgcaagaacaugucccacgaggcccucaccuccucccacuccaagaucgaggaccgcggcgccucccagcagcgcgagucccucgaccucuccgaggucuccgaggucgaguccaacuacggcgccaccgaggaggaccucaucaccuccgccuccaagaccgaggagacccucuccaagaagcgcgaguaccaguccuccuccugcgucuccuccaccuccuccuccuacuccuccuccuccgagucccgcuucuccgaguccaucggccgccucgacugggagacccucguccacgagaaccuccccggccucauggagauggaccaggacgaccgcgucuggccccgcgacucccucuuccgcuacuucgagcuccucgagaagcuccaguacaaccucgaggagcgcaagaagcuccaggaguucgccguccaggcccucaugaaccucgaggacaaguga

SEQ ID NO: 40795 - RNA, 444 nt, Artificial Sequence
  derived and/or modified sequence opt2 from CAV1__Homo_sapiens__NP_001166366
auggccgacgagcucuccgagaagcaggucuacgacgcccacaccaaggagaucgaccucgucaaccgcgaccccaagcaccucaacgacgacgucgucaagaucgacuucgaggacgucaucgccgagcccgagggcacccacuccuucgacggcaucuggaaggccuccuucaccaccuucaccgucaccaaguacugguucuaccgccuccucuccgcccucuucggcauccccauggcccucaucuggggcaucuacuucgccauccucuccuuccuccacaucugggccgucguccccugcaucaaguccuuccucaucgagauccagugcaucucccgcgucuacuccaucuacguccacaccgucugcgacccccucuucgaggccgucggcaagaucuucuccaacguccgcaucaaccuccagaaggagaucuga

SEQ ID NO: 40796 - RNA, 489 nt, Artificial Sequence
  derived and/or modified sequence opt2 from CAV2__Homo_sapiens__NP_001224
augggccucgagaccgagaaggccgacguccagcucuucauggacgacgacuccuacucccaccacuccggccucgaguacgccgaccccgagaaguucgccgacuccgaccaggaccgcgacccccaccgccucaacucccaccucaagcucggcuucgaggacgucaucgccgagcccgucaccacccacuccuucgacaaggucuggaucugcucccacgcccucuucgagaucuccaaguacgucauguacaaguuccucaccgucuuccucgccaucccccucgccuucaucgccggcauccucuucgccacccucuccugccuccacaucuggauccucaugcccuucgucaagaccugccucaugguccuccccuccguccagaccaucuggaaguccgucaccgacgucaucaucgccccccucugcaccuccgucggccgcugcuucuccuccgucucccuccagcucucccaggacuga

SEQ ID NO: 40797 - RNA, 456 nt, Artificial Sequence
  derived and/or modified sequence opt2 from CAV3__Homo_sapiens__NP_001225
augauggccgaggagcacaccgaccucgaggcccagaucgucaaggacauccacugcaaggagaucgaccucgucaaccgcgaccccaagaacaucaacgaggacaucgucaaggucgacuucgaggacgucaucgccgagcccgucggcaccuacuccuucgacggcgucuggaaggucuccuacaccaccuucaccgucuccaaguacuggugcuaccgccuccucuccacccuccucggcgucccccucgcccuccucuggggcuuccucuucgccugcaucuccuucugccacaucugggccgucguccccugcaucaaguccuaccucaucgagauccagugcaucucccacaucuacucccucugcauccgcaccuucugcaacccccucuucgccgcccucggccaggucugcuccuccaucaaggucguccuccgcaaggaggucuga

SEQ ID NO: 40798 - RNA, 1788 nt, Artificial Sequence
  derived and/or modified sequence opt2 from CBFA2T2__Homo_sapiens__NP_001028171
auggucggcguccccggcgccgccgccuuccagcucggccccgagaagcgcguccccgccaugcccggcucccccgucgaggucaagauccagucccgcuccuccccccccaccaugcccccccucccccccaucaaccccggcggcccccgccccgucuccuucacccccaccgcccucuccaacggcaucaaccacuccccccccacccucaacggcgcccccucccccccccagcgcuucuccaacggccccgccuccuccaccuccuccgcccucaccaaccagcagcuccccgccaccugcggcgcccgccagcucuccaagcucaagcgcuuccucaccacccuccagcaguucggcaacgacaucucccccgagaucggcgagaagguccgcacccucguccucgcccucgucaacuccaccgucaccaucgaggaguuccacugcaagcuccaggaggccaccaacuucccccuccgccccuucgucauccccuuccucaaggccaaccucccccuccuccagcgcgagcuccuccacugcgcccgcgccgccaagcagacccccucccaguaccucgcccagcacgagcaccuccuccucaacaccuccaucgccucccccgccgacuccuccgagcuccucauggagguccacggcaacggcaagcgccccucccccgagcgccgcgaggagaacuccuucgaccgcgacaccaucgcccccgagccccccgccaagcgcgucugcaccaucucccccgccccccgccacucccccgcccucaccgucccccucaugaaccccggcggccaguuccaccccaccccccccccccuccagcacuacacccucgaggacaucgccaccucccaccucuaccgcgagcccaacaagaugcucgagcaccgcgagguccgcgaccgccaccacucccucggccucaacggcggcuaccaggacgagcucgucgaccaccgccucaccgagcgcgagugggccgacgaguggaagcaccucgaccacgcccucaacugcaucauggagauggucgagaagacccgccgcuccauggccguccuccgccgcugccaggaguccgaccgcgaggagcucaacuacuggaagcgccgcuacaacgagaacaccgagcuccgcaagaccggcaccgagcucgucucccgccagcacucccccggcuccgccgacucccucuccaacgacucccagcgcgaguucaacucccgccccggcaccggcuacguccccgucgaguucuggaagaagaccgaggaggccgucaacaaggucaagauccaggccauguccgagguccagaaggccgucgccgaggccgagcagaaggccuucgaggucaucgccaccgagcgcgcccgcauggagcagaccaucgccgacgucaagcgccaggccgccgaggacgccuuccucgucaucaacgagcaggaggaguccaccgagaacugcuggaacugcggccgcaaggccuccgagaccugcuccggcugcaacaucgcccgcuacugcggcuccuucugccagcacaaggacugggagcgccaccaccgccucugcggccagaaccuccacggccaguccccccacggccagggccgcccccuccuccccgucggccgcggcuccuccgcccgcuccgccgacugcuccguccccucccccgcccucgacaagaccuccgccaccaccucccgcuccuccacccccgccuccgucaccgccaucgacaccaacggccucuga

SEQ ID NO: 40799 - RNA, 1962 nt, Artificial Sequence
  derived and/or modified sequence opt2 from CBFA2T3__Homo_sapiens__NP_005178
augcccgccucccgccuccgcgaccgcgccgccuccuccgccuccggcuccaccugcggcuccaugucccagacccaccccguccucgaguccggccuccucgccuccgccggcugcuccgccccccgcggcccccgcaagggcggccccgcccccgucgaccgcaaggccaaggccuccgccaugcccgacucccccgccgaggucaagacccagccccgcuccaccccccccuccaugcccccccccccccccgccgccucccagggcgccacccgcccccccuccuucaccccccacacccaccgcgaggacggccccgccacccucccccacggccgcuuccacggcugccucaagugguccauggucugccuccucaugaacggcuccucccacucccccaccgccaucaacggcgcccccugcacccccaacggcuucuccaacggccccgccaccuccuccaccgccucccucuccacccagcaccucccccccgccugcggcgcccgccagcucuccaagcucaagcgcuuccucaccacccuccagcaguucggcuccgacaucucccccgagaucggcgagcgcguccgcacccucguccucggccucgucaacuccacccucaccaucgaggaguuccacuccaagcuccaggaggccaccaacuucccccuccgccccuucgucauccccuuccucaaggccaaccucccccuccuccagcgcgagcuccuccacugcgcccgccucgccaagcagacccccgcccaguaccucgcccagcacgagcagcuccuccucgacgccuccgccuccucccccaucgacuccuccgagcuccuccucgaggucaacgagaacggcaagcgccgcacccccgaccgcaccaaggagaacggcuccgaccgcgacccccuccaccccgagcaccucuccaagcgccccugcacccucaaccccgcccagcgcuacucccccuccaacggccccccccagcccaccccccccccccacuaccgccucgaggacaucgccauggcccaccacuuccgcgacgccuaccgccaccccgacccccgcgagcuccgcgagcgccaccgcccccucgucguccccggcucccgccaggaggaggucaucgaccacaagcucaccgagcgcgagugggccgaggaguggaagcaccucaacaaccuccucaacugcaucauggacauggucgagaagacccgccgcucccucaccguccuccgccgcugccaggaggccgaccgcgaggagcucaaccacugggcccgccgcuacuccgacgccgaggacaccaagaagggccccgcccccgccgccgcccgcccccgcuccuccuccgccggccccgagggcccccagcucgacgucccccgcgaguuccucccccgcacccucaccggcuacguccccgaggacaucuggcgcaaggccgaggaggccgucaacgaggucaagcgccaggccauguccgagcuccagaaggccgucuccgacgccgagcgcaaggcccacgagcucaucaccaccgagcgcgccaagauggagcgcgcccucgccgaggccaagcgccaggccuccgaggacgcccucaccgucaucaaccagcaggaggacuccuccgaguccugcuggaacugcggccgcaaggccuccgagaccugcuccggcugcaacgccgcccgcuacugcggcuccuucugccagcaccgcgacugggagaagcaccaccacgucugcggccagucccuccagggccccaccgccgucgucgccgaccccguccccggcccccccgaggccgcccacucccucggccccucccuccccgucggcgccgccucccccuccgaggccggcuccgccggccccucccgccccggcucccccuccccccccggcccccucgacaccgucccccgcuga

SEQ ID NO: 40800 - RNA, 549 nt, Artificial Sequence
  derived and/or modified sequence opt2 from CBFB__Homo_sapiens__NP_001746
augccccgcgucguccccgaccagcgcuccaaguucgagaacgaggaguucuuccgcaagcucucccgcgagugcgagaucaaguacaccggcuuccgcgaccgcccccacgaggagcgccaggcccgcuuccagaacgccugccgcgacggccgcuccgagaucgccuucgucgccaccggcaccaaccucucccuccaguucuuccccgccuccuggcagggcgagcagcgccagacccccucccgcgaguacgucgaccucgagcgcgaggccggcaaggucuaccucaaggcccccaugauccucaacggcgucugcgucaucuggaagggcuggaucgaccuccagcgccucgacggcaugggcugccucgaguucgacgaggagcgcgcccagcaggaggacgcccucgcccagcaggccuucgaggaggcccgccgccgcacccgcgaguucgaggaccgcgaccgcucccaccgcgaggagauggagguccgcgucucccagcuccucgccgucaccggcaagaagaccacccgccccuga

SEQ ID NO: 40801 - RNA, 2949 nt, Artificial Sequence
  derived and/or modified sequence opt2 from CBLB__Homo_sapiens__NP_733762
auggccaacuccaugaacggccgcaaccccggcggccgcggcggcaacccccgcaagggccgcauccucggcaucaucgacgccauccaggacgccgucggcccccccaagcaggccgccgccgaccgccgcaccgucgagaagaccuggaagcucauggacaaggucguccgccucugccagaaccccaagcuccagcucaagaacuccccccccuacauccucgacauccuccccgacaccuaccagcaccuccgccucauccucuccaaguacgacgacaaccagaagcucgcccagcucuccgagaacgaguacuucaagaucuacaucgacucccucaugaagaaguccaagcgcgccauccgccucuucaaggagggcaaggagcgcauguacgaggagcagucccaggaccgccgcaaccucaccaagcucucccucaucuucucccacaugcucgccgagaucaaggccaucuuccccaacggccaguuccagggcgacaacuuccgcaucaccaaggccgacgccgccgaguucuggcgcaaguucuucggcgacaagaccaucguccccuggaaggucuuccgccagugccuccacgagguccaccagaucuccuccggccucgaggccauggcccucaaguccaccaucgaccucaccugcaacgacuacaucuccgucuucgaguucgacaucuucacccgccucuuccagcccuggggcuccauccuccgcaacuggaacuuccucgccgucacccaccccggcuacauggccuuccucaccuacgacgaggucaaggcccgccuccagaaguacuccaccaagcccggcuccuacaucuuccgccucuccugcacccgccucggccagugggccaucggcuacgucaccggcgacggcaacauccuccagaccaucccccacaacaagccccucuuccaggcccucaucgacggcucccgcgagggcuucuaccucuaccccgacggccgcuccuacaaccccgaccucaccggccucugcgagcccaccccccacgaccacaucaaggucacccaggagcaguacgagcucuacugcgagaugggcuccaccuuccagcucugcaagaucugcgccgagaacgacaaggacgucaagaucgagcccugcggccaccucaugugcaccuccugccucaccgccuggcaggaguccgacggccagggcugccccuucugccgcugcgagaucaagggcaccgagcccaucaucgucgaccccuucgacccccgcgacgagggcucccgcugcugcuccaucaucgaccccuucggcaugcccaugcucgaccucgacgacgacgacgaccgcgaggagucccucaugaugaaccgccucgccaacguccgcaagugcaccgaccgccagaacucccccgucaccucccccggcuccuccccccucgcccagcgccgcaagccccagcccgacccccuccagaucccccaccucucccucccccccguccccccccgccucgaccucauccagaagggcaucguccgcucccccugcggcucccccaccggcucccccaaguccucccccugcaugguccgcaagcaggacaagccccuccccgcccccccccccccccuccgcgacccccccccccccccccccgagcgccccccccccaucccccccgacaaccgccucucccgccacauccaccacgucgaguccguccccucccgcgacccccccaugccccucgaggccuggugcccccgcgacgucuucggcaccaaccagcucgucggcugccgccuccucggcgagggcucccccaagcccggcaucaccgccuccuccaacgucaacggccgccacucccgcgucggcuccgaccccguccucaugcgcaagcaccgccgccacgaccucccccucgagggcgccaaggucuucuccaacggccaccucggcuccgaggaguacgacguccccccccgccucuccccccccccccccgucaccacccuccuccccuccaucaagugcaccggcccccucgccaacucccucuccgagaagacccgcgaccccgucgaggaggacgacgacgaguacaagauccccuccucccaccccgucucccucaacucccagcccucccacugccacaacgucaagccccccguccgcuccugcgacaacggccacugcaugcucaacggcacccacggccccuccuccgagaagaaguccaacauccccgaccucuccaucuaccucaagggcgacgucuucgacuccgccuccgaccccgucccccucccccccgcccgcccccccacccgcgacaaccccaagcacggcuccucccucaaccgcacccccuccgacuacgaccuccucauccccccccucggcgaggacgccuucgacgcccucccccccucccucccccccccccccccccccgcccgccacucccucaucgagcacuccaagccccccggcuccuccucccgccccuccuccggccaggaccucuuccuccuccccuccgaccccuucgucgaccucgccuccggccaggucccccucccccccgcccgccgccuccccggcgagaacgucaagaccaaccgcaccucccaggacuacgaccagcuccccuccugcuccgacggcucccaggcccccgcccgcccccccaagccccgcccccgccgcaccgcccccgagauccaccaccgcaagccccacggccccgaggccgcccucgagaacgucgacgccaagaucgccaagcucaugggcgagggcuacgccuucgaggaggucaagcgcgcccucgagaucgcccagaacaacgucgaggucgcccgcuccauccuccgcgaguucgccuuccccccccccgucuccccccgccucaaccucuga

SEQ ID NO: 40802 - RNA, 2721 nt, Artificial Sequence
  derived and/or modified sequence opt2 from CBL__Homo_sapiens__NP_005179
auggccggcaacgucaagaaguccuccggcgccggcggcggcuccggcuccggcggcuccggcuccggcggccucaucggccucaugaaggacgccuuccagccccaccaccaccaccaccaccaccucuccccccacccccccggcaccgucgacaagaagauggucgagaagugcuggaagcucauggacaaggucguccgccucugccagaaccccaagcucgcccucaagaacuccccccccuacauccucgaccuccuccccgacaccuaccagcaccuccgcaccauccucucccgcuacgagggcaagauggagacccucggcgagaacgaguacuuccgcgucuucauggagaaccucaugaagaagaccaagcagaccaucucccucuucaaggagggcaaggagcgcauguacgaggagaacucccagccccgccgcaaccucaccaagcucucccucaucuucucccacaugcucgccgagcucaagggcaucuuccccuccggccucuuccagggcgacaccuuccgcaucaccaaggccgacgccgccgaguucuggcgcaaggccuucggcgagaagaccaucguccccuggaaguccuuccgccaggcccuccacgagguccaccccaucuccuccggccucgaggccauggcccucaaguccaccaucgaccucaccugcaacgacuacaucuccgucuucgaguucgacaucuucacccgccucuuccagcccugguccucccuccuccgcaacuggaacucccucgccgucacccaccccggcuacauggccuuccucaccuacgacgaggucaaggcccgccuccagaaguucauccacaagcccggcuccuacaucuuccgccucuccugcacccgccucggccagugggccaucggcuacgucaccgccgacggcaacauccuccagaccaucccccacaacaagccccucuuccaggcccucaucgacggcuuccgcgagggcuucuaccucuuccccgacggccgcaaccagaaccccgaccucaccggccucugcgagcccaccccccaggaccacaucaaggucacccaggagcaguacgagcucuacugcgagaugggcuccaccuuccagcucugcaagaucugcgccgagaacgacaaggacgucaagaucgagcccugcggccaccucaugugcaccuccugccucaccuccuggcaggaguccgagggccagggcugccccuucugccgcugcgagaucaagggcaccgagcccaucgucgucgaccccuucgacccccgcggcuccggcucccuccuccgccagggcgccgagggcgcccccucccccaacuacgacgacgacgacgacgagcgcgccgacgacacccucuucaugaugaaggagcucgccggcgccaaggucgagcgcccccccucccccuucuccauggccccccaggccucccucccccccguccccccccgccucgaccuccucccccagcgcgucugcguccccuccuccgccuccgcccucggcaccgccuccaaggccgccuccggcucccuccacaaggacaagccccuccccgucccccccacccuccgcgaccucccccccccccccccccccgaccgccccuacuccgucggcgccgagucccgcccccagcgccgcccccuccccugcacccccggcgacugccccucccgcgacaagcucccccccguccccuccucccgccucggcgacuccuggcucccccgccccauccccaagguccccgucuccgcccccuccuccuccgaccccuggaccggccgcgagcucaccaaccgccacucccuccccuucucccuccccucccagauggagccccgccccgacgucccccgccucggcuccaccuucucccucgacaccuccauguccaugaacuccuccccccucgucggccccgagugcgaccaccccaagaucaagcccuccuccuccgccaacgccaucuacucccucgccgcccgcccccuccccguccccaagcucccccccggcgagcagugcgagggcgaggaggacaccgaguacaugacccccuccucccgcccccuccgcccccucgacaccucccaguccucccgcgccugcgacugcgaccagcagaucgacuccugcaccuacgaggccauguacaacauccagucccaggcccccuccaucaccgaguccuccaccuucggcgagggcaaccucgccgccgcccacgccaacaccggccccgaggaguccgagaacgaggacgacggcuacgacguccccaagccccccguccccgccguccucgcccgccgcacccucuccgacaucuccaacgccuccuccuccuucggcuggcucucccucgacggcgaccccaccaccaacgucaccgagggcucccagguccccgagcgcccccccaagcccuucccccgccgcaucaacuccgagcgcaaggccggcuccugccagcagggcuccggccccgccgccuccgccgccaccgccuccccccagcucuccuccgagaucgagaaccucaugucccagggcuacuccuaccaggacauccagaaggcccucgucaucgcccagaacaacaucgagauggccaagaacauccuccgcgaguucgucuccaucuccucccccgcccacgucgccaccuga

SEQ ID NO: 40803 - RNA, 1473 nt, Artificial Sequence
  derived and/or modified sequence opt2 from CBLL1__Homo_sapiens__NP_001271220
auggaccacaccgacaacgagcuccagggcaccaacuccuccggcucccucggcggccucgacguccgccgccgcauccccaucaagcucaucuccaagcaggccaacaaggccaagcccgccccccgcacccagcgcaccaucaaccgcaugcccgccaaggccccccccggcgacgagggcuucgacuacaacgaggaggagcgcuacgacugcaagggcggcgagcucuucgccaaccagcgccgcuuccccggccaccucuucugggacuuccagaucaacauccucggcgagaaggacgacacccccguccacuucugcgacaagugcggccuccccaucaagaucuacggccgcaugauccccugcaagcacgucuucugcuacgacugcgccauccuccacgagaagaagggcgacaagaugugccccggcugcuccgaccccguccagcgcaucgagcagugcacccgcggcucccucuucaugugcuccaucguccagggcugcaagcgcaccuaccucucccagcgcgaccuccaggcccacaucaaccaccgccacaugcgcgccggcaagcccgucacccgcgccucccucgagaacguccacccccccaucgcccccccccccaccgagauccccgagcgcuucaucaugccccccgacaagcaccacaugucccacaucccccccaagcagcacaucaugaugcccccccccccccuccagcacgucccccacgagcacuacaaccagccccacgaggacauccgcgccccccccgccgagcucuccauggcccccccccccccccgcuccgucucccaggagaccuuccgcaucuccacccgcaagcacuccaaccucaucaccguccccauccaggacgacuccaacuccggcgcccgcgagccccccccccccgcccccgcccccgcccaccaccaccccgaguaccagggccagcccgucgucucccacccccaccacaucaugcccccccagcagcacuacgccccccccccccccccccccccccccaucucccaccccaugccccaccccccccaggccgccggcaccccccaccucgucuacucccaggccccccccccccccaugaccuccgcccccccccccaucacccccccccccggccacaucaucgcccagaugccccccuacaugaaccaccccccccccggccccccccccccccagcacggcggcccccccgucaccgccccccccccccaccacuacaaccccaacucccucccccaguucaccgaggaccagggcacccucuccccccccuucacccagcccggcggcaugucccccggcaucuggcccgccccccgcggcccccccccccccccccgccuccagggcccccccucccagaccccccuccccggcccccaccaccccgaccagacccgcuaccgccccuacuaccaguga

SEQ ID NO: 40804 - RNA, 582 nt, Artificial Sequence
  derived and/or modified sequence opt2 from CBLN1__Homo_sapiens__NP_004343
augcucggcguccucgagcuccuccuccucggcgccgccuggcucgccggccccgcccgcggccagaacgagaccgagcccaucguccucgagggcaagugccucgucgucugcgacuccaaccccaccuccgaccccaccggcaccgcccucggcaucuccguccgcuccggcuccgccaaggucgccuucuccgccauccgcuccaccaaccacgagcccuccgagauguccaaccgcaccaugaucaucuacuucgaccagguccucgucaacaucggcaacaacuucgacuccgagcgcuccaccuucaucgccccccgcaagggcaucuacuccuucaacuuccacgucgucaaggucuacaaccgccagaccauccaggucucccucaugcucaacggcuggcccgucaucuccgccuucgccggcgaccaggacgucacccgcgaggccgccuccaacggcguccucauccagauggagaagggcgaccgcgccuaccucaagcucgagcgcggcaaccucaugggcggcuggaaguacuccaccuucuccggcuuccucgucuucccccucuga

SEQ ID NO: 40805 - RNA, 675 nt, Artificial Sequence
  derived and/or modified sequence opt2 from CBLN2__Homo_sapiens__XP_011524128
augcaggcccccggccgcggcccccucggccuccgccucaugaugcccggccgccgcggcgcccuccgcgagcccggcggcugcggcuccugccucggcgucgcccucgcccuccuccuccuccuccuccccgccugcugccccguccgcgcccagaacgacaccgagcccaucguccucgagggcaagugccucgucgucugcgacuccucccccuccgccgacggcgccgucaccuccucccucggcaucuccguccgcuccggcuccgccaaggucgccuucuccgccacccgcuccaccaaccacgagcccuccgagauguccaaccgcaccaugaccaucuacuucgaccagguccucgucaacaucggcaaccacuucgaccucgccuccuccaucuucgucgccccccgcaagggcaucuacuccuucuccuuccacgucgucaaggucuacaaccgccagaccauccaggucucccucaugcagaacggcuaccccgucaucuccgccuucgccggcgaccaggacgucacccgcgaggccgccuccaacggcguccuccuccucauggagcgcgaggacaagguccaccucaagcucgagcgcggcaaccucaugggcggcuggaaguacuccaccuucuccggcuuccucgucuucccccucuga

SEQ ID NO: 40806 - RNA, 606 nt, Artificial Sequence
  derived and/or modified sequence opt2 from CBLN4__Homo_sapiens__NP_542184
augggcuccggccgccgcgcccucuccgccguccccgccguccuccucguccucacccuccccggccuccccgucugggcccagaacgacaccgagcccaucguccucgagggcaagugccucgucgucugcgacuccaaccccgccaccgacuccaagggcuccuccuccuccccccucggcaucuccguccgcgccgccaacuccaaggucgccuucuccgccguccgcuccaccaaccacgagcccuccgagauguccaacaagacccgcaucaucuacuucgaccagauccucgucaacgucggcaacuucuucacccucgaguccgucuucgucgccccccgcaagggcaucuacuccuucuccuuccacgucaucaaggucuaccagucccagaccauccaggucaaccucaugcucaacggcaagcccgucaucuccgccuucgccggcgacaaggacgucacccgcgaggccgccaccaacggcguccuccucuaccucgacaaggaggacaaggucuaccucaagcucgagaagggcaaccucgucggcggcuggcaguacuccaccuucuccggcuuccucgucuucccccucuga

SEQ ID NO: 40807 - RNA, 834 nt, Artificial Sequence
  derived and/or modified sequence opt2 from CBR1__Homo_sapiens__NP_001748
auguccuccggcauccacgucgcccucgucaccggcggcaacaagggcaucggccucgccaucguccgcgaccucugccgccucuucuccggcgacgucguccucaccgcccgcgacgucacccgcggccaggccgccguccagcagcuccaggccgagggccucuccccccgcuuccaccagcucgacaucgacgaccuccaguccauccgcgcccuccgcgacuuccuccgcaaggaguacggcggccucgacguccucgucaacaacgccggcaucgccuucaaggucgccgaccccacccccuuccacauccaggccgaggucaccaugaagaccaacuucuucggcacccgcgacgucugcaccgagcuccucccccucaucaagccccagggccgcgucgucaacgucuccuccaucauguccguccgcgcccucaaguccugcucccccgagcuccagcagaaguuccgcuccgagaccaucaccgaggaggagcucgucggccucaugaacaaguucgucgaggacaccaagaagggcguccaccagaaggagggcuggcccuccuccgccuacggcgucaccaagaucggcgucaccguccucucccgcauccacgcccgcaagcucuccgagcagcgcaagggcgacaagauccuccucaacgccugcugccccggcuggguccgcaccgacauggccggccccaaggccaccaagucccccgaggagggcgccgagacccccgucuaccucgcccuccucccccccgacgccgagggcccccacggccaguucgucuccgagaagcgcgucgagcagugguga

SEQ ID NO: 40808 - RNA, 834 nt, Artificial Sequence
  derived and/or modified sequence opt2 from CBR3__Homo_sapiens__NP_001227
auguccuccugcucccgcgucgcccucgucaccggcgccaaccgcggcaucggccucgccaucgcccgcgagcucugccgccaguucuccggcgacgucguccucaccgcccgcgacgucgcccgcggccaggccgccguccagcagcuccaggccgagggccucuccccccgcuuccaccagcucgacaucgacgaccuccaguccauccgcgcccuccgcgacuuccuccgcaaggaguacggcggccucaacguccucgucaacaacgccgccgucgccuucaaguccgacgaccccaugcccuucgacaucaaggccgagaugacccucaagaccaacuucuucgccacccgcaacaugugcaacgagcuccuccccaucaugaagccccacggccgcgucgucaacaucuccucccuccagugccuccgcgccuucgagaacugcuccgaggaccuccaggagcgcuuccacuccgagacccucaccgagggcgaccucgucgaccucaugaagaaguucgucgaggacaccaagaacgagguccacgagcgcgagggcuggcccaacucccccuacggcgucuccaagcucggcgucaccguccucucccgcauccucgcccgccgccucgacgagaagcgcaaggccgaccgcauccucgucaacgccugcugccccggccccgucaagaccgacauggacggcaaggacuccauccgcaccgucgaggagggcgccgagacccccgucuaccucgcccuccucccccccgacgccaccgagccccagggccagcucguccacgacaaggucguccagaacugguga

SEQ ID NO: 40809 - RNA, 714 nt, Artificial Sequence
  derived and/or modified sequence opt2 from CBR4__Homo_sapiens__NP_116172
auggacaaggucugcgccgucuucggcggcucccgcggcaucggccgcgccgucgcccagcucauggcccgcaagggcuaccgccucgccgucaucgcccgcaaccucgagggcgccaaggccgccgccggcgaccucggcggcgaccaccucgccuucuccugcgacgucgccaaggagcacgacguccagaacaccuucgaggagcucgagaagcaccucggccgcgucaacuuccucgucaacgccgccggcaucaaccgcgacggccuccucguccgcaccaagaccgaggacauggucucccagcuccacaccaaccuccucggcuccaugcucaccugcaaggccgccaugcgcaccaugauccagcagcagggcggcuccaucgucaacgucggcuccaucgucggccucaagggcaacuccggccaguccgucuacuccgccuccaagggcggccucgucggcuucucccgcgcccucgccaaggaggucgcccgcaagaagauccgcgucaacgucgucgcccccggcuucguccacaccgacaugaccaaggaccucaaggaggagcaccucaagaagaacaucccccucggccgcuucggcgagaccaucgaggucgcccacgccgucgucuuccuccucgagucccccuacaucaccggccacguccucgucgucgacggcggccuccagcucauccucuga

SEQ ID NO: 40810 - RNA, 1698 nt, Artificial Sequence
  derived and/or modified sequence opt2 from CBS__Homo_sapiens__XP_011528084
augcccuccgagaccccccaggccgaggucggccccaccggcugcccccaccgcuccggcccccacuccgccaagggcucccucgagaagggcucccccgaggacaaggaggccaaggagccccucuggauccgccccgacgcccccucccgcugcaccuggcagcucggccgccccgccuccgaguccccccaccaccacaccgcccccgccaagucccccaagauccuccccgacauccucaagaagaucggcgacacccccaugguccgcaucaacaagaucggcaagaaguucggccucaagugcgagcuccucgccaagugcgaguucuucaacgccggcggcuccgucaaggaccgcaucucccuccgcaugaucgaggacgccgagcgcgacggcacccucaagcccggcgacaccaucaucgagcccaccuccggcaacaccggcaucggccucgcccucgccgccgccguccgcggcuaccgcugcaucaucgucaugcccgagaagauguccuccgagaaggucgacguccuccgcgcccucggcgccgagaucguccgcacccccaccaacgcccgcuucgacucccccgagucccacgucggcgucgccuggcgccucaagaacgagauccccaacucccacauccucgaccaguaccgcaacgccuccaacccccucgcccacuacgacaccaccgccgacgagauccuccagcagugcgacggcaagcucgacaugcucgucgccuccgucggcaccggcggcaccaucaccggcaucgcccgcaagcucaaggagaagugccccggcugccgcaucaucggcgucgaccccgagggcuccauccucgccgagcccgaggagcucaaccagaccgagcagaccaccuacgaggucgagggcaucggcuacgacuucauccccaccguccucgaccgcaccgucgucgacaagugguucaaguccaacgacgaggaggccuucaccuucgcccgcaugcucaucgcccaggagggccuccucugcggcggcuccgccggcuccaccgucgccgucgccgucaaggccgcccaggagcuccaggagggccagcgcugcgucgucauccuccccgacuccguccgcaacuacaugaccaaguuccucuccgaccgcuggaugcuccagaagggcuuccucaaggaggaggaccucaccgagaagaagcccuggugguggcaccuccgcguccaggagcucggccucuccgccccccucaccguccuccccaccaucaccugcggccacaccaucgagauccuccgcgagaagggcuucgaccaggcccccgucgucgacgaggccggcgucauccucggcauggucacccucggcaacaugcucuccucccuccucgccggcaagguccagcccuccgaccaggucggcaaggucaucuacaagcaguucaagcagauccgccucaccgacacccucggccgccucucccacauccucgagauggaccacuucgcccucgucguccacgagcagauccagucccaggaccaggccugggccggcgucgucggcggccccgccgaccacuccaccggcaaguccucccagcgccagauggucuucggcgucgucaccgccaucgaccuccucaacuucgucgccgcccaggagcgcgaccagaaguga

SEQ ID NO: 40811 - RNA, 558 nt, Artificial Sequence
  derived and/or modified sequence opt2 from CBX1__Homo_sapiens__NP_006798
augggcaagaagcagaacaagaagaaggucgaggagguccucgaggaggaggaggaggaguacgucgucgagaagguccucgaccgccgcgucgucaagggcaaggucgaguaccuccucaaguggaagggcuucuccgacgaggacaacaccugggagcccgaggagaaccucgacugccccgaccucaucgccgaguuccuccagucccagaagaccgcccacgagaccgacaaguccgagggcggcaagcgcaaggccgacuccgacuccgaggacaagggcgaggaguccaagcccaagaagaagaaggaggaguccgagaagccccgcggcuucgcccgcggccucgagcccgagcgcaucaucggcgccaccgacuccuccggcgagcucauguuccucaugaaguggaagaacuccgacgaggccgaccucguccccgccaaggaggccaacgucaagugcccccaggucgucaucuccuucuacgaggagcgccucaccuggcacuccuaccccuccgaggacgacgacaagaaggacgacaagaacuga

SEQ ID NO: 40812 - RNA, 1599 nt, Artificial Sequence
  derived and/or modified sequence opt2 from CBX2__Homo_sapiens__NP_005180
auggaggagcucuccuccgucggcgagcaggucuucgccgccgagugcauccucuccaagcgccuccgcaagggcaagcucgaguaccucgucaaguggcgcggcugguccuccaagcacaacuccugggagcccgaggagaacauccucgacccccgccuccuccucgccuuccagaagaaggagcacgagaaggagguccagaaccgcaagcgcggcaagcgcccccgcggccgcccccgcaagcucaccgccauguccuccugcucccgccgcuccaagcucaaggagcccgacgcccccuccaaguccaaguccuccuccuccuccuccuccuccaccuccuccuccuccuccuccgacgaggaggacgacuccgaccucgacgccaagcgcggcccccgcggccgcgagacccaccccgucccccagaagaaggcccagauccucgucgccaagcccgagcucaaggaccccauccgcaagaagcgcggccgcaagccccucccccccgagcagaaggccacccgccgccccgucucccucgccaagguccucaagaccgcccgcaaggaccucggcgcccccgccuccaagcucccccccccccucuccgcccccgucgccggccucgccgcccucaaggcccacgccaaggaggccugcggcggccccuccgccauggccacccccgagaaccucgccucccucaugaagggcauggccuccucccccggccgcggcggcaucuccuggcaguccuccaucguccacuacaugaaccgcaugacccagucccaggcccaggccgccucccgccucgcccucaaggcccaggccaccaacaagugcggccucggccucgaccucaagguccgcacccagaagggcgagcucggcauguccccccccggcuccaagauccccaaggcccccuccggcggcgccgucgagcagaaggucggcaacaccggcggccccccccacacccacggcgccucccgcguccccgccggcugccccggcccccagcccgcccccacccaggagcucucccuccagguccucgaccuccaguccgucaagaacggcaugcccggcgucggccuccucgcccgccacgccaccgccaccaagggcguccccgccaccaaccccgcccccggcaagggcaccggcuccggccucaucggcgccuccggcgccaccaugcccaccgacaccuccaaguccgagaagcucgccucccgcgccgucgccccccccacccccgccuccaagcgcgacugcgucaagggcuccgccacccccuccggccaggagucccgcaccgcccccggcgaggcccgcaaggccgccacccuccccgagauguccgccggcgaggaguccuccuccuccgacuccgaccccgacuccgccuccccccccuccaccggccagaaccccuccgucuccguccagaccucccaggacuggaagcccacccgcucccucaucgagcacgucuucgucaccgacgucaccgccaaccucaucaccgucaccgucaaggagucccccaccuccgucggcuucuucaaccuccgccacuacuga

SEQ ID NO: 40813 - RNA, 552 nt, Artificial Sequence
  derived and/or modified sequence opt2 from CBX3__Homo_sapiens__NP_009207
auggccuccaacaagaccacccuccagaagaugggcaagaagcagaacggcaaguccaagaaggucgaggaggccgagcccgaggaguucgucgucgagaagguccucgaccgccgcgucgucaacggcaaggucgaguacuuccucaaguggaagggcuucaccgacgccgacaacaccugggagcccgaggagaaccucgacugccccgagcucaucgaggccuuccucaacucccagaaggccggcaaggagaaggacggcaccaagcgcaagucccucuccgacuccgaguccgacgacuccaaguccaagaagaagcgcgacgccgccgacaagccccgcggcuucgcccgcggccucgaccccgagcgcaucaucggcgccaccgacuccuccggcgagcucauguuccucaugaaguggaaggacuccgacgaggccgaccucguccucgccaaggaggccaacaugaagugcccccagaucgucaucgccuucuacgaggagcgccucaccuggcacuccugccccgaggacgaggcccaguga

SEQ ID NO: 40814 - RNA, 1683 nt, Artificial Sequence
  derived and/or modified sequence opt2 from CBX4__Homo_sapiens__NP_003646
auggagcuccccgccgucggcgagcacgucuucgccgucgaguccaucgagaagaagcgcauccgcaagggccgcgucgaguaccucgucaaguggcgcggcuggucccccaaguacaacaccugggagcccgaggagaacauccucgacccccgccuccucaucgccuuccagaaccgcgagcgccaggagcagcucaugggcuaccgcaagcgcggccccaagcccaagccccucgucguccagguccccaccuucgcccgccgcuccaacguccucaccggccuccaggacuccuccaccgacaaccgcgccaagcucgaccucggcgcccagggcaagggccagggccaccaguacgagcucaacuccaagaagcaccaccaguaccagccccacuccaaggagcgcgccggcaagccccccccccccggcaaguccggcaaguacuacuaccagcucaacuccaagaagcaccaccccuaccagcccgaccccaagauguacgaccuccaguaccagggcggccacaaggaggcccccucccccaccugccccgaccucggcgccaagucccacccccccgacaagugggcccagggcgccggcgccaagggcuaccucggcgccgucaagccccucgccggcgccgccggcgcccccggcaagggcuccgagaagggcccccccaacggcaugaugcccgcccccaaggaggccgucaccggcaacggcaucggcggcaagaugaagaucgucaagaacaagaacaagaacggccgcaucgucaucgucauguccaaguacauggagaacggcaugcaggccgucaagaucaaguccggcgaggucgccgagggcgaggcccgcucccccucccacaagaagcgcgccgccgacgagcgccacccccccgccgaccgcaccuucaagaaggccgccggcgccgaggagaagaaggucgaggccccccccaagcgccgcgaggaggaggucuccggcgucuccgacccccagccccaggacgccggcucccgcaagcucucccccaccaaggaggccuucggcgagcagccccuccagcucaccaccaagcccgaccuccucgccugggaccccgcccgcaacacccacccccccucccaccacccccacccccacccccaccaccaccaccaccaccaccaccaccaccaccacgccgucggccucaaccucucccacguccgcaagcgcugccucuccgagacccacggcgagcgcgagcccugcaagaagcgccucaccgcccgcuccaucuccacccccaccugccucggcggcucccccgccgccgagcgccccgccgaccucccccccgccgccgcccucccccagcccgaggucauccuccucgacuccgaccucgacgagcccaucgaccuccgcugcgucaagacccgcuccgaggccggcgagccccccuccucccuccaggucaagcccgagacccccgccuccgccgccgucgccgucgccgccgccgccgcccccaccaccaccgccgagaagccccccgccgaggcccaggacgagcccgccgagucccucuccgaguucaagcccuucuucggcaacaucaucaucaccgacgucaccgccaacugccucaccgucaccuucaaggaguacgucaccgucuga

SEQ ID NO: 40815 - RNA, 576 nt, Artificial Sequence
  derived and/or modified sequence opt2 from CBX5__Homo_sapiens__NP_001120793
augggcaagaagaccaagcgcaccgccgacuccuccuccuccgaggacgaggaggaguacgucgucgagaagguccucgaccgccgcgucgucaagggccaggucgaguaccuccucaaguggaagggcuucuccgaggagcacaacaccugggagcccgagaagaaccucgacugccccgagcucaucuccgaguucaugaagaaguacaagaagaugaaggagggcgagaacaacaagccccgcgagaaguccgaguccaacaagcgcaaguccaacuucuccaacuccgccgacgacaucaaguccaagaagaagcgcgagcaguccaacgacaucgcccgcggcuucgagcgcggccucgagcccgagaagaucaucggcgccaccgacuccugcggcgaccucauguuccucaugaaguggaaggacaccgacgaggccgaccucguccucgccaaggaggccaacgucaagugcccccagaucgucaucgccuucuacgaggagcgccucaccuggcacgccuaccccgaggacgccgagaacaaggagaaggagaccgccaaguccuga

SEQ ID NO: 40816 - RNA, 1185 nt, Artificial Sequence
  derived and/or modified sequence opt2 from CBX6__Homo_sapiens__NP_001290423
auggagcucuccgccgucggcgagcgcgucuucgccgccgaguccaucaucaagcgccgcauccgcaagggccgcaucgaguaccucgucaaguggaagggcugggccaucaaguacuccaccugggagcccgaggagaacauccucgacucccgccucaucgccgccuucgagcagaaggagcgcgagcgcgagcucuacggccccaagaagcgcggccccaagcccaagaccuuccuccucaagcccuccgccuccgccuccucccccaagcuccacuccuccgccgccguccaccgccucaagaaggacauccgccgcugccaccgcaugucccgccgcccccucccccgccccgacccccagggcggcucccccggccuccgcccccccaucucccccuucuccgagaccguccgcaucaucaaccgcaaggucaagccccgcgagcccaagcgcaaccgcaucauccucaaccucaaggucaucgacaagggcgccggcggcggcggcgccggccagggcgccggcgcccucgcccgccccaagguccccucccgcaaccgcgucaucggcaaguccaagaaguucuccgaguccguccuccgcacccagauccgccacaugaaguucggcgccuucgcccucuacaagcccccccccgccccccucgucgcccccucccccggcaaggccgaggccuccgcccccggccccggccuccuccucgccgcccccgccgcccccuacgacgcccgcuccuccggcuccuccggcugccccucccccaccccccaguccuccgaccccgacgacaccccccccaagcuccuccccgagaccgucucccccuccgcccccuccuggcgcgagcccgagguccucgaccucucccucccccccgaguccgccgccaccuccaagcgcgccccccccgaggucaccgccgccgccggccccgccccccccaccgcccccgagcccgccggcgccuccuccgagcccgaggccggcgacuggcgccccgagaugucccccugcuccaacgucgucgucaccgacgucaccuccaaccuccucaccgucaccaucaaggaguucugcaaccccgaggacuucgagaaggucgccgccggcgucgccggcgccgccggcggcggcggcuccaucggcgccuccaaguga

SEQ ID NO: 40817 - RNA, 756 nt, Artificial Sequence
  derived and/or modified sequence opt2 from CBX7__Homo_sapiens__NP_783640
auggagcucuccgccaucggcgagcaggucuucgccgucgaguccauccgcaagaagcgcguccgcaagggcaaggucgaguaccucgucaaguggaagggcuggccccccaaguacuccaccugggagcccgaggagcacauccucgacccccgccucgucauggccuacgaggagaaggaggagcgcgaccgcgccuccggcuaccgcaagcgcggccccaagcccaagcgccuccuccuccagcgccucuacuccauggaccuccgcuccucccacaaggccaagggcaaggagaagcucugcuucucccucaccugcccccucggcuccggcucccccgagggcgucgucaaggccggcgcccccgagcucgucgacaagggcccccucguccccacccuccccuucccccuccgcaagccccgcaaggcccacaaguaccuccgccucucccgcaagaaguuccccccccgcggccccaaccucgagucccacucccaccgccgcgagcucuuccuccaggagccccccgcccccgacguccuccaggccgccggcgagugggagcccgccgcccagccccccgaggaggaggccgacgccgaccucgccgagggccccccccccuggacccccgcccuccccuccuccgaggucaccgucaccgacaucaccgccaacuccaucaccgucaccuuccgcgaggcccaggccgccgagggcuucuuccgcgaccgcuccggcaaguucuga

SEQ ID NO: 40818 - RNA, 1170 nt, Artificial Sequence
  derived and/or modified sequence opt2 from CBX8__Homo_sapiens__NP_065700
auggagcucuccgccgucggcgagcgcgucuucgccgccgaggcccuccucaagcgccgcauccgcaagggccgcauggaguaccucgucaaguggaagggcuggucccagaaguacuccaccugggagcccgaggagaacauccucgacgcccgccuccucgccgccuucgaggagcgcgagcgcgagauggagcucuacggccccaagaagcgcggccccaagcccaagaccuuccuccucaaggcccaggccaaggccaaggccaagaccuacgaguuccgcuccgacuccgcccgcggcauccgcauccccuaccccggccgcuccccccaggaccucgccuccaccucccgcgcccgcgagggccuccgcaacaugggccucuccccccccgccuccuccaccuccaccuccuccaccugccgcgccgaggccccccgcgaccgcgaccgcgaccgcgaccgcgaccgcgagcgcgaccgcgagcgcgagcgcgagcgcgagcgcgagcgcgagcgcgagcgcgagcgcgagcgcggcaccucccgcgucgacgacaagcccuccucccccggcgacuccuccaagaagcgcggccccaagccccgcaaggagcuccccgaccccucccagcgcccccucggcgagcccuccgccggccucggcgaguaccucaagggccgcaagcucgacgacacccccuccggcgccggcaaguuccccgccggccacuccgucauccagcucgcccgccgccaggacuccgaccucguccagugcggcgucaccucccccuccuccgccgaggccaccggcaagcucgccgucgacaccuuccccgcccgcgucaucaagcaccgcgccgccuuccucgaggccaagggccagggcgcccucgaccccaacggcacccgcguccgccacggcuccggcccccccuccuccggcggcggccucuaccgcgacaugggcgcccagggcggccgccccucccucaucgcccgcauccccgucgcccgcauccucggcgaccccgaggaggaguccuggucccccucccucaccaaccucgagaaggucgucgucaccgacgucaccuccaacuuccucaccgucaccaucaaggaguccaacaccgaccagggcuucuucaaggagaagcgcuga

SEQ ID NO: 40819 - RNA, 510 nt, Artificial Sequence
  derived and/or modified sequence opt2 from CBY1__Homo_sapiens__NP_001002880
auggacaagugccagaagcacgacgucgagugcgagaagcccgacgccaacgaggacucccucugcaacuccguccacguccaguggcccggcgagggcuccaccggcuucgccuucauccgccccaagaugcccuucuucggcaacaccuucucccccaagaagacccccccccgcaaguccgccucccucuccaaccuccacucccucgaccgcuccacccgcgaggucgagcucggccucgaguacggcucccccaccaugaaccucgccggccagucccucaaguucgagaacggccaguggaucgccgagaccggcgucuccggcggcgucgaccgccgcgagguccagcgccuccgccgccgcaaccagcagcucgaggaggagaacaaccuccuccgccucaaggucgacauccuccucgacaugcucuccgaguccaccgccgagucccaccucauggagaaggagcucgacgagcuccgcaucucccgcaagcgcaaguga

SEQ ID NO: 40820 - RNA, 2856 nt, Artificial Sequence
  derived and/or modified sequence opt2 from CC2D1A__Homo_sapiens__NP_060191
augcacaagcgcaagggcccccccggcccccccggccgcggcgccgccgccgcccgccagcucggccuccucgucgaccucucccccgacggccucaugauccccgaggacggcgccaacgacgaggagcucgaggccgaguuccucgcccucgucggcggccagccccccgcccucgagaagcucaagggcaagggcccccuccccauggaggccaucgagaagauggccucccucugcaugcgcgaccccgacgaggacgaggaggagggcaccgacgaggacgaccucgaggccgacgacgaccuccucgccgagcucaacgagguccucggcgaggagcagaaggccuccgagacccccccccccgucgcccagcccaagcccgaggccccccaccccggccucgagaccacccuccaggagcgccucgcccucuaccagaccgccaucgaguccgcccgccaggccggcgacuccgccaagaugcgccgcuacgaccgcggccucaagacccucgagaaccuccucgccuccauccgcaagggcaacgccaucgacgaggccgacauccccccccccgucgccaucggcaagggccccgccuccacccccaccuacucccccgcccccacccagcccgccccccgcaucgccuccgcccccgagccccgcgucacccucgagggccccuccgccaccgcccccgccuccucccccggccucgccaagccccagaugccccccggccccugcucccccggcccccucgcccagcuccagucccgccagcgcgacuacaagcucgccgcccuccacgccaagcagcagggcgacaccaccgccgccgcccgccacuuccgcgucgccaaguccuucgacgccguccucgaggcccucucccgcggcgagcccgucgaccucuccugccucccccccccccccgaccagcucccccccgacccccccuccccccccucccagccccccacccccgccaccgcccccuccaccaccgagguccccccccccccccgcacccuccucgaggcccucgagcagcgcauggagcgcuaccaggucgccgccgcccaggccaaguccaagggcgaccagcgcaaggcccgcaugcacgagcgcaucgucaagcaguaccaggacgccauccgcgcccacaaggccggccgcgccgucgacgucgccgagcuccccgucccccccggcuucccccccauccagggccucgaggccaccaagcccacccagcagucccucgucggcguccucgagaccgccaugaagcucgccaaccaggacgagggccccgaggacgaggaggacgagguccccaagaagcagaacucccccgucgcccccaccgcccagcccaaggccccccccucccgcaccccccaguccggcuccgcccccaccgccaaggccccccccaaggccaccuccacccgcgcccagcagcagcucgccuuccucgagggccgcaagaagcagcuccuccaggccgcccuccgcgccaagcagaagaacgacgucgagggcgccaagaugcaccuccgccaggccaagggccucgagcccaugcucgaggccucccgcaacggccuccccgucgacaucaccaaggucccccccgcccccgucaacaaggacgacuucgcccucguccagcgccccggccccggccucucccaggaggccgcccgccgcuacggcgagcucaccaagcucauccgccagcagcacgagaugugccucaaccacuccaaccaguucacccagcucggcaacaucaccgagaccaccaaguucgagaagcucgccgaggacugcaagcgcuccauggacauccucaagcaggccuucguccgcggccuccccacccccaccgcccgcuucgagcagcgcaccuucuccgucaucaagaucuuccccgaccucuccuccaacgacaugcuccucuucaucgucaagggcaucaaccuccccaccccccccggccucucccccggcgaccucgacgucuucguccgcuucgacuuccccuaccccaacgucgaggaggcccagaaggacaagaccuccgucaucaagaacaccgacucccccgaguucaaggagcaguucaagcucugcaucaaccgcucccaccgcggcuuccgccgcgccauccagaccaagggcaucaaguucgaggucguccacaagggcggccucuucaagaccgaccgcguccucggcaccgcccagcucaagcucgacgcccucgagaucgccugcgagguccgcgagauccucgagguccucgacggccgccgccccaccggcggccgccucgaggucaugguccgcauccgcgagccccucaccgcccagcagcucgagaccaccaccgagcgcuggcucgucaucgaccccguccccgccgccguccccacccaggucgccggccccaagggcaaggccccccccguccccgcccccgcccgcgaguccggcaaccgcuccgcccgcccccuccacucccucuccguccucgccuucgaccaggagcgccucgagcgcaagauccucgcccuccgccaggcccgccgccccgucccccccgaggucgcccagcaguaccaggacaucaugcagcgcucccaguggcagcgcgcccagcucgagcagggcggcgucggcauccgccgcgaguacgccgcccagcucgagcgccagcuccaguucuacaccgaggccgcccgccgccucggcaacgacggcucccgcgacgccgccaaggaggcccucuaccgccgcaaccucgucgaguccgagcuccagcgccuccgccgcuga

SEQ ID NO: 40821 - RNA, 1806 nt, Artificial Sequence
  derived and/or modified sequence opt2 from CC2D1B__Homo_sapiens__XP_011539232
augaugcccggcccccgcccccgcaagggcccccaggcccgcggccagggcgucgccgccgccaagcagaugggccucuucauggaguucggccccgaggacaugcuccucggcauggacgaggccgaggacgacgaggaccucgaggccgagcuccucgcccucaccggcgaggcccagaccaccggcaagaagcccgcccccaagggccaggccccccuccccauggcccacaucgagaagcucgccgccgacugcaugcgcgacgucgaggaggaggaggaggaggagggccucgaggaggacgccgagcuccucaccgagcuccaggagguccucggcgucgacgaggagaccgagccccucgacggcgacgaggucgccgaccccggcggcuccgaggaggagaacggccucgaggacaccgagccccccguccagaccgccguccucaccgccuccgcccccgccgcccaggccggcgccucccagggccuccacgcccuccucgaggagcgcauccacaacuaccgcgaggccgccgccuccgccaaggaggccggcgaggccgccaaggcccgccgcugcgagcgcggccucaagacccucgagucccagcucgccuccguccgccgcggccgcaagaucaacgaggacgagauccccccccccgucgcccucggcaagcgcccccucgccccccaggagcccgccaaccgcucccccgagaccgacccccccgccccccccgcccucgaguccgacaaccccucccagcccgagaccucccuccccggcaucuccgcccagcccgucuccgaccucgaccccgacccccgcgcccuccucuccucccgccagcgcgaguacaaggucgccgcccucuccgccaagcgcgccggcgagcucgaccgcgcccgcgagcucaugcgcaucggcaagcgcuucggcgccguccucgaggcccucgagaagggccagcccgucgaccucuccgccaugccccccgcccccgaggaccucaagccccagcaggccucccaggcccccaccgcccccuccgucaucccccccgccgucgagcgcguccagcccgucauggcccccgacguccccgccacccccgucgcccccaccgagucccagaccguccucgacgcccuccagcagcgccucaacaaguaccgcgaggccggcauccaggcccgcuccggcggcgacgagcgcaaggcccgcaugcacgagcgcaucgccaagcaguaccaggacgccauccgcgcccaccgcgccggccgcaaggucaacuucgccgagcuccccgucccccccggcuucccccccauccccggccucgaguccaccaugggcgucgaggaggacgccgucgccgccacccucgccgccgccgagaagcucgccuccgccgaggacuccgcccccgccgacaaggacgaggacgagccccccggccaccuccagggcgagccccccgcccaggcccccgucgccaagaagcccgcccgccccaccguccccuccucccagcgccuccccgagccccgcgccuccuccuccaaggagucccccucccccuccguccgcgagcagcucgcccuccucgaggcccgcaagcuccaguaccagcgcgccgcccuccaggccaagcgcucccaggaccucgagcaggccaaggccuaccuccgcgucgccaaguggcucgaggcccagaucauccaggcccgcuccggccgccccgucgaccucuccaagggccccugcgaccucggccgcugccuccgccccuga

SEQ ID NO: 40822 - RNA, 4863 nt, Artificial Sequence
  derived and/or modified sequence opt2 from CC2D2A__Homo_sapiens__NP_001073991
augaacccccgcgaggagaaggucaagaucaucaccgaggaguucaucgagaacgacgaggacgccgacaugggccgccagaacaagaacuccaagguccgccgccagccccgcaagaagcagccccccaccgccguccccaaggagauggucuccgagaagucccaccucggcaacccccaggagcccguccaggaggagcccaagacccgccuccucuccaugaccguccgccgcggcccccgcucccucccccccauccccuccaccucccgcaccggcuucgccgaguucuccaugcgcggccgcaugcgcgagaagcuccaggccgcccgcuccaaggccgaguccgcccuccuccaggagauccccaccccccgcccccgccgccuccgcucccccuccaagaaggagcucgagaccgaguucggcaccgagcccggcaaggaggucgagcgcacccagcaggaggucgacucccaguccuacucccgcgucaaguuccacgacuccgcccgcaagaucaagcccaagccccaggucccccccggcuuccccuccgccgaggaggccuacaacuucuucaccuucaacuucgaccccgagcccgagggcuccgaggagaagcccaaggcccgccaccgcgccggcaccaaccaggaggaggaggagggcgaggaggaggagccccccgcccagggcggcggcaaggagauggacgaggaggagcuccucaacggcgacgacgccgaggacuuccuccucggccucgaccacgucgccgacgacuucgucgccguccgccccgccgacuacgaguccauccacgaccgccuccagauggagcgcgagaugcucuucauccccucccgccagaccguccccaccuacaagaagcuccccgagaacguccagccccgcuuccucgaggacgagggccucuacaccggcguccgccccgaggucgcccgcaccaaccagaacaucauggagaaccgccuccucaugcaggaccccgagcgccgcugguucggcgacgacggccgcauccucgcccuccccaaccccaucaagcccuuccccucccgcccccccguccucacccaggagcaguccaucaaggccgagcucgagacccucuacaagaaggccgucaaguacguccacuccucccagcacgucauccgcuccggcgacccccccggcaacuuccagcucgacaucgacaucuccggccucaucuucacccaccaccccugcuucucccgcgagcacguccucgccgccaagcucgcccagcucuacgaccaguaccucgcccgccaccagcgcaacaaggccaaguuccucaccgacaagcuccaggcccuccgcaacgccguccagaccggccucgaccccgagaagccccaccagucccucgacaccauccagaagaccaucaacgaguacaaguccgagauccgccagacccgcaaguuccgcgacgccgagcaggagaaggaccgcacccuccucaagaccaucaucaaggucuggaaggagaugaagucccuccgcgaguuccagcgcuucaccaacaccccccucaagcucguccuccgcaaggagaaggccgaccagaaggccgacgaggaggccuacgaggccgagauccaggccgagaucuccgagcuccucgaggagcacaccgaggaguacgcccagaagauggaggaguaccgcaccucccuccagcaguggaaggccuggcgcaagguccagcgcgccaagaagaagaagcgcaagcaggccgccgaggagcaccccggcgacgagaucgccgagcccuaccccgaggaggaccucgucaagcccuccccccccgagcccaccgaccgcgccgucaucgagcaggagguccgcgagcgcgccgcccagucccgccgccgccccugggagcccacccucguccccgagcucucccucgccggcuccgucacccccaacgaccagugcccccgcgccgaggucucccgccgcgaggacgucaagaagcgcuccgucuaccucaagguccucuucaacaacaaggaggucucccgcaccgucucccgcccccucggcgccgacuuccgcguccacuucggccagaucuucaaccuccagaucgucaacuggcccgagucccucacccuccaggucuacgagaccgucggccacuccucccccacccuccucgccgaggucuuccuccccauccccgagaccaccgucgucaccggccgcgcccccaccgaggaggucgaguucuccuccaaccagcacgucacccucgaccacgagggcgucggcuccggcguccccuucuccuucgaggccgacggcuccaaccagcucacccucaugaccuccggcaaggucucccacuccgucgccugggccaucggcgagaacggcaucccccucauccccccccucucccagcagaacaucggcuuccgcuccgcccucaagaaggccgacgccaucuccuccaucggcaccuccggccucaccgacaugaagaagcucgccaagugggccgccgaguccaagcucgaccccaacgaccccaacaacgccccccucaugcagcucaucuccgucgccaccuccggcgaguccuacguccccgacuucuuccgccucgagcagcuccagcaggaguucaacuucgucuccgaccaggagcucaaccgcuccaagcgcuuccgccuccuccaccuccgcucccaggagguccccgaguuccgcaacuacaagcagguccccgucuacgaccgcgagaucauggagaaggucuuccaggacuacgagaagcgccuccgcgaccgcaacgucaucgagaccaaggagcacaucgacacccaccgcgccaucgucgccaaguaccuccagcagguccgcgaguccgucaucaaccgcuuccucaucgccaagcaguacuuccuccucgccgacaugaucgucgaggaggagguccccaacaucuccauccucggccucucccucuucaagcucgccgagcagaagcgcccccuccgcccccgccgcaagggccgcaagaaggucaccgcccagaaccucuccgacggcgacaucaagcuccucgucaacaucguccgcgccuacgacauccccguccgcaagcccgccgucuccaaguuccagcagcccucccgcuccucccgcauguucuccgagaagcacgccgccucccccuccaccuacucccccacccacaacgccgacuacccccucggccagguccucguccgccccuucgucgaggucuccuuccagcgcaccgucugccacaccaccaccgccgagggccccaaccccuccuggaacgaggagcucgagcuccccuuccgcgcccccaacggcgacuacuccaccgccucccuccaguccgucaaggacgucgucuucaucaacaucuucgacgagguccuccacgacguccucgaggacgaccgcgagcgcggcuccggcauccacacccgcaucgagcgccacuggcucggcugcgucaagaugcccuucuccaccaucuacuuccaggcccgcaucgacggcaccuucaagaucgacaucccccccguccuccucggcuacuccaaggagcgcaacaugauccucgagcgcggcuucgacuccguccgcucccucuccgagggcuccuacaucacccucuucaucaccaucgagccccagcucguccccggcgaguccauccgcgagaaguucgagucccaggaggacgagaagcuccuccaggccaccgagaaguuccaggccgagugcgcccucaaguuccccaaccgccagugccucaccaccgucaucgacaucuccggcaagaccgucuucaucacccgcuaccucaagccccucaaccccccccaggagcuccucaacgucuaccccaacaaccuccaggccaccgccgagcucgucgcccgcuacgucucccucauccccuuccuccccgacaccgucuccuucggcggcaucugcgaccucugguccaccuccgaccaguuccucgaccuccucgccggcgacgaggaggagcacgccguccuccucugcaacuacuuccucucccucggcaagaaggccuggcuccucaugggcaacgccauccccgagggccccaccgccuacguccucaccugggagcagggccgcuaccucaucuggaaccccugcuccggccacuucuacggccaguucgacaccuucugcccccucaagaacgucggcugccucaucggccccgacaacaucugguucaacauccagcgcuacgaguccccccuccgcaucaacuucgacgucacccgccccaagcucuggaaguccuucuucucccgcucccuccccuaccccggccucuccuccguccagcccgaggagcucaucuaccagcgcuccgacaaggccgccgccgccgagcuccaggaccgcaucgagaagauccucaaggagaagaucauggacuggcgcccccgccaccucacccgcuggaaccgcuacugcaccuccacccuccgccacuuccucccccuccucgagaagucccagggcgaggacgucgaggacgaccaccgcgccgagcuccucaagcagcucggcgacuaccgcuucuccggcuucccccuccacaugcccuacuccgaggucaagccccucaucgacgccgucuacuccaccggcguccacaacaucgacguccccaacgucgaguucgcccucgccgucuacauccaccccuaccccaagaacguccucuccgucuggaucuacgucgccucccucauccgcaaccgcuga

SEQ ID NO: 40823 - RNA, 3408 nt, Artificial Sequence
  derived and/or modified sequence opt2 from CCAR1__Homo_sapiens__NP_001269889
auggcccaguucggcggccagaagaacccccccugggccacccaguucaccgccaccgccgucucccagcccgccgcccucggcguccagcagcccucccuccucggcgccucccccaccaucuacacccagcagaccgcccucgccgccgccggccucaccacccagacccccgccaacuaccagcucacccagaccgccgcccuccagcagcaggccgccgccgccgccgccgcccuccagcagcuccagcagccccagcagacccuccucacccagcccgccgucgcccuccccaccucccucucccucuccaccccccagcccaccgcccagaucaccgucuccuaccccaccccccgcuccucccagcagcagacccagccccagaagcagcgcgucuucaccggcgucgucaccaagcuccacgacaccuucggcuucgucgacgaggacgucuucuuccagcucuccgccgucaagggcaagaccccccaggucggcgaccgcguccucgucgaggccaccuacaaccccaacaugcccuucaaguggaacgcccagcgcauccagacccuccccaaccagaaccagucccagacccagccccuccucaagaccccccccgccguccuccagcccaucgccccccagaccaccuucggcguccagacccagccccagccccagucccuccuccaggcccagaucuccgccgccuccaucaccccccuccuccagacccagccccagccccuccuccagcagccccagcagaaggccggccuccuccagccccccguccgcaucgucucccagccccagcccgcccgccgccucgacccccccucccgcuucuccggccgcaacgaccgcggcgaccagguccccaaccgcaaggacgaccgcucccgcgagcgcgagcgcgagcgccgccgcucccgcgagcgcuccccccagcgcaagcgcucccgcgagcgcuccccccgccgcgagcgcgagcgcuccccccgccgcguccgccgcgucgucccccgcuacaccguccaguucuccaaguucucccucgacugccccuccugcgacaugauggagcuccgccgccgcuaccagaaccucuacauccccuccgacuucuucgacgcccaguucaccugggucgacgccuucccccucucccgccccuuccagcucggcaacuacugcaacuucuacgucaugcaccgcgaggucgagucccucgagaagaacauggccauccucgacccccccgacgccgaccaccucuacuccgccaaggucaugcucauggccucccccuccauggaggaccucuaccacaaguccugcgcccucgccgaggacccccaggagcuccgcgacggcuuccagcaccccgcccgccucgucaaguuccucgucggcaugaagggcaaggacgaggccauggccaucggcggccacuggucccccucccucgacggccccgaccccgagaaggaccccuccguccucaucaagaccgccauccgcugcugcaaggcccucaccggcaucgaccucuccgucugcacccagugguaccgcuucgccgagauccgcuaccaccgccccgaggagacccacaagggccgcaccguccccgcccacgucgagaccgucguccucuucuuccccgacgucuggcacugccuccccacccgcuccgagugggagacccucucccgcggcuacaagcagcagcucgucgagaagcuccagggcgagcgcaaggaggccgacggcgagcaggacgaggaggagaaggacgacggcgaggccaaggagaucuccacccccacccacugguccaagcucgaccccaagaccaugaaggucaacgaccuccgcaaggagcucgagucccgcgcccucuccuccaagggccucaagucccagcucaucgcccgccucaccaagcagcucaaggucgaggagcagaaggaggagcagaaggagcucgagaaguccgagaaggaggaggacgaggacgacgaccgcaaguccgaggacgacaaggaggaggaggagcgcaagcgccaggaggagaucgagcgccagcgccgcgagcgccgcuacauccuccccgacgagcccgccaucaucguccaccccaacugggccgccaaguccggcaaguucgacugcuccaucaugucccucuccguccuccucgacuaccgccucgaggacaacaaggagcacuccuucgaggucucccucuucgccgagcucuucaacgagaugcuccagcgcgacuucggcguccgcaucuacaagucccuccucucccuccccgagaaggaggacaagaaggagaaggacaagaaguccaagaaggacgagcgcaaggacaagaaggaggagcgcgacgacgagaccgacgagcccaagcccaagcgccgcaaguccggcgacgacaaggacaagaaggaggaccgcgacgagcgcaagaaggaggacaagcgcaaggacgacuccaaggacgacgacgagaccgaggaggacaacaaccaggacgaguacgaccccauggaggccgaggaggccgaggacgaggaggacgaccgcgacgaggaggagaugaccaagcgcgacgacaagcgcgacaucaaccgcuacugcaaggagcgccccuccaaggacaaggagaaggagaagacccagaugaucaccaucaaccgcgaccuccucauggccuucgucuacuucgaccagucccacugcggcuaccuccucgagaaggaccucgaggagauccucuacacccucggccuccaccucucccgcgcccaggucaagaagcuccucaacaaggucguccuccgcgaguccugcuucuaccgcaagcucaccgacaccuccaaggacgaggagaaccacgaggaguccgagucccuccaggaggacaugcucggcaaccgccuccuccuccccacccccaccgucaagcaggaguccaaggacgucgaggagaacgucggccucaucgucuacaacggcgccauggucgacgucggcucccuccuccagaagcucgagaaguccgagaagguccgcgccgaggucgagcagaagcuccagcuccucgaggagaagaccgacgaggacgagaagaccauccucaaccucgagaacuccaacaagucccucuccggcgagcuccgcgaggucaagaaggaccucucccagcuccaggagaaccucaagaucuccgagaacaugaaccuccaguucgagaaccagaugaacaagaccauccgcaaccucuccaccgucauggacgagauccacaccguccucaagaaggacaacgucaagaacgaggacaaggaccagaaguccaaggagaacggcgccuccgucuga

SEQ ID NO: 40824 - RNA, 2772 nt, Artificial Sequence
  derived and/or modified sequence opt2 from CCAR2__Homo_sapiens__NP_066997
augucccaguucaagcgccagcgcaucaacccccuccccggcggccgcaacuucuccggcaccgccuccaccucccuccucggccccccccccggccuccucaccccccccgucgccaccgagcucucccagaacgcccgccaccuccagggcggcgagaagcagcgcgucuucaccggcaucgucaccucccuccacgacuacuucggcgucgucgacgaggaggucuucuuccagcucuccgucgucaagggccgccucccccagcucggcgagaagguccucgucaaggccgccuacaaccccggccaggccguccccuggaacgccgucaagguccagacccucuccaaccagccccuccucaagucccccgcccccccccuccuccacgucgccgcccucggccagaagcagggcauccucggcgcccagccccagcucaucuuccagccccaccgcauccccccccucuucccccagaagccccucucccucuuccagaccucccacacccuccaccucucccaccucaaccgcuuccccgcccgcggcccccacggccgccucgaccagggccgcuccgacgacuacgacuccaagaagcgcaagcagcgcgccggcggcgagcccuggggcgccaagaagccccgccacgaccucccccccuaccgcguccaccucacccccuacaccgucgacucccccaucugcgacuuccucgagcuccagcgccgcuaccgcucccuccucguccccuccgacuuccucuccguccaccucuccuggcucuccgccuucccccucucccagcccuucucccuccaccaccccucccgcauccaggucuccuccgagaaggaggccgcccccgacgccggcgccgagcccaucaccgccgacuccgaccccgccuacuccuccaagguccuccuccucuccucccccggccucgaggagcucuaccgcugcugcaugcucuucgucgacgacauggccgagccccgcgagacccccgagcacccccucaagcagaucaaguuccuccucggccgcaaggaggaggaggccguccucgucggcggcgaguggucccccucccucgacggccucgacccccaggccgacccccagguccucguccgcaccgccauccgcugcgcccaggcccagaccggcaucgaccucuccggcugcaccaagugguggcgcuucgccgaguuccaguaccuccagcccggccccccccgccgccuccagaccgucgucgucuaccuccccgacgucuggaccaucaugcccacccucgaggagugggaggcccucugccagcagaaggccgccgaggccgccccccccacccaggaggcccagggcgagaccgagcccaccgagcaggcccccgacgcccucgagcaggccgccgacaccucccgccgcaacgccgagacccccgaggccaccacccagcaggagaccgacaccgaccuccccgaggcccccccccccccccucgagcccgccgucaucgcccgccccggcugcgucaaccucucccuccacggcaucgucgaggaccgccgccccaaggagcgcaucuccuucgaggucaugguccucgccgagcucuuccucgagaugcuccagcgcgacuucggcuaccgcgucuacaagaugcuccucucccuccccgagaaggucgucuccccccccgagcccgagaaggaggaggccgccaaggaggaggccaccaaggaggaggaggccaucaaggaggaggucgucaaggagcccaaggacgaggcccagaacgagggccccgccaccgaguccgaggccccccucaaggaggacggccuccuccccaagccccucuccuccggcggcgaggaggaggagaagccccgcggcgaggccuccgaggaccucugcgagauggcccucgaccccgagcuccuccuccuccgcgacgacggcgaggaggaguucgccggcgccaagcucgaggacuccgagguccgcuccgucgccuccaaccaguccgagauggaguucuccucccuccaggacaugcccaaggagcucgaccccuccgccguccucccccucgacugccuccucgccuucgucuucuucgacgccaacuggugcggcuaccuccaccgccgcgaccucgagcgcauccuccucacccucggcauccgccucuccgccgagcaggccaagcagcucgucucccgcgucgucacccagaacaucugccaguaccgcucccuccaguacucccgccaggagggccucgacggcggccuccccgaggagguccucuucggcaaccucgaccuccuccccccccccggcaaguccaccaagcccggcgccgcccccaccgagcacaaggcccucgucucccacaacggcucccucaucaacgucggcucccuccuccagcgcgccgagcagcaggacuccggccgccucuaccucgagaacaagauccacacccucgagcucaagcucgaggagucccacaaccgcuucuccgccaccgaggucaccaacaagacccucgccgccgagaugcaggagcuccgcguccgccucgccgaggccgaggagaccgcccgcaccgccgagcgccagaagucccagcuccagcgccuccuccaggagcuccgccgccgccucaccccccuccagcucgagauccagcgcgucgucgagaaggccgacuccugggucgagaaggaggagcccgcccccuccaacuga

SEQ ID NO: 40825 - RNA, 1221 nt, Artificial Sequence
  derived and/or modified sequence opt2 from CCBE1__Homo_sapiens__NP_597716
auggucccccccccccccucccgcggcggcgccgcccgcggccagcucggccgcucccucggcccccuccuccuccuccucgcccucggccacaccuggaccuaccgcgaggagcccgaggacggcgaccgcgagaucugcuccgaguccaagaucgccaccaccaaguaccccugccucaaguccuccggcgagcucaccaccugcuaccgcaagaagugcugcaagggcuacaaguucguccucggccagugcauccccgaggacuacgacgucugcgccgaggcccccugcgagcagcagugcaccgacaacuucggccgcguccucugcaccugcuaccccggcuaccgcuacgaccgcgagcgccaccgcaagcgcgagaagcccuacugccucgacaucgacgagugcgccuccuccaacggcacccucugcgcccacaucugcaucaacacccucggcuccuaccgcugcgagugccgcgagggcuacauccgcgaggacgacggcaagaccugcacccgcggcgacaaguaccccaacgacaccggccacgagaaguccgagaacauggucaaggccggcaccugcugcgccaccugcaaggaguucuaccagaugaagcagaccguccuccagcucaagcagaagaucgcccuccuccccaacaacgccgccgaccucggcaaguacaucaccggcgacaagguccucgccuccaacaccuaccuccccggcccccccggccuccccggcggccagggcccccccggcucccccggccccaagggcucccccggcuuccccggcaugcccggcccccccggccagcccggcccccgcggcuccaugggccccaugggccccucccccgaccucucccacaucaagcagggccgccgcggccccgucggcccccccggcgcccccggccgcgacggcuccaagggcgagcgcggcgcccccggcccccgcggcucccccggcccccccggcuccuucgacuuccuccuccucaugcucgccgacauccgcaacgacaucaccgagcuccaggagaaggucuucggccaccgcacccacuccuccgccgaggaguucccccucccccaggaguuccccuccuaccccgaggccauggaccucggcuccggcgacgaccacccccgccgcaccgagacccgcgaccuccgcgccccccgcgacuucuaccccuga

SEQ ID NO: 40826 - RNA, 1119 nt, Artificial Sequence
  derived and/or modified sequence opt2 from CCBL1__Homo_sapiens__NP_001116144
auggccaagcagcuccaggcccgccgccucgacggcaucgacuacaaccccugggucgaguucgucaagcucgccuccgagcacgacgucgucaaccucggccagggcuuccccgacuuccccccccccgacuucgccgucgaggccuuccagcacgccgucuccggcgacuucaugcucaaccaguacaccaagaccuucgucaucaucaucgagcccuucuucgacugcuacgagcccaugaccaugauggccggcggccgccccgucuucgucucccucaagcccggccccauccagaacggcgagcucggcuccuccuccaacuggcagcucgaccccauggagcucgccggcaaguucaccucccgcaccaaggcccucguccucaacacccccaacaacccccucggcaaggucuucucccgcgaggagcucgagcucgucgccucccucugccagcagcacgacgucgucugcaucaccgacgaggucuaccaguggauggucuacgacggccaccagcacaucuccaucgccucccuccccggcaugugggagcgcacccucaccaucggcuccgccggcaagaccuucuccgccaccggcuggaaggucggcuggguccucggccccgaccacaucaugaagcaccuccgcaccguccaccagaacuccgucuuccacugccccacccagucccaggccgccgucgccgaguccuucgagcgcgagcagcuccucuuccgccagcccuccuccuacuucguccaguucccccaggccaugcagcgcugccgcgaccacaugauccgcucccuccaguccgucggccucaagcccaucaucccccagggcuccuacuuccucaucaccgacaucuccgacuucaagcgcaagaugcccgaccuccccggcgccgucgacgagcccuacgaccgccgcuucgucaaguggaugaucaagaacaagggccucgucgccauccccgucuccaucuucuacuccgucccccaccagaagcacuucgaccacuacauccgcuucugcuucgucaaggacgaggccacccuccaggccauggacgagaagcuccgcaaguggaaggucgagcucuga

SEQ ID NO: 40827 - RNA, 882 nt, Artificial Sequence
  derived and/or modified sequence opt2 from CCDC101__Homo_sapiens__NP_612423
auggcccucgucuccgccgacucccgcaucgccgagcuccucaccgagcuccaccagcucaucaagcagacccaggaggagcgcucccgcuccgagcacaaccucgucaacauccagaagacccacgagcgcaugcagaccgagaacaagaucucccccuacuaccgcaccaagcuccgcggccucuacaccaccgccaaggccgacgccgaggccgagugcaacauccuccgcaaggcccucgacaagaucgccgagaucaagucccuccucgaggagcgccgcaucgccgccaagaucgccggccucuacaacgacuccgagcccccccgcaagaccaugcgccgcggcguccucaugacccuccuccagcaguccgccaugacccucccccucuggaucggcaagcccggcgacaagccccccccccucugcggcgccauccccgccuccggcgacuacgucgcccgccccggcgacaaggucgccgcccgcgucaaggccgucgacggcgacgagcaguggauccucgccgaggucgucuccuacucccacgccaccaacaaguacgaggucgacgacaucgacgaggagggcaaggagcgccacacccucucccgccgccgcgucaucccccucccccaguggaaggccaaccccgagaccgaccccgaggcccucuuccagaaggagcagcucguccucgcccucuacccccagaccaccugcuucuaccgcgcccucauccacgcccccccccagcgcccccaggacgacuacuccguccucuucgaggacaccuccuacgccgacggcuacucccccccccucaacgucgcccagcgcuacgucgucgccugcaaggagcccaagaagaaguga

SEQ ID NO: 40828 - RNA, 1542 nt, Artificial Sequence
  derived and/or modified sequence opt2 from CCDC102B__Homo_sapiens__NP_001087198
augaaccucgacuccauccaccgccucaucgaggagacccagaucuuccagaugcagcaguccuccaucaagucccgcggcgacauggucgcccccgccucccccccccgcgacaccugcaacaccugcuucccccuccacggccuccagucccacgccgcccacaacuucugcgcccacuccuacaacaccaacaagugggacaucugcgaggagcuccgccuccgcgagcucgaggaggucaaggcccgcgccgcccagauggagaagaccaugcgcuggugguccgacugcaccgccaacuggcgcgagaagugguccaagguccgcgccgagcgcaacuccgcccgcgaggagggccgccagcuccgcaucaagcucgagauggccaugaaggagcucuccacccucaagaagaagcagucccuccccccccagaaggaggcccucgaggccaacgucacccaggaccucaagcuccccggcuucgucgaggaguccugcgagcacaccgaccaguuccagcucuccucccagaugcacgaguccauccgcgaguaccucgucaagcgccaguucuccaccaaggaggacaccaacaacaaggagcagggcgucgucaucgacucccucaagcucuccgaggagaugaagcccaaccucgacggcgucgaccucuucaacaacggcggcuccggcaacggcgagaccaagaccggccuccgccucaaggccaucaaccucccccucgagaacgaggucaccgagaucuccgcccuccagguccaccucgacgaguuccagaagauccucuggaaggagcgcgagaugcgcaccgcccucgagaaggagaucgagcgccucgaguccgcccucucccucuggaaguggaaguacgaggagcucaaggaguccaagcccaagaacgucaaggaguucgacauccuccucggccagcacaacgacgagaugcaggagcucuccggcaacaucaaggaggaguccaagucccagaacuccaaggaccgcgucaucugcgagcuccgcgccgagcucgagcgccuccaggccgagaacaccuccgagugggacaagcgcgagauccucgagcgcgagaagcagggccucgagcgcgagaaccgccgccucaagauccaggucaaggagauggaggagcuccucgacaagaagaaccgccucuccgccaacucccagucccccgacuucaagaugucccagaucgaccuccaggagaagaaccaggagcuccucaaccuccagcacgccuacuacaagcucaaccgccaguaccaggccaacaucgccgagcucacccacgccaacaaccgcgucgaccagaacgaggccgaggucaagaagcuccgccuccgcgucgaggagcucaagcagggccucaaccagaaggaggacgagcucgacgacucccucaaccagauccgcaagcuccagcgcucccucgacgaggagaaggagcgcaacgagaaccucgagaccgagcuccgccaccuccagaacugguga

SEQ ID NO: 40829 - RNA, 297 nt, Artificial Sequence
  derived and/or modified sequence opt2 from CCDC103__Homo_sapiens__NP_001245326
auggagcgcaacgacaucaucaacuucaaggcccucgagaaggagcuccaggccgcccucaccgccgacgagaaguacaagcgcgagaacgccgccaagcuccgcgccgucgagcagcgcgucgccuccuacgaggaguuccgcggcaucguccucgccucccaccucaagccccucgagcgcaaggacaagaugggcggcaagcgcaccguccccuggaacugccacaccauccagggccgcaccuuccaggacgucgccaccgagaucucccccaacuccuggaaguccuccuga

SEQ ID NO: 40830 - RNA, 1500 nt, Artificial Sequence
  derived and/or modified sequence opt2 from CCDC105__Homo_sapiens__NP_775753
augcgcguccucgucccccccgccgagcgcucccaggacacccgcgucggcgcccccgccuggcgcgaggccgcccaggccauggcccgcaccgcccacauccucaccgaccgcugcggccaggaggccgucaccauguggcagcccaaggacuccguccucgaccccaacgucgcccaccaccucggccgcgccgccuacauccagcccuggcgcuuccgcgucgagaugaucaagggcggcggcacccucgagaagcccccccccggcgagggcgucacccucuggaagggcaagaugaagccccccgccugguacgcccgccucccccucccccuccaccgcaaggcccgcgcccuccagaccaccgaggucguccacgcccacgcccgcggcgcccgccucaccgccgcccgccucggccgcgcccagcaccagaucaacggccgcguccgccagcuccuccgccagcgcgaggucaccgaccaccgccucuccgagguccgcaagggccuccucaucaaccagcaguccgucaagcuccgcggcuaccgccccaaguccgagaagguccccgacaaggccgacuccaugcucaccugggagaaggaggagcucaaguccaugaagcgcaagauggagcgcgacauggagaaguccgagguccuccucaagacccucgccuccugccgcgacacccucaacuucugcuucaaggagcgccuccaggccgucgaccucaugaaccagccccucgacaagguccucgagcaggcccgccgccacuccugggucaaccucucccgcgcccccaccccccgcacccagggccagaagacccccccccccgaccccgucggcaccuacaaccccgccugcgcccucgcccucaacgaggccaagcgccuccucgucgaguccaaggacacccucgucgagauggccaagaacgaggucgacguccgcgagcagcagcuccagaucuccgaccgcgucugcgccucccucgcccagaaggccuccgagacccucgagcucaaggagcgccucaacaugacccucggccucaugcgcggcaccauccuccgcugcaccaaguacaaccaggagcucuacaccacccacggccucaucaagggcccccucuccaagguccaccucgagaccgccgagaagcucgaccgcccccucguccgcauguaccagcgccacgucggcacccagcuccccgaggccgcccgccucgcccagggcaccgacaagcuccagugccacaucaccuaccucgagaagaaccucgacgagcuccucgccacccacaagaaccucuccuggggccucaacugcaagaacaucggccacgaggucgacggcaacgucguccgccuccgccuccgccagcgccagccccacgucugcuacgagcaggcccagcgccucgucaaggacugggacccccgcaccccccccccccgcuccaaguccuccgccgaccccuga

SEQ ID NO: 40831 - RNA, 2355 nt, Artificial Sequence
  derived and/or modified sequence opt2 from CCDC108__Homo_sapiens__NP_001265224
auggagaccgccaucuggcgccgcuccuacaucucccucaucuccuccgagcgccccguccacaacuggcgcggcaaguccguccagaagaagcaggccgaguccaagucccagaucaagcuccacacccaguccgcccccuucggccucugccccaaggacaugaugcucacccaggcccccuccuccgucguccgcucccgcaacucccgcaaccacaccgucaacuccggcggcuccugccucuccgccuccaccgucgccauccccgccaucaacgacuccuccgccgccauguccgccugcuccaccaucuccgcccagcccgccuccuccauggacacccagaugcacucccccaagaagcaggagcgcgucaacaagcgcgucaucuggggcaucgaggucgccgaggagcuccacuggaagggcugggagcucggcaaggagaccacccgcaaccucguccucaagaaccgcucccucaagcuccagaagaugaaguaccgcccccccaagaccaaguucuucuucaccgucaucccccagcccaucuuccucucccccggcaucacccucacccuccccaucgucuuccgcccccucgaggccaaggaguacauggaccagcucugguucgagaaggccgagggcauguucugcgucggccuccgcgccacccuccccugccaccgccucaucugccgcccccccucccuccagcuccccaugugcgccgucggcgacaccaccgaggccuucuucugccucgacaacgucggcgaccuccccaccuucuucaccugggaguucuccucccccuuccagaugcuccccgccaccggccuccucgagcccggccaggccucccagaucaaggucaccuuccagccccucaccgccgucaucuacgagguccaggccaccugcugguacggcgccggcucccgccagcgcuccuccauccagcuccaggccgucgccaagugcgcccagcuccucgucuccaucaagcacaagugccccgaggaccaggacgccgagggcuuccagaagcuccucuacuucggcuccgucgccgucggcugcaccuccgagcgccagauccgccuccacaaccccuccgccgucaacgcccccuuccgcaucgagaucucccccgacgagcucgccgaggaccaggccuucuccugccccaccgcccacggcaucguccuccccggcgagaagaagugcgucuccgucuucuuccaccccaagacccucgacacccgcaccgucgacuacugcuccaucaugcccuccggcugcgccuccaagacccuccucaaggucgucggcuucugccgcggccccgccgucucccuccagcacuacugcgucaacuucuccugggucaaccucggcgagcgcuccgagcagccccucuggaucgagaaccaguccgacugcaccgcccacuuccaguucgccaucgacugccucgaguccgucuucaccauccgccccgccuucggcacccucgucggcaaggcccgcaugacccuccacugcgccuuccagcccacccaccccaucaucugcuuccgccgcgucgccugccucauccaccaccaggacccccucuuccucgaccucaugggcaccugccacuccgacuccaccaagcccgccauccucaagccccagcaccucaccugguaccgcacccaccucgcccgcggccucacccucuacccccccgacauccucgacgccaugcucaaggagaagaagcucgcccaggaccagaacggcgcccucaugauccccauccaggaccucgaggacaugcccgccccccaguaccccuacaucccccccaugaccgaguucuucuucgacggcaccuccgacaucaccaucuuccccccccccaucuccgucgagcccgucgaggucgacuucggcgccugccccggccccgaggcccccaaccccgucccccucugccucaugaaccacaccaagggcaagaucauggucgucuggacccgccgcuccgacugccccuucugggucacccccgaguccugcgacguccccccccucaaguccauggccaugcgccuccacuuccagcccccccaccccaacugccucuacaccgucgagcucgaggccuucgccaucuacaaggucugcgcccgcaacgagcgcgaggagugcggcgucuccgcccgcucccucuccggccucgucggcuggcaggaggucaccgagggcuccuuccgccuccacccccuccgcgcccgccucucccucggcuggaccgucacccccaugucccucuccccccccaagcuccucgccuga

SEQ ID NO: 40832 - RNA, 2013 nt, Artificial Sequence
  derived and/or modified sequence opt2 from CCDC114__Homo_sapiens__NP_653178
auggagggcgagcgccgcgccuacuccaaggagguccaccagcgcaucaacaagcagcucgaggagauccgccgccucgaggagguccgcggcgaccuccagguccagaucuccgccgcccagaaccaggucaagcgccuccgcgacucccagcgccucgagaacauggaccgccuccucaagggccgcgcccagguccaggccgagaucgaggagcuccaggagcagacccgcgcccucgacaagcagauccaggagugggagacccgcaucuucacccacuccaagaacguccgcucccccggcuucauccucgaccagaaggucaagauccgccgccgcauccgcauccucgagaaccagcucgaccgcgucaccugccacuucgacaaccagcucguccgcaacgccgcccuccgcgaggagcucgaccuccuccgcaucgaccgcaaccgcuaccucaacgucgaccgcaagcucaagaaggagauccaccaccuccaccaccucgucuccacccucauccucuccuccaccuccgccuacgccguccgcgaggaggccaaggccaagaugggccuccuccgcgagcgcgccgagaaggaggaggcccaguccgagauggaggcccagguccuccagcgccagauccuccaccucgagcagcuccaccacuuccucaagcucaagaacaacgaccgccagcccgaccccgacguccucgagaagcgcgagaagcaggccggcgaggucgccgagggcgucuggaagaccucccaggagcgccucguccucugcuacgaggacgcccucaacaagcucucccagcucaugggcgaguccgaccccgaccuccucguccagaaguaccucgagaucgaggagcgcaacuucgccgaguucaacuucaucaacgagcagaaccucgagcucgagcacguccaggaggagaucaaggagaugcaggaggcccucgucuccgcccgcgccuccaaggacgaccagcaccuccuccaggagcagcagcagaagguccuccagcagcgcauggacaagguccacuccgaggccgagcgccucgaggcccgcuuccaggacguccgcggccagcucgagaagcucaaggccgacauccagcuccucuucaccaaggcccacugcgacuccuccaugaucgacgaccuccucggcgucaagaccuccaugggcgaccgcgacaugggccucuuccucucccucaucgagaagcgccucgucgagcuccucaccguccaggccuuccuccacgcccaguccuucaccucccucgccgacgccgcccuccucguccucggccagucccucgaggaccuccccaagaagauggccccccuccagccccccgacacccucgaggacccccccggcuucgaggccuccgacgacuaccccaugucccgcgaggagcuccucucccaggucgagaagcucgucgagcuccaggagcaggccgaggcccagcgccagaaggaccucgccgccgccgccgccaagcucgacggcacccucuccgucgaccucgccuccacccagcgcgccggcuccuccaccguccucguccccacccgccacccccacgccauccccggcuccauccucucccacaagaccucccgcgaccgcggcucccucggccacgucaccuucggcggccucuccuccuccaccggccaccuccccucccacaucacccacggcgaccccaacaccggccacgucaccuucggcuccaccuccgccuccuccggcggccacgucaccuuccgccccgucuccgccuccuccuaccucggcuccaccggcuacgucggcuccucccgcggcggcgagaacaccgagggcggcgucgaguccggcggcaccgccuccgacuccuccggcggccucggcuccucccgcgaccacgucuccuccaccggccccgccuccuccaccggccccggcuccuccaccuccaaggacucccgcggcuga

SEQ ID NO: 40833 - RNA, 543 nt, Artificial Sequence
  derived and/or modified sequence opt2 from CCDC115__Homo_sapiens__NP_115733
auggccgcccucgaccuccgcgccgagcucgacucccucguccuccagcuccucggcgaccucgaggagcucgagggcaagcgcaccguccucaacgcccgcgucgaggagggcuggcucucccucgccaaggcccgcuacgccaugggcgccaaguccgucggcccccuccaguacgccucccacauggagccccaggucugccuccacgccuccgaggcccaggagggccuccagaaguucaaggucguccgcgccggcguccacgcccccgaggaggucggcccccgcgaggccggccuccgccgccgcaagggccccaccaagacccccgagcccgaguccuccgaggccccccaggacccccucaacugguucggcauccucgucccccacucccuccgccaggcccaggccuccuuccgcgacggccuccagcucgccgccgacaucgccucccuccagaaccgcaucgacuggggccgcucccagcuccgcggccuccaggagaagcucaagcagcucgagcccggcgccgccuga

SEQ ID NO: 40834 - RNA, 1323 nt, Artificial Sequence
  derived and/or modified sequence opt2 from CCDC121__Homo_sapiens__NP_001136155
augggcucccgcggccagggcucccacuccaagaagacccgcuccaugcccgucauccucuccccccagcgcaccggcuccggcgccaccggcggccccgccgcccgcgccuacuccgucgccgaggccgucaagcaguuccgcgccggccccgccggcaccggcgccggcugcucccuccagggcugcugggccgccccccgccccuucgagcaccgcaccaacaagcuccgcgagcucuccacccucgcccacugcucccgcgagcuccagacccagguccccgacgccuccgcccacucccucgccgucacccucuccgagcuccacuccugccgcgaccuccaggacgagugccucgacucccgcuucgccgagggcccccgccgccuccucccccccuaccacucccucaucaacaacuucgucaagcccgagaagcucaccaaggucgagacccgccucaaggagaagaucgucgccgagaugaccgaccucaacaagcacaucaagcaggcccagacccagcgcaagcagcuccucgaggagucccgcgagcuccaccgcgagaagcuccucguccaggccgagaaccgcuucuuccucgaguaccucaccaacaagaccgaggaguacaccgagcagcccgagaaggucuggaacuccuaccuccagaaguccggcgagaucgagcgccgccgccaggaguccgccucccgcuacgccgagcagaucuccguccucaagaccgcccuccuccagaaggagaacauccaguccucccucaagcgcaagcuccaggccaugcgcgacaucgccauccucaaggagaagcaggagaaggagauccagacccuccaggaggagaccaagaagguccaggccgagaccgccuccaagacccgcgagguccaggcccagcuccuccaggagaagcgccuccucgagaagcagcucuccgagcccgaccgccgccuccucggcaagcgcaagcgccgcgagcucaacaugaaggcccaggcccucaagcucgccgccaagcgcuucaucuucgaguacuccugcggcaucaaccgcgagaaccagcaguucaagaaggagcuccuccagcucaucgagcaggcccagaagcucaccgccacccagucccaccucgagaaccgcaagcagcagcuccagcaggagcagugguaccucgagucccucauccaggcccgccagcgccuccagggcucccacaaccagugccucaaccgccaggacguccccaagaccacccccucccucccccagggcaccaagucccgcaucaaccccaaguga

SEQ ID NO: 40835 - RNA, 822 nt, Artificial Sequence
  derived and/or modified sequence opt2 from CCDC122__Homo_sapiens__NP_659411
auguccgacaacaaggagcgcaagucccagggcuuccccaaggaggacaaccaggacaccuccucccucgccgacgccgucgagaaggucgccaagcagcagcagucccaggccuccgagaucgagaagaacaagaagguccucuucaaccucaagaacgagcuccacgagcucgagaaggagaucgccgccaucuccgccgagaccaaggagaccgagcgccagaucuaccagcaggacuccgccaucgagaacaccaagcuccacugcgacucccucgagacccagaucaagucccuccacuccgagaacgucaagcucaaguucgacaucgagaccgcccaggaggacuucgaggagcacaugaucaaguacaacgccuacuacgccaagaucaaggcccacaagaacucccucggcgaggucgaguccaagugguccuucaugaccgagcuccacgagaagcgcgacuucgucaagaagcucaagaccaugaaggaggagcucaugcaggaccuccagaaccccggcggcaaccgcaucacccagguccaggaggacaucaccaaccucaaggacaagaucaucaccgucaaggaguccaucaucgagaagaccugcuuccucgaggaggagaagaagacccacgagaagcuccgcaaggagaucgagguccagcacaagcgcuacgacgccauccucaagcgccuccacugccaggucaacaagcuccaguccaaccgccgccaguggcaguggaacauccagcagcucgagaagaccgccgccgagcuccgcaagugcaucggcaugcaggaguga

SEQ ID NO: 40836 - RNA, 3165 nt, Artificial Sequence
  derived and/or modified sequence opt2 from CCDC129__Homo_sapiens__NP_001244896
auguccgucucccuccagaacuacucccccaugauggcccagaagucccagggcuccgacaaccuccaggagggccaggagaaguccaagcgcgagauccucaagugcaccaaguccgccugggccccccucgacgaguggcucccccccgaccccgaggaggagucccagucccucaccauccccaugcucgaggacuccaagcaggaguccauccagcaguggcucgacuccggcuucuucgucuccgccaacgagaacuuccagcaggucaucgaccgcaccgucucccucuacgagcagggcaugguccagaugaccgucaaggacuacaugcgcucccuccaccaguucuccgagacccccauccucucccgcggcaccuccuucaacuccugcuacuccaccgccuccgucccccaguccauccccgaguggcucgaguucugggagaucgaccccgucgagauccuccucgaccucggcuucggcgccgacgagcccgacaucugcaugcagauccccgcccgcuuccucggcugcggcuccgccgcccgcggcaucaacauccgcgucuuccucgaggcccagaagcagcgcauggacaucgagaaccccaaccucuacggccgcuuccgccagcucgagauccucgaccacgucaccaacgccuucuccucccuccucuccgacgucuccauccuccccaaccgcgccgaggagaaggccggcggcgaguccguccagcgcaccuccgucuccgccgccaaggagcaccgccgccgcaugggcaagcuccuccgccgcgccuccaagcagaacauccgccgcgacugcaaccccgaggucuccgaguccuucaaggucaaggacgaggucuucguccccuucaccaagcccugggacugcggcgccgagcucgccgccaccuccaucaaccacaagcagaaccaccucucccucuccgucgagcaccagucccuccaggccugcgacgaccuccuccccuaccccccccacggccuccucuccaagcaguggcccugcuccuccaugcccgccaagcaggccccccccuccugcgucuccgagggcuccgucaagggccgcacccagaaggagaaccucuuccagaccaacaagcucaagucccucucccaccucgccggcaagggccccgacuccuucgagauggaggagguccaguccuucgaggaggagaccggcaacccccucgacaugaccuccggcaccgucggcgcccgcgucgaccgcgccaacuccugccaguccgacuccuccggcuuccucgaggagccccucgagccccucccccuccagaugcccucccuccccaacucccagucccccgccgagaacggcggccgcaagccccgcgaccagucccacucccucgucuccucccaggacugccagcucgaguccgacggccccgacuccaagucccgcgccuccauguccuucuccucccaggaggccaacgcccucgagcagcgcgccuccgucuccgucauggaggaggaguuccuccucgaggccauggagggcccccccgagcucuacauccccgacauggccugcgccaagaccaccacccgcggcgagugcccccgcaaggacucccaccucuggcagcuccuccccaugccccacgccgaguacgaggucacccgccccaccgccaccuccaaguacgaccacccccucggcuucauggucacccacgucaccgagaugcaggacuccuucguccgccccgagggcgccggcaagguccagucccaccacaacgagucccagcgcucccccggcaacgaccacacccaggacaaguuccuccacgucgacuccgaggccccccgcgaggaggaguccuccggcuucugcccccacaccaaccacucccuccucguccccgaguccuccucccagugcauccccaagcacuccgagaucacccccuacgccaccgaccucgcccagaccuccgagaagcucaucccccaccuccacaagcuccccggcgaccccgcccaggucaagucccgcuccggcacccucggccagauccuccccggcaccgaggccgagauggagaaccucccccucaacaccggcuccucccgcuccgucaugacccagauguccuccucccucgucuccgccgcccagcgcgccgucgcccucggcaccggcccccgcggcaccucccucgagugcaccgucugcgaccccgucaccgccaccgagacccgccucggcaccaaggcccgccagcucaacgacgccuccauccagaccuccgcccucuccaacaagacccucacccacggcccccagccccucaccaaguccgucucccucgacuccggcuucuccuccaucugccccaugggcaccugccacgccauccccgcccacugcugcaucugcugccaccaccacccccacugccacggcgagcgccagucccccggccccgagcccuccgucugccgccacugccucugcucccucaccggccaccaggaggcccaguucaugaccacccucaaggcccuccaggacaccaccguccgcgagcucugcuccugcaccguccacgagauggaggccaugaagaccaucugccaguccuuccgcgaguaccucgaggagaucgagcagcaccucaugggccagcaggcccucuucucccgcgacauguccgaggaggagcgcgaggaggccgagcagcuccagacccuccgcgaggcccuccgccagcaggucgccgagcucgaguuccagcucggcgaccgcgcccagcagauccgcgagggcauccuccuccagcucgagguccucaccgccgagccccccgagcacuacuccaaccuccaccaguacaacuggaucgaggaguccaacggccagaccuccugcuccaagauccaccccggcauggccccccgcaccgucuucccccccgacgacggccaggaggcccccugcuccggcggcacccagcucgccgccuucaccccccccacccucgagaacuccacccgcaugucccccuccuccuccgccugggccaagcucggccccaccccccucuccaacugccccgucggcgagaaggacgccgacgucuuccucuga

SEQ ID NO: 40837 - RNA, 1191 nt, Artificial Sequence
  derived and/or modified sequence opt2 from CCDC130__Homo_sapiens__NP_110445
augggcgagcgcaagggcgucaacaaguacuacccccccgacuucaaccccgagaagcacggcucccucaaccgcuaccacaacucccacccccuccgcgagcgcgcccgcaagcucucccagggcauccucaucauccgcuucgagaugcccuacaacaucuggugcgacggcugcaagaaccacaucggcaugggcguccgcuacaacgccgagaagaagaaggucggcaacuacuacaccacccccaucuaccgcuuccgcaugaagugccaccucugcgucaacuacaucgagaugcagaccgaccccgccaacugcgacuacgucaucgucuccggcgcccagcgcaaggaggagcgcugggacauggccgacaacgagcagguccucaccaccgagcacgagaagaagcagaagcucgagaccgacgccauguuccgccucgagcacggcgaggccgaccgcuccacccucaagaaggcccuccccacccucucccacauccaggaggcccaguccgccuggaaggacgacuucgcccucaacuccaugcuccgccgccgcuuccgcgagaagaagaaggccauccaggaggaggaggagcgcgaccaggcccuccaggccaaggccucccucaccaucccccucguccccgagaccgaggacgaccgcaagcucgccgcccuccucaaguuccacacccucgacuccuacgaggacaagcagaagcucaagcgcaccgagaucaucucccgcuccugguuccccuccgcccccggcuccgccuccuccuccaaggucuccggcguccucaagaagcucgcccagucccgccgcaccgcccucgccaccucccccaucaccgucggcgaccucggcaucguccgccgccgcucccgcgacguccccgaguccccccagcacgccgccgacacccccaaguccggcgagccccgcguccccgaggaggccgcccaggaccgccccaugucccccggcgacugcccccccgagaccaccgagacccccaagugcuccuccccccgcggccaggagggcucccgccaggacaagccccucucccccgccggcuccucccaggaggccgccgacacccccgacacccgccaccccugcucccucggcuccucccucgucgccgacuacuccgacuccgaguccgaguga

SEQ ID NO: 40838 - RNA, 351 nt, Artificial Sequence
  derived and/or modified sequence opt2 from CCDC134__Homo_sapiens__NP_001291726
auggaccuccuccaguuccucgccuuccucuucguccuccuccucuccggcaugggcgccaccggcacccuccgcaccucccucgaccccucccucgagaucuacaagaagauguucgaggucaagcgccgcgagcagcuccucgcccucaagaaccucgcccagcucaacgacauccaccagcaguacaagauccucgacgucaugcucaagggccucuucaaguucauccccuccaccgaccccuuccagaaggcccuccgcgaggaggagaagcgccgcaagaaggaggagaagcgcaaggagauccgcaagggcccccgcaucucccgcucccaguccgagcucuga

SEQ ID NO: 40839 - RNA, 1305 nt, Artificial Sequence
  derived and/or modified sequence opt2 from CCDC136__Homo_sapiens__NP_001188301
auggaggccggcgccggcgccggcgccggcgccgccggcugguccugccccggccccggccccaccgucaccacccucggcuccuacgaggccuccgagggcugcgagcgcaagaagggccagcgcuggggcucccucgagcgccgcggcaugcaggccauggagggcgagguccuccuccccgcccucuacgaggaggaggaggaggaggaggaggaggaggaggaggucgaggaggaggaggagcagguccagaagggcggcuccgucggcucccucuccgucaacaagcaccgcggccucucccucaccgagaccgagcucgaggagcuccgcgcccagguccuccagcucgucgccgagcucgaggagacccgcgagcucgccggccagcacgaggacgacucccucgagcuccagggccuccucgaggacgagcgccucgccuccgcccagcaggccgaggucuucaccaagcagauccagcagcuccagggcgagcuccgcucccuccgcgaggagaucucccuccucgagcacgagaaggaguccgagcucaaggagaucgagcaggagcuccaccucgcccaggccgagauccagucccuccgccaggccgccgaggacuccgccaccgagcacgaguccgacaucgccucccuccaggaggaccucugccgcaugcagaacgagcucgaggacauggagcgcauccgcggcgacuacgagauggagaucgccucccuccgcgccgagauggagaugaaguccuccgagcccuccgaggagcuccaggagcuccgcgagcgcuaccacuuccucaacgaggaguaccgcgcccuccaggaguccaacuccucccucaccggccagcucgccgaccucgaguccgagcgcacccagcgcgccaccgagcgcuggcuccagucccagacccucuccaugaccuccgccgagucccagaccuccgagauggacuuccucgagcccgaccccgagaugcagcuccuccgccagcagcuccgcgacgccgaggagcagaugcacggcaugaagaacaagugccaggagcucugcugcgagcucgaggagcuccagcaccaccgccaggucuccgaggaggagcagcgccgccuccagcgcgagcucaagugcgcccagaacgagguccuccgcuuccagaccucccacuccgucacccaguccucccccacccccaacccccccaucuucucccucccccucgucggccucgucgucaucuccgcccuccucuggugcuggugggccgagaccuccuccuga

SEQ ID NO: 40840 - RNA, 492 nt, Artificial Sequence
  derived and/or modified sequence opt2 from CCDC140__Homo_sapiens__NP_694583
augggcgacgagugcuccaaccccgaccuccucgccgagcccggcuccuccccccccugggaccacggcaaccagcgccaggaggccgccaacgaguccaacacccgcgucccccgcguccucaaggcccaccucggccccgagaccgcccagcccaccaagcgcuccaagcgcaaccgcuggcgccgccaguccugccagggccccucccccgcccgcuccggccaguuccucggcuccgccgaccucggccuccagcgcggcguccucaaguccgccgcccgcaccugccucuccgagaucuccaacuccacccgcgccucccccgaguccgcccaguccaccgaccccggccgcgccgcccgcccccgcacccgcacccuccccaccccccacuccuucaagaucggcgaggaggccgaggagaugaagaagaagaaggagcgcaagcgccgcaaggagcgcaagaaggagcgcaacuucaagaaguga

SEQ ID NO: 40841 - RNA, 4593 nt, Artificial Sequence
  derived and/or modified sequence opt2 from CCDC141__Homo_sapiens__NP_775919
auguccucccagggcucccccuccgucgcccucuccaccaccaccgucuccuccgucgccguccaggccggcgacuccaagaucgucaucgccgucaucaagugcggcaaguggguccagcuccagcucgccgagucccagcccaaccuccucgagaucggcuccucccaggacgagaccaagaagcuccuccacgaccacgagcuccuccucgccaagcucaaggcccucgaggaccgcgucugggagcuccuccaggaggccgacaagaccgccgaggagaacaaggaccagucccaggucuacgacgccauggccgagacccucggcgaggccugggccgcccucgucuccaugcucgagcgccgcaccgagcuccuccgccucaccuccgaguucuucgagaacgcccucgaguucgccaucaagaucgaccaggccgaggacuuccuccagaacacccacgaguucgaguccgccgagucccucaagucccuccuccagcuccacgagcaccacaccaaggagcuccucgagcgcucccucgcccuccucaacaagucccagcagcucaccgacuucaucgagaaguucaagugcgagggccccaacgucaaccccgagcucacccagggcgcccacuccuccugccucaaggucgaccgccuccucgagcuccuccaggaccgccgccgccagcucgacaaguaccucaagcagcaguggcaggagcucucccagguccuccagaucugccagugggaccagcaggagaaccaggucaccugcugguuccagaagaccauccgcaaccuccaggagcagucccucggcuccucccucuccgacaacgaggaccgcauccacaagcaggaggagcucaucaucaaggccaaggaguggaacuccgccgucgagaagcucaaguccgaggcccuccgcauccuccucuccaaggacuacgucgagaaggagcaccuccagcucucccaccagaagcucucccagcuccaggaggaguucggccagcucauggucgagcgcaacaccuggcucaagaaggccaacgaguucuucaacuccgccaacaaggccuucgacguccucggccgcgucgaggccuaccucaagcuccucaaguccgagggccucucccucgccguccucgccguccgccacgaggagcuccaccgcaagaucaaggacugcaccaccgacgcccuccagaagggccagacccucaucucccaggucgacuccugcuccucccaggucuccggcauccacgagaugaugggcugcaucaagcgccgcgucgaccaccucaccgagcagugcuccgcccacaaggaguacgcccucaagaagcagcagcucaccgccuccgucgagggcuaccuccgcaaggucgagauguccauccagaagaucucccccguccucuccaacgccauggacgucggcuccacccgcuccgaguccgagaagauccucaacaaguaccucgagcucgacauccaggccaaggagaccucccacgagcucgaggccgccgccaagaccaugauggagaagaacgaguucgucuccgacgagauggucucccucuccuccaaggcccgcuggcucgccgaggagcucaaccucuucggccaguccaucgacuaccgcucccagguccuccagaccuacgucgccuuccucaaguccuccgaggaggucgagaugcaguuccagucccucaaggaguucuacgagaccgagaucccccagaaggagcaggacgacgccaaggccaagcacugcuccgacuccgccgagaagcaguggcagcucuuccucaagaaguccuucaucacccaggaccucggccucgaguuccucaaccucaucaacauggccaaggagaacgagauccucgacgucaagaacgaggucuaccucaugaagaacaccauggagaaccagaaggccgagcgcgaggagcucucccuccuccgccucgccuggcagcucaaggccaccgaguccaagcccggcaagcagcagugggccgccuucaaggagcagcucaagaagaccucccacaaccucaagcuccuccaggaggcccucaugcccgucuccgcccucgaccucggcggcucccuccaguucauccucgaccuccgccagaaguggaacgacaugaagccccaguuccagcagcucaacgacgagguccaguacaucaugaaggaguccgaggagcucaccggccgcggcgcccccgucaaggagaagucccagcagcucaaggaccucauccacuuccaccagaagcagaaggagcgcauccaggacuacgaggacauccucuacaaggucguccaguuccaccaggucaaggaggagcucggccgccucaucaagucccgcgagcucgaguucgucgagcagcccaaggagcucggcgacgcccacgacguccagauccaccuccgcugcucccaggagaagcaggcccgcgucgaccaccuccaccgccucgcccucucccucggcgucgacaucaucuccuccguccagcgcccccacugcuccaacgucuccgccaagaaccuccagcagcagcucgagcuccucgaggaggacuccaugaaguggcgcgccaaggccgaggaguacggccgcacccucucccgcuccgucgaguacugcgccaugcgcgacgagaucaacgagcucaaggacuccuucaaggacaucaagaagaaguucaacaaccucaaguucaacuacaccaagaagaacgagaagucccgcaaccucaaggcccucaaguaccagauccagcaggucgacauguacgccgagaagaugcaggcccucaagcgcaagauggagaaggucuccaacaagaccuccgacuccuuccucaacuaccccuccgacaaggucaacguccuccucgaggucaugaaggaccuccagaagcacgucgacgacuucgacaaggucgucaccgacuacaagaagaaccucgaccucaccgagcacuuccaggaggucaucgaggagugccacuucugguacgaggacgccuccgccaccgucguccgcgucggcaaguacuccaccgagugcaagaccaaggaggccgucaagauccuccaccagcaguucaacaaguucaucgcccccuccgucccccagcaggaggagcgcauccaggaggccaccgaccucgcccagcaccucuacggccucgaggagggccagaaguacaucgagaagaucgucaccaagcacaaggagguccucgaguccgucaccgagcucugcgagucccucaccgagcucgaggagaagcucaagcagggcgacguccucaagaugaaccccaaccucgaggacuuccacuacgacuacaucgaccuccucaaggagcccgccaagaacaagcagaccaucuucaacgaggagcgcaacaagggccagguccaggucgccgaccuccucggcaucaacggcaccggcgaggagcgccucccccaggaccucaaggucuccaccgacaaggagggcggcguccaggaccuccuccuccccgaggacaugcucuccggcgaggaguacgagugcgucucccccgacgacaucucccuccccccccuccccggcucccccgaguccccccucgcccccuccgacauggaggucgaggagcccgucuccuccucccucucccuccacaucuccuccuacggcguccaggccggcaccuccucccccggcgacgcccaggaguccguccuccccccccccgucgccuucgccgacgccugcaacgacaagcgcgagaccuucuccucccacuucgagcgccccuaccuccaguucaaggccgagcccccccucaccucccgcggcuucgucgagaaguccaccgcccuccaccgcaucuccgccgagcaccccgaguccaugauguccgagguccacgagcgcgcccuccagcagcacccccaggcccagggcggccuccucgagacccgcgagaagaugcacgccgacaacaacuucaccaagacccaggaccgccuccacgccuccuccgacgccuucuccggccuccgcuuccaguccggcaccucccgcggcuaccagcgccagauggucccccgcgaggagaucaaguccaccuccgccaaguccuccgucgucucccucgccgaccaggcccccaacuucucccgccuccucuccaacgucaccgucauggagggcucccccgucacccucgaggucgaggucaccggcuuccccgagcccacccucaccugguacaagaagggccagaagcucuccgccgacggccaccuccagguccuccacaaggagacccgccacuccgucuucauccccaaggucugcaaggccgacgccggccucuacgucgcccgcgcccagaacuccuccggcgcccucuccuccaacgucauccuccacgucaccggcaacugccgccuccccaucacccgcgucaacuggaucacccucugcgucgucuacgucuccgucucccucauguacuggcuccucacccaguga

SEQ ID NO: 40842 - RNA, 1338 nt, Artificial Sequence
  derived and/or modified sequence opt2 from CCDC148__Homo_sapiens__NP_001288613
augaagcgcacccucgagaugaacgucuucgucacccuccagauccucgucgacuucgucaagaagcagcucaagaccgucuucgagcgccuccgccucgagcagcagcgcaucgagaacgaccucuccgacugguccaucaagauccucgaccacucccucgaggagaagaccaacccccucuccgagcuccccaucgagcucgagucccucgagugccccuaccccgaccucaaguccuccauccucuccgaguucuacaaguucacccagaaguaccagaagaagcuccaggacuucaaccuccagcucgaggacaucuaccgcaacugccagcucuccgaggaggaccacuggaucuaccaggccauccucgaccaguaccccggcgaccucuucggccgccgcacccucuaccucgacaugcuccagcgcuacuucccccacaagucccgccacgaccucgucgagcacgagaaguacugcgaccaguaccgcuucgccaucgagcagcagaacauccucaucuccaacuggaacaagaacaagaaggacuucauccagaaggccguccucacccucaccgaggccugcgccacccacgagauggaguccaugcucgccaaggacaagaagaagcagcaggagcucugcgccgaccucaaggccaagguccgccaguggcgcgcccaccaggaggaggucgcccgccucgagauggagaucuccgcccgccgccgcgagaaggaggaggagaaggagaagcucuggaagaagaaggagcuccuccagcgcgccgagaagaagaagaagaucaagaaguacugggccaagaagaagcagaaguggcaggagauggagaugcgcgaccuccagcgccucgaggagcucaagaagcucaucgccgagcagucccucaaggaccgcgagcgcgucaaguaccgccaggagcuccucgagcgccgccucauggagaagaaggaggucgcccuccaggaggcccacgaggacaaggagcgcgcccgccgccucgaggcccuccgcaagcaggucgccgucgucgcccaguucgaccccguccgcaugauguccgacaccauggccuccaaggcccgcaugggcaucgagaucgaggaggaguucauccuccagaagccccucuucacccucaacaccuacaacgagcagcagaucaucuccgacccccgccuccgcuucgagcucgcccuccgcgaggccggccuccaccgcacccucuacgccaaggagauccuccccaagaucuccccccagaagcccccccgcaaggacauggaguccaccgucuucaagaucuga

SEQ ID NO: 40843 - RNA, 1626 nt, Artificial Sequence
  derived and/or modified sequence opt2 from CCDC151__Homo_sapiens__NP_001289382
augcacccccccgucgcccccugcaagaagcuccgcugcccccccacccgcuccuucacccccacccgcggccgcuccaaggagggcgaccgcaaggccuucuucgaguccucccaguggaacaucaagaagaaccaggagaccaucucccagcuccgcaaggagaccaaggcccucgagcucaagcuccucgaccuccucaagggcgacgagaaggucguccaggccgucauccgcgaguggaagugggagaagcccuaccucaagaaccgcaccggccaggcccucgagcaccucgaccaccgccuccgcgagaaggucaagcagcagaacgcccuccgccaccaggucguccuccgccagcgccgccucgaggagcuccagcuccagcacucccuccgccuccucgagauggccgaggcccagaaccgccacaccgaggucgccaagaccaugcgcaaccucgagaaccgccucgagaaggcccagaugaaggcccaggaggccgagcacaucaccuccgucuaccuccagcucaaggccuaccucauggacgagucccucaaccucgagaaccgccucgacuccauggaggccgaggucguccgcaccaagcacgagcucgaggcccuccacgucgucaaccaggaggcccucaacgcccgcgacaucgccaagaaccagcuccaguaccucgaggagacccucguccgcgagcgcaagaagcgcgagcgcuacaucuccgagugcaagaagcgcgccgaggagaagaagcucgagaacgagcgcauggagcgcaagacccaccgcgagcaccuccuccuccaguccgacgacaccauccaggacucccuccacgccaaggaggaggagcuccgccagcgcugguccauguaccagauggaggucaucuucggcaaggucaaggacgccaccggcaccgacgagacccacucccucguccgccgcuuccucgcccagggcgacaccuucgcccagcucgagacccucaaguccgagaacgagcagacccucguccgccucaagcaggagaagcagcagcuccagcgcgagcucgaggaccucaaguacuccggcgaggccacccucgucucccagcagaagcuccaggccgaggcccaggagcgccucaagaaggaggagcgccgccacgccgaggccaaggaccagcucgagcgcgcccuccgcgccaugcaggucgccaaggacucccucgagcaccucgccuccaagcucauccacaucaccgucgaggacggccgcuucgccggcaaggagcucgacccccaggccgacaacuacguccccaaccuccucggccucgucgaggagaagcuccucaagcuccaggcccagcuccagggccacgacguccaggagaugcucugccacaucgccaaccgcgaguuccucgccucccucgagggccgccuccccgaguacaacacccgcaucgcccucccccucgccaccuccaaggacaaguucuucgacgaggaguccgaggaggaggacaacgaggucgucacccgcgccucccucaagauccgcucccagaagcucaucgagucccacaagaagcaccgccgcucccgccgcuccuga

SEQ ID NO: 40844 - RNA, 294 nt, Artificial Sequence
  derived and/or modified sequence opt2 from CCDC167__Homo_sapiens__NP_612502
augaccaagaagaagcgcgagaaccucggcgucgcccucgagaucgacggccucgaggagaagcucucccagugccgccgcgaccucgaggccgucaacucccgccuccacucccgcgagcucucccccgaggcccgccgcucccucgagaaggagaagaacucccucaugaacaaggccuccaacuacgagaaggagcucaaguuccuccgccaggagaaccgcaagaacaugcuccucuccgucgccaucuucauccuccucacccucgucuacgccuacuggaccauguga

SEQ ID NO: 40845 - RNA, 1509 nt, Artificial Sequence
  derived and/or modified sequence opt2 from CCDC169-SOHLH2__Homo_sapiens__NP_001185839
auggagacccuccaggagucccucaacacccuccucaagcagcucgaggaggagaagaagacccucgagucccaggucaaguacuacgcccucaagcucgagcaggaguccaaggccuaccagaagaucaacaacgagcgccgcaccuaccucgccgagaugucccagggcuccggccuccaccaggucuccaagcgccagcaggucgaccagcucccccgcaugcaggagaaccucgucaagacccuccuccucaaggaggagcucgacccccucaaggccaagaucgacauccuccucgucggcgacgucaccgucggcuaccucgccgacaccguccagaagcucuucgccaacaucgccgaggucaccaucaccaucuccgacaccaaggaggccgccgcccuccucgacgacugcaucuucaacaugguccuccucaagguccccuccucccucuccgccgaggagcucgaggccaucaagcucauccgcuucggcaagaagaagaacacccacucccucuucgucuucaucauccccgagaacuucaagggcugcaucuccggccacggcauggacaucgcccucaccgagccccucaccauggagaagauguccaacgucgucaaguacuggaccaccugccccuccaacaccgucaagaccgagaacgccaccggccccgaggagcucggccucccccuccagcgcuccuacuccgagcaccucggcuacuuccccaccgaccucuucgccugcuccgagucccuccgcaacggcaacggccucgagcucaacgccucccucuccgaguucgagaagaacaagaagaucucccuccuccacuccuccaaggagaagcuccgccgcgagcgcaucaaguacugcugcgagcagcuccgcacccuccuccccuacgucaagggccgcaagaacgacgccgccuccguccucgaggccaccgucgacuacgucaaguacauccgcgagaagaucucccccgccgucauggcccagaucaccgaggcccuccaguccaacaugcgcuucugcaagaagcagcagacccccaucgagcucucccuccccggcaccgucauggcccagcgcgagaacuccgucauguccaccuacucccccgagcgcggccuccaguuccucaccaacaccugcuggaacggcugcuccacccccgacgccgaguccucccucgacgaggccguccgcguccccuccuccuccgccuccgagaacgccaucggcgaccccuacaagacccacaucuccuccgccgcccucucccucaacucccuccacaccguccgcuacuacuccaaggucacccccuccuacgacgccaccgccgucaccaaccagaacaucuccauccaccuccccuccgccaugccccccgucuccaagcuccucccccgccacugcaccuccggccucggccagaccugcaccacccaccccaacugccuccagcaguucugggccuacuga

SEQ ID NO: 40846 - RNA, 2148 nt, Artificial Sequence
  derived and/or modified sequence opt2 from CCDC170__Homo_sapiens__NP_079335
augucccucgacugcaccucccacaucgcccucggcgccgccucccccgcccccgaggagaccuacgaccaccucuccgagguccccgucacccgcgagcagcucaaccacuaccgcaacgucgcccagaacgcccgcuccgagcucgccgccacccucgucaaguucgagugcgcccaguccgagcuccaggaccuccgcuccaagaugcucuccaaggaggucuccugccaggagcucaaggccgagauggaguccuacaaggagaacaacgcccgcaaguccucccuccucaccucccuccgcgaccgcguccaggagcucgaggaggaguccgccgcccucuccaccuccaagauccgcaccgagaucaccgcccacgccgccaucaaggagaaccaggagcucaagaagaaggucgucgagcucaacgagaagcuccagaagugcuccaaggagaacgaggagaacaagaagcaggucuccaagaacugccgcaagcacgaggaguuccucacccagcuccgcgacugccucgaccccgacgagcgcaacgacaaggccuccgacgaggaccucauccucaagcuccgcgaccuccgcaaggagaacgaguucgucaagggccagaucgucauccucgaggagaccaucaacguccacgagauggaggccaaggccucccgcgagaccaucaugcgccucgccuccgaggucaaccgcgagcagaagaaggccgccuccugcaccgaggagaaggagaagcucaaccaggaccuccucuccgccgucgaggccaaggaggcccucgagcgcgaggucaagaucuuccaggagcgccuccucgccggccagcaggucugggacgccuccaagcaggaggucucccuccucaagaaguccuccuccgagcucgagaagucccucaaggccucccaggacgccgucaccaccucccagucccaguacuucuccuuccgcgagaagaucgccgcccuccuccgcggccgccucuccaugaccggcuccaccgaggacaccauccucgagaagauccgcgagauggacucccgcgaggagucccgcgaccgcauggucucccagcucgaggcccagaucuccgagcucgucgagcagcucggcaaggaguccggcuuccaccagaaggcccuccagcgcgcccagaaggccgagaacaugcucgagacccuccagggccagcucacccaccucgaggccgagcucgucuccggcggcguccuccgcgacaaccucaacuucgagaagcagaaguaccucaaguuccucgaccagcucucccagaagaugaagcucgaccagauggccgccgagcucggcuucgacaugcgccucgacgucguccucgcccgcaccgagcagcucguccgccucgaguccaacgccgucaucgagaacaagaccaucgcccacaaccuccagcgcaagcucaagacccagaaggagcgccucgaguccaaggagcuccacaugucccuccuccgccagaagaucgcccagcucgaggaggagaagcaggcccgcaccgcccucgucgucgagcgcgacaacgcccaccucaccauccgcaaccuccagaagaaggucgagcgccuccagaaggagcucaacaccugccgcgaccuccacaccgagcucaaggccaagcucgccgacaccaacgagcucaagaucaagacccucgagcagaccaaggccaucgaggaccucaacaagucccgcgaccagcucgagaagaugaaggagaaggccgagaagaagcucauguccgucaaguccgagcucgacaccaccgagcacgaggccaaggagaacaaggagcgcgcccgcaacaugaucgaggucgucaccuccgagaugaagacccucaagaagucccucgaggaggccgagaagcgcgagaagcagcucgccgacuuccgcgaggucgucucccagaugcucggccucaacgucaccucccucgcccuccccgacuacgagaucaucaagugccucgagcgccucguccacucccaccagcaccacuucgucaccugcgccugccucaaggacgucaccaccggccaggagcgccacccccagggccaccuccagcuccuccacuga

SEQ ID NO: 40847 - RNA, 3981 nt, Artificial Sequence
  derived and/or modified sequence opt2 from CCDC171__Homo_sapiens__NP_775821
augaaccucaacaccuccuccaacaccggcgacacccagcgccucaagaucgccucccucgacgucaagcagauccucaagaacgagaccgagcucgacaucaccgacaaccuccgcaagaagcuccacugggccaagaaggagaagcucgagaucaccaccaagcacaacgccgagcucgccuccuacgagucccagaucgccaagcuccgcuccgaggucgagaagggcgaggcccuccgccagucccucgaguacgaccucgccgucgcccgcaaggaggccggccucggccgccgcgccgccgaggagcgccucgccgaggcccaccgcauccaggagaagcucugcgcccagaacuccgagcuccaggccaagaccaacgagaccgagaaggccuuccagaccucccagcagaaguggaaggaggagugccgccgcuucgagcacgaccucgaggagcgcgacaacaugauccagaacugcaaccgcgaguacgaccuccucaugaaggagaagucccgccucgagaagacccuccaggaggcccucgagaagcaccagcgcgagaagaacgagauggagucccacauccgcgagaccgcccucgaggaguuccgccuccaggaggagcagugggaggccgagcgccgcgagcuccaguucaucguccaggagcaggacaccgccguccagaacaugcacaagaaggucgagaagcucgagaccgagcacauggacugcuccgaccuccuccgccgccagaccuccgagcucgaguucuccacccagcgcgaggagcgccuccgcaaggaguucgaggccaccacccuccgcguccgcaagcucgaggagaacaucgaggccgagcgcgccgcccaccucgaguccaaguucaacuccgagaucauccagcuccgcauccgcgaccucgagggcgcccuccaggucgagaaggccucccaggccgaggccgucgccgaccucgagaucaucaagaacgaguucaaggaggucgaguccgccuacgagcgcgagaagcacaacgcccaggaguccuucgccaagcucaaccuccucgagaaggaguacuucuccaagaacaagaagcucaacgaggacaucgaggagcagaagaaggucaucaucgaccucuccaagcgccuccaguacaacgagaaguccugcuccgagcuccaggaggagcucgucauggccaagaagcaccaggccuuccucgucgagaccugcgagaacaacgucaaggagcucgaguccauccucgacuccuucaccgucuccggccaguggaccuccggcauccacaaggacaaggacaagccccccuccuucuccgucguccucgagcgccuccgccgcacccucaccgacuaccagaacaagcucgaggacgccuccaacgaggagaaggccugcaacgagcucgacuccaccaagcagaagaucgacucccacaccaagaacaucaaggagcuccaggacaagcucgccgacgucaacaaggagcucucccaccuccacaccaagugcgccgaccgcgaggcccucaucuccacccucaaggucgagcuccagaacguccuccacugcugggagaaggagaaggcccaggccgcccaguccgaguccgagcuccagaagcucucccaggccuuccacaaggacgccgaggagaagcucaccuuccuccacacccucuaccagcaccucgucgccggcugcguccucaucaagcagcccgagggcaugcucgacaaguucuccugguccgagcucugcgccguccuccaggagaacgucgacgcccucaucgccgaccucaaccgcgccaacgagaagauccgccaccucgaguacaucugcaagaacaaguccgacaccaugcgcgagcuccagcagacccaggaggacaccuucaccaaggucgccgagcagaucaaggcccaggaguccugcuggcaccgccagaagaaggagcucgagcuccaguacuccgagcucuuccucgagguccagaagcgcgcccagaaguuccaggagaucgccgagaagaacauggagaagcucaaccacaucgagaagucccacgagcagcucguccucgagaacucccacuucaagaagcuccucucccagacccagcgcgagcagaugucccuccucgccgccugcgcccucauggccggcgcccucuacccccucuacucccgcuccugcgcccucuccacccagcgcgacuuccuccaggagcaggucaacaccuucgagcucuucaagcucgagauccgcacccucgcccaggcccucuccaccgucgaggagaagaagcaggaggaggccaagaugaagaagaagaccuucaagggccucauccgcaucuuccgcaagggcgucaucgccguccucgccgccaaccgccucaagauccucggccaguccugcgccucccucuucaccuggauggaguccuucaaggagggcaucggcaugcucgucugcaccggcgagccccaggacaagcacaaguuccccaagcaccagaaggagcagcuccgcugccuccaggcccucuccuggcucaccuccuccgaccuccucgccgccaucaucuccuccauggccgagcuccaggacgucaucggcaaggccgaccccaacucccgcaucugcggccaccuccucaucggcgccgccaagaacuccuucgccaagcucauggacaagaucucccucgucauggagugcaucccccuccacuccucccgcuccaucaccuacgucgagaaggacucccucguccagcgccucgcccacggccuccacaaggucaacacccucgcccucaaguacggccuccgcggccacguccccaucaccaaguccaccgccucccuccagaagcagauccucggcuucacccagcgccuccacgccgccgaggucgagcgccgcucccuccgccucgaggucaccgaguucaagcgcuccgucaacgagaugaagaaggagcucgacaaggcccagggccuccagaugcagcucaacgaguucaagcaguccaagcucaucacccacgagaaguucgaguccgccugcgaggagcucaacaacgcccuccuccgcgaggagcaggcccagaugcuccucaacgagcaggcccagcagcuccaggagcucaacuacaagcucgagcuccacuccuccgaggaggccgacaagaaccagacccucggcgaggccgucaagucccucuccgaggccaagauggagcuccgccgcaaggaccagucccuccgccagcucaaccgccaccucacccagcucgagcaggacaagcgccgccucgaggagaacauccacgacgccgaguccgcccuccgcauggccgccaaggacaaggagugcgucgccaaccacaugcgcgccgucgagaacacccuccacaagguccgcgaccagaucucccucuccugguccgccgccucccgcaacgacuucacccuccagcuccccaagcuccaccucgagaccuucgccauggagggccucaagggcggccccgaggucgucgccugccaggccaugaucaaguccuucauggacgucuaccagcucgccuccacccgcaucaugacccucgagaaggagaugaccucccaccgcucccacaucgccgcccucaaguccgagcuccacaccgccugccuccgcgagaacgccucccuccaguccaucggcucccgcgaccacuccaaccucuccauccccucccgcgccccccuccccgccgacaccaccggcaucggcgacuuccucccccucaaggccgagcucgacaccaccuacaccuuccucaaggagaccuucaucaacaccgucccccacgcccucaccuccucccacuccucccccgucaccauguccgccaacgccaaccgccccacccagaucggccucuga

SEQ ID NO: 40848 - RNA, 2382 nt, Artificial Sequence
  derived and/or modified sequence opt2 from CCDC175__Homo_sapiens__NP_001157871
auggcccucucccccuggacccccggccucggcgccggcgagaagcucguccaggccgccgccgucuccaccggccccucccucgagcucugcacccuccccuccacccucggcuccuccgucgccgucgaggcccucgagcagcucuucgucgucgagcagucccuccaguccgacuacuucaagugcaacgaggaggccaagaucuuccucaaggacaucgccgucgccgucaagaagcucgaggagaugcgcaaggccaccaucgaccuccucgagaucgaguccauggagcucaacaagcucuacuaccuccucgagacccuccccaacuccaucaagcgcgagcucgaggagugcguccgcgacgcccgccgccucaaccucuucgagaucaacaccaucaagaugcgcaucacccgcaccgagaacgagaucgagcuccucaagaagaagaucaccgaccucaccaaguacaacgaggcccucggcgagaagcaggaggagcucgcccgcaagcacgcccgcuucguccucucccucaaccagaccauggagaagaaggccaccaccaccgucuacaucaacgagaccuacaccaagaucaaccucaagcgcgaggacaucgcccuccagaagaagugcauccaggaggccgaggagcucauggagaaggagcgcgccgaguaccucauccgcaagcaggagcucaccgcccagaucaacgaguucgagaacacccgcgaggucaagcgcauggagaccuaccagaagaagaaggagcucgacaagcuccagaccaagauguccaagaucaaggagaccgucaccgucuccgccgccguccucuccgaccacaaccucgagaucgcccgccuccacgaguccauccgcuacugggagcaggaggucuccgagcucaagaaggaccucgccauccucgaggccaagcucugcuucuucaccgacaacaaggagaagcucgacgacaucuccaacgacgagaagaacgaguuccucaacaagaucaagcagcucgucgagacccuccacgccgcccgcauggaguacaaggaccuccgcgagaagaugaagacccucgcccgccaguacaagaucguccucuccgaggaggagaaggccuuccuccagaagcagaagauccacgacgagaaccagaagcagcucaccuucaucucccagaaggaguacuuccucucccagaagcgcgucgacaucaagaacauggaggagggccucaucacccuccaggagcuccagcaggccaccaagaccgucuaccagcagcagaucaagauccucuccgccaaccucgagcgcgagucccagcgcugcgucaucacccaguggaagauggccugccuccgcaagaagcacgcccgcuggaccgccaagaucaaggccgagauccaggccaucaccgagaagauccagaacgccgagguccgccgcaucgagcuccucaacgagaccuccuuccgccagcaggagaucuccggcuucgucgcccagaucgagaagcucaccaccgagcucaaggaggaggagaaggccuucgucaacaaggagaagaugcucaugaaggagcucuccaaguacgaggagaucuucgucaaggagacccagaucaacaaggagaaggaggaggagcucgucgaguaccucccccagcuccaggucgccgagcaggaguacaaggagaagcgccgcaagcucgaggagcucuccaacaucaucaccgcccagcgccaggaggaggaccuccucaacaaccacaucuuccucuucacccgcgacuucucccgcuacaucuccaacauggaggacgucaagcaggagcuccagcagcuccgcgaccaggaguccaagaagaacaaggaccacuucgagacccucaagaaccucgagaacggcuucuacaucaacgaccagaaggccgaccuccuccuccucgagaacaagaagcucaaggaguacauccucuaccucaagaacaacaucgagaaguaccgcgagggccaggaggcccucaugcacaccuccuccgaccucucccgccagcucaucgcccaggaggcccaguacaaggaccucugggccgaguuccagaccaccgucaagauccucgucgacaacggcgaggagacccuccaggacaucaacaaccucaccgacaagcuccgcgagcgcgacgagaagaugcagcacgucuccaccuggcuccgcggcucccucgagggccuccgccuccucgucgagcaggagucccccauggaccuccucaagaagaagaagcacauccgcacccgcguccacuuccccgucgucaagugcaccgagaagaacacccucaccaaguga

SEQ ID NO: 40849 - RNA, 1590 nt, Artificial Sequence
  derived and/or modified sequence opt2 from CCDC176__Homo_sapiens__NP_079333
augcccuccaagggcaaggacaagaagaagggcaaguccaagggcaaggacaccaagaagcucaucaagaccgacgaguccgucgucgaccgcgccaaggccaacgccucccucugggaggcccgccucgaggucaccgagcucucccgcaucaaguaccgcgacaccucccgcauccucgccaaguccaacgaggaccucaagaagaagcagugcaagauggagaaggacaucauguccguccucuccuaccucaagaagcaggaccaggagaaggacaacaugaucgagaagcucaagcagcagcucaacgagaccaaggagaaggcccaggaggagaaggacaagcucgagcagaaguacacccgccagaucaacgagcucgagggccaguuccaccagaaggccaaggagaucggcaugauccacaccgagcucaaggccguccgccaguuccagaagcgcaagauccaggucgagcgcgagcucgacgaccucaaggagaaccuccgcaacaccgagcgcauccaccaggagacccuccgccgccucgagucccgcuucuucgaggagaagcaccgccucgagcaggaggccgagaagaagaucaucaugcucgccgagcgcgcccaccacgaggccaucguccagcucaacgacgccggccgcaacgucuucaaggagaacgacuaccuccagaaggcccucgccuaccaccucaaggagaccgacgcccuccagaagaacucccagaagcuccaggagucccacacccuccuccuccaccagaaggagaucaacgaccuccucgucaaggagaagaucaugcagcucguccagcagcgcucccagauccagacccuccagaagaaggucgucaaccucgagaccgcccucuccuacaugaccaaggaguucgaguccgagguccucaagcuccagcagcacgccaugaucgagaaccaggccggccaggucgagaucgacaagcuccagcaccuccuccagaugaaggaccgcgagaugaaccgcgucaagaagcucgccaagaacauccucgacgagcgcaccgaggucgagcgcuucuuccucgacgcccuccaccaggucaagcagcagauccucaucucccgcaagcacuacaagcagaucgcccaggccgccuucaaccucaagaugcgcgccgccugcaccggccgcaccgaguaccccaagauccgcaccuucgacggccgcgagcacuccaccaacuccgucaaccaggaccuccucgaggccgagaaguggacccacaucgagggcaacgucgacaucggcgaccucaccugggagcagaaggagaagguccuccgccuccucuucgccaagaugaacggcugccccucccgcaaguacaaccaguccucccgcccccccguccccgacuacgucgucuccgacuccggcgagaccaaggaguucggcgacgaguccaagcuccaggacaagaucuucaucacccagcagaucgccaucuccgacuccuccggcgaggucguccuccccaccauccccaaggagccccaggaguccgacaccggcaccuucuga

SEQ ID NO: 40850 - RNA, 2604 nt, Artificial Sequence
  derived and/or modified sequence opt2 from CCDC178__Homo_sapiens__NP_001098998
augaccgagaacaagaccgucuccuccuccuccacccgcgacgaccagaccaacaucggccucaccugccaggaggucaaggcccuccgcgagaaggccuggucccgcaccaacgagggcaacgccaugucccagucccucguccucuacggcgccuccaaggagaacuccgagggcuuccacgaguccaagaugaccaacaccgagggcgucaacaagggcaucuacuucuccuaccccugccgccgccacuccugcgccgucgucaacauccccgcccccugcgucaacaagaugaucucccacauccaggacgucgaguccaagauccaggagcaccucaagcgcuucgagaccuccuucgaggaguggucccgcaccuccuccaccaaggaccucaaggaggacugguccgucaccacccccgucaaggaggucaagcccggcgagaagcgcgacgagaagugccccgagcucaagcaggagauggagacccuccucuccgaggccauccgccucaucaagucccucgagaccgaccgcgccgacgccgaggaggcccucaagcagcagcgcucccgcaagaacaugaucaacaugaagaucgacuccugguccgucuggaagcuccaggagcucccccucgccguccagaaggagcacgaggccuaccucuccgacgucaucgagcuccaguggcaccucgaggacaaggccaaccagcuccagcacuucgagaagcagaagaccgagcucgaggaggccaacgccaagauccaggccgacaucgacuacaugaacgagcacggcccccuccucgacuccaagcagaaccaggagcuccaggaccucaagaaccacuacaagaagaagauggaggucauggaccuccaccgcaaggucaacgaggagcucgaggaggcccucgaggccugcgagaacgcccgccucaaggcccagcagaucaaggaggagaucgacaaggacaucuaccaggacgagaagaccaucgaggccuacaagcgcgagaucuaccagcucaacucccucuucgaccacuacuccuccuccgucaucaacgucaacaccaacaucgaggagaaggaggaggaggucaccgaggccauccgcgagaccaaguccuccaagaacgagcuccacucccucuccaagaugcucgaggaccuccgccgcgucuacgaccagcucaccuggaagcagaagucccacgagaaccaguaccucgaggccgucaacgacuucuacgccgccaagaagaccugggacaucgagcucuccgacgucgccaaggacuucuccgccaucucccucgccugcaccaagcucaccgaggacaacaagaagcucgagaucgacaucaacaagaucaccgucaagaccaacgaguccauccgcaagaaguccaaguacgaguccgagaucaaguaccucaccaucaugaagcucaagaacgacaagcaccucaagaacaucuacaaggaggccuaccgcaucggcacccucuuccaccucaccaagcacaagaccgacgagauggaggacaagaucgccgagguccgccgcaaguucaagggccgcgaggaguuccucaagaagcucacccagggcgaggucgccgccggcaugguccuccagaagaagcucuacuccaucuacgagguccaggcccucgagcgcaaggagcucaucaagaaccgcgccaucugcgccaugucccucgccgagcuccaggagccccuccuccagcucgaggacgaggccgagcgcauccgcucccucgacaaggagcacuccgucaugcucaacaacaucaucgaccagaaggaccucauccgccgcaaggucggcaaggucaagaagaagcuccgcaagaagggcaagaagacccucgacgcccucaucgagaccgaguccaagcgcuccgccaucuucaaggaccucgaggccaccaaguccaagaccaugaucuucuacgccaagaucaacgagcucaacgaggagcucaaggccaaggaggaggagaagaaguccuucgaccagacccucgagauccucaagaacaaguucaucaccaugcgcuucaagcgcgagcacgcccagaccgucuucgaccacuacaugcaggagaagaaggacugcgaggagcgcaucuucgaggaggaccagcgcuuccgcguccuccucgccguccgccagaagacccuccaggacacccagaagaucaucgccgacucccucgaggagaaccuccgccucgcccaggaguaccagcagcuccagaucaccuuccucaaggagaaggacaacuacuucaacaucuacgacaagcagcucucccucgacaccuccauccgcgacaagaagcagcucugccagcuccagcgccgcaugcacacccucuggcaggagcacuucaagcucgucguccucuucucccagaugcgccucgccaacuuccagaccgacucccaggaguccauccagaagauccucgccguccaggaggaguccuccaaccucaugcagcacauccucggcuucuuccagacccucaccgacggcaccugcgagaacgacggcuga

SEQ ID NO: 40851 - RNA, 5106 nt, Artificial Sequence
  derived and/or modified sequence opt2 from CCDC180__Homo_sapiens__NP_065944
augcgcggcggcgagaaccgcccccccgcccgcguccaguccuccuccgaggagcucgagcuccgccaccagucccucgacgccuuccccggccgccgccuccccggccgcggcauccagcccgccgccaagauguccuccgucggcaaggucacccagguccccaacggcaaggccuaccagcagaucuuccaggccgagguccagcucguccacucccucgccgccacccgcaagcgcgccgccgagcgcuccgucacccucaaguccggccgcauccccaugaugaagaaggucgagacccccgagggcgaggucauguccccccgccagcagaaguggaugcacucccuccccaacgacuggaucauggagaaccccguccuccaccgcgagaaggagcgcgccaagcgcgagaaggcccgcgaguccgagaacaccaucgccgcccgcgagguccgcggccucauggacaccaucguccccgagaagaucuccaccuccaccuuccagcgccaggccgagcacaagcgcaaguccuacgaguccgcccucgccuccuuccaggaggagaucgcccaggucggcaaggagauggagccccucaucgucgacaccggcggccucuuccucaagaagcucaccgaguccgacgaggagaugaaccgccucuuccucaaggucgagaacgacaccaaccucgaggacuacaccauccaggcccuccucgagcucugggacaaggucgccggccgccuccuccuccgcaagcaggagaucaaggagcucgacgaggcccuccacucccucgaguucucccgcaccgacaagcucaaguccguccucaagaaguacgccgaggucaucgagaagaccuccuaccucaugcgccccgaggucuaccgccucaucaacgaggaggccauggucaugaacuacgcccuccucggcaaccgcaaggcccucgcccagcucuucgucaaccucauggaguccacccuccagcaggagcucgacucccgccaccgcuggcagggccucgucgacaccuggaaggcccucaagaaggaggcccuccuccaguccuucuccgaguucauggccuccgaguccauccacaccccccccgccgucaccaaggagcucgaggucaugcucaagacccagaacguccuccagcagcgccgccucaagcaccucugcaccaucugcgaccuccucccccccuccuacuccaagacccagcucaccgaguggcacuccucccucaacucccucaacaaggagcucgacaccuaccacgucgacugcaugaugcgcauccgccuccucuacgagaagaccuggcaggagugccucaugcacguccagaacugcaagaagcagcuccucgacuggaaggccuucaccgaggaggaggccgagacccucgucaaccaguucuucuuccagauggucggcgcccuccagggcaaggucgaggaggaccucgagcuccucgacaaguccuucgagacccucgccgaccagaccgaguggcaguccucccaccucuucaaguacuuccaggaggucguccagcucugggaggcccaccaguccgagcuccucguccaggagcucgagcucgagaagcgcauggagcagcaccgccagaagcacucccucgagucccagguccaggaggcccaccucgaccgccuccucgaccagcuccgccagcaguccgacaaggagacccucgccuuccaccucgagaaggucaaggacuaccucaagaacaugaagucccgcuacgagugcuuccacacccuccucaccaaggaggucauggaguaccccgccaucaugcucaaggagcucaacuccuacuccuccgcccucucccaguacuucuucguccgcgagaucuucgagcagaaccucgccggcgaggucaucuucaaguuccgccagcccgaggcccacgagaagcccucccagaagcgcgucaagaagcuccgcaagaagcagggcuccaaggaggacaugacccgcuccgaggaguccaucuccuccggcaccuccaccgcccgcuccgucgaggaggucgaggaggagaacgaccaggagauggaguccuucaucaccgaggagguccucggccagcagaagaaguccccccuccacgccaagauggacgaguccaaggagggcuccauccagggccucgaggagaugcaggucgagcgcgagggcucccucaaccccucccucaacgaggagaacgucaagggccagggcgagaagaaggaggaguccgaggaggaggacgagaaggaggaggaggaggaggaggagaagcucgaggaggagaaggaggagaaggaggcccaggaggagcaggagucccucuccgucggcgaggaggaggacaaggaggagggccucgaggagaucuacuacgaggacauggaguccuucaccaucuccuccggcaacaccuacuucgucuucgucccccucgaggaggagcacugccgcaagucccacuccaccuucuccgccauguucaucaacgacaccuccuccgccaaguucaucgagcaggucaccauccccucccgccucauccucgagaucaagaagcagcuccgcgccggcuucuucgagcaccucgagaagugguucgaccagugcucccucaacacccgcgucaccgucgccaccaagaucaacgagcucgacuccgagcucgagcuccaccuccaccuccaccagccccgcgcccagcagaucgagaaggacauccacaacguccgcgccgccgagcuccuccuccaccaggagcagcucgacucccacugcgccggcgucaccgagacccucaagaagaagcgccucauguucugccaguuccaggaggagcagaacguccgcuccaagaacuuccgccucaagaucuacgacauggagcacaucuuccucaacgccacccgcucccagaagcucgucacccucuccaacacccuccaccaggagcuccucuccuacgucgacgucacccaggucucccuccgcuccuuccgccaguaccucgaggagucccucggcaagcuccgcuacuccaacaucgaguucaucaagcacugccgccucuucuccgagggcggcaacuucucccccaaggagaucaacucccucugcucccgccucgagaaggaggccgcccgcaucgagcucgucgaguccgucaucaugcucaacauggagaagcucgagaacgaguaccucgaccaggccaacgacgucaucaacaaguucgaguccaaguuccacaaccucuccgucgaccucaucuucaucgagaagauccagcgccuccucaccaaccuccaggucaagaucaagugccaggucgccaaguccaacucccagaccaacggccucaacuucucccuccagcagcuccagaacaagaucaagaccugccaggagucccgcggcgagaagaccaccgucaccaccgaggagcuccucuccuucguccagaccuggaaggagaagcucucccagcgcauccaguaccucaacugcucccucgaccgcgucuccaugaccgagcucgucuucaccaacaccauccucaaggaccaggaggaggacuccgacauccucaccuccuccgaggcccucgaggaggaggccaagcucgacgucgucacccccgaguccuucacccagcucucccgcgucggcaagccccucaucgaggaccccgccgucgacgucauccgcaagcuccuccagcuccccaacaccaaguggcccacccaccacugcgacaaggaccccucccagaccggccgcggcgccugggccugcggcucccgcggcuccuccgaggccggcgccggcggcgccgucugcuccccccccguccucugcuccugccccggccccuccucccccaagggcuucaagcgccaccgcugccagcccgagaacuccggcaagaaggccguccccuccgccuccgccaccuccgccggcuccuucaccccccaccccaagcccaacaagauggagcgcaaguaccgcguccucggcgacaagcccccccccgccgccgaggacuucaagggcaucauccucacccuccucugggaguccuccgagaaccuccucaccgucgccgaggaguucuaccgcaaggagaagcgccccgucacccgccccgacugcaugugcgacaccuucgaccagugcgccgagaacaucuccaagaagauccucgaguaccagucccaggccaacaaguaccacaacuccugccucaucgagcuccgcauccagauccgccgcuucgaggagcuccucccccaggucugcuggcucgucauggagaacuucaaggagcaccacuggaagaaguucuucaccuccgucaaggagauccgcggccaguucgaggagcagcagaagcgccucgagaagcgcaaggacaagaacgcccagaagcuccaccucaaccucggccaccccguccacuuccaggagauggagucccuccaccucuccgaggaggagcgccaggaggagcucgacuccaugauccgcaugaacaaggagaagcucgaggagugcacccgccgcaacggccaggucuucaucaccaaccucgccaccuucaccgagaaguuccuccuccagcucgacgaggucgucaccaucgacgacguccaggucgcccgcauggagccccccaagcagaagcucuccaugcucauccgccgcaagcucgccggccucucccucaaggaggaguccgagaagccccucaucgagcgcggcucccgcaaguggcccggcaucaagcccaccgaggucaccauccagaacaagauccuccuccagcccaccuccuccaucuccaccaccaagaccacccucggccaccucgccgccgucgaggcccgcgacgccgucuaccucaaguaccucgccuccuucgaggaggagcucaagcgcauccaggacgacugcaccucccagaucaaggaggcccagcgcuggaaggacuccuggaagcagucccuccacaccauccagggccucuacgucuga

SEQ ID NO: 40852 - RNA, 1527 nt, Artificial Sequence
  derived and/or modified sequence opt2 from CCDC181__Homo_sapiens__NP_067002
augaacgagaacaaggacaccgacuccaagaaguccgaggaguacgaggacgacuucgagaaggaccucgaguggcucaucaacgagaacgagaaguccgacgccuccaucaucgagauggccugcgagaaggaggagaacaucaaccaggaccucaaggagaacgagaccgucauggagcacaccaagcgccacuccgaccccgacaagucccuccaggacgaggucuccccccgccgcaacgacaucaucuccguccccggcauccagccccucgaccccaucuccgacuccgacuccgagaacuccuuccaggaguccaagcucgagucccagaaggaccucgaggaggaggaggacgaggagguccgccgcuacaucauggagaagaucguccaggccaacaagcuccuccagaaccaggagcccgucaacgacaagcgcgagcgcaagcucaaguucaaggaccagcucgucgaccucgagguccccccccucgaggacaccaccaccuucaagaacuacuucgagaacgagcgcaacauguucggcaagcucucccagcucugcaucuccaacgacuucggccaggaggacguccuccucucccucaccaacggcuccugcgaggagaacaaggaccgcaccauccucgucgagcgcgacggcaaguucgagcuccucaaccuccaggacaucgccucccagggcuuccucccccccaucaacaacgccaacuccaccgagaacgacccccagcagcuccucccccgcuccuccaacuccuccgucuccggcaccaagaaggaggacuccaccgccaagauccacgccgucacccacuccuccaccggcgagccccucgccuacaucgcccagcccccccucaaccgcaagaccugccccuccuccgccgucaacuccgaccgcuccaagggcaacggcaaguccaaccaccgcacccaguccgcccacaucucccccgucaccuccaccuacugccucuccccccgccagaaggagcuccagaagcagcucgaggagaagcgcgagaagcucaagcgcgaggaggagcgccgcaagaucgaggaggagaaggagaagaagcgcgagaacgacaucgucuucaaggccuggcuccagaagaagcgcgagcagguccucgagaugcgccgcauccagcgcgccaaggagaucgaggacaugaacucccgcgagaaccgcgacccccagcaggccuuccgccucuggcucaagaagaagcacgaggagcagaugaaggagcgccagaccgaggagcuccgcaagcaggaggagugccucuucuuccucaagggcaccgagggccgcgagcgcgccuucaagcaguggcuccgccgcaagcgcauggagaagauggccgagcagcaggccguccgcgagcgcacccgccagcuccgccucgaggccaagcgcuccaagcagcuccagcaccaccucuacauguccgaggccaagcccuuccgcuucaccgaccacuacaacuga

SEQ ID NO: 40853 - RNA, 1872 nt, Artificial Sequence
  derived and/or modified sequence opt2 from CCDC185__Homo_sapiens__NP_689823
auggccggcuucucccacuucucccagccccccuaccgcgaccucugggagcccccccgccccggcggcgagcgcgaguccacccagcgccucggcggccagcgcuccggcgccgacuccaccgccugcucccgcgccggcacccccggcgccgaguccgaggccggcgccugcuggcuccacccccacugcuccuucaccccccgcccccgccgccgcggcugcuccgacucccuccgcggcucccgcucccucuccgacgucgcccgccgcccccucgagcgcucccgcaagcaccgcccccgcucccgccgccucgaggacgccuggggcgagaccggcaccaagccccgccccgccuggcagccccagacccagcuccccccccagcgcccccagcccugcccccacuacccccucgcccagggcgacucccccccccccugccccggcggcgccggcaccccccucuccggcaccuuccgcgucgagaaggcccagggcggcgaccagugggccgucccccucggccgccaccucggccgcuggucccccuccuccguccccuccgagcgcuccuccguccccucccagaaguucaagcgccacuccgccugcgucugcgcccagaagcgcgacuccuccgaccaggucgagucccucgccucccgcgacucccagccccucgccuccuccaaggagaugcgcuccccccacacccagguccucaaguccaagcucgaggaggucgucgucuccucccaggaccagcagaucgucgcccucguccucacccgccucaagaaggcccagcgcauccgcgagcuccagcagcaggccgccaaggccugggaggagcucaagcgcuccgaccagaagguccagaugacccucgagcgcgagcgccgccuccuccuccgccagucccaggagcaguggcaggagaaggagcagcgcaagacccuccagucccccgagcagcgcggccuccgccgcgacucccagcgcaagaacgucccccccggcgagucccgcuggaaggagcagcccgaggaccaggaguccccccgccaggagaagcucgagaaggcccgcgcccaggccgagcaccgcaagcagugccagguccgccgccuccgcgagcaggagaagaugcuccgcaaccuccgcgagcagcacucccuccagcuccagcgccgccucgucgaggccugccgcaagcgccaccuccacgccgucgagggccagaagaagguccaggacaccaaccucuccucccucaucaacuaccaggcccgcaagguccucauggacugccaggccaaggccgaggagcuccuccgccagcucucccucgagcaguccuuccagcgcucccaggagauccaccagggccuccgcaaggagcgccagcgcgagcuccgcgagaaggcccagaaggaggaggagcagcuccagcaggcccgcuggcgcgccggcgaguccgaggagcagcgcaagaugcgcaagcgcauccucgucgagcucgccgacgagaagauccgccaggcccgcucccacguccacaagaccacccgcgacaagguccagcaccuccgcgagcucaaccaccuccgcgagaagaaccaccacauccucaagcucaaggccgagaaggaggagaagugccacaucgagggcaucaaggaggccaucaagaagaaggagcagcgcguccagcacaucucccagggcaaggaccccaacuuccaggaguuccagaagcucccccaggccucccgccgcgaggagcgcgccccccccaacuccucccucgaccagaugguccucgaggcccagcuccgcgccugccagcagaaccgcggcuacuga

SEQ ID NO: 40854 - RNA, 1884 nt, Artificial Sequence
  derived and/or modified sequence opt2 from CCDC22__Homo_sapiens__NP_054727
auggaggaggccgaccgcauccucauccacucccuccgccaggccggcaccgccgucccccccgacguccagacccuccgcgccuucaccaccgagcucgucgucgaggccgucguccgcugccuccgcgucaucaaccccgccgucggcuccggccucuccccccuccucccccucgccauguccgcccgcuuccgccucgccaugucccucgcccaggccugcauggaccucggcuacccccucgagcucggcuaccagaacuuccucuaccccuccgagcccgaccuccgcgaccuccuccucuuccucgccgagcgccuccccaccgacgccuccgaggacgccgaccagcccgccggcgacuccgccauccuccuccgcgccaucggcucccagauccgcgaccagcucgcccuccccuggguccccccccaccuccgcacccccaagcuccagcaccuccagggcuccgcccuccagaagcccuuccacgccucccgccucgucguccccgagcucuccucccgcggcgagccccgcgaguuccaggccuccccccuccuccuccccguccccacccaggucccccagcccgucggccgcgucgccucccuccucgagcaccacgcccuccagcucugccagcagaccggccgcgaccgccccggcgacgaggacuggguccaccgcaccucccgccuccccccccaggaggacacccgcgcccagcgccagcgccuccagaagcagcucaccgagcaccuccgccaguccuggggccuccucggcgcccccauccaggcccgcgaccucggcgagcuccuccaggccuggggcgccggcgccaagaccggcgcccccaagggcucccgcuucacccacuccgagaaguucaccuuccaccucgagccccaggcccaggccacccaggucuccgacguccccgccaccucccgccgccccgagcaggucaccugggccgcccaggagcaggagcucgagucccuccgcgagcagcucgagggcgucaaccgcuccaucgaggaggucgaggccgacaugaagacccucggcgucuccuucguccaggccgaguccgagugccgccacuccaagcucuccaccgccgagcgcgagcaggcccuccgccucaagucccgcgccgucgagcuccuccccgacggcaccgccaaccucgccaagcuccagcucgucgucgagaacuccgcccagcgcgucauccaccucgccggccagugggagaagcaccgcgucccccuccucgccgaguaccgccaccuccgcaagcuccaggacugccgcgagcucgaguccucccgccgccucgccgagauccaggagcuccaccaguccguccgcgccgccgccgaggaggcccgccgcaaggaggaggucuacaagcagcucauguccgagcucgagacccucccccgcgacgucucccgccucgccuacacccagcgcauccucgagaucgucggcaacauccgcaagcagaaggaggagaucaccaagauccucuccgacaccaaggagcuccagaaggagaucaacucccucuccggcaagcucgaccgcaccuucgccgucaccgacgagcucgucuucaaggacgccaagaaggacgacgccguccgcaaggccuacaaguaccucgccgcccuccacgagaacugcucccagcucauccagaccaucgaggacaccggcaccaucaugcgcgagguccgcgaccucgaggagcagaucgagaccgagcucggcaagaagacccucuccaaccucgagaagauccgcgaggacuaccgcgcccuccgccaggagaacgccggccuccucggccgcguccgcgaggccuga

SEQ ID NO: 40855 - RNA, 825 nt, Artificial Sequence
  derived and/or modified sequence opt2 from CCDC28A__Homo_sapiens__NP_056254
augccccgcgccgagccccgcgccacccucggcgagcaggagaaggccggccucccccucggcgccuggcgccucuaccuccuccgccacuuccgcaagcagaccgagcuccgccgcuccggcucccgcgacgucaccggcgcccuccucgucgccgccgccgucgccuccgaggccgucggcucccuccgcgucgccgagggcggccccaacacccuccuccuccagguccuccgcuccuggcccuggugcaacaaggagcucaagaccauggaggagcgcaaggucaagcgccgcucccccaaguccuucuccgcccacugcacccaggucgucaacgccaagaagaacgccauccccgucuccaaguccaccggcuucuccaaccccgccucccaguccaccucccagcgccccaagcucaagcgcgucaugaaggagaagaccaagccccagggcggcgagggcaagggcgcccaguccacccccauccagcacuccuuccucaccgacgucuccgacguccaggagauggagcgcggccuccucucccuccucaacgacuuccacuccggcaagcuccaggccuucggcaacgagugcuccaucgagcagauggagcacguccgcggcaugcaggagaagcucgcccgccucaaccucgagcucuacggcgagcucgaggagcuccccgaggacaagcgcaagaccgccuccgacuccaaccucgaccgccuccucuccgaccucgaggagcucaacuccuccauccagaagcuccaccucgccgacgcccaggacguccccaacaccuccgccuccuga

SEQ ID NO: 40856 - RNA, 2826 nt, Artificial Sequence
  derived and/or modified sequence opt2 from CCDC39__Homo_sapiens__NP_852091
auguccuccgaguuccucgccgagcuccacugggaggacggcuucgccauccccgucgccaacgaggagaacaagcuccucgaggaccagcucuccaagcucaaggacgagcgcgccucccuccaggacgagcuccgcgaguacgaggagcgcaucaacuccaugaccucccacuucaagaacgucaagcaggagcucuccaucacccagucccucugcaaggcccgcgagcgcgagaccgaguccgaggagcacuucaaggccaucgcccagcgcgagcucggccgcgucaaggacgagauccagcgccucgagaacgagauggccuccauccucgagaagaaguccgacaaggagaacggcaucuucaaggccacccagaagcucgacggccucaagugccagaugaacugggaccagcaggcccucgaggccuggcucgaggaguccgcccacaaggacuccgacgcccucacccuccagaaguacgcccagcaggacgacaacaagauccgcgcccucacccuccagcucgagcgccucacccucgagugcaaccagaagcgcaagauccucgacaacgagcucaccgagaccaucuccgcccagcucgagcucgacaaggccgcccaggacuuccgcaagauccacaacgagcgccaggagcucaucaagcagugggagaacaccaucgagcagaugcagaagcgcgacggcgacaucgacaacugcgcccucgagcucgcccgcaucaagcaggagacccgcgagaaggagaaccucgucaaggagaagaucaaguuccucgaguccgagaucggcaacaacaccgaguucgagaagcgcaucuccgucgccgaccgcaagcuccucaagugccgcaccgccuaccaggaccacgagaccucccgcauccagcucaagggcgagcucgacucccucaaggccaccgucaaccgcaccuccuccgaccucgaggcccuccgcaagaacaucuccaagaucaagaaggacauccacgaggagaccgcccgccuccagaagaccaagaaccacaacgagaucauccagaccaagcucaaggagaucaccgagaagaccauguccgucgaggagaaggccaccaaccucgaggacaugcucaaggaggaggagaaggacgucaaggaggucgacguccagcucaaccucaucaagggcguccucuucaagaaggcccaggagcuccagaccgagaccaugaaggagaaggccguccucuccgagaucgagggcacccgcuccucccucaagcaccucaaccaccagcuccagaagcucgacuucgagacccucaagcagcaggagaucauguacucccaggacuuccacauccagcaggucgagcgccgcaugucccgccucaagggcgagaucaacuccgaggagaagcaggcccucgaggccaagaucgucgagcuccgcaagucccucgaggagaagaaguccaccugcggccuccucgagacccagaucaagaagcuccacaacgaccucuacuucaucaagaaggcccacuccaagaacuccgacgagaagcagucccucaugaccaagaucaacgagcucaaccucuucaucgaccgcuccgagaaggagcucgacaaggccaagggcuucaagcaggaccucaugaucgaggacaaccuccucaagcucgaggucaagcgcacccgcgagaugcuccacuccaaggccgaggagguccucucccucgagaagcgcaagcagcagcucuacaccgccauggaggagcgcaccgaggagaucaagguccacaagaccaugcucgccucccagauccgcuacgucgaccaggagcgcgagaacaucuccaccgaguuccgcgagcgccucuccaagaucgagaagcucaagaaccgcuacgagauccucaccgucgucaugcucccccccgagggcgaggaggagaagacccaggccuacuacgucaucaaggccgcccaggagaaggaggagcuccagcgcgagggcgacugccucgacgccaagaucaacaaggccgagaaggagaucuacgcccucgagaacacccuccagguccucaacuccugcaacaacaacuacaagcaguccuucaagaaggucacccccuccuccgacgaguacgagcucaagauccagcucgaggagcagaagcgcgccgucgacgagaaguaccgcuacaagcagcgccagauccgcgagcuccaggaggacauccaguccauggagaacacccucgacgucaucgagcaccucgccaacaacgucaaggagaagcucuccgagaagcaggccuacuccuuccagcucuccaaggagaccgaggagcagaagcccaagcucgagcgcgucaccaagcagugcgccaagcucaccaaggagauccgccuccucaaggacaccaaggacgagaccauggaggagcaggacaucaagcuccgcgagaugaagcaguuccacaaggucaucgacgagaugcucgucgacaucaucgaggagaacaccgagauccgcaucauccuccagaccuacuuccagcaguccggccucgagcuccccaccgccuccaccaagggcucccgccaguccucccgcucccccucccacaccucccucuccgcccgcuccucccgcuccaccuccaccuccaccucccaguccuccaucaagguccucgagcucaaguuccccgccuccuccucccucgucggcucccccucccgccccuccuccgccuccuccuccuccuccaacgucaaguccaagaaguccuccaaguga

SEQ ID NO: 40857 - RNA, 438 nt, Artificial Sequence
  derived and/or modified sequence opt2 from CCDC3__Homo_sapiens__NP_001269587
auggacgagaacuacaaccuccucccccacggcgucaacuuccaggacgccaucuuccccgacacccaggagaaccgccgcauguucuccucccucuuccaguucuccaacugcucccagggccagcagcucgccaccuucuccuccgacugggagauccaggaggacucccgccucaugugcuccuccguccagaaggcccucuucgaggaggaggaccacgucaagaagcuccagcagaaggucgccacccucgagaagcgcaaccgccagcuccgcgagcgcgucaagaaggucaagcgcucccuccgccaggcccgcaagaagggccgccaccucgagcucgccaaccagaagcucuccgagaagcucgccgccggcgcccucccccacaucaacgcccgcggccccguccgcccccccuaccuccgcggcuga

SEQ ID NO: 40858 - RNA, 3093 nt, Artificial Sequence
  derived and/or modified sequence opt2 from CCDC40__Homo_sapiens__NP_001230271
auggccgagcccggcggcgccgccggccgcucccaccccgaggacggcuccgccuccgagggcgagaaggagggcaacaacgagucccacauggucuccccccccgagaaggacgacggccagaagggcgaggaggccgucggcuccaccgagcaccccgaggaggucaccacccaggccgaggccgccaucgaggagggcgaggucgagaccgagggcgaggccgccgucgagggcgaggaggaggccgucuccuacggcgacgccgaguccgaggaggaguacuacuacaccgagaccuccucccccgagggccagaucuccgccgccgacaccaccuaccccuacuucucccccccccaggagcuccccggcgaggaggccuacgacuccgucuccggcgaggccggccuccagggcuuccagcaggaggccaccggcccccccgagucccgcgagcgccgcgucaccucccccgagcccucccacggcguccucggccccuccgagcagaugggccaggucaccuccggccccgccgucggccgccucaccggcuccaccgaggagccccagggccagguccuccccaugggcguccagcaccgcuuccgccucucccacggcuccgacaucgaguccuccgaccucgaggaguucgucucccaggagcccgucaucccccccggcguccccgacgcccacccccgcgagggcgaccuccccgucuuccaggaccagauccagcagcccuccaccgaggagggcgccauggccgagcgcgucgaguccgagggcuccgacgaggaggccgaggacgagggcucccagcucgucguccucgaccccgaccacccccucaugguccgcuuccaggccgcccucaagaacuaccucaaccgccagaucgagaagcucaagcucgaccuccaggagcucgucgucgccaccaagcagucccgcgcccagcgccaggagcucggcgucaaccucuacgagguccagcagcaccucguccaccuccagaagcuccucgagaagucccacgaccgccacgccauggccuccuccgagcgccgccagaaggaggaggagcuccaggccgcccgcgcccucuacaccaagaccugcgccgccgccaacgaggagcgcaagaagcucgccgcccuccagaccgagauggagaaccucgcccuccaccucuucuacaugcagaacaucgaccaggacaugcgcgacgacauccgcgucaugacccaggucgucaagaaggccgagaccgagcgcauccgcgccgagaucgagaagaagaagcaggaccucuacgucgaccagcucaccacccgcgcccagcagcucgaggaggacaucgcccucuucgaggcccaguaccucgcccaggccgaggacacccgcauccuccgcaaggccgucuccgaggccugcaccgagaucgacgccaucuccgucgagaagcgccgcaucaugcagcagugggccuccucccucgucggcaugaagcaccgcgacgaggcccaccgcgccguccucgaggcccuccgcggcugccagcaccaggccaaguccaccgacggcgagaucgaggccuacaagaaguccaucaugaaggaggaggagaagaacgagaagcucgccuccauccucaaccgcaccgagaccgaggccacccuccuccagaagcucaccacccagugccucaccaagcaggucgcccuccagucccaguucaacaccuaccgccucacccuccaggacaccgaggacgcccucucccaggaccagcucgagcagaugauccucaccgaggagcuccaggccauccgccaggccauccagggcgagcucgagcuccgccgcaagaccgacgccgccauccgcgagaagcuccaggagcacaugaccuccaacaagaccaccaaguacuucaaccagcucauccuccgccuccagaaggagaagaccaacaugaugacccaccucuccaagaucaacggcgacaucgcccagaccacccucgacaucacccacaccuccucccgccucgacgcccaccagaagacccucgucgagcucgaccaggacgucaagaaggucaacgagcucaucaccaacucccaguccgagaucucccgccgcaccauccucaucgagcgcaagcagggccucaucaacuuccucaacaagcagcucgagcgcauggucuccgagcucggcggcgaggaggucggcccccucgagcucgagaucaagcgccucuccaagcucaucgacgagcacgacggcaaggccguccaggcccaggucaccuggcuccgccuccagcaggagauggucaaggucacccaggagcaggaggagcagcucgccucccucgacgccuccaagaaggagcuccacaucauggagcagaagaagcuccgcgucgaguccaagaucgagcaggagaagaaggagcagaaggagaucgagcaccacaugaaggaccucgacaacgaccucaagaagcucaacaugcucaugaacaagaaccgcugcuccuccgaggagcucgagcagaacaaccgcgucaccgagaacgaguucguccgcucccucaaggccuccgagcgcgagaccaucaagaugcaggacaagcucaaccagcucuccgaggagaaggccacccuccucaaccagcucgucgaggccgagcaccagaucaugcucugggagaagaagauccagcucgccaaggagaugcgcuccuccgucgacuccgagaucggccagaccgagauccgcgccaugaagggcgagauccaccgcaugaagaaguacugccgcaccacccaggacgcccaccgccacguccacgagcagcacggcacccacgccggcaccugcaccaagaacaccggccgcgcccaggcccgcgcccgcaccacccgcgacgcccgcggccacguccacgagcagcacggcacccgcgccggcaccugcaccaacaacaccggccgcgcccaggcccgcgcccgcacccgcgacgcccgccgccacguccacgagcaccgcacccacaccgcccgcgccuga

SEQ ID NO: 40859 - RNA, 927 nt, Artificial Sequence
  derived and/or modified sequence opt2 from CCDC42B__Homo_sapiens__NP_001138344
auggccguccccugggaggaguacuuccgccucgcccuccaggagaagcucuccaccaagcuccccgagcaggccgaggaccacgucccccccguccuccgccuccucgagaagcgccaggagcucgucgacgccgaccaggcccuccaggcccagaaggaggucuuccgcaccaagaccgccgcccucaagcagcgcugggagcagcucgagcagaaggagcgcgagcucaagggcuccuucauccgcuucgacaaguuccuccaggacuccgaggcccgccgcaaccgcgcccuccgccgcgccgccgaggagcgccaccaggccggccgccgcgaggucgaggcccuccgccucuggacccagcuccaggagcuccgccgcgagcacgcccgccuccagcgccgccucaagcgccucgagcccugcgcccgccuccucgagcaggcccucgagcuccuccccggcuuccaggagguccccgagcucgucgcccgcuucgacggccucgccgagacccaggccgcccuccgccuccgcgagcgcgagcagcucgccgagcucgaggccgcccgcgcccgccuccagcagcuccgcgacgccuggcccgacgagguccucgcccagggccagcgccgcgcccagcuccaggagcgccucgaggccgcccgcgagcgcacccuccagugggaguccaaguggauccagauccagaacaccgccgccgagaagacccuccuccucggccgcucccgcauggccguccucaaccucuuccagcucgucugccagcaccagggccagccccccacccucgacaucgaggacaccgagggccagcucgagcacgucaagcucuucaugcaggaccucuccgccaugcucgccggccucggccaggccgagcccgccgcccccgccuccuga

SEQ ID NO: 40860 - RNA, 729 nt, Artificial Sequence
  derived and/or modified sequence opt2 from CCDC42__Homo_sapiens__NP_001151733
augucccucggcaucauggaggaggaggaccucgccgaguacuuccgccuccaguacggcgagcgccuccuccagaugcuccagaagcuccccaacgucgagggcgccuccgagucccccuccaucuggcuccucgagaagaagaaggagaccgagaucaugcaccagaccaugguccagaagaagaagauguuccagcgccgcauggagacccucaaccuccgcugggaggagcucggcgucaaggaggcccagcucaaggcccacauccagaaguccgagcaguucauccaggagaacgaccagaagcgcauccgcgccaugaagaaggccaacaaggagcgcgagcucaagugccagcacaugcaggagcucaccaagcgcaagcaggagauggucgcccuccgccucgagcaccagcgccucuccgccaagcucaaggacuacuacaucuucaacaaguaccucgagaaggucgucgagaacuccgaggagucccgcugggcccacauccagaacaccgccgccaagaagacccuccuccucggcaccaucaagauggccacccucaaccucuuccagaucgucuccaagcaccucaaggaggucaccgaggucgcccucgaggacacccacaagcagcucgacaugauccagcaguucauccaggaccgcuccgacaucugggccgaggucaagaagaaggagcagcagcgcguccgcaucuga

SEQ ID NO: 40861 - RNA, 921 nt, Artificial Sequence
  derived and/or modified sequence opt2 from CCDC50__Homo_sapiens__NP_777568
auggccgaggucuccaucgaccaguccaagcuccccggcgucaaggaggucugccgcgacuucgccguccucgaggaccacacccucgcccacucccuccaggagcaggagaucgagcaccaccucgccuccaacguccagcgcaaccgccucguccagcacgaccuccaggucgccaagcagcuccaggaggaggaccucaaggcccaggcccagcuccagaagcgcuacaaggaccucgagcagcaggacugcgagaucgcccaggagauccaggagaagcucgccaucgaggccgagcgccgccgcauccaggagaagaaggacgaggacaucgcccgccuccuccaggagaaggagcuccaggaggagaagaagcgcaagaagcacuuccccgaguuccccgccacccgcgccuacgccgacuccuacuacuacgaggacggcggcaugaagccccgcgucaugaaggaggccgucuccacccccucccgcauggcccaccgcgaccaggagugguacgacgccgagaucgcccgcaagcuccaggaggaggagcuccucgccacccaggucgacaugcgcgccgcccaggucgcccaggacgaggagaucgcccgccuccucauggccgaggagaagaaggccuacaagaaggccaaggagcgcgagaaguccucccucgacaagcgcaagcaggaccccgaguggaagcccaagaccgccaaggccgccaacuccaaguccaaggaguccgacgagccccaccacuccaagaacgagcgccccgcccgcccccccccccccaucaugaccgacggcgaggacgccgacuacacccacuucaccaaccagcaguccuccacccgccacuucuccaaguccgaguccucccacaagggcuuccacuacaagcacuga

SEQ ID NO: 40862 - RNA, 987 nt, Artificial Sequence
  derived and/or modified sequence opt2 from CCDC54__Homo_sapiens__NP_115989
auguacacccuccacaccaagcgcgucaaggccgccgcccgccagauguggaccuccaaccucuccaagguccgccagucccucaagaacgucuaccacaagugcaagauccgccaccaggacuccaccggcuaccccaccgucaccuccgacgacugcaaccaggacgacgacuccuacgacggcaagaugaaccuccccgucguccuccaggacgucaagaccgcccaggucgagcucuucucccagaugaccgacaucguccacaugauccccaagguccaggagaagaccgaccucuaccagaagcagauggagguccucgagacccgcaugaacgucaacgaggacaagcagugcaccaccaccaaggacauccucuccaugaaggaggacaucaaggcccucaagaagaaggucaccgagcucgagauccagaacuccugcuccaccauccacugccucgagauccucgagggcgagcgcggcaaggagaucaccgagcuccucuacaagcucauccagcccgccacccucaagaacacccucgccuccaccgacauggagaucuccuccgccgagcccgagaagguccccuccuaccccaaguccaccgaccaccucgagaagaagaccaucuccccccagaugaagacccucaagaagcgcaaccaccagaacgccucccgcuccuucgagaaggccaagcccaacaucuacaucuaccccgacuucuccaccuggaucaagcucaccuucguccacggcggcaaguggaccuucuuccucuccgccaccaagcucgaggaguucauccaguggcuccucucccgccccaccauccuccccgaggagccccaggucaucacccagcgcuacugccccuucaccggccccauccucucccucaccaccaucugccucuccaucuucaacaacaucuacggcuucaucugcucccucaaggaggaggucacccgccucuga

SEQ ID NO: 40863 - RNA, 1653 nt, Artificial Sequence
  derived and/or modified sequence opt2 from CCDC60__Homo_sapiens__NP_848594
augaccaagguccccgccaccaagaagcuccaguccucccccaacuccggcgccguccgccccuucuacgccuccgagaaccuccgccagguccccgacaagcccaugaaguccaucaaguacauggacaaggagaucaucaaccucaagaaggaccucauccgcucccgcuuccucauccaguccgucaagaucggccgcggcuacuucgccauccuccgcgaggagaccgccaagaagaagaagcagcagcagcuccagaagcucaaggaggaggagcgcaacaaguuccagcccgccgagaagaucuccgagauccacuacggcgacacccuccucuccaccuacgacgacgagaagcucaagacccucggcgcccgcgucacccgccgccccuucacccccauccacuccugcaucaucucccccucccucaccgaggcccacgucgagccccucuuccgccagcucugcgcccuccacuggcuccucgaggcccucaccaucgaccacacccaccacaccaugaagcccgucaucaccugcuggaaccccaaggaccccggcggcuccaaguccaccaucaagaagaucaacaaggacaaguccaugggccagaagugggagcacuucaucaccgcccccaagaccaagaaguucaagauccccaccaugcgcgucaccaaccgcaagcccucccgccgcggcuccacccucucccucucccgcgccuccggcggcuccuccccccaguccuccaugaucuccgucaaccccggcuccgacgagccccccuccgucaacacccaggucaccuccuccaaggacaucgaggacaacgaguccuccuccaccaagcccgacgaggagccccucuacaugaaccuccagaagcuccucgagaugguccgcgaggacgcccgccgcaccgucaccaucgagaacggcaugcagcgcaaggcccccuccauccucuccguccucaagcagaacaaguccaacuccgccuacaaggagaugcagaccacccucaaguccuccgagcgcuccuccuccaccuccgccgagucccacauccagcccguccagaagaaguccaagaaccgcaccaacugcgacaucaacauccacuacaaguccggcgucugcaacaccaugcgcgccaaguucuacuccgucgcccaggaggccggcuucugccuccaggacaagauggagauccucaugaagcgccaggaggagcgcggcauccagaaguuccgcgccuucguccucgucuccaacuuccagaaggacaucgccaagaugcgccaccacaucuccgucgucaagggcgacgccgaggagaucgccgaccacugguacuucgaccuccucuccaagcuccccgaggaccucaagaacuuccgccccgccaagaagauccucgucaagcuccagaaguucggcgagaaccucgaccuccgcauccgcccccacguccuccucaagguccuccaggaccuccgcaucugggagcucugcucccccgacaucgccgucgccaucgaguucguccgcgagcacaucauccacaugccccaggaggacuacaucuccuggcuccagucccgcaucaacauccccaucggccccuacuccgcccuccgcuga

SEQ ID NO: 40864 - RNA, 2055 nt, Artificial Sequence
  derived and/or modified sequence opt2 from CCDC62__Homo_sapiens__NP_958843
augaacccccccgccgccuuccucgccggccgccagaacaucggcuccgaggucgagaucuccaccaucgagaagcagcgcaaggagcuccagcuccucaucggcgagcucaaggaccgcgacaaggagcucaacgacauggucgccguccaccagcagcagcuccucuccugggaggaggaccgccagaagguccucacccucgaggagcgcugcuccaagcucgagggcgagcuccacaagcgcaccgagaucauccgcucccucaccaagaaggucaaggcccucgaguccaaccagauggagugccagaccgcccuccagaagacccagcuccagcuccaggagauggcccagaaggccacccacuccucccuccucuccgaggaccucgaggcccgcaacgagacccucuccaacacccucgucgagcucuccgcccaggucggccagcuccaggcccgcgagcaggcccucaccaccaugaucaagcucaaggacaaggacaucaucgaggccgucaaccacaucgccgacugcuccggcaaguucaagaugcucgagcacgcccuccgcgacgccaagauggccgagaccugcaucgucaaggagaagcaggacuacaagcagaagcucaaggcccucaagaucgaggucaacaagcucaaggaggaccucaacgagaagaccaccgagaacaacgagcagcgcgaggagaucauccgccucaagcaggagaaguccugccuccacgacgagcuccucuucaccgucgagcgcgagaagcgcaaggacgagcuccucaacaucgccaaguccaagcaggagcgcaccaacuccgagcuccacaaccuccgccagaucuacgucaagcagcaguccgaccuccaguuccucaacuucaacgucgagaacucccaggagcucauccagauguacgacuccaagauggaggaguccaaggcccucgacuccucccgcgacaugugccucuccgaccucgagaacaaccaccccaaggucgacaucaagcgcgagaagaaccagaagucccucuucaaggaccagaaguucgaggccaugcucguccagcagaaccgcuccgacaaguccuccugcgacgagugcaaggagaagaagcagcagaucgacaccgucuucggcgagaaguccgucaucacccucuccuccaucuucaccaaggaccucgucgagaagcacaaccuccccuggucccucggcggcaagacccagaucgagcccgagaacaagaucacccucugcaagauccacaccaagucccccaagugccacggcaccggcguccagaacgagggcaagcagcccuccgagacccccacccucuccgacgagaagcaguggcacgacgucuccgucuaccucggccucaccaacugccccuccuccaagcaccccgagaagcucgacgucgagugccaggaccagauggagcgcuccgagaucuccugcugccagaagaacgaggccugccucggcgaguccggcaugugcgacuccaagugcugccaccccuccaacuucaucaucgaggcccccggccacauguccgacgucgaguggauguccaucuucaagcccuccaagaugcagcgcaucguccgccucaaguccggcugcaccugcuccgaguccaucugcggcacccagcacgacucccccgccuccgagcucaucgccauccaggacucccacucccucggcuccuccaaguccgcccuccgcgaggacgagaccgaguccuccuccaacaagaagaacucccccaccucccuccucaucuacaaggacgcccccgccuucaacgagaaggccuccaucguccuccccucccaggacgacuucucccccaccuccaagcuccagcgccuccucgccgagucccgccagauggucaccgaccucgagcucuccacccuccuccccaucucccacgagaaccucaccggcuccgccaccaacaaguccgagguccccgaggaguccgcccagaagaacaccuucgucuccuacuga

SEQ ID NO: 40865 - RNA, 1692 nt, Artificial Sequence
  derived and/or modified sequence opt2 from CCDC63__Homo_sapiens__XP_011536303
auguccguccucaagaagaaccgccgcaaggacuccgacaccccccaggagcccuccgagaaggccaaggagcagcaggccgaggccgagcuccgcaagcuccgccagcaguuccgcaagauggucgagucccgcaaguccuucaaguuccgcaaccagcagaagaucgccucccaguacaaggagaucaagacccucaagaccgagcaggacgagaucacccuccuccucucccucaugaaguccucccgcaacaugaaccgcuccgagaagaacuacauggagcuccgccuccuccuccagaccaaggaggacuacgaggcccucaucaagucccucaagguccuccucgccgagcucgacgagaagauccuccagauggagaagaagaucgccaaccagaagcagaucuucgccaagaugcaggaggccaacaacccccgcaagcuccagaagcagauccacauccucgagacccgccucaaccucgucaccguccacuucgacaagaugcucaccaccaacgccaagcuccgcaaggagaucgaggaccuccgcuucgagaaggccgccuacgacaacgucuaccagcagcuccagcacugccuccucauggagaagaagaccaugaaccucgccaucgagcaguccucccaggccuacgagcagcgcgucgaggccauggcccgcauggccgccaugaaggaccgccagaagaaggacaccucccaguacaaccucgagauccgcgagcucgagcgccucuacgcccacgaguccaagcucaaguccuuccuccucgucaagcucaacgaccgcaacgaguucgaggagcaggccaagcgcgaggaggcccucaaggccaagaagcacgucaagaagaaccgcggcgaguccuucgaguccuacgaggucgcccaccuccgccuccucaagcucgccgaguccggcaaccucaaccagcucaucgaggacuuccucgccaaggaggagaagaacuucgcccgcuucaccuacgucaccgagcucaacaacgacauggagaugaugcacaagcgcacccagcgcauccaggacgagaucauccuccuccgcucccagcagaagcucucccacgacgacaaccacuccguccuccgccagcucgaggacaagcuccgcaagaccaccgaggaggccgacauguacgaguccaaguacggcgaggucuccaagacccucgaccuccucaagaacuccgucgagaagcucuucaagaagaucaacugcgacgccaccaagauccucguccagcucggcgagaccggcaaggucaccgacaucaaccucccccaguacuucgccaucaucgagaagaagaccaacgaccuccuccuccucgagaccuaccgccgcauccucgaggucgagggcgccgaggccgagauccccccccccuucaucaaccccuucuggggcggcuccgcccuccucaagccccccgagcccaucaaggucaucccccccguccucggcgccgaccccuucuccgaccgccucgacgacgucgagcagccccucgaccacuccucccuccgccagcucguccucgacaacuacauccucaaggagaaccgcuccaaggagguccgcggcgacucccuccccgagaaggucgacgacuuccgcucccgcaagaaggucaccauguga

SEQ ID NO: 40866 - RNA, 1455 nt, Artificial Sequence
  derived and/or modified sequence opt2 from CCDC65__Homo_sapiens__NP_149115
augcccaagaaggagaagauggccaagaccccccucuccgacgagaagcagcuccuccucuuccagcagaagcuccucgccgaggaggagauggccaagaagaaggagcgccuccucucccaguuccucaaggacaagcucgccaaggaggagcacaacuccgcccucaaccucaacaagaucaacacccaguggcgcaccguccuccgcgaggucaagacccgcgagcuccacaaggacaucgagauccucucccagaccuucgagcgcgucgucgacugcaaggacaacgucaucaagucccucgccaaggaccucuccgaggccgaggagcaguacgcccacgcccuccgcucccaccuccacaacgucgaccagcuccucgcccuccagcgccaccgccucucccuccucgaggaguccuacaacauggagcucgaggcccucaccaaggaguucgagaccgagcgcaagaccaucaucgaccagcacgagaaggagauccacuaccuccaggacaucuucauggccauggagcagaacuacaucgacuccgaguacgaguccaagcucgaguuccaguccauguggaacgaccucaagaacaugaaccucgaggagaagcacuuccuccgccuccaccucgagaaccgcgucgaggaccucuggcgcaaguuccaggacguccucaagaacuacaccgacgccaccgaggaccgcaaggccgccuucgagacccuccaggucaaggacgagaaguccuccaaggagaucgagguccagaugaagaagauccagaagcuccaggacgccaucaccaucuccaagggcaagaucaugauccacucccgcgaguccgaggacgagaaccgcuacauccgcaacgacaaggagcucguccucguccagcuccgcaagcucaaggcccagcgcacccaggcccgcgccgccucccagaagaaccucguccgccucacccucgaguccaacgccacccucaaggcccuccgcaagaucgucgacaagggcgagaagauccucaagcucgccgagaucugccgcaaguucgagaccgaggaggagaagguccuccccuucuacuccuccguccucacccccaaggagcaggagggcauccagaagaacaaccucgaggagcucaccgaggagcucaccaaggucauggucgacuacaucggcauggagaacuucuggaagcgcuacaacaaggucaagcucgagcagcucucccuccagcaccgccgcgcccagcuccucgacaucaacggcaagcuccgcgagaugcucaagcaguaccucgacggcaucuccgucuccgacgagguccucucccagcucaacccccucuucaucgucaacuaccaguccaaccuccuccagccccucuccauccgcaucgcccaccccggcgacaagcagcaccccaccaccuga

SEQ ID NO: 40867 - RNA, 2745 nt, Artificial Sequence
  derived and/or modified sequence opt2 from CCDC66__Homo_sapiens__NP_001012524
augggcaacaaggccaagaucgccaagugcccccuccgcaccaagaccggccacauccucaaguccacccaggacaccugcaucggcuccgagaagcuccuccagaagaagcccgucggcuccgagaccucccaggccaagggcgagaagaacggcaugaccuucuccuccaccaaggaccucugcaagcagugcaucgacaaggacugccuccacauccagaaggagaucucccccgccacccccaacaugcagaagacccgcaacaccgucaacaccucccucgucggcaagcagaagccccacaagaagcacaucaccgccgagaacaugaaguccucccucgucugccucacccaggaccagcuccagcagauccucaugaccgucaaccagggcaaccgcucccucucccucaccgagaacggcaaggaggccaagucccaguacucccucuaccucaacuccaucuccaaccagcccaaggacgagaacaucaugggccucuucaagaagaccgagauggucuccuccguccccgccgagaacaaguccguccucaacgagcaccaggagaccuccaagcagugcgagcagaagaucgccaucgagaacgaguggaagcccgccgacaucuucuccacccucggcgagcgcgagugcgaccgcuccucccucgaggccaagaaggcccaguggcgcaaggagcucgacgagcaggucgcccucaagaagaaggagaaggaggucuccgagaaguggaacgaccccuggaagaaguccgaguccgacaagaucaucugggagaagcaccagauccucgaccagucccgcgagaccguccuccucgagcaccccuucuccgccgucaagcaggagcuccagcgcaaguggaucgaggagcucaacaagcagaucgaggacgaccgccagcgcaagaucgaggagaagaucaucuacuccaagggcgaggagcacgaccgcugggccaugcacuucgacucccucaaguccuaccccggcucccagucccagcucuucucccaguccacccacaagcagcccgaguacuucugcgucucccccgacacccaggagcucgccgacgucuccuccgucugcacccccaccaccggcucccaggucgagcccuccgaggaggagcacaucgccaagcccaucaaggacgucgucauggccaacuccaagaagaccaacuuccuccgcuccaugaccgcccuccucgaccccgcccagaucgaggagcgcgaccgccgccgccagaagcagcucgagcaccagaaggccaucaccgcccaggucgaggagaagcgccgcaagaagcagcucgaggaggagcagcgcaagaaggaggagcaggaggaggagcuccgccucgcccaggagcgcgaggagaugcagaagcaguacgaggaggacauccucaagcagaagcagaaggaggagaucaugacccucaagaccaacgagcucuuccagaccaugcagcgcgcccaggagcucgcccagcgccucaagcaggagcagcgcauccgcgagcucgcccagaagggccacgacaccucccgccucaucaagaaccucggcgucgacaccauccagauggaguacaacgccuccaacaucuccaacucccgccacgacuccgacgagaucuccggcaagaugaacaccuacaugaacuccaccaccuccaagaaggacaccggcguccagaccgacgaccucaacaucggcaucuucaccaacgccgagucccacugcggcucccucauggagcgcgacaucaccaacugcuccucccccgagaucuccgccgagcucaucggccaguucuccaccaagaagaacaagcaggagcucacccaggacaagggcgccucccucgagaaggagaacaaccgcugcaacgaccagugcaaccaguucacccgcaucgagaagcagaccaagcacaugaagaaguaccccaagcgccccgacuggaacaucaacaagccccccaagcgcuacauccccgccuccgagaaguaccccaagcagcuccagaagcagcgcgaggagaagaagguccgccgccagauggagcuccuccaccucgucgagaagaacaaccccggccaccucucccagaaccgcggcaucucccccgagaucuuccacuccucccaccaggagaccgaguccaagcuccgcuggcaccucgucaagaaggaggaggagccccucaacauccacuccuucuccaaggagcgcucccccuccucccccguccccgucgucaagaaccgcacccagcagacccagaacacccuccaccucccccucaagaacuccuccuacgagcgcgagaaccucaucuccggcuccaaccagaccgagcucuccuccggcaucuccgaguccucccacuucauccccuacguccgcaccaacgagaucuacuaccucgaccccgacgccccccucuccggccccuccacccaggacccccaguaccagaacucccaggacugcggccagaagcgccagcucuucgacuccgacugcguccgcgacccccuccucaaccccaacauggucaagaaccgcgaccgccagcaggccauccucaagggccucuccgagcuccgccagggccuccuccagaagcagaaggagcucgaguccucccuccucccccucgccgagaaccaggaggaguccuucggcuccuccuucuga

SEQ ID NO: 40868 - RNA, 1815 nt, Artificial Sequence
  derived and/or modified sequence opt2 from CCDC67__Homo_sapiens__NP_857596
auggagaaccaggcccacaacaccaugggcaccucccccugcgaggccgagcuccaggagcucauggagcagaucgacaucauggucuccaacaagaagauggacugggagcgcaagaugcgcgcccucgagacccgccucgaccuccgcgaccaggagcucgccaacgcccagaccugccucgaccagaagggccaggaggucggccuccuccgccagaagcucgacucccucgagaagugcaaccucgccaugacccagaacuacgagggccagcuccagucccucaaggcccaguucuccaagcucaccaacaacuucgagaagcuccgccuccaccagaugaagcagaacaaggucccccgcaaggagcucccccaccucaaggaggagauccccuucgagcucuccaaccucaaccagaagcucgaggaguuccgcgccaagucccgcgagugggacaagcaggagauccucuaccagacccaccucaucucccucgacgcccagcagaagcuccucuccgagaagugcaaccaguuccagaagcaggcccaguccuaccagacccagcucaacggcaagaagcagugccucgaggacuccuccuccgagaucccccgccucaucugcgaccccgaccccaacugcgagaucaacgagcgcgacgaguucaucaucgagaagcucaaguccgccgucaacgagaucgcccucucccgcaacaagcuccaggacgagaaccagaagcuccuccaggagcucaagauguaccagcgccagugccaggccauggaggccggccucuccgaggucaaguccgagcuccagucccgcgacgaccuccuccgcaucaucgagauggagcgccuccagcuccaccgcgagcuccucaagaucggcgagugccagaacgcccagggcaacaagacccgccucgaguccuccuaccuccccuccaucaaggagcccgagcgcaagaucaaggagcucuucuccgucaugcaggaccagcccaaccacgagaaggagcucaacaagauccgcucccagcuccagcaggucgaggaguaccacaacuccgagcaggagcgcaugcgcaacgagaucuccgaccucaccgaggagcuccaccagaaggagaucaccaucgccaccgucaccaagaaggccgcccuccucgagaagcagcucaagauggagcucgagaucaaggagaagaugcucgccaagcagaaggucuccgacaugaaguacaaggccguccgcaccgagaacacccaccucaagggcaugaugggcgaccucgaccccggcgaguacauguccauggacuucaccaaccgcgagcagucccgccacaccuccaucaacaagcuccaguacgagaacgagcgccuccgcaacgaccucgccaagcuccacgucaacggcaaguccaccuggaccaaccagaacaccuacgaggagaccggccgcuacgccuaccagucccagaucaaggucgagcagaacgaggagcgccucucccacgacugcgagcccaaccgcuccaccaugcccccccucccccccuccaccuuccaggccaaggagaugaccuccccccucgucuccgacgacgacgucuucccccucuccccccccgacauguccuuccccgccucccucgccgcccagcacuuccuccucgaggaggagaagcgcgccaaggagcucgagaagcuccucaacacccacaucgacgagcuccagcgccacaccgaguucacccucaacaaguacuccaagcucaagcagaaccgccacaucuga

SEQ ID NO: 40869 - RNA, 1008 nt, Artificial Sequence
  derived and/or modified sequence opt2 from CCDC68__Homo_sapiens__NP_001137301
augaccaccgucaccgucaccaccgagauccccccccgcgacaagauggaggacaacuccgcccucuacgaguccaccuccgcccacaucaucgaggagaccgaguacgucaagaagauccgcaccacccuccagaagauccgcacccagauguucaaggacgagauccgccacgacuccaccaaccacaagcucgacgccaagcacugcggcaaccuccagcagggcuccgacuccgagauggaccccuccugcugcucccucgaccuccucaugaagaagaucaagggcaaggaccuccagcuccucgagaugaacaaggagaacgagguccucaagaucaagcuccaggccucccgcgaggccggcgccgccgcccuccgcaacgucgcccagcgccucuucgagaacuaccagacccaguccgaggagguccgcaagaagcaggaggacuccaagcagcuccuccaggucaacaagcucgagaaggagcagaagcucaagcagcacgucgagaaccucaaccaggucgccgagaagcucgaggagaagcacucccagaucaccgagcucgagaaccucguccagcgcauggagaaggagaagcgcacccuccucgagcgcaagcucucccucgagaacaagcuccuccagcucaaguccuccgccaccuacggcaaguccugccaggaccuccagcgcgagaucuccauccuccaggagcagaucucccaccuccaguucgucauccacucccagcaccagaaccuccgcuccgucauccaggagauggagggccucaagaacaaccucaaggagcaggacaagcgcaucgagaaccuccgcgagaaggucaacauccucgaggcccagaacaaggagcucaagacccaggucgcccucuccuccgagaccccccgcaccaaggucuccaaggccgucuccaccuccgagcucaagaccgagggcgucucccccuaccucaugcucauccgccuccgcaaguga

SEQ ID NO: 40870 - RNA, 1425 nt, Artificial Sequence
  derived and/or modified sequence opt2 from CCDC6__Homo_sapiens__NP_005427
auggccgacuccgccuccgaguccgacaccgacggcgccggcggcaacuccuccuccuccgccgccaugcaguccuccugcuccuccaccuccggcggcggcggcggcggcggcggcggcggcggcggcggcaaguccggcggcaucgucaucucccccuuccgccucgaggagcucaccaaccgccucgccucccuccagcaggagaacaagguccucaagaucgagcucgagaccuacaagcucaagugcaaggcccuccaggaggagaaccgcgaccuccgcaaggccuccgucaccauccaggcccgcgccgagcaggaggaggaguucaucuccaacacccucuucaagaagauccaggcccuccagaaggagaaggagacccucgccgucaacuacgagaaggaggaggaguuccucaccaacgagcucucccgcaagcucaugcagcuccagcacgagaaggccgagcucgagcagcaccucgagcaggagcaggaguuccaggucaacaagcucaugaagaagaucaagaagcucgagaacgacaccaucuccaagcagcucacccucgagcagcuccgccgcgagaagaucgaccucgagaacacccucgagcaggagcaggaggcccucgucaaccgccucuggaagcgcauggacaagcucgaggccgagaagcgcauccuccaggagaagcucgaccagcccgucuccgccccccccuccccccgcgacaucuccauggagaucgacucccccgagaacaugaugcgccacauccgcuuccucaagaacgaggucgagcgccucaagaagcagcuccgcgccgcccagcuccagcacuccgagaagauggcccaguaccucgaggaggagcgccacaugcgcgaggagaaccuccgccuccagcgcaagcuccagcgcgagauggagcgccgcgaggcccucugccgccagcucuccgaguccgaguccucccucgagauggacgacgagcgcuacuucaacgagauguccgcccagggccuccgcccccgcaccgucuccucccccauccccuacacccccucccccuccuccucccgccccaucucccccggccucuccuacgccucccacaccgucggcuucaccccccccaccucccucacccgcgccggcauguccuacuacaacucccccggccuccacguccagcacaugggcaccucccacggcaucacccgccccuccccccgccgcuccaacucccccgacaaguucaagcgccccacccccccccccucccccaacacccagacccccguccagcccccccccccccccccccccccccccaugcagcccaccguccccuccgccgccaccucccagcccacccccucccagcacuccgcccaccccuccucccagcccuga

SEQ ID NO: 40871 - RNA, 1317 nt, Artificial Sequence
  derived and/or modified sequence opt2 from CCDC78__Homo_sapiens__NP_001026907
auggagcacgccgccaccaccggcccccgccccggcccccccucccgccgcgucgagaacgucguccuccgcgccaaggacuggcuccccggcgcccccggcggcaccgccgucugggccaccucccucgaggccgaggucccccccgaccucgcccucaacaaggagcagcagcuccagaucuccaaggagcucgucgacauccagaucaccacccaccaccuccacgagcagcacgaggccgagaucuuccagcucaaguccgagauccuccgccucgagucccgcguccucgagcucgagcuccgcggcgacggcaccucccagggcugcgccguccccgucgaguccgacccccgccacccccgcgccgccgcccaggagcuccgccacaaggcccagguccccggccacuccgacgaccaccgcuuccagguccagcccaagaacaccaugaaccccgagaacgagcagcaccgccucggcuccggccuccagggcgaggucaagugggcccucgagcaccaggaggcccgccagcaggcccucgucacccgcgucgccacccucggccgccagcuccagggcgcccgcgaggaggcccgcgccgccggccagcgccucgccacccaggccgucguccucugcuccugccagggccagcuccgccaggccgaggccgagaacgcccgccuccagcuccagcucaagaagcucaaggacgaguacguccuccgccuccagcacugcgccuggcaggccgucgagcacgccgacggcgccggccaggcccccgccaccaccgcccuccgcaccuuccucgaggccacccucgaggacauccgcgccgcccaccgcucccgcgagcagcagcucgcccgcgccgcccgcuccuaccacaagcgccucgucgaccucucccgccgccacgaggagcuccucgucgccuaccgcgcccccggcaacccccaggccaucuucgacaucgccucccucgaccucgagccccuccccgucccccucgucaccgacuucucccaccgcgaggaccagcacggcggccccggcgcccuccucuccucccccaagaagcgccccggcggcgccucccagggcggcaccuccgagccccagggccucgacgccgccuccugggcccagauccaccagaagcuccgcgacuucucccgcuccacccaguccuggaacggcuccggccacuccugcugguccggcccccgcuggcucaaguccaacuuccucuccuaccgcuccaccuggaccuccaccugggccggcaccuccaccaaguccuga

SEQ ID NO: 40872 - RNA, 2853 nt, Artificial Sequence
  derived and/or modified sequence opt2 from CCDC80__Homo_sapiens__NP_955805
augaccuggcgcaugggcccccgcuucaccaugcuccucgccauguggcucgucugcggcuccgagccccacccccacgccaccauccgcggcucccacggcggccgcaaggucccccucgucucccccgacuccucccgccccgcccgcuuccuccgccacaccggccgcucccgcggcaucgagcgcuccacccucgaggagcccaaccuccagccccuccagcgccgccgcuccguccccguccuccgccucgcccgccccaccgagccccccgcccgcuccgacaucaacggcgccgccguccgccccgagcagcgccccgccgcccgcggcuccccccgcgagaugauccgcgacgagggcuccuccgcccgcucccgcaugcuccgcuuccccuccggcuccuccucccccaacauccucgccuccuucgccggcaagaaccgcgucugggucaucuccgccccccacgccuccgagggcuacuaccgccucaugaugucccuccucaaggacgacgucuacugcgagcucgccgagcgccacauccagcagaucguccucuuccaccaggccggcgaggagggcggcaagguccgccgcaucaccuccgagggccagauccucgagcagccccucgaccccucccucauccccaagcucauguccuuccucaagcucgagaagggcaaguucggcaugguccuccucaagaagacccuccaggucgaggagcgcuaccccuaccccguccgccucgaggccauguacgaggucaucgaccagggccccauccgccgcaucgagaagauccgccagaagggcuucguccagaagugcaaggccuccggcgucgagggccaggucgucgccgagggcaacgacggcggcggcggcgccggccgccccucccucggcuccgagaagaagaaggaggacccccgccgcgcccaggucccccccacccgcgagucccgcgucaagguccuccgcaagcucgccgccaccgcccccgcccucccccagccccccuccaccccccgcgccaccacccucccccccgcccccgccaccaccgucacccgcuccaccucccgcgccgucaccgucgccgcccgccccaugaccaccaccgccuuccccaccacccagcgccccuggacccccucccccucccaccgcccccccaccaccaccgaggucaucaccgcccgccgccccuccgucuccgagaaccucuacccccccucccgcaaggaccagcaccgcgagcgcccccagaccacccgccgccccuccaaggccaccucccucgaguccuucaccaacgccccccccaccaccaucuccgagcccuccacccgcgccgccggccccggccgcuuccgcgacaaccgcauggaccgccgcgagcacggccaccgcgaccccaacgucguccccggcccccccaagcccgccaaggagaagccccccaagaagaaggcccaggacaagauccucuccaacgaguacgaggagaaguacgaccucucccgccccaccgccucccagcucgaggacgagcuccaggucggcaacgucccccucaagaaggccaaggaguccaagaagcacgagaagcucgagaagcccgagaaggagaagaagaagaagaugaagaacgagaacgccgacaagcuccucaaguccgagaagcagaugaagaaguccgagaagaaguccaagcaggagaaggagaaguccaagaagaagaagggcggcaagaccgagcaggacggcuaccagaagcccaccaacaagcacuucacccagucccccaagaaguccgucgccgaccuccucggcuccuucgagggcaagcgccgccuccuccucaucaccgcccccaaggccgagaacaacauguacguccagcagcgcgacgaguaccucgaguccuucugcaagauggccacccgcaagaucuccgucaucaccaucuucggccccgucaacaacuccaccaugaagaucgaccacuuccagcucgacaacgagaagcccaugcgcgucgucgacgacgaggaccucgucgaccagcgccucaucuccgagcuccgcaaggaguacggcaugaccuacaacgacuucuucaugguccucaccgacgucgaccuccgcgucaagcaguacuacgagguccccaucaccaugaaguccgucuucgaccucaucgacaccuuccagucccgcaucaaggacauggagaagcagaagaaggagggcaucgucugcaaggaggacaagaagcagucccucgagaacuuccucucccgcuuccgcuggcgccgccgccuccucgucaucuccgcccccaacgacgaggacugggccuacucccagcagcucuccgcccucuccggccaggccugcaacuucggccuccgccacaucaccauccucaagcuccucggcgucggcgaggaggucggcggcguccucgagcucuuccccaucaacggcuccuccgucgucgagcgcgaggacguccccgcccaccucgucaaggacauccgcaacuacuuccaggucucccccgaguacuucuccaugcuccucgucggcaaggacggcaacgucaaguccugguaccccucccccaugugguccauggucaucgucuacgaccucaucgacuccaugcagcuccgccgccaggagauggccauccagcagucccucggcaugcgcugccccgaggacgaguacgccggcuacggcuaccacuccuaccaccagggcuaccaggacggcuaccaggacgacuaccgccaccacgaguccuaccaccacggcuaccccuacuga

SEQ ID NO: 40873 - RNA, 1242 nt, Artificial Sequence
  derived and/or modified sequence opt2 from CCDC83__Homo_sapiens__NP_001273088
auggagaacuccggcaaggccaacaagaaggacacccacgacggcccccccaaggagaucaagcuccccaccuccgaggcccuccucgacuaccagugccagaucaaggaggacgccgucgagcaguucauguuccagaucaagacccuccgcaagaagaaccagaaguaccacgagcgcaacucccgccucaaggaggagcagaucuggcacauccgccaccuccucaaggagcucuccgaggagaaggccgagggccuccccgucgucacccgcgaggacgucgaggaggccaugaaggagaaguggaaguucgagcgcgaccaggagaagaaccuccgcgacaugcgcaugcagaucuccaacgccgagaagcucuuccucgagaagcucuccgagaaggaguacugggaggaguacaagaacgucggcuccgagcgccacgccaagcucaucaccucccuccagaacgacaucaacaccgucaaggagaacgccgagaagauguccgagcacuacaagaucacccucgaggacacccgcaagaagaucaucaaggagacccuccuccagcucgaccagaagaaggagugggccacccagaacgccgucaagcucaucgacaagggcuccuaccucgagaucugggagaacgacuggcucaagaaggaggucgccauccaccgcaaggaggucgaggagcucaagaacgccauccacgagcucgaggccgagaaccucguccucaucgaccagcucuccaacugccgccucgucgaccucaagaucccccgccgccucuaccucacccaggccgccggccucgaggucccccccgaggagaugucccucgagcuccccgagacccacaucgaggagaaguccgagcuccagcccaccgaggucgagucccgcgaccucauguccuccuccgacgaguccaccauccuccaccucucccacgagaacuccaucgaggaccuccaguacgucaagaucgacaaggaggagaacuccggcaccgaguucggcgacaccgacaugaaguaccuccucuacgaggacgagaaggacuucaaggacuacgucaaccucggcccccucggcgucaagcucauguccgucgaguccaagaagaugcccauccacuuccaggagaaggagauccccgucaagcucuacaaggacguccgcucccccgagucccacaucaccuacaagaugaugaaguccuuccucuga

SEQ ID NO: 40874 - RNA, 1662 nt, Artificial Sequence
  derived and/or modified sequence opt2 from CCDC85A__Homo_sapiens__NP_001073902
auguccaaggccgccggcggcgccgccgccgccgccgccgccgccgaguccugcucccccgcccccgccggcuccuccgccgccccccccgcccccgucgaggaccucuccaaggucuccgacgaggagcuccuccagugguccaaggaggagcucauccgcucccuccgccgcgccgaggccgagaaggucuccgccaugcucgaccacuccaaccucauccgcgaggucaaccgccgccuccagcuccaccucggcgagauccgcggccucaaggacaucaaccagaagcuccaggaggacaaccaggagcuccgcgaccucugcugcuuccucgacgacgaccgccagaagggcaagcgcgucucccgcgaguggcagcgccucggccgcuacaccgccggcgucaugcacaaggaggucgcccucuaccuccagaagcucaaggaccucgaggucaagcaggaggaggucgucaaggagaacauggagcucaaggagcucugcguccuccucgacgaggagaagggcgccggcugcgccggcucccgcugcuccaucgacucccaggccucccucugccagcucaccgccuccaccgcccccuacguccgcgacgucggcgacggcuccuccaccuccuccaccggcuccaccgacucccccgaccaccacaagcaccacgccuccuccggcucccccgagcaccuccagaagccccgcuccgagggcucccccgagcacuccaagcaccgcuccgccucccccgagcacccccagaagccccgcgccugcggcacccccgaccgccccaaggcccucaagggccccucccccgagcaccacaagccccucugcaagggcucccccgagcagcagcgccacccccaccccggcuccucccccgagacccuccccaagcacguccucuccggcucccccgagcacuuccagaagcaccgcuccggcuccucccccgagcacgcccgccacuccggcggcucccccgagcaccuccagaagcacgcccucggcggcucccucgagcaccucccccgcgcccgcggcaccucccccgagcaccucaagcagcacuacggcggcucccccgaccacaagcacggcggcggcuccggcggcuccggcggcuccggcggcggcucccgcgagggcacccuccgccgccaggcccaggaggacggcuccccccaccaccgcaacgucuacuccggcaugaacgaguccacccucuccuacguccgccagcucgaggcccgcguccgccagcucgaggaggagaaccgcaugcucccccaggccucccagaaccgccgccagccccccacccgcaacuccuccaacauggagaagggcuggggcucccgcgcccgccgcguccuccagugguggcagggcugccgcggcaucggccgcugccuccccacccuccccggcuccuuccgccucuccuccggcgccgacggcuccaacuccucccccaacuccgccgccuccuucuccggccacgccacccccucccagcagcccgagcccgucguccacucccucaaggucgucuggcgcaagcucggcgacgccgccggcuccugccccggcauccgccagcaccucuccggcaaccaguacaagggccccauguga

SEQ ID NO: 40875 - RNA, 1083 nt, Artificial Sequence
  derived and/or modified sequence opt2 from CCDC86__Homo_sapiens__NP_077003
auggacaccccccuccgccgcucccgccgccucggcggccuccgccccgagucccccgagucccucaccuccgucucccgcacccgccgcgcccucgucgaguucgaguccaaccccgaggagacccgcgagcccggcuccccccccuccguccagcgcgccggccucggcucccccgagcgcccccccaagaccucccccggcuccccccgccuccagcagggcgccggccucgaguccccccagggccagcccgagcccggcgccgccuccccccagcgccagcaggaccuccaccucgaguccccccagcgccagcccgaguacucccccgaguccccccgcugccagcccaagcccuccgaggaggcccccaagugcucccaggaccagggcguccucgccuccgagcucgcccagaacaaggaggagcucacccccggcgccccccagcaccagcucccccccguccccggcucccccgagcccuaccccggccagcaggcccccggccccgagcccucccagccccuccucgagcucaccccccgcgcccccggcuccccccgcggccagcacgagcccuccaagcccccccccgccggcgagaccgucaccggcggcuucggcgccaagaagcgcaagggcuccuccucccaggcccccgccuccaagaagcucaacaaggaggagcuccccgucauccccaagggcaagcccaaguccggccgcgucuggaaggaccgcuccaagaagcgcuucucccagaugcuccaggacaagccccuccgcaccuccuggcagcgcaagaugaaggagcgccaggagcgcaagcucgccaaggacuucgcccgccaccucgaggaggagaaggagcgccgccgccaggagaagaagcagcgccgcgccgagaaccucaagcgccgccucgagaacgagcgcaaggccgaggucguccaggucauccgcaaccccgccaagcucaagcgcgccaagaagaagcagcuccgcuccaucgagaagcgcgacacccucgcccuccuccagaagcagcccccccagcagcccgccgccaagaucuga

SEQ ID NO: 40876 - RNA, 5613 nt, Artificial Sequence
  derived and/or modified sequence opt2 from CCDC88A__Homo_sapiens__NP_001129069
auggagaacgagaucuucaccccccuccucgagcaguucaugaccuccccccucgucaccugggucaagaccuucggcccccucgccgccggcaacggcaccaaccucgacgaguacgucgcccucgucgacggcgucuuccucaaccaggucaugcuccagaucaaccccaagcucgagucccagcgcgucaacaagaaggucaacaacgacgccucccuccgcaugcacaaccucuccauccucguccgccagaucaaguucuacuaccaggagacccuccagcagcucaucaugaugucccuccccaacguccucaucaucggcaagaaccccuucuccgagcagggcaccgaggaggucaagaagcuccuccuccuccuccucggcugcgccguccagugccagaagaaggaggaguucaucgagcgcauccagggccucgacuucgacaccaaggccgccgucgccgcccacauccaggaggucacccacaaccaggagaacgucuucgaccuccaguggauggaggucaccgacaugucccaggaggacaucgagccccuccucaagaacauggcccuccaccucaagcgccucaucgacgagcgcgacgagcacuccgagaccaucaucgagcucuccgaggagcgcgacggccuccacuuccucccccacgccuccuccuccgcccagucccccugcggcucccccggcaugaagcgcaccgagucccgccagcaccucuccgucgagcucgccgacgccaaggccaagauccgccgccuccgccaggagcucgaggagaagaccgagcagcuccucgacugcaagcaggagcucgagcagauggagaucgagcucaagcgccuccagcaggagaacaugaaccuccucuccgacgcccgcuccgcccgcauguaccgcgacgagcucgacgcccuccgcgagaaggccguccgcgucgacaagcucgaguccgaggucucccgcuacaaggagcgccuccacgacaucgaguucuacaaggcccgcgucgaggagcucaaggaggacaaccagguccuccucgagaccaagaccaugcucgaggaccagcucgagggcacccgcgcccgcuccgacaagcuccacgagcucgagaaggagaaccuccagcucaaggccaagcuccacgacauggagauggagcgcgacauggaccgcaagaagaucgaggagcucauggaggagaacaugacccucgagauggcccagaagcaguccauggacgagucccuccaccucggcugggagcucgagcagaucucccgcaccuccgagcucuccgaggccccccagaagucccucggccacgaggucaacgagcucaccuccucccgccuccucaagcucgagauggagaaccagucccucaccaagaccgucgaggagcuccgcaccaccgucgacuccgucgagggcaacgccuccaagauccucaagauggagaaggagaaccagcgccucuccaagaaggucgagauccucgagaacgagaucguccaggagaagcagucccuccagaacugccagaaccucuccaaggaccucaugaaggagaaggcccagcucgagaagaccaucgagacccuccgcgagaacuccgagcgccagaucaagauccucgagcaggagaacgagcaccucaaccagaccgucuccucccuccgccagcgcucccagaucuccgccgaggcccgcgucaaggacaucgagaaggagaacaagauccuccacgaguccaucaaggagaccuccuccaagcucuccaagaucgaguucgagaagcgccagaucaagaaggagcucgagcacuacaaggagaagggcgagcgcgccgaggagcucgagaacgagcuccaccaccucgagaaggagaacgagcuccuccagaagaagaucaccaaccucaagaucaccugcgagaagaucgaggcccucgagcaggagaacuccgagcucgagcgcgagaaccgcaagcucaagaagacccucgacuccuucaagaaccucaccuuccagcucgagucccucgagaaggagaacucccagcucgacgaggagaaccucgagcuccgccgcaacgucgagucccucaagugcgccuccaugaagauggcccagcuccagcucgagaacaaggagcucgaguccgagaaggagcagcucaagaagggccucgagcuccucaaggccuccuucaagaagaccgagcgccucgaggucuccuaccagggccucgacaucgagaaccagcgccuccagaagacccucgagaacuccaacaagaagauccagcagcucgaguccgagcuccaggaccucgagauggagaaccagacccuccagaagaaccucgaggagcucaagaucuccuccaagcgccucgagcagcucgagaaggagaacaagucccucgagcaggagaccucccagcucgagaaggacaagaagcagcucgagaaggagaacaagcgccuccgccagcaggccgagaucaaggacaccacccucgaggagaacaacgucaagaucggcaaccucgagaaggagaacaagacccucuccaaggagaucggcaucuacaaggaguccugcguccgccucaaggagcucgagaaggagaacaaggagcucgucaagcgcgccaccaucgacaucaagacccucgucacccuccgcgaggaccucgucuccgagaagcucaagacccagcagaugaacaacgaccucgagaagcucacccacgagcucgagaagaucggccucaacaaggagcgccuccuccacgacgagcaguccaccgacgaccgcuacaagcuccucgaguccaagcucgaguccacccucaagaagucccucgagaucaaggaggagaagaucgccgcccucgaggcccgccucgaggaguccaccaacuacaaccagcagcuccgccaggagcucaagaccgucaagaagaacuacgaggcccucaagcagcgccaggacgaggagcgcaugguccaguccuccccccccaucuccggcgaggacaacaagugggagcgcgagucccaggagaccacccgcgagcuccucaaggucaaggaccgccucaucgaggucgagcgcaacaacgccacccuccaggccgagaagcaggcccucaagacccagcucaagcagcucgagacccagaacaacaaccuccaggcccagauccucgcccuccagcgccagaccgucucccuccaggagcagaacaccacccuccagacccagaacgccaagcuccaggucgagaacuccacccucaacucccaguccaccucccucaugaaccagaacgcccagcuccucauccagcaguccucccucgagaacgagaacgaguccgucaucaaggagcgcgaggaccucaagucccucuacgacucccucaucaaggaccacgagaagcucgagcuccuccacgagcgccaggccuccgaguacgagucccucaucuccaagcacggcacccucaaguccgcccacaagaaccucgaggucgagcaccgcgaccucgaggaccgcuacaaccagcuccucaagcagaagggccagcucgaggaccucgagaagaugcucaaggucgagcaggagaagaugcuccucgagaacaagaaccacgagaccgucgccgccgaguacaagaagcucugcggcgagaacgaccgccucaaccacaccuacucccagcuccucaaggagaccgagguccuccagaccgaccacaagaaccucaagucccuccucaacaacuccaagcucgagcagacccgccucgaggccgaguucuccaagcucaaggagcaguaccagcagcucgacaucaccuccaccaagcucaacaaccagugcgagcuccucucccagcucaagggcaaccucgaggaggagaaccgccaccuccucgaccagauccagacccucaugcuccagaaccgcacccuccucgagcagaacauggaguccaaggaccucuuccacgucgagcagcgccaguacaucgacaagcucaacgagcuccgccgccagaaggagaagcucgaggagaagaucauggaccaguacaaguucuacgaccccucccccccccgccgccgcggcaacuggaucacccucaagaugcgcaagcucaucaaguccaagaaggacaucaaccgcgagcgccagaagucccucacccucacccccacccgcuccgacuccuccgagggcuuccuccagcucccccaccaggacucccaggacuccuccuccgucggcuccaacucccucgaggacggccagacccucggcaccaagaaguccuccauggucgcccucaagcgccuccccuuccuccgcaaccgccccaaggacaaggacaagaugaaggccugcuaccgccgcuccauguccaugaacgaccucguccaguccaugguccucgccggccaguggaccggcuccaccgagaaccucgagguccccgacgacaucuccaccggcaagcgccgcaaggagcucggcgccauggccuucuccaccaccgccaucaacuucuccaccgucaacuccuccgccggcuuccgcuccaagcagcucgucaacaacaaggacaccaccuccuucgaggacaucuccccccagggcgucuccgacgacuccuccaccggcucccgcguccacgccucccgccccgccucccucgacuccggccgcaccuccaccuccaacuccaacaacaacgccucccuccacgaggucaaggccggcgccgucaacaaccagucccgcccccagucccacuccuccggcgaguucucccuccuccacgaccacgaggccugguccuccuccggcuccucccccauccaguaccucaagcgccagacccgcuccucccccguccuccagcacaagaucuccgagacccucgagucccgccaccacaagaucaagaccggcucccccggcuccgaggucgucacccuccagcaguuccucgaggaguccaacaagcucaccuccguccagaucaaguccuccucccaggagaaccuccucgacgaggucaugaagucccucuccgucuccuccgacuuccucggcaaggacaagcccgucuccugcggccucgcccgcuccgucuccggcaagacccccggcgacuucuacgaccgccgcaccaccaagcccgaguuccuccgccccggcccccgcaagaccgaggacaccuacuucaucuccuccgccggcaagcccacccccggcacccagggcaagaucaagcucgucaaggaguccucccucucccgccaguccaaggacuccaaccccuacgccacccucccccgcgccuccuccgucaucuccaccgccgagggcaccacccgccgcaccuccauccacgacuuccucaccaaggacucccgccuccccaucuccgucgacuccccccccgccgccgccgacuccaacaccaccgccgccuccaacgucgacaagguccaggagucccgcaacuccaagucccgcucccgcgagcagcaguccuccuga

SEQ ID NO: 40877 - RNA, 6087 nt, Artificial Sequence
  derived and/or modified sequence opt2 from CCDC88C__Homo_sapiens__NP_001073883
auggacgucaccgucuccgagcuccucgagcucuuccuccaguccccccucgucaccugggucaagaccuucggccccuucggcuccggcucccaggacaaccucaccauguacauggaccucgucgacggcaucuuccucaaccagaucaugcuccagaucgacccccgccccaccaaccagcgcaucaacaagcacgucaacaacgacgucaaccuccgcauccagaaccucaccauccucguccgcaacaucaagaccuacuaccaggagguccuccagcagcucaucgucaugaaccuccccaacguccucaugaucggccgcgacccccucuccggcaaguccauggaggagaucaagaagguccuccuccucguccucggcugcgccguccagugcgagcgcaaggaggaguucaucgagcgcaucaagcagcucgacaucgagacccaggccggcaucgucgcccacauccaggaggucacccacaaccaggagaacgucuucgaccuccaguggcucgagcuccccgacgucgcccccgaggagcucgaggcccucucccgcuccaugguccuccaccuccgccgccucaucgaccagcgcgacgagugcaccgagcucaucgucgaccucacccaggagcgcgacuaccuccaggcccagcacccccccucccccaucaaguccuccuccgccgacuccacccccucccccaccuccucccucuccuccgaggacaagcagcaccucgccgucgagcucgccgacaccaaggcccgccuccgccgcguccgccaggagcucgaggacaagaccgagcagcucgucgacacccgccacgaggucgaccagcucguccucgagcuccagaaggucaagcaggagaacauccagcucgccgccgacgcccgcuccgcccgcgccuaccgcgacgagcucgacucccuccgcgagaaggccaaccgcgucgagcgccucgagcucgagcucacccgcugcaaggagaagcuccacgacgucgacuucuacaaggcccgcauggaggagcuccgcgaggacaacaucauccucaucgagaccaaggccaugcucgaggagcagcucaccgccgcccgcgcccgcggcgacaagguccacgagcucgagaaggagaaccuccagcucaaguccaagcuccacgaccucgagcucgaccgcgacaccgacaagaagcgcaucgaggagcuccucgaggagaacaugguccucgagaucgcccagaagcaguccaugaacgaguccgcccaccucggcugggagcucgagcagcucuccaagaacgccgaccucuccgacgccucccgcaaguccuucgucuucgagcucaacgagugcgccuccucccgcauccucaagcucgagaaggagaaccagucccuccaguccaccauccagggccuccgcgacgccucccucguccucgaggaguccggccucaagugcggcgagcucgagaaggagaaccaccagcucuccaagaagaucgagaagcuccagacccagcucgagcgcgagaagcaguccaaccaggaccucgagacccucuccgaggagcucauccgcgagaaggagcagcuccaguccgacauggagacccucaaggccgacaaggcccgccagaucaaggaccucgagcaggagaaggaccaccucaaccgcgccauguggucccuccgcgagcgcucccaggucuccuccgaggcccgcaugaaggacgucgagaaggagaacaaggcccuccaccagaccgucaccgaggccaacggcaagcucucccagcucgaguucgagaagcgccagcuccaccgcgaccucgagcaggccaaggagaagggcgagcgcgccgagaagcucgagcgcgagcuccagcgccuccaggaggagaacggccgccucgcccgcaaggucaccucccucgagaccgccaccgagaaggucgaggcccucgagcacgagucccagggccuccagcucgagaaccgcacccuccgcaagucccucgacacccuccagaacgucucccuccagcucgagggccucgagcgcgacaacaagcagcucgacgccgagaaccucgagcuccgccgccucgucgagaccaugcgcuucaccuccaccaagcucgcccagauggagcgcgagaaccagcagcucgagcgcgagaaggaggagcuccgcaagaacgucgaccuccucaaggcccucggcaagaaguccgagcgccucgagcucuccuaccaguccgucuccgccgagaaccuccgccuccagcagucccucgaguccuccucccacaagacccagacccucgaguccgagcucggcgagcucgaggccgagcgccaggcccuccgccgcgaccucgaggcccuccgccucgccaacgcccagcucgagggcgccgagaaggaccgcaaggcccucgagcaggaggucgcccagcucgagaaggacaagaagcuccucgagaaggaggccaagcgccucuggcagcaggucgagcucaaggacgccguccucgacgacuccaccgccaagcucuccgccgucgagaaggagucccgcgcccucgacaaggagcucgcccgcugccgcgacgccgccggcaagcucaaggagcucgagaaggacaaccgcgaccucaccaagcaggucaccguccacgcccgcacccucaccacccuccgcgaggaccucguccucgagaagcucaagucccagcagcucuccuccgagcucgacaagcucucccaggagcucgagaaggucggccucaaccgcgagcuccuccuccaggaggacgacuccggcuccgacaccaaguacaagauccucgagggccgcaacgaguccgcccucaagaccacccucgccaugaaggaggagaagaucguccuccucgaggcccagauggaggagaaggccucccucaaccgccagcucgaguccgagcuccagaugcucaagaaggagugcgagacccuccgccagaaccagggcgagggccagcaccuccagaacuccuucaagcaccccgccggcaagaccgccgccucccaccagggcaaggaggccuggggccccggccacaaggaggccaccauggagcuccuccgcgucaaggaccgcgccaucgagcucgagcgcaacaacgccgcccuccaggccgagaagcagcuccucaaggagcagcuccagcaccucgagacccagaacgucaccuucuccucccagauccucacccuccagaagcaguccgccuuccuccaggagcacaacaccacccuccagacccagaccgccaagcuccaggucgagaacuccacccucuccucccaguccgccgcccucaccgcccaguacacccuccuccagaaccaccacaccgccaaggagaccgagaacgagucccuccagcgccagcaggagcagcucaccgccgccuacgaggcccuccuccaggaccacgagcaccucggcacccuccacgagcgccaguccgccgaguacgaggcccucauccgccagcacuccugccucaagacccuccaccgcaaccucgagcucgagcacaaggagcucggcgagcgccacggcgacaugcucaagcgcaaggccgagcucgaggagcgcgagaagguccucaccaccgagcgcgaggcccuccagcaggagcagcgcaccaacgcccucgccaugggcgagaaccagcgccuccgcggcgagcucgaccgcgucaacuuccuccaccaccagcucaagggcgaguacgaggagcuccacgcccacaccaaggagcucaagaccucccucaacaacgcccagcucgagcucaaccgcuggcaggcccgcuucgacgagcucaaggagcagcaccagaccauggacaucucccucaccaagcucgacaaccacugcgagcuccucucccgccucaagggcaaccucgaggaggagaaccaccaccuccucucccagauccagcuccucucccagcagaaccagaugcuccucgagcagaacauggagaacaaggagcaguaccacgaggagcagaagcaguacaucgacaagcucaacgcccuccgccgccacaaggagaagcucgaggagaagaucauggaccaguacaaguucuacgaccccccccccaagaagaagaaccacuggaucggcgccaaggcccucgucaagcucaucaagcccaagaaggagggcucccgcgagcgccucaaguccaccgucgacuccccccccuggcagcucgaguccuccgaccccgccucccccgccgccucccagccccuccgcucccaggccgagaaccccgacacccccgcccucggcuccaacugcgccgaggagcgcgacgcccacaacggcuccgucggcaagggccccggcgaccucaagcccaagcgcggcuccccccaccgcggcucccucgaccgcaccgacgccuccaccgaccucgccaugcgcuccuggcccuccgagcucggcucccgcaccugcuccaccuccgccaccaccaccgcccccuccaacuccacccccaucgcccgccaccccggccgcaccaagggcuacaacuccgacgacaaccucugcgagcccucccucgaguucgagguccccaaccaccgccaguacgucucccgccccuccucccucgaguccucccgcaacaccuccuccaacuccuccccccucaaccucaagggcuccuccgagcagcuccacggccgcuccgaguccuucuccuccgaggaccucauccccucccgcgaccucgccacccucccccgcgaggccuccacccccggccgcaacgcccucggccgccacgaguacccccucccccgcaacggcccccucccccaggagggcgcccagaagcgcggcaccgccccccccuacgucggcguccgccccugcuccgccucccccuccuccgagauggucacccucgaggaguuccucgaggaguccaaccgcuccucccccacccacgacacccccuccugccgcgacgaccuccucuccgacuacuuccgcaaggccuccgacccccccgccaucggcggccagcccggcccccccgccaagaaggagggcgccaagaugcccaccaacuucgucgcccccaccgucaagauggccgcccccaccuccgagggccgcccccucaagcccggccaguacgucaagcccaacuuccgccucaccgaggccgaggccccccccuccgucgccccccgccaggcccagcccccccagucccucucccucggccgcccccgccaggcccccgucccccccgccucccacgcccccgccucccgcuccgccucccucucccgcgccuucucccucgccuccgccgaccuccuccgcgccuccggccccgaggccugcaagcaggaguccccccagaagcucggcgcccccgaggcccucggcggccgcgagaccggcucccacacccuccagucccccgccccccccuccucccacucccucgcccgcgagcgcaccccccucgucggcaaggccggcuccuccugccagggccccggcccccgcucccgcccccucgacacccgccgcuucucccucgccccccccaaggaggagcgccucgccccccuccaccaguccgccaccgcccccgccaucgccaccgccggcgccggcgccgccgccgccggcuccggcuccaacucccagcuccuccacuucucccccgccgccgcccccgccgcccgcaccaagcccaaggcccccccccgcuccggcgaggucgccaccaucacccccguccgcgccggccucucccucuccgagggcgacggcguccccggccagggcugcuccgagggccuccccgccaagucccccggccgcucccccgaccucgccccccaccucggccgcgcccucgaggacugcucccgcggcuccgucuccaaguccucccccgccucccccgagcccggcggcgacccccagaccgucugguacgaguacggcugcgucuga

SEQ ID NO: 40878 - RNA, 1617 nt, Artificial Sequence
  derived and/or modified sequence opt2 from CCDC8__Homo_sapiens__NP_114429
augcuccagaucggcgaggacgucgacuaccuccucaucccccgcgagguccgccucgccggcggcgucuggcgcgucaucuccaagcccgccaccaaggaggccgaguuccgcgagcgccucacccaguuccucgaggaggagggccgcacccucgaggacgucgcccgcaucauggagaaguccaccccccaccccccccagccccccaagaagcccaaggagccccgcguccgccgccgcguccagcagauggucaccccccccccccgccucgucgucggcaccuacgacuccuccaacgccuccgacuccgaguucuccgacuucgagaccucccgcgacaagucccgccagggcccccgccgcggcaagaagguccgcaagaugcccgucuccuaccucggcuccaaguuccucggcuccgaccucgaguccgaggacgacgaggagcucgucgaggccuuccuccgccgccaggagaagcagcccuccgccccccccgcccgccgccgcgucaaccuccccguccccauguucgaggacaaccucggcccccagcucuccaaggccgaccgcuggcgcgaguacgucucccaggucuccuggggcaagcucaagcgccgcgucaagggcugggccccccgcgccggccccggcgucggcgaggcccgccucgccuccaccgccgucgaguccgccggcgucuccuccgcccccgagggcaccucccccggcgaccgccucggcaacgccggcgacgucugcgucccccaggccuccccccgccgcuggcgccccaagaucaacugggccuccuuccgccgccgccgcaaggagcagaccgcccccaccggccagggcgccgacaucgaggccgaccagggcggcgaggccgccgacucccagcgcgaggaggccaucgccgaccagcgcgagggcgccgccggcaaccagcgcgccggcgcccccgccgaccagggcgccgaggccgccgacaaccagcgcgaggaggccgccgacaaccagcgcgccggcgcccccgccgaggagggcgccgaggccgccgacaaccagcgcgaggaggccgccgacaaccagcgcgccgaggcccccgccgaccagcgcucccagggcaccgacaaccaccgcgaggaggccgccgacaaccagcgcgccgaggcccccgccgaccagggcuccgaggucaccgacaaccagcgcgaggaggccguccacgaccagcgcgagcgcgcccccgccguccagggcgccgacaaccagcgcgcccaggcccgcgccggccagcgcgccgaggccgcccacaaccagcgcgccggcgcccccggcauccaggaggccgaggucuccgccgcccagggcaccaccggcaccgcccccggcgcccgcgcccgcaagcaggucaagaccguccgcuuccagacccccggccgcuucuccugguucugcaagcgccgccgcgccuucuggcacaccccccgccuccccacccuccccaagcgcgucccccgcgccggcgaggcccgcaaccuccgcguccuccgcgccgaggcccgcgccgaggccgagcagggcgagcaggaggaccagcucuga

SEQ ID NO: 40879 - RNA, 1326 nt, Artificial Sequence
  derived and/or modified sequence opt2 from CCDC91__Homo_sapiens__NP_060788
auggacgacgacgacuucggcggcuucgaggccgccgagaccuucgacggcggcuccggcgagacccagaccaccucccccgccauccccugggccgccuuccccgccgucuccggcguccaccucucccccuccucccccgagaucguccucgaccgcgaccacuccuccuccaucggcugccucuccuccgacgccaucaucuccucccccgagaacacccacgccgccaacuccaucgucucccagaccauccccaaggcccagauccagcaguccacccacacccaccucgacaucucccucuucccccucggccucaccgacgagaaguccaacggcaccaucgcccucgucgacgacuccgaggaccccggcgccaacgucuccaacauccagcuccagcagaagaucuccucccucgagaucaagcucaaggucuccgaggaggagaagcagcgcaucaagcaggacgucgagucccucauggagaagcacaacguccucgagaagggcuuccucaaggagaaggagcaggaggccaucuccuuccaggaccgcuacaaggagcuccaggagaagcacaagcaggagcucgaggacaugcgcaaggccggccacgaggcccucuccaucaucgucgacgaguacaaggcccuccuccaguccuccgucaagcagcaggucgaggccaucgagaagcaguacaucuccgccaucgagaagcaggcccacaagugcgaggagcuccucaacgcccagcaccagcgccuccucgagaugcucgacaccgagaaggagcuccucaaggagaagaucaaggaggcccucauccagcagucccaggagcagaaggagauccucgagaagugccucgaggaggagcgccagcgcaacaaggaggcccucgucuccgccgccaagcucgagaaggaggccgucaaggacgccguccucaaggucgucgaggaggagcgcaagaaccucgagaaggcccacgccgaggagcgcgagcucuggaagaccgagcacgccaaggaccaggagaaggucucccaggagauccagaaggccauccaggagcagcgcaagaucucccaggagaccgucaaggccgccaucaucgaggagcagaagcgcuccgagaaggccgucgaggaggccgucaagcgcacccgcgacgagcucaucgaguacaucaaggagcagaagcgccucgaccaggucauccgccagcgcucccucuccucccucgagcucuuccucuccugcgcccagaagcagcucuccgcccucaucgccaccgagcccgucgacaucgaguga

SEQ ID NO: 40880 - RNA, 972 nt, Artificial Sequence
  derived and/or modified sequence opt2 from CCDC94__Homo_sapiens__NP_060544
auguccgagcgcaagguccucaacaaguacuacccccccgacuucgaccccuccaagauccccaagcucaagcuccccaaggaccgccaguacgucguccgccucauggcccccuucaacaugcgcugcaagaccugcggcgaguacaucuacaagggcaagaaguucaacgcccgcaaggagaccguccagaacgaggucuaccucggccuccccaucuuccgcuucuacaucaagugcacccgcugccucgccgagaucaccuucaagaccgaccccgagaacaccgacuacaccauggagcacggcgccacccgcaacuuccaggccgagaagcuccucgaggaggaggagaagcgcguccagaaggagcgcgaggacgaggagcucaacaaccccaugaagguccucgagaaccgcaccaaggacuccaagcucgagauggagguccucgagaaccuccaggagcucaaggaccucaaccagcgccaggcccacgucgacuucgaggccaugcuccgccagcaccgccucuccgaggaggagcgccgccgccagcagcaggaggaggacgagcaggagaccgccgcccuccucgaggaggcccgcaagcgccgccuccucgaggacuccgacuccgaggacgaggccgcccccuccccccuccagcccgcccuccgccccaaccccaccgccauccucgacgaggcccccaagcccaagcgcaaggucgaggucugggagcaguccgucggcucccucggcucccgccccccccucucccgccucgucgucgucaagaaggccaaggccgaccccgacugcuccaacggccagccccaggccgcccccacccccggcgccccccagaaccgcaaggaggccaaccccaccccccucacccccggcgccuccucccucucccagcucggcgccuaccucgacuccgacgacuccaacggcuccaacuga

SEQ ID NO: 40881 - RNA, 1032 nt, Artificial Sequence
  derived and/or modified sequence opt2 from CCDC97__Homo_sapiens__NP_443080
auggaggccgucgccaccgccaccgccgccaaggagcccgacaagggcugcaucgagcccggccccggccacuggggcgagcucucccgcacccccguccccuccaagccccaggacaaggucgaggccgccgaggccacccccgucgcccucgacuccgacaccuccggcgccgagaacgccgccgucuccgccaugcuccacgccgucgccgccucccgccuccccgucugcucccagcagcagggcgagcccgaccucaccgagcacgagaaggucgccauccucgcccagcucuaccacgagaagccccucgucuuccucgagcgcuuccgcaccggccuccgcgaggagcaccucgccugcuucggccacguccgcggcgaccaccgcgccgacuucuacugcgccgaggucgcccgccagggcaccgcccgcccccgcacccuccgcacccgccuccgcaaccgccgcuacgccgcccuccgcgagcucauccagggcggcgaguacuucuccgacgagcagaugcgcuuccgcgccccccuccucuacgagcaguacaucggccaguaccucacccaggaggagcucuccgcccgcacccccacccaccagccccccaagcccggcucccccggccgccccgccugcccccucuccaaccuccuccuccaguccuacgaggagcgcgagcuccagcagcgccuccuccagcagcaggaggaggaggaggccugccucgaggaggaggaggaggaggaggacuccgacgaggaggaccagcgcuccggcaaggacuccgaggccuggguccccgacuccgaggagcgccucauccuccgcgaggaguucaccucccgcaugcaccagcgcuuccucgacggcaaggacggcgacuucgacuacuccaccgucgacgacaaccccgacuucgacaaccucgacaucgucgcccgcgacgaggaggagcgcuacuucgacgaggaggagcccgaggacgcccccucccccgagcucgacggcgacuga

SEQ ID NO: 40882 - RNA, 2508 nt, Artificial Sequence
  derived and/or modified sequence opt2 from CCHCR1__Homo_sapiens__NP_001099033
auguggccccacuccgccggcgcccgccccugggccuccacccucaccggcaaggacccccgcgucauggccugcuggugccucgacggccuccccuccggccucgccgagcccuggcgcgagcucuggcgcuggcgcucccgcccccuccacugcgucccccccuucuccccccucgcccgcuccucccgcgaccaccgcaaccuccgccgccgcggcaacaucgacggcuggcgccagaaccucgagcccuccaacaacgucgagauguucccccccuccggccaccaggacgucuccgagcgccgccucgacacccagcgcccccaggucaccaugugggagcgcgacgucuccuccgaccgccaggagcccggccgccgcggccgcuccuggggccucgagggcucccaggcccucucccagcaggccgaggucaucguccgccagcuccaggagcuccgccgccucgaggaggagguccgccuccuccgcgagaccucccuccagcagaagaugcgccucgaggcccaggccauggagcucgaggcccucgcccgcgccgagaaggccggccgcgccgaggccgagggccuccgcgccgcccucgccggcgccgaggucguccgcaagaaccucgaggagggcucccagcgcgagcucgaggagguccagcgccuccaccaggagcagcucuccucccucacccaggcccacgaggaggcccucuccucccucaccuccaaggccgagggccucgagaagucccucuccucccucgagacccgccgcgccggcgaggccaaggagcucgccgaggcccagcgcgaggccgagcuccuccgcaagcagcucuccaagacccaggaggaccucgaggcccaggucacccucgucgagaaccuccgcaaguacgucggcgagcagguccccuccgagguccacucccagaccugggagcucgagcgccagaagcuccucgagaccaugcagcaccuccaggaggaccgcgacucccuccacgccaccgccgagcuccuccagguccgcguccagucccucacccacauccucgcccuccaggaggaggagcucacccgcaagguccagcccuccgacucccucgagcccgaguucacccgcaagugccagucccuccucaaccgcuggcgcgagaaggucuucgcccucaugguccagcucaaggcccaggagcucgagcacuccgacuccgucaagcagcucaagggccaggucgccucccuccaggagaaggucaccucccagucccaggagcaggccauccuccagcgcucccuccaggacaaggccgccgaggucgaggucgagcgcaugggcgccaagggccuccagcucgagcucucccgcgcccaggaggcccgccgccgcuggcagcagcagaccgccuccgccgaggagcagcuccgccucgucgucaacgccgucuccuccucccagaucuggcucgagaccaccauggccaaggucgagggcgccgccgcccagcuccccucccucaacaaccgccucuccuacgccguccgcaagguccacaccauccgcggccucaucgcccgcaagcucgcccucgcccagcuccgccaggaguccugcccccuccccccccccgucaccgacgucucccucgagcuccagcagcuccgcgaggagcgcaaccgccucgacgccgagcuccagcucuccgcccgccucauccagcaggaggucggccgcgcccgcgagcagggcgaggccgagcgccagcagcucuccaaggucgcccagcagcucgagcaggagcuccagcagacccaggagucccucgccucccucggccuccagcucgaggucgcccgccagggccagcaggaguccaccgaggaggccgccucccuccgccaggagcucacccagcagcaggagcucuacggccaggcccuccaggagaaggucgccgaggucgagacccgccuccgcgagcagcucuccgacaccgagcgccgccucaacgaggcccgccgcgagcacgccaaggccgucgucucccuccgccagauccagcgccgcgccgcccaggagaaggagcgcucccaggagcuccgccgccuccaggaggaggcccgcaaggaggagggccagcgccucgcccgccgccuccaggagcucgagcgcgacaagaaccucaugcucgccacccuccagcaggagggccuccucucccgcuacaagcagcagcgccuccucaccguccuccccucccuccucgacaagaagaaguccgucgucuccuccccccgcccccccgagugcuccgccuccgcccccgucgccgccgccguccccacccgcgaguccaucaagggcucccucuccguccuccucgacgaccuccaggaccucuccgaggccaucuccaaggaggaggccgucugccagggcgacaaccucgaccgcugcuccuccuccaacccccagauguccuccuga

SEQ ID NO: 40883 - RNA, 1287 nt, Artificial Sequence
  derived and/or modified sequence opt2 from CCKAR__Homo_sapiens__NP_000721
auggacgucgucgacucccuccucgucaacggcuccaacaucaccccccccugcgagcucggccucgagaacgagacccucuucugccucgaccagccccgccccuccaaggaguggcagcccgccguccagauccuccucuacucccucaucuuccuccucuccguccucggcaacacccucgucaucaccguccucauccgcaacaagcgcaugcgcaccgucaccaacaucuuccuccucucccucgccgucuccgaccucaugcucugccucuucugcaugcccuucaaccucauccccaaccuccucaaggacuucaucuucggcuccgccgucugcaagaccaccaccuacuucaugggcaccuccgucuccgucuccaccuucaaccucgucgccaucucccucgagcgcuacggcgccaucugcaagccccuccagucccgcgucuggcagaccaagucccacgcccucaaggucaucgccgccaccuggugccucuccuucaccaucaugacccccuaccccaucuacuccaaccucguccccuucaccaagaacaacaaccagaccgccaacaugugccgcuuccuccuccccaacgacgucaugcagcaguccuggcacaccuuccuccuccucauccucuuccucauccccggcaucgucaugauggucgccuacggccucaucucccucgagcucuaccagggcaucaaguucgaggccucccagaagaaguccgccaaggagcgcaagcccuccaccaccuccuccggcaaguacgaggacuccgacggcugcuaccuccagaagacccgccccccccgcaagcucgagcuccgccagcucuccaccggcuccuccucccgcgccaaccgcauccgcuccaacuccuccgccgccaaccucauggccaagaagcgcgucauccgcaugcucaucgucaucgucguccucuucuuccucugcuggaugcccaucuucuccgccaacgccuggcgcgccuacgacaccgccuccgccgagcgccgccucuccggcacccccaucuccuucauccuccuccucuccuacaccuccuccugcgucaaccccaucaucuacugcuucaugaacaagcgcuuccgccucggcuucauggccaccuuccccugcugccccaaccccggcccccccggcgcccgcggcgaggucggcgaggaggaggagggcggcaccaccggcgccucccucucccgcuucuccuacucccacauguccgccuccguccccccccaguga

SEQ ID NO: 40884 - RNA, 1344 nt, Artificial Sequence
  derived and/or modified sequence opt2 from CCKBR__Homo_sapiens__NP_795344
auggagcuccucaagcucaaccgcuccguccagggcaccggccccggccccggcgccucccucugccgccccggcgccccccuccucaacuccuccuccgucggcaaccucuccugcgagcccccccgcauccgcggcgccggcacccgcgagcucgagcucgccauccgcaucacccucuacgccgucaucuuccucauguccgucggcggcaacaugcucaucaucgucguccucggccucucccgccgccuccgcaccgucaccaacgccuuccuccucucccucgccgucuccgaccuccuccucgccgucgccugcaugcccuucacccuccuccccaaccucaugggcaccuucaucuucggcaccgucaucugcaaggccgucuccuaccucaugggcgucuccgucuccgucuccacccucucccucgucgccaucgcccucgagcgcuacuccgccaucugccgcccccuccaggcccgcgucuggcagacccgcucccacgccgcccgcgucaucgucgccaccuggcuccucuccggccuccucaugguccccuaccccgucuacaccgucguccagcccgucggcccccgcguccuccagugcguccaccgcuggcccuccgcccgcguccgccagaccugguccguccuccuccuccuccuccucuucuucauccccggcgucgucauggccgucgccuacggccucaucucccgcgagcucuaccucggccuccgcuucgacggcgacuccgacuccgacucccagucccgcguccgcaaccagggcggccuccccggcgccguccaccagaacggccgcugccgccccgagaccggcgccgucggcgaggacuccgacggcugcuacguccagcucccccgcucccgccccgcccucgagcucaccgcccucaccgcccccggccccggcuccggcucccgccccacccaggccaagcuccucgccaagaagcgcgucguccgcaugcuccucgucaucgucguccucuucuuccucugcuggcuccccgucuacuccgccaacaccuggcgcgccuucgacggccccggcgcccaccgcgcccucuccggcgcccccaucuccuucauccaccuccucuccuacgccuccgccugcgucaacccccucgucuacugcuucaugcaccgccgcuuccgccaggccugccucgagaccugcgcccgcugcugcccccgccccccccgcgcccgcccccgcgcccuccccgacgaggacccccccacccccuccaucgccucccucucccgccucuccuacaccaccaucuccacccucggccccggcuga

SEQ ID NO: 40885 - RNA, 348 nt, Artificial Sequence
  derived and/or modified sequence opt2 from CCK__Homo_sapiens__NP_000720
augaacuccggcgucugccucugcguccucauggccguccucgccgccggcgcccucacccagcccgucccccccgccgaccccgccggcuccggccuccagcgcgccgaggaggccccccgccgccagcuccgcgucucccagcgcaccgacggcgagucccgcgcccaccucggcgcccuccucgcccgcuacauccagcaggcccgcaaggcccccuccggccgcauguccaucgucaagaaccuccagaaccucgaccccucccaccgcaucuccgaccgcgacuacaugggcuggauggacuucggccgccgcuccgccgaggaguacgaguaccccuccuga

SEQ ID NO: 40886 - RNA, 294 nt, Artificial Sequence
  derived and/or modified sequence opt2 from CCL11__Homo_sapiens__NP_002977
augaaggucuccgccgcccuccucuggcuccuccucaucgccgccgccuucuccccccagggccucgccggccccgccuccguccccaccaccugcugcuucaaccucgccaaccgcaagaucccccuccagcgccucgaguccuaccgccgcaucaccuccggcaagugcccccagaaggccgucaucuucaagaccaagcucgccaaggacaucugcgccgaccccaagaagaaguggguccaggacuccaugaaguaccucgaccagaagucccccacccccaagcccuga

SEQ ID NO: 40887 - RNA, 297 nt, Artificial Sequence
  derived and/or modified sequence opt2 from CCL13__Homo_sapiens__NP_005399
augaaggucuccgccguccuccucugccuccuccucaugaccgccgccuucaacccccagggccucgcccagcccgacgcccucaacguccccuccaccugcugcuucaccuucuccuccaagaagaucucccuccagcgccucaaguccuacgucaucaccaccucccgcugcccccagaaggccgucaucuuccgcaccaagcucggcaaggagaucugcgccgaccccaaggagaaguggguccagaacuacaugaagcaccucggccgcaaggcccacacccucaagaccuga

SEQ ID NO: 40888 - RNA, 330 nt, Artificial Sequence
  derived and/or modified sequence opt2 from CCL14__Homo_sapiens__NP_116738
augaagaucuccgucgccgccauccccuucuuccuccucaucaccaucgcccucggcaccaagaccgaguccuccucccagaccggcggcaagcccaaggucgucaagauccagcucaagcucgucggcggccccuaccaccccuccgagugcugcuucaccuacaccaccuacaagaucccccgccagcgcaucauggacuacuacgagaccaacucccagugcuccaagcccggcaucgucuucaucaccaagcgcggccacuccgucugcaccaaccccuccgacaaguggguccaggacuacaucaaggacaugaaggagaacuga

SEQ ID NO: 40889 - RNA, 342 nt, Artificial Sequence
  derived and/or modified sequence opt2 from CCL15__Homo_sapiens__NP_116741
augaaggucuccgucgccgcccucuccugccucaugcucgucgccguccucggcucccaggcccaguucaccaacgacgccgagaccgagcucaugauguccaagcucccccucgagaaccccgucguccucaacuccuuccacuucgccgccgacugcugcaccuccuacaucucccaguccauccccugcucccucaugaaguccuacuucgagaccuccuccgagugcuccaagcccggcgucaucuuccucaccaagaagggccgccaggucugcgccaagcccuccggccccggcguccaggacugcaugaagaagcucaagcccuacuccaucuga

SEQ ID NO: 40890 - RNA, 363 nt, Artificial Sequence
  derived and/or modified sequence opt2 from CCL16__Homo_sapiens__XP_005258077
augaaggucuccgaggccgcccucucccuccucguccucauccucaucaucaccuccgccucccgcucccagcccaagguccccgagugggucaacacccccuccaccugcugccucaaguacuacgagaagguccucccccgccgccucgucgucggcuaccgcaaggcccucaacugccaccuccccgccaucaucuucgucaccaagcgcaaccgcgaggucugcaccaaccccaacgacgacuggguccaggaguacaucaaggaccccaaccucccccuccuccccacccgcaaccucuccaccgucaagaucaucaccgccaagaacggccagccccagcuccucaacucccaguga

SEQ ID NO: 40891 - RNA, 285 nt, Artificial Sequence
  derived and/or modified sequence opt2 from CCL17__Homo_sapiens__NP_002978
auggccccccucaagaugcucgcccucgucacccuccuccucggcgccucccuccagcacauccacgccgcccgcggcaccaacgucggccgcgagugcugccucgaguacuucaagggcgccaucccccuccgcaagcucaagaccugguaccagaccuccgaggacugcucccgcgacgccaucgucuucgucaccguccagggccgcgccaucugcuccgaccccaacaacaagcgcgucaagaacgccgucaaguaccuccagucccucgagcgcuccuga

SEQ ID NO: 40892 - RNA, 270 nt, Artificial Sequence
  derived and/or modified sequence opt2 from CCL18__Homo_sapiens__NP_002979
augaagggccucgccgccgcccuccucguccucgucugcaccauggcccucugcuccugcgcccaggucggcaccaacaaggagcucugcugccucgucuacaccuccuggcagaucccccagaaguucaucgucgacuacuccgagaccuccccccagugccccaagcccggcgucauccuccucaccaagcgcggccgccagaucugcgccgaccccaacaagaaguggguccagaaguacaucuccgaccucaagcucaacgccuga

SEQ ID NO: 40893 - RNA, 297 nt, Artificial Sequence
  derived and/or modified sequence opt2 from CCL19__Homo_sapiens__NP_006265
auggcccuccuccucgcccucucccuccucguccucuggaccucccccgcccccacccucuccggcaccaacgacgccgaggacugcugccucuccgucacccagaagcccauccccggcuacaucguccgcaacuuccacuaccuccucaucaaggacggcugccgcguccccgccgucgucuucaccacccuccgcggccgccagcucugcgccccccccgaccagcccugggucgagcgcaucauccagcgccuccagcgcaccuccgccaagaugaagcgccgcuccuccuga

SEQ ID NO: 40894 - RNA, 291 nt, Artificial Sequence
  derived and/or modified sequence opt2 from CCL1__Homo_sapiens__NP_002972
augcagaucaucaccaccgcccucgucugccuccuccucgccggcauguggcccgaggacgucgacuccaaguccaugcagguccccuucucccgcugcugcuucuccuucgccgagcaggagaucccccuccgcgccauccucugcuaccgcaacaccuccuccaucugcuccaacgagggccucaucuucaagcucaagcgcggcaaggaggccugcgcccucgacaccgucggcuggguccagcgccaccgcaagaugcuccgccacugccccuccaagcgcaaguga

SEQ ID NO: 40895 - RNA, 288 nt, Artificial Sequence
  derived and/or modified sequence opt2 from CCL20__Homo_sapiens__NP_001123518
augugcugcaccaagucccuccuccucgccgcccucauguccguccuccuccuccaccucugcggcgaguccgaggccuccaacuucgacugcugccucggcuacaccgaccgcauccuccaccccaaguucaucgucggcuucacccgccagcucgccaacgagggcugcgacaucaacgccaucaucuuccacaccaagaagaagcucuccgucugcgccaaccccaagcagaccugggucaaguacaucguccgccuccucuccaagaaggucaagaacauguga

SEQ ID NO: 40896 - RNA, 405 nt, Artificial Sequence
  derived and/or modified sequence opt2 from CCL21__Homo_sapiens__NP_002980
auggcccagucccucgcccucucccuccucauccucguccucgccuucggcaucccccgcacccagggcuccgacggcggcgcccaggacugcugccucaaguacucccagcgcaagauccccgccaaggucguccgcuccuaccgcaagcaggagcccucccucggcugcuccauccccgccauccucuuccucccccgcaagcgcucccaggccgagcucugcgccgaccccaaggagcucuggguccagcagcucaugcagcaccucgacaagacccccuccccccagaagcccgcccagggcugccgcaaggaccgcggcgccuccaagaccggcaagaagggcaagggcuccaagggcugcaagcgcaccgagcgcucccagacccccaagggccccuga

SEQ ID NO: 40897 - RNA, 282 nt, Artificial Sequence
  derived and/or modified sequence opt2 from CCL22__Homo_sapiens__NP_002981
auggaccgccuccagaccgcccuccucgucguccucguccuccucgccgucgcccuccaggccaccgaggccggccccuacggcgccaacauggaggacuccgucugcugccgcgacuacguccgcuaccgccucccccuccgcgucgucaagcacuucuacuggaccuccgacuccugcccccgccccggcgucguccuccucaccuuccgcgacaaggagaucugcgccgacccccgcguccccugggucaagaugauccucaacaagcucucccaguga

SEQ ID NO: 40898 - RNA, 414 nt, Artificial Sequence
  derived and/or modified sequence opt2 from CCL23__Homo_sapiens__NP_005055
augaaggucuccgucgccgcccucuccugccucaugcucgucaccgcccucggcucccaggcccgcgucaccaaggacgccgagaccgaguucaugauguccaagcucccccucgagaaccccguccuccucgacaugcucuggcgccgcaagaucggcccccagaugacccucucccacgccgccggcuuccacgccaccuccgccgacugcugcaucuccuacaccccccgcuccauccccugcucccuccucgaguccuacuucgagaccaacuccgagugcuccaagcccggcgucaucuuccucaccaagaagggccgccgcuucugcgccaaccccuccgacaagcagguccaggucugcaugcgcaugcucaagcucgacacccgcaucaagacccgcaagaacuga

SEQ ID NO: 40899 - RNA, 360 nt, Artificial Sequence
  derived and/or modified sequence opt2 from CCL24__Homo_sapiens__XP_011514762
auggccggccucaugaccaucgucaccucccuccucuuccucggcgucugcgcccaccacaucauccccaccggcuccgucgucauccccucccccugcugcauguucuucgucuccaagcgcauccccgagaaccgcgucgucuccuaccagcucuccucccgcuccaccugccucaaggccggcgucaucuucaccaccaagaagggccagcaguucugcggcgaccccaagcaggaguggguccagcgcuacaugaagaaccucgacgccaagcagaagaaggccuccccccgcgcccgcgccgucgccgucaagggccccguccagcgcuaccccggcaaccagaccaccugcuga

SEQ ID NO: 40900 - RNA, 450 nt, Artificial Sequence
  derived and/or modified sequence opt2 from CCL25__Homo_sapiens__NP_001188288
augaaccucuggcuccucgccugccucgucgccggcuuccucggcgccugggcccccgccguccacacccagggcgucuucgaggacugcugccucgccuaccacuaccccaucggcugggccguccuccgccgcgccuggaccuaccgcauccaggaggucuccggcuccugcaaccuccccgccgccaucuucuaccuccccaagcgccaccgcaaggucugcggcaaccccaagucccgcgagguccagcgcgccaugaagcuccucgacgcccgcaacaaggucuucgccaagcuccaccacaacacccagaccuuccagggcccccacgccgucaagaagcucuccuccggcaacuccaagcucuccuccuccaaguucuccaaccccaucuccuccuccaagcgcaacgucucccuccucaucuccgccaacuccggccucuga

SEQ ID NO: 40901 - RNA, 285 nt, Artificial Sequence
  derived and/or modified sequence opt2 from CCL26__Homo_sapiens__NP_006063
augaugggccucucccucgccuccgccguccuccucgccucccuccucucccuccaccucggcaccgccacccgcggcuccgacaucuccaagaccugcugcuuccaguacucccacaagccccuccccuggaccuggguccgcuccuacgaguucaccuccaacuccugcucccagcgcgccgucaucuucaccaccaagcgcggcaagaaggucugcacccacccccgcaagaaguggguccagaaguacaucucccuccucaagacccccaagcagcucuga

SEQ ID NO: 40902 - RNA, 339 nt, Artificial Sequence
  derived and/or modified sequence opt2 from CCL27__Homo_sapiens__NP_006655
augaagggcccccccaccuucugcucccuccuccuccucucccuccuccucucccccgaccccaccgccgccuuccuccucccccccuccaccgccugcugcacccagcucuaccgcaagccccucuccgacaagcuccuccgcaaggucauccaggucgagcuccaggaggccgacggcgacugccaccuccaggccuucguccuccaccucgcccagcgcuccaucugcauccacccccagaaccccucccucucccagugguucgagcaccaggagcgcaagcuccacggcacccuccccaagcucaacuucggcaugcuccgcaagaugggcuga

SEQ ID NO: 40903 - RNA, 384 nt, Artificial Sequence
  derived and/or modified sequence opt2 from CCL28__Homo_sapiens__NP_001288802
augcagcagcgcggccucgccaucgucgcccucgccgucugcgccgcccuccacgccuccgaggccauccuccccaucgccuccuccugcugcaccgaggucucccaccacaucucccgccgccuccucgagcgcgucaacaugugccgcauccagcgcgccgacggcgacugcgaccucgccgccgucauccuccacgucaagcgccgccgcaucugcgucuccccccacaaccacaccgucaagcaguggaugaagguccaggccgccaagaagaacggcaagggcaacgucugccaccgcaagaagcaccacggcaagcgcaacuccaaccgcgcccaccagggcaagcacgagaccuacggccacaagacccccuacuga

SEQ ID NO: 40904 - RNA, 300 nt, Artificial Sequence
  derived and/or modified sequence opt2 from CCL2__Homo_sapiens__NP_002973
augaaggucuccgccgcccuccucugccuccuccucaucgccgccaccuucaucccccagggccucgcccagcccgacgccaucaacgcccccgucaccugcugcuacaacuucaccaaccgcaagaucuccguccagcgccucgccuccuaccgccgcaucaccuccuccaagugccccaaggaggccgucaucuucaagaccaucgucgccaaggagaucugcgccgaccccaagcagaaguggguccaggacuccauggaccaccucgacaagcagacccagacccccaagaccuga

SEQ ID NO: 40905 - RNA, 279 nt, Artificial Sequence
  derived and/or modified sequence opt2 from CCL3__Homo_sapiens__NP_002974
augcaggucuccaccgccgcccucgccguccuccucugcaccauggcccucugcaaccaguucuccgccucccucgccgccgacacccccaccgccugcugcuucuccuacaccucccgccagaucccccagaacuucaucgccgacuacuucgagaccuccucccagugcuccaagcccggcgucaucuuccucaccaagcgcucccgccaggucugcgccgaccccuccgaggaguggguccagaaguacgucuccgaccucgagcucuccgccuga

SEQ ID NO: 40906 - RNA, 282 nt, Artificial Sequence
  derived and/or modified sequence opt2 from CCL3L3__Homo_sapiens__NP_001001437
augcaggucuccaccgccgcccucgccguccuccucugcaccauggcccucugcaaccagguccucuccgccccccucgccgccgacacccccaccgccugcugcuucuccuacaccucccgccagaucccccagaacuucaucgccgacuacuucgagaccuccucccagugcuccaagcccuccgucaucuuccucaccaagcgcggccgccaggucugcgccgaccccuccgaggaguggguccagaaguacgucuccgaccucgagcucuccgccuga

SEQ ID NO: 40907 - RNA, 279 nt, Artificial Sequence
  derived and/or modified sequence opt2 from CCL4__Homo_sapiens__NP_002975
augaagcucugcgucaccguccucucccuccucaugcucgucgccgccuucugcucccccgcccucuccgcccccaugggcuccgacccccccaccgccugcugcuucuccuacaccgcccgcaagcucccccgcaacuucgucgucgacuacuacgagaccuccucccucugcucccagcccgccgucgucuuccagaccaagcgcuccaagcaggucugcgccgaccccuccgaguccuggguccaggaguacgucuacgaccucgagcucaacuga

SEQ ID NO: 40908 - RNA, 279 nt, Artificial Sequence
  derived and/or modified sequence opt2 from CCL4L1__Homo_sapiens__NP_996890
augaagcucugcgucaccguccucucccuccucguccucgucgccgccuucugcucccucgcccucuccgcccccaugggcuccgacccccccaccgccugcugcuucuccuacaccgcccgcaagcucccccgcaacuucgucgucgacuacuacgagaccuccucccucugcucccagcccgccgucgucuuccagaccaagcgcggcaagcaggucugcgccgaccccuccgaguccuggguccaggaguacgucuacgaccucgagcucaacuga

SEQ ID NO: 40909 - RNA, 264 nt, Artificial Sequence
  derived and/or modified sequence opt2 from CCL4L2__Homo_sapiens__NP_001278397
augaagcucugcgucaccguccucucccuccucguccucgucgccgccuucugcucccucgcccucuccgcccccaugggcuccgacccccccaccgccugcugcuucuccuacaccgcccgcaagcucccccgcaacuucgucgucgacuacuacgagaccuccucccucugcucccagcccgccgucgucggcaagcaggucugcgccgaccccuccgaguccuggguccaggaguacgucuacgaccucgagcucaacuga

SEQ ID NO: 40910 - RNA, 465 nt, Artificial Sequence
  derived and/or modified sequence opt2 from CCL5__Homo_sapiens__NP_001265665
augaaggucuccgccgccgcccucgccgucauccucaucgccaccgcccucugcgcccccgccuccgccucccccuacuccuccgacaccacccccugcugcuucgccuacaucgcccgcccccucccccgcgcccacaucaaggaguacuucuacaccuccggcaagugcuccaaccccgccgucguccaccgcucccgcaugcccaagcgcgagggccagcaggucuggcaggacuuccucuacgacucccgccucaacaagggcaagcucugccaccccaaggagccccccuccgucugccagccccgcgaggagaugggcuccggcguccaccagcucuucggcgacgagcucggcuggcgcguccucgagcccgagcucacccagaucugccucuuccuccucgcccucguccucgccugggaggccuccccccacuaccccaccccccccgcccccuga

SEQ ID NO: 40911 - RNA, 300 nt, Artificial Sequence
  derived and/or modified sequence opt2 from CCL7__Homo_sapiens__NP_006264
augaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucuga

SEQ ID NO: 40912 - RNA, 300 nt, Artificial Sequence
  derived and/or modified sequence opt2 from CCL8__Homo_sapiens__NP_005614
augaaggucuccgccgcccuccucugccuccuccucauggccgccaccuucuccccccagggccucgcccagcccgacuccgucuccauccccaucaccugcugcuucaacgucaucaaccgcaagauccccauccagcgccucgaguccuacacccgcaucaccaacauccagugccccaaggaggccgucaucuucaagaccaagcgcggcaaggaggucugcgccgaccccaaggagcgcuggguccgcgacuccaugaagcaccucgaccagaucuuccagaaccucaagcccuga

SEQ ID NO: 40913 - RNA, 1398 nt, Artificial Sequence
  derived and/or modified sequence opt2 from CCM2__Homo_sapiens__NP_001025006
augcacuccuccugccgccagcgccgcaaccagaaccucuccaaggagaucccccagaccgaguuccacaccggcuacuccauggagaacgagcccggcaucgucucccccuucaagcgcgucuuccucaagggcgagaagucccgcgacaagaaggcccacgagaaggucaccgagcgccgcccccuccacaccgucguccucucccuccccgagcgcgucgagcccgaccgccuccucuccgacuacaucgagaaggaggucaaguaccucggccagcucaccuccauccccggcuaccucaaccccuccucccgcaccgagauccuccacuucaucgacaacgccaagcgcgcccaccagcuccccggccaccucacccaggagcacgacgccguccucucccucuccgccuacaacgucaagcucgccuggcgcgacggcgaggacaucauccuccgcguccccauccacgacaucgccgccgucuccuacguccgcgacgacgccgcccaccucgucguccucaagaccgcccaggaccccggcaucucccccucccagucccucugcgccgaguccucccgcggccucuccgccggcucccucuccgaguccgccgucggccccgucgaggccugcugccucgucauccucgccgccgaguccaaggucgccgccgaggagcucugcugccuccucggccaggucuuccaggucgucuacaccgaguccaccaucgacuuccucgaccgcgccaucuucgacggcgccuccacccccacccaccaccucucccuccacuccgacgacuccuccaccaaggucgacaucaaggagaccuacgaggucgaggccuccaccuucugcuuccccgaguccgucgacgucggcggcgccuccccccacuccaagaccaucuccgaguccgagcucuccgccuccgccaccgagcuccuccaggacuacaugcucacccuccgcaccaagcucuccucccaggagauccagcaguucgccgcccuccuccacgaguaccgcaacggcgccuccauccacgaguucugcaucaaccuccgccagcucuacggcgacucccgcaaguuccuccuccucggccuccgccccuucauccccgagaaggacucccagcacuucgagaacuuccucgagaccaucggcgucaaggacggccgcggcaucaucaccgacuccuucggccgccaccgccgcgcccucuccaccaccuccuccuccaccaccaacggcaaccgcgccaccggcuccuccgacgaccgcuccgcccccuccgagggcgacgagugggaccgcaugaucuccgacaucuccuccgacaucgaggcccucggcugcuccauggaccaggacuccgccuga

SEQ ID NO: 40914 - RNA, 1395 nt, Artificial Sequence
  derived and/or modified sequence opt2 from CCNA1__Homo_sapiens__NP_001104515
auggagaccggcuuccccgccaucauguaccccggcuccuucaucggcggcuggggcgaggaguaccucuccugggagggccccggccuccccgacuucgucuuccagcagcccgucgaguccgaggccaugcacugcuccaaccccaaguccggcgucguccucgccaccgucgcccgcggccccgacgccugccagauccucacccgcgccccccucggccaggaccccccccagcgcaccguccucggccuccucaccgccaacggccaguaccgccgcaccugcggccagggcaucacccgcauccgcugcuacuccggcuccgagaacgccuucccccccgccggcaagaaggcccuccccgacugcggcguccaggagccccccaagcagggcuucgacaucuacauggacgagcucgagcagggcgaccgcgacuccugcuccguccgcgagggcauggccuucgaggacgucuacgaggucgacaccggcacccucaaguccgaccuccacuuccuccucgacuucaacaccgucucccccaugcucgucgacuccucccuccucucccaguccgaggacaucuccucccucggcaccgacgucaucaacgucaccgaguacgccgaggagaucuaccaguaccuccgcgaggccgagauccgccaccgccccaaggcccacuacaugaagaagcagcccgacaucaccgagggcaugcgcaccauccucgucgacuggcucgucgaggucggcgaggaguacaagcuccgcgccgagacccucuaccucgccgucaacuuccucgaccgcuuccucuccugcauguccguccuccgcggcaagcuccagcucgucggcaccgccgccaugcuccucgccuccaaguacgaggagaucuacccccccgaggucgacgaguucgucuacaucaccgacgacaccuacaccaagcgccagcuccucaagauggagcaccuccuccucaagguccucgccuucgaccucaccguccccaccaccaaccaguuccuccuccaguaccuccgccgccagggcgucugcguccgcaccgagaaccucgccaaguacgucgccgagcucucccuccucgaggccgaccccuuccucaaguaccuccccucccucaucgccgccgccgccuucugccucgccaacuacaccgucaacaagcacuucuggcccgagacccucgccgccuucaccggcuacucccucuccgagaucguccccugccucuccgagcuccacaaggccuaccucgacaucccccaccgcccccagcaggccauccgcgagaaguacaaggccuccaaguaccucugcgucucccucauggagccccccgccguccuccuccuccaguga

SEQ ID NO: 40915 - RNA, 1299 nt, Artificial Sequence
  derived and/or modified sequence opt2 from CCNA2__Homo_sapiens__NP_001228
augcucggcaacuccgcccccggccccgccacccgcgaggccggcuccgcccuccucgcccuccagcagaccgcccuccaggaggaccaggagaacaucaaccccgagaaggccgcccccguccagcagccccgcacccgcgccgcccucgccguccucaaguccggcaacccccgcggccucgcccagcagcagcgccccaagacccgccgcgucgccccccucaaggaccuccccgucaacgacgagcacgucaccgucccccccuggaaggccaacuccaagcagcccgccuucaccauccacgucgacgaggccgagaaggaggcccagaagaagcccgccgagucccagaagaucgagcgcgaggacgcccucgccuucaacuccgccaucucccuccccggcccccgcaagccccucgucccccucgacuaccccauggacggcuccuucgaguccccccacaccauggacauguccaucguccucgaggacgagaagcccgucuccgucaacgagguccccgacuaccacgaggacauccacaccuaccuccgcgagauggaggucaagugcaagcccaaggucggcuacaugaagaagcagcccgacaucaccaacuccaugcgcgccauccucgucgacuggcucgucgaggucggcgaggaguacaagcuccagaacgagacccuccaccucgccgucaacuacaucgaccgcuuccucuccuccauguccguccuccgcggcaagcuccagcucgucggcaccgccgccaugcuccucgccuccaaguucgaggagaucuacccccccgaggucgccgaguucgucuacaucaccgacgacaccuacaccaagaagcagguccuccgcauggagcaccucguccucaagguccucaccuucgaccucgccgcccccaccgucaaccaguuccucacccaguacuuccuccaccagcagcccgccaacugcaaggucgagucccucgccauguuccucggcgagcucucccucaucgacgccgaccccuaccucaaguaccuccccuccgucaucgccggcgccgccuuccaccucgcccucuacaccgucaccggccaguccuggcccgagucccucauccgcaagaccggcuacacccucgagucccucaagcccugccucauggaccuccaccagaccuaccucaaggccccccagcacgcccagcaguccauccgcgagaaguacaagaacuccaaguaccacggcgucucccuccucaacccccccgagacccucaaccucuga

SEQ ID NO: 40916 - RNA, 1302 nt, Artificial Sequence
  derived and/or modified sequence opt2 from CCNB1__Homo_sapiens__NP_114172
auggcccuccgcgucacccgcaacuccaagaucaacgccgagaacaaggccaagaucaacauggccggcgccaagcgcguccccaccgcccccgccgccaccuccaagcccggccuccgcccccgcaccgcccucggcgacaucggcaacaaggucuccgagcagcuccaggccaagaugcccaugaagaaggaggccaagcccuccgccaccggcaaggucaucgacaagaagcuccccaagccccucgagaagguccccaugcucguccccguccccgucuccgagcccguccccgagcccgagcccgagcccgagcccgagcccgucaaggaggagaagcucucccccgagcccauccucgucgacaccgccucccccucccccauggagaccuccggcugcgcccccgccgaggaggaccucugccaggccuucuccgacgucauccucgccgucaacgacgucgacgccgaggacggcgccgaccccaaccucugcuccgaguacgucaaggacaucuacgccuaccuccgccagcucgaggaggagcaggccguccgccccaaguaccuccucggccgcgaggucaccggcaacaugcgcgccauccucaucgacuggcucguccagguccagaugaaguuccgccuccuccaggagaccauguacaugaccgucuccaucaucgaccgcuucaugcagaacaacugcguccccaagaagaugcuccagcucgucggcgucaccgccauguucaucgccuccaaguacgaggagauguacccccccgagaucggcgacuucgccuucgucaccgacaacaccuacaccaagcaccagauccgccagauggagaugaagauccuccgcgcccucaacuucggccucggccgcccccucccccuccacuuccuccgccgcgccuccaagaucggcgaggucgacgucgagcagcacacccucgccaaguaccucauggagcucaccaugcucgacuacgacaugguccacuucccccccucccagaucgccgccggcgccuucugccucgcccucaagauccucgacaacggcgaguggacccccacccuccagcacuaccucuccuacaccgaggagucccuccuccccgucaugcagcaccucgccaagaacgucgucauggucaaccagggccucaccaagcacaugaccgucaagaacaaguacgccaccuccaagcacgccaagaucuccacccucccccagcucaacuccgcccucguccaggaccucgccaaggccgucgccaaggucuga

SEQ ID NO: 40917 - RNA, 1197 nt, Artificial Sequence
  derived and/or modified sequence opt2 from CCNB2__Homo_sapiens__NP_004692
auggcccuccuccgccgccccaccgucuccuccgaccucgagaacaucgacaccggcgucaacuccaaggucaagucccacgucaccauccgccgcaccguccucgaggagaucggcaaccgcgucaccacccgcgccgcccaggucgccaagaaggcccagaacaccaagguccccguccagcccaccaagaccaccaacgucaacaagcagcucaagcccaccgccuccgucaagcccguccagauggagaagcucgcccccaagggccccucccccacccccgaggacgucuccaugaaggaggagaaccucugccaggccuucuccgacgcccuccucugcaagaucgaggacaucgacaacgaggacugggagaacccccagcucugcuccgacuacgucaaggacaucuaccaguaccuccgccagcucgagguccuccaguccaucaacccccacuuccucgacggccgcgacaucaacggccgcaugcgcgccauccucgucgacuggcucguccagguccacuccaaguuccgccuccuccaggagacccucuacaugugcgucggcaucauggaccgcuuccuccagguccagcccgucucccgcaagaagcuccagcucgucggcaucaccgcccuccuccucgccuccaaguacgaggagauguucucccccaacaucgaggacuucgucuacaucaccgacaacgccuacaccuccucccagauccgcgagauggagacccucauccucaaggagcucaaguucgagcucggccgcccccucccccuccacuuccuccgccgcgccuccaaggccggcgaggucgacgucgagcagcacacccucgccaaguaccucauggagcucacccucaucgacuacgacaugguccacuaccaccccuccaaggucgccgccgccgccuccugccucucccagaagguccucggccagggcaaguggaaccucaagcagcaguacuacaccggcuacaccgagaacgagguccucgaggucaugcagcacauggccaagaacgucgucaaggucaacgagaaccucaccaaguucaucgccaucaagaacaaguacgccuccuccaagcuccucaagaucuccaugaucccccagcucaacuccaaggccgucaaggaccucgccuccccccucaucggccgcuccuga

SEQ ID NO: 40918 - RNA, 876 nt, Artificial Sequence
  derived and/or modified sequence opt2 from CCNB3__Homo_sapiens__NP_391990
augcuccucccccuccccccccaguccuccaagcccguccccaagaagucccaguccuccaagaucguccccucccaccacgaccccuccgagaagaccggcgagaacugccagaccaagaucucccccuccucccuccaggagucccccuccucccuccagggcgcccucaagaagcgcuccgccuucgaggaccucaccaacgucuccuucgagaugacccacgagacccucuaccucgccgucaagcucgucgaccucuaccucaugaaggccgucugcaagaaggacaagcuccagcuccucggcgccaccgccuucaugaucgccgccaaguucgaggagcacaacuccccccgcgucgacgacuucgucuacaucugcgacgacaacuaccagcgcuccgagguccucuccauggagaucaacauccucaacguccucaagugcgacaucaacauccccaucgccuaccacuuccuccgccgcuacgcccgcugcauccacaccaacaugaagacccucacccucucccgcuacaucugcgagaugacccuccaggaguaccacuacguccaggagaaggccuccaagcucgccgccgccucccuccuccucgcccucuacaugaagaagcucggcuacuggguccccuuccucgagcacuacuccggcuacuccaucuccgagcuccacccccucguccgccagcucaacaagcuccucaccuucuccuccuacgacucccucaaggccgucuacuacaaguacucccaccccgucuucuucgaggucgccaagauccccgcccucgacaugcucaagcucgaggagauccucaacugcgacugcgaggcccagggccucguccucuga

SEQ ID NO: 40919 - RNA, 597 nt, Artificial Sequence
  derived and/or modified sequence opt2 from CCNC__Homo_sapiens__NP_001013417
auggcccccaccugcgucuuccucgccuccaaggucgaggaguucggcgucgucuccaacacccgccucaucgccgccgccaccuccguccucaagacccgcuucuccuacgccuuccccaaggaguuccccuaccgcaugaaccacauccucgagugcgaguucuaccuccucgagcucauggacugcugccucaucgucuaccaccccuaccgcccccuccuccaguacguccaggacaugggccaggaggacaugcuccucccccucgccuggcgcaucgucaacgacaccuaccgcaccgaccucugccuccucuacccccccuucaugaucgcccucgccugccuccacgucgccugcgucguccagcagaaggacgcccgccagugguucgccgagcucuccgucgacauggagaagauccucgagaucauccgcgucauccucaagcucuacgagcaguggaagaacuucgacgagcgcaaggagauggccaccauccucuccaagaugcccaagcccaagcccccccccaacuccgagggcgagcagggccccaacggcucccagaacuccuccuacucccaguccuga

SEQ ID NO: 40920 - RNA, 888 nt, Artificial Sequence
  derived and/or modified sequence opt2 from CCND1__Homo_sapiens__NP_444284
auggagcaccagcuccucugcugcgaggucgagaccauccgccgcgccuaccccgacgccaaccuccucaacgaccgcguccuccgcgccaugcucaaggccgaggagaccugcgcccccuccgucuccuacuucaagugcguccagaaggagguccuccccuccaugcgcaagaucgucgccaccuggaugcucgaggucugcgaggagcagaagugcgaggaggaggucuucccccucgccaugaacuaccucgaccgcuuccucucccucgagcccgucaagaagucccgccuccagcuccucggcgccaccugcauguucgucgccuccaagaugaaggagaccaucccccucaccgccgagaagcucugcaucuacaccgacaacuccauccgccccgaggagcuccuccagauggagcuccuccucgucaacaagcucaaguggaaccucgccgccaugaccccccacgacuucaucgagcacuuccucuccaagaugcccgaggccgaggagaacaagcagaucauccgcaagcacgcccagaccuucgucgcccucugcgccaccgacgucaaguucaucuccaacccccccuccauggucgccgccggcuccgucgucgccgccguccagggccucaaccuccgcucccccaacaacuuccucuccuacuaccgccucacccgcuuccucucccgcgucaucaagugcgaccccgacugccuccgcgccugccaggagcagaucgaggcccuccucgaguccucccuccgccaggcccagcagaacauggaccccaaggccgccgaggaggaggaggaggaggaggaggaggucgaccucgccugcacccccaccgacguccgcgacgucgacaucuga

SEQ ID NO: 40921 - RNA, 870 nt, Artificial Sequence
  derived and/or modified sequence opt2 from CCND2__Homo_sapiens__NP_001750
auggagcuccucugccacgaggucgaccccguccgccgcgccguccgcgaccgcaaccuccuccgcgacgaccgcguccuccagaaccuccucaccaucgaggagcgcuaccucccccagugcuccuacuucaagugcguccagaaggacauccagcccuacaugcgccgcauggucgccaccuggaugcucgaggucugcgaggagcagaagugcgaggaggaggucuucccccucgccaugaacuaccucgaccgcuuccucgccggcguccccacccccaagucccaccuccagcuccucggcgccgucugcauguuccucgccuccaagcucaaggagaccuccccccucaccgccgagaagcucugcaucuacaccgacaacuccaucaagccccaggagcuccucgagugggagcucgucguccucggcaagcucaaguggaaccucgccgccgucaccccccacgacuucaucgagcacauccuccgcaagcucccccagcagcgcgagaagcucucccucauccgcaagcacgcccagaccuucaucgcccucugcgccaccgacuucaaguucgccauguacccccccuccaugaucgccaccggcuccgucggcgccgccaucugcggccuccagcaggacgaggaggucuccucccucaccugcgacgcccucaccgagcuccucgccaagaucaccaacaccgacgucgacugccucaaggccugccaggagcagaucgaggccguccuccucaacucccuccagcaguaccgccaggaccagcgcgacggcuccaaguccgaggacgagcucgaccaggccuccacccccaccgacguccgcgacaucgaccucuga

SEQ ID NO: 40922 - RNA, 636 nt, Artificial Sequence
  derived and/or modified sequence opt2 from CCND3__Homo_sapiens__NP_001129489
augaacuaccucgaccgcuaccucuccugcguccccacccgcaaggcccagcuccagcuccucggcgccgucugcaugcuccucgccuccaagcuccgcgagaccaccccccucaccaucgagaagcucugcaucuacaccgaccacgccgucuccccccgccagcuccgcgacugggagguccucguccucggcaagcucaagugggaccucgccgccgucaucgcccacgacuuccucgccuucauccuccaccgccucucccucccccgcgaccgccaggcccucgucaagaagcacgcccagaccuuccucgcccucugcgccaccgacuacaccuucgccauguacccccccuccaugaucgccaccggcuccaucggcgccgccguccagggccucggcgccugcuccauguccggcgacgagcucaccgagcuccucgccggcaucaccggcaccgaggucgacugccuccgcgccugccaggagcagaucgaggccgcccuccgcgagucccuccgcgaggccucccagaccuccuccucccccgcccccaaggccccccgcggcuccuccucccagggccccucccagaccuccacccccaccgacgucaccgccauccaccucuga

SEQ ID NO: 40923 - RNA, 1083 nt, Artificial Sequence
  derived and/or modified sequence opt2 from CCNDBP1__Homo_sapiens__NP_036274
auggccuccgccaccgcccccgccgccgccguccccacccucgccuccccccucgagcagcuccgccaccucgccgaggagcuccgccuccuccucccccgcguccgcgucggcgaggcccaggagaccaccgaggaguucaaccgcgagauguucuggcgccgccucaacgaggccgccgucaccgucucccgcgaggccaccacccucaccaucgucuucucccagcucccccuccccuccccccaggagacccagaaguucugcgagcagguccacgccgccaucaaggccuucaucgccgucuacuaccuccuccccaaggaccagggcaucacccuccgcaagcucguccgcggcgccacccucgacaucgucgacggcauggcccagcucauggagguccucuccgucacccccacccagucccccgagaacaacgaccucaucuccuacaacuccgucugggucgccugccagcagaugccccagaucccccgcgacaacaaggccgccgcccuccucaugcucaccaagaacgucgacuucgucaaggacgcccacgaggagauggagcaggccgucgaggagugcgaccccuacuccggccuccucaacgacaccgaggagaacaacuccgacaaccacaaccacgaggacgacguccucggcuuccccuccaaccaggaccucuacugguccgaggacgaccaggagcucaucauccccugccucgcccucguccgcgccuccaaggccugccucaagaagauccgcaugcucgucgccgagaacggcaagaaggaccaggucgcccagcucgacgacaucgucgacaucuccgacgagaucucccccuccgucgacgaccucgcccucuccaucuacccccccaugugccaccucaccguccgcaucaacuccgccaagcucgucuccguccucaagaaggcccucgagaucaccaaggccucccacgucaccccccagcccgaggacuccuggaucccccuccucaucaacgccaucgaccacugcaugaaccgcaucaaggagcucacccaguccgagcucgagcucuga

SEQ ID NO: 40924 - RNA, 1233 nt, Artificial Sequence
  derived and/or modified sequence opt2 from CCNE1__Homo_sapiens__NP_001229
augccccgcgagcgccgcgagcgcgacgccaaggagcgcgacaccaugaaggaggacggcggcgccgaguucuccgcccgcucccgcaagcgcaaggccaacgucaccgucuuccuccaggaccccgacgaggagauggccaagaucgaccgcaccgcccgcgaccagugcggcucccagcccugggacaacaacgccgucugcgccgaccccugcucccucauccccacccccgacaaggaggacgacgaccgcgucuaccccaacuccaccugcaagccccgcaucaucgcccccucccgcggcuccccccuccccguccucuccugggccaaccgcgaggaggucuggaagaucaugcucaacaaggagaagaccuaccuccgcgaccagcacuuccucgagcagcacccccuccuccagcccaagaugcgcgccauccuccucgacuggcucauggaggucugcgaggucuacaagcuccaccgcgagaccuucuaccucgcccaggacuucuucgaccgcuacauggccacccaggagaacgucgucaagacccuccuccagcucaucggcaucuccucccucuucaucgccgccaagcucgaggagaucuacccccccaagcuccaccaguucgccuacgucaccgacggcgccugcuccggcgacgagauccucaccauggagcucaugaucaugaaggcccucaaguggcgccucuccccccucaccaucgucuccuggcucaacgucuacaugcaggucgccuaccucaacgaccuccacgagguccuccucccccaguacccccagcagaucuucauccagaucgccgagcuccucgaccucugcguccucgacgucgacugccucgaguuccccuacggcauccucgccgccuccgcccucuaccacuucuccuccuccgagcucaugcagaaggucuccggcuaccaguggugcgacaucgagaacugcgucaaguggaugguccccuucgccauggucauccgcgagaccggcuccuccaagcucaagcacuuccgcggcgucgccgacgaggacgcccacaacauccagacccaccgcgacucccucgaccuccucgacaaggcccgcgccaagaaggccaugcucuccgagcagaaccgcgccuccccccuccccuccggccuccucacccccccccaguccggcaagaagcaguccuccggccccgagauggccuga

SEQ ID NO: 40925 - RNA, 1215 nt, Artificial Sequence
  derived and/or modified sequence opt2 from CCNE2__Homo_sapiens__NP_477097
augucccgccgcuccucccgccuccaggccaagcagcagccccagcccucccagaccgaguccccccaggaggcccagaucauccaggccaagaagcgcaagaccacccaggacgucaagaagcgccgcgaggaggucaccaagaagcaccaguacgagauccgcaacugcuggccccccguccucuccggcggcaucucccccugcaucaucaucgagaccccccacaaggagaucggcaccuccgacuucucccgcuucaccaacuaccgcuucaagaaccucuucaucaaccccuccccccuccccgaccucuccuggggcugcuccaaggaggucuggcucaacaugcucaagaaggagucccgcuacguccacgacaagcacuucgagguccuccacuccgaccucgagccccagaugcgcuccauccuccucgacuggcuccucgaggucugcgaggucuacacccuccaccgcgagaccuucuaccucgcccaggacuucuucgaccgcuucaugcucacccagaaggacaucaacaagaacaugcuccagcucaucggcaucaccucccucuucaucgccuccaagcucgaggagaucuacgcccccaagcuccaggaguucgccuacgucaccgacggcgccugcuccgaggaggacauccuccgcauggagcucaucauccucaaggcccucaagugggagcucugccccgucaccaucaucuccuggcucaaccucuuccuccaggucgacgcccucaaggacgcccccaagguccuccucccccaguacucccaggagaccuucauccagaucgcccagcuccucgaccucugcauccucgccaucgacucccucgaguuccaguaccgcauccucaccgccgccgcccucugccacuucaccuccaucgaggucgucaagaaggccuccggccucgagugggacuccaucuccgagugcgucgacuggaugguccccuucgucaacgucgucaaguccaccucccccgucaagcucaagaccuucaagaagauccccauggaggaccgccacaacauccagacccacaccaacuaccucgccaugcucgaggaggucaacuacaucaacaccuuccgcaagggcggccagcucucccccgucugcaacggcggcaucaugaccccccccaaguccaccgagaagccccccggcaagcacuga

SEQ ID NO: 40926 - RNA, 2361 nt, Artificial Sequence
  derived and/or modified sequence opt2 from CCNF__Homo_sapiens__NP_001752
augggcuccggcggcgucguccacugccgcugcgccaagugcuucugcuaccccaccaagcgccgcauccgccgccgcccccgcaaccucaccauccucucccuccccgaggacguccucuuccacauccucaaguggcucuccgucgaggacauccucgccguccgcgccguccacucccagcucaaggaccucgucgacaaccacgccuccgucugggccugcgccuccuuccaggagcucuggcccucccccggcaaccucaagcucuucgagcgcgccgccgagaagggcaacuucgaggccgccgucaagcucggcaucgccuaccucuacaacgagggccucuccgucuccgacgaggcccgcgccgaggucaacggccucaaggccucccgcuucuucucccucgccgagcgccucaacgucggcgccgcccccuucaucuggcucuucauccgcccccccugguccgucuccggcuccugcugcaaggccgucguccacgagucccuccgcgccgagugccagcuccagcgcacccacaaggccuccauccuccacugccucggccgcguccucucccucuucgaggacgaggagaagcagcagcaggcccacgaccucuucgaggaggccgcccaccagggcugccucaccuccuccuaccuccucugggaguccgaccgccgcaccgacgucuccgaccccggccgcugccuccacuccuuccgcaagcuccgcgacuacgccgccaagggcugcugggaggcccagcucucccucgccaaggccugcgccaacgccaaccagcucggccucgagguccgcgccuccuccgagaucgucugccagcucuuccaggccucccaggccgucuccaagcagcaggucuucuccguccagaagggccucaacgacaccaugcgcuacauccucaucgacuggcucgucgaggucgccaccaugaaggacuucaccucccucugccuccaccucaccgucgagugcgucgaccgcuaccuccgccgccgccucgucccccgcuaccgccuccagcuccucggcaucgccugcauggucaucugcacccgcuucaucuccaaggagauccucaccauccgcgaggccgucuggcucaccgacaacaccuacaaguacgaggaccucguccgcaugaugggcgagaucgucuccgcccucgagggcaagauccgcguccccaccgucgucgacuacaaggagguccuccucacccucguccccgucgagcuccgcacccagcaccucugcuccuuccucugcgagcucucccuccuccacaccucccucuccgccuacgcccccgcccgccucgccgccgccgcccuccuccucgcccgccucacccacggccagacccagcccuggaccacccagcucugggaccucaccggcuucuccuacgaggaccucauccccugcguccucucccuccacaagaagugcuuccacgacgacgcccccaaggacuaccgccaggucucccucaccgccgucaagcagcgcuucgaggacaagcgcuacggcgagaucucccaggaggagguccucuccuacucccagcucugcgccgcccucggcgucacccaggacucccccgacccccccaccuuccucuccaccggcgagauccacgccuuccucuccucccccuccggccgccgcaccaagcgcaagcgcgagaacucccuccaggaggaccgcggcuccuucgucaccacccccaccgccgagcucuccucccaggaggagacccuccucggcuccuuccucgacuggucccucgacugcugcuccggcuacgagggcgaccaggaguccgagggcgagaaggagggcgacgucaccgcccccuccggcauccucgacgucaccgucgucuaccucaaccccgagcagcacugcugccaggaguccuccgacgaggaggccugccccgaggacaagggcccccaggacccccaggcccucgcccucgacacccagauccccgccacccccggccccaagccccucguccgcaccucccgcgagcccggcaaggacgucaccaccuccggcuacuccuccgucuccaccgccucccccaccuccuccgucgacggcggccucggcgcccucccccagcccaccuccguccucucccucgacuccgacucccacacccagcccugccaccaccaggcccgcaaguccugccuccagugccgcccccccuccccccccgaguccuccgucccccagcagcaggucaagcgcaucaaccucugcauccacuccgaggaggaggacaugaaccucggccucguccgccucuga

SEQ ID NO: 40927 - RNA, 888 nt, Artificial Sequence
  derived and/or modified sequence opt2 from CCNG1__Homo_sapiens__NP_954854
augaucgagguccucaccaccaccgacucccagaagcuccuccaccagcucaacgcccuccucgagcaggagucccgcugccagcccaaggucugcggccuccgccucaucgaguccgcccacgacaacggccuccgcaugaccgcccgccuccgcgacuucgaggucaaggaccuccucucccucacccaguucuucggcuucgacaccgagaccuucucccucgccgucaaccuccucgaccgcuuccucuccaagaugaagguccagcccaagcaccucggcugcgucggccucuccugcuucuaccucgccgucaaguccaucgaggaggagcgcaacgucccccucgccaccgaccucauccgcaucucccaguaccgcuucaccgucuccgaccucaugcgcauggagaagaucguccucgagaaggucugcuggaaggucaaggccaccaccgccuuccaguuccuccagcucuacuacucccuccuccaggagaaccucccccucgagcgccgcaacuccaucaacuucgagcgccucgaggcccagcucaaggccugccacugccgcaucaucuucuccaaggccaagcccuccguccucgcccucuccaucaucgcccucgagauccaggcccagaagugcgucgagcucaccgagggcaucgagugccuccagaagcacuccaagaucaacggccgcgaccucaccuucuggcaggagcucgucuccaagugccucaccgaguacuccuccaacaagugcuccaagcccaacguccagaagcucaaguggaucgucuccggccgcaccgcccgccagcucaagcacuccuacuaccgcaucacccaccuccccaccauccccgagaugguccccuga

SEQ ID NO: 40928 - RNA, 1035 nt, Artificial Sequence
  derived and/or modified sequence opt2 from CCNG2__Homo_sapiens__XP_011530701
augaaggaccucggcgccgagcaccucgccggccacgagggcguccagcuccucggccuccucaacgucuaccucgagcaggaggagcgcuuccagccccgcgagaagggccucucccucaucgaggccacccccgagaacgacaacacccucugccccggccuccgcaacgccaaggucgaggaccuccgcucccucgccaacuucuucggcuccugcaccgagaccuucguccucgccgucaacauccucgaccgcuuccucgcccucaugaaggucaagcccaagcaccucuccugcaucggcgucugcuccuuccuccucgccgcccgcaucgucgaggaggacugcaacauccccuccacccacgacgucauccgcaucucccagugcaagugcaccgccuccgacaucaagcgcauggagaagaucaucuccgagaagcuccacuacgagcucgaggccaccaccgcccucaacuuccuccaccucuaccacaccaucauccucugccacaccuccgagcgcaaggagauccucucccucgacaagcucgaggcccagcucaaggccugcaacugccgccucaucuucuccaaggccaagcccuccguccucgcccucugccuccucaaccucgaggucgagacccucaaguccgucgagcuccucgagauccuccuccucgucaagaagcacuccaagaucaacgacaccgaguucuucuacuggcgcgagcucgucuccaagugccucgccgaguacuccucccccgagugcugcaagcccgaccucaagaagcucgucuggaucgucucccgccgcaccgcccagaaccuccacaacuccuacuacuccguccccgagcuccccaccauccccgagggcggcugcuucgacgaguccgaguccgaggacuccugcgaggacauguccugcggcgaggagucccucuccuccuccccccccuccgaccaggagugcaccuucuucuucaacuucaaggucgcccagacccucugcuuccccuccuga

SEQ ID NO: 40929 - RNA, 813 nt, Artificial Sequence
  derived and/or modified sequence opt2 from CCNH__Homo_sapiens__NP_001186118
augacccucugcaaguacuacgagaagcgccuccucgaguucugcuccgucuucaagcccgccaugccccgcuccgucgucggcaccgccugcauguacuucaagcgcuucuaccucaacaacuccgucauggaguaccacccccgcaucaucaugcucaccugcgccuuccucgccugcaaggucgacgaguucaacgucuccuccccccaguucgucggcaaccuccgcgaguccccccucggccaggagaaggcccucgagcagauccucgaguacgagcuccuccucauccagcagcucaacuuccaccucaucguccacaaccccuaccgccccuucgagggcuuccucaucgaccucaagacccgcuaccccauccucgagaaccccgagauccuccgcaagaccgccgacgacuuccucaaccgcaucgcccucaccgacgccuaccuccucuacacccccucccagaucgcccucaccgccauccucuccuccgccucccgcgccggcaucaccauggaguccuaccucuccgagucccucaugcucaaggagaaccgcaccugccucucccagcuccucgacaucaugaaguccaugcgcaaccucgucaagaaguacgagcccccccgcuccgaggaggucgccguccucaagcagaagcucgagcgcugccacuccgccgagcucgcccucaacgucaucaccaagaagcgcaagggcuacgaggacgacgacuacgucuccaagaaguccaagcacgaggaggaggaguggaccgacgacgaccucgucgagucccucuga

SEQ ID NO: 40930 - RNA, 1134 nt, Artificial Sequence
  derived and/or modified sequence opt2 from CCNI__Homo_sapiens__NP_006826
augaaguuccccggcccccucgagaaccagcgccucuccuuccuccucgagaaggccaucacccgcgaggcccagauguggaaggucaacguccgcaagaugcccuccaaccagaacgucucccccucccagcgcgacgaggucauccaguggcucgccaagcucaaguaccaguucaaccucuaccccgagaccuucgcccucgccuccucccuccucgaccgcuuccucgccaccgucaaggcccaccccaaguaccucuccugcaucgccaucuccugcuucuuccucgccgccaagaccgucgaggaggacgagcgcauccccguccucaagguccucgcccgcgacuccuucugcggcugcuccuccuccgagauccuccgcauggagcgcaucauccucgacaagcucaacugggaccuccacaccgccaccccccucgacuuccuccacaucuuccacgccaucgccgucuccacccgcccccagcuccucuucucccuccccaagcucucccccucccagcaccucgccguccucaccaagcagcuccuccacugcauggccugcaaccagcuccuccaguuccgcggcuccaugcucgcccucgccauggucucccucgagauggagaagcucauccccgacuggcucucccucaccaucgagcuccuccagaaggcccagauggacuccucccagcucauccacugccgcgagcucgucgcccaccaccucuccacccuccaguccucccucccccucaacuccgucuacgucuaccgcccccucaagcacacccucgucaccugcgacaagggcgucuuccgccuccaccccuccuccguccccggccccgacuucuccaaggacaacuccaagcccgagguccccguccgcggcaccgccgccuucuaccaccaccuccccgccgccuccggcugcaagcagaccuccaccaagcgcaaggucgaggagauggaggucgacgacuucuacgacggcaucaagcgccucuacaacgaggacaacgucuccgagaacgucggcuccgucugcggcaccgaccucucccgccaggagggccacgccucccccugccccccccuccagcccgucuccgucauguga

SEQ ID NO: 40931 - RNA, 1152 nt, Artificial Sequence
  derived and/or modified sequence opt2 from CCNJ__Homo_sapiens__NP_001127847
auggagcucgagggccagugguggcgcggccagcucgccgccgacauccaccaggcccuccgcuacaaggagcucaagcuccccuccuacaagggccaguccccccagcucucccuccgccgcuacuucgccgaccucaucgccaucgucuccaaccgcuucacccucugccccuccgcccgccaccucgccgucuaccuccucgaccucuucauggaccgcuacgacaucuccauccagcagcuccaccucgucgcccucuccugccuccuccucgccuccaaguucgaggagaaggaggacuccguccccaagcucgagcagcucaacucccucggcugcaugaccaacaugaaccucguccucaccaagcagaaccuccuccacauggagcuccuccuccucgagaccuuccaguggaaccucugccuccccaccgccgcccacuucaucgaguacuaccucuccgaggccguccacgagaccgaccuccacgacggcuggcccaugaucugccucgagaagaccaagcucuacauggccaaguacgccgacuacuuccucgaggucucccuccaggacuacgccuuccucaacuacgcccccucccucgucgccgccgccugcgucgccuccucccgcaucauccuccgccucucccccaccuggcccacccgccuccaccgccucaccgccuacuccugggacuuccucguccagugcaucgagcgccuccucaucgcccacgacaacgacgucaaggaggccaacaagcagcgcggccaggccggcccccaguccgcccagcucuccgucuuccagaccgccucccagcccucccgccccguccacuuccagcagccccaguaccuccaccagacccaccagaccucccuccaguaccgccaccccaccuccgagcagcccuccugccagcagaucgucuccaccacccacaccuccuccuacacccuccagaccugccccgccggcuuccagaccuccguccagggccucggccacaugcagaccggcgucggcaugucccucgccauccccgucgaggucaagcccugccucuccgucuccuacaaccgcuccuaccagaucaacgagcacuaccccugcaucacccccugcuucgagcgcuga

SEQ ID NO: 40932 - RNA, 1308 nt, Artificial Sequence
  derived and/or modified sequence opt2 from CCNJL__Homo_sapiens__NP_078841
augauggacgagcccuggugggagggccgcgucgccuccgacguccacugcacccuccgcgagaaggagcucaagcuccccaccuuccgcgcccacuccccccuccucaagucccgccgcuucuucgucgacauccucacccuccucuccucccacugccagcucugccccgccgcccgccaccucgccgucuaccuccucgaccacuucauggaccgcuacaacgucaccaccuccaagcagcucuacaccgucgccgucuccugccuccuccucgccaacggcgucucccuccucuccccccgccucaagugcuccggcaugaucuccgcccacugcaaccuccaccuccccggcuccuccaacucccccgccuccgccccccaccccccccccacccccccccaggucgccgagaccaccggcaaguucgaggaccgcgaggaccacguccccaagcucgagcagaucaacuccacccgcauccucuccucccagaacuucacccucaccaagaaggagcuccucuccaccgagcuccuccuccucgaggccuucuccuggaaccucugccuccccacccccgcccacuuccucgacuacuaccuccucgccuccgucucccagaaggaccaccacugccacaccuggcccaccaccugcccccgcaagaccaaggagugccucaaggaguacgcccacuacuuccucgaggucacccuccaggaccacaucuucuacaaguuccagcccuccgucgucgccgccgccugcgucggcgccucccgcaucugccuccagcucucccccuacuggacccgcgaccuccagcgcaucuccuccuacucccucgagcaccucuccaccugcaucgagauccuccucgucgucuacgacaacguccucaaggacgccgucgccgucaagucccaggcccucgccaugguccccggcaccccccccacccccacccagguccucuuccagccccccgccuaccccgcccucggccagcccgccaccacccucgcccaguuccagacccccguccaggaccucugccucgccuaccgcgacucccuccaggcccaccgcuccggcucccuccucuccggcuccaccggcuccucccuccacacccccuaccagccccuccagccccucgacaugugccccguccccguccccgccucccucuccaugcacauggccaucgccgccgagccccgccacugccucgccaccaccuacggcuccuccuacuucuccggcucccacauguuccccaccggcugcuucgaccgcuga

SEQ ID NO: 40933 - RNA, 1743 nt, Artificial Sequence
  derived and/or modified sequence opt2 from CCNK__Homo_sapiens__XP_011535577
augaaggagaacaaggagaacuccucccccuccgucaccuccgccaaccucgaccacaccaagcccugcugguacugggacaagaaggaccucgcccacacccccucccagcucgagggccucgaccccgccaccgaggcccgcuaccgccgcgagggcgcccgcuucaucuucgacgucggcacccgccucggccuccacuacgacacccucgccaccggcaucaucuacuuccaccgcuucuacauguuccacuccuucaagcaguucccccgcuacgucaccggcgccugcugccucuuccucgccggcaaggucgaggagacccccaagaagugcaaggacaucaucaagaccgcccgcucccuccucaacgacguccaguucggccaguucggcgacgaccccaaggaggaggucaugguccucgagcgcauccuccuccagaccaucaaguucgaccuccaggucgagcaccccuaccaguuccuccucaaguacgccaagcagcucaagggcgacaagaacaagauccagaagcucguccagauggccuggaccuucgucaacgacucccucugcaccacccucucccuccagugggagcccgagaucaucgccgucgccgucauguaccucgccggccgccucugcaaguucgagauccaggaguggaccuccaagcccauguaccgccgcuggugggagcaguucguccaggacguccccgucgacguccucgaggacaucugccaccagauccucgaccucuacucccagggcaagcagcagaugccccaccacaccccccaccagcuccagcagccccccucccuccagcccaccccccaggucccccagguccagcagucccagcccucccaguccuccgagcccucccagccccagcagaaggacccccagcagcccgcccagcagcagcagcccgcccagcagcccaagaagcccuccccccagcccuccuccccccgccaggucaagcgcgccgucgucgucucccccaaggaggagaacaaggccgccgagccccccccccccaagauccccaagaucgagaccacccaccccccccucccccccgcccaccccccccccgaccgcaagcccccccucgccgccgcccucggcgaggccgagccccccggccccgucgacgccaccgaccuccccaagguccagauccccccccccgcccaccccgcccccguccaccagccccccccccucccccaccgcccccccccccccccccccuccuccuacaugaccggcauguccaccaccuccuccuacauguccggcgagggcuaccagucccuccaguccaugaugaagaccgagggccccuccuacggcgcccucccccccgccuacggcccccccgcccaccuccccuaccacccccacgucuacccccccaaccccccccccccccccgucccccccccccccgccuccuuccccccccccgccauccccccccccacccccggcuaccccccccccccccccaccuacaaccccaacuucccccccccccccccccgccucccccccacccacgccguccccccccaccccccccccggccucggccucccccccgccuccuaccccccccccgccgucccccccggcggccagccccccguccccccccccauccccccccccggcaugccccccgucggcggccucggccgcgccgccuggaugcgcuga

SEQ ID NO: 40934 - RNA, 1581 nt, Artificial Sequence
  derived and/or modified sequence opt2 from CCNL1__Homo_sapiens__NP_064703
auggccuccggcccccacuccaccgccaccgccgccgccgccgccuccuccgccgcccccuccgccggcggcuccuccuccggcaccaccaccaccaccaccaccaccaccggcggcauccucaucggcgaccgccucuacuccgaggucucccucaccaucgaccacucccucauccccgaggagcgccucucccccacccccuccaugcaggacggccucgaccuccccuccgagaccgaccuccgcauccucggcugcgagcucauccaggccgccggcauccuccuccgccucccccaggucgccauggccaccggccagguccucuuccaccgcuucuucuacuccaaguccuucgucaagcacuccuucgagaucgucgccauggccugcaucaaccucgccuccaagaucgaggaggccccccgccgcauccgcgacgucaucaacgucuuccaccaccuccgccagcuccgcggcaagcgcacccccuccccccucauccucgaccagaacuacaucaacaccaagaaccaggucaucaaggccgagcgccgcguccucaaggagcucggcuucugcguccacgucaagcacccccacaagaucaucgucauguaccuccagguccucgagugcgagcgcaaccagacccucguccagaccgccuggaacuacaugaacgacucccuccgcaccaacgucuucguccgcuuccagcccgagaccaucgccugcgccugcaucuaccucgccgcccgcgcccuccagaucccccuccccacccgcccccacugguuccuccucuucggcaccaccgaggaggagauccaggagaucugcaucgagacccuccgccucuacacccgcaagaagcccaacuacgagcuccucgagaaggaggucgagaagcgcaaggucgcccuccaggaggccaagcucaaggccaagggccucaaccccgacggcacccccgcccucuccacccucggcggcuucucccccgccuccaagcccuccuccccccgcgaggucaaggccgaggagaagucccccaucuccaucaacgucaagaccgucaagaaggagcccgaggaccgccagcaggccuccaagucccccuacaacggcguccgcaaggacuccaagcgcucccgcaacucccgcuccgccucccgcucccgcucccgcacccgcucccgcucccgcucccacaccccccgccgccacuacaacaaccgccgcucccgcuccggcaccuacuccucccgcucccgcucccgcucccgcucccacuccgaguccccccgccgccaccacaaccacggcuccccccaccucaaggccaagcacacccgcgacgaccucaaguccuccaaccgccacggccacaagcgcaagaagucccgcucccgcucccaguccaagucccgcgaccacuccgacgccgccaagaagcaccgccacgagcgcggccaccaccgcgaccgccgcgagcgcucccgcuccuucgagcgcucccacaaguccaagcaccacggcggcucccgcuccggccacggccgccaccgccgcuga

SEQ ID NO: 40935 - RNA, 1170 nt, Artificial Sequence
  derived and/or modified sequence opt2 from CCNL2__Homo_sapiens__XP_011540521
augggccagcucgccgccgcccucauguccccccgccgcggccucccccucggcgccgagucccccuccgcccgcugcucccacgccuccaaccuccacccccgcggcuucucccucuuccaggucgacuccuucaaggaggccgccgcccgcuccgccgagaagggccccgccgccuccgcccucgaggaggaggaggaggagcccaagcgcauggccugccuccccgccgccacccccgcccucugcuccgccuccuccuucgagaacuacaugaacgacucccuccgcaccgacgucuucguccgcuuccagcccgaguccaucgccugcgccugcaucuaccucgccgcccgcacccucgagaucccccuccccaaccgcccccacugguuccuccucuucggcgccaccgaggaggagauccaggagaucugccucaagauccuccagcucuacgcccgcaagaaggucgaccucacccaccucgagggcgaggucgagaagcgcaagcacgccaucgaggaggccaaggcccaggcccgcggccuccuccccggcggcacccagguccucgacggcaccuccggcuucucccccgcccccaagcucgucgagucccccaaggagggcaagggcuccaagcccuccccccucuccgucaagaacaccaagcgccgccucgagggcgccaagaaggccaaggccgacucccccgucaacggccuccccaagggccgcgagucccgcucccgcucccgcucccgcgagcaguccuacucccgcucccccucccgcuccgccucccccaagcgccgcaaguccgacuccggcuccaccuccggcggcuccaagucccagucccgcucccgcucccgcuccgacucccccccccgccaggccccccgcuccgcccccuacaagggcuccgagauccgcggcucccgcaaguccaaggacugcaaguacccccagaagccccacaagucccgcucccgcuccuccucccgcucccgcucccgcucccgcgagcgcgccgacaaccccggcaaguacaagaagaagucccacuacuaccgcgaccagcgccgcgagcgcucccgcuccuacgagcgcaccggccgccgcuacgagcgcgaccaccccggccacucccgccaccgccgcuga

SEQ ID NO: 40936 - RNA, 1053 nt, Artificial Sequence
  derived and/or modified sequence opt2 from CCNO__Homo_sapiens__NP_066970
auggucacccccugccccaccucccccuccucccccgccgcccgcgccggccgccgcgacaacgaccagaaccuccgcgcccccgucaagaagucccgccgcccccgccuccgccgcaagcagccccuccacccccucaaccccugcccccuccccggcgacuccggcaucugcgaccucuucgagucccccuccuccggcuccgacggcgccgagucccccuccgccgcccgcggcggcuccccccuccccggccccgcccagcccgucgcccagcucgaccuccagaccuuccgcgacuacggccaguccugcuacgccuuccgcaaggcccaggagucccacuuccacccccgcgaggcccucgcccgccagccccaggucaccgccgagucccgcugcaagcuccucuccuggcucauccccguccaccgccaguucggccucuccuucgagucccucugccucaccgucaacacccucgaccgcuuccucaccaccacccccgucgccgccgacugcuuccagcuccucggcgucaccucccuccucaucgccugcaagcaggucgagguccaccccccccgcgucaagcagcuccucgcccucugcugcggcgccuucucccgccagcagcucugcaaccucgagugcaucguccuccacaagcuccacuucacccucggcgcccccaccaucuccuucuuccucgagcacuucacccacgcccgcgucgaggccggccaggccgaggccuccgaggcccucgaggcccaggcccucgcccgcggcgucgccgagcucucccucgccgacuacgccuucaccuccuacucccccucccuccucgccaucugcugccucgcccucgccgaccgcaugcuccgcgucucccgccccgucgaccuccgccucggcgaccaccccgaggccgcccucgaggacugcaugggcaagcuccagcuccucgucgccaucaacuccaccucccucacccacaugcuccccguccagaucugcgagaagugcucccucccccccuccuccaaguga

SEQ ID NO: 40937 - RNA, 2181 nt, Artificial Sequence
  derived and/or modified sequence opt2 from CCNT1__Homo_sapiens__NP_001231
auggagggcgagcgcaagaacaacaacaagcgcugguacuucacccgcgagcagcucgagaacucccccucccgccgcuucggcgucgaccccgacaaggagcucuccuaccgccagcaggccgccaaccuccuccaggacaugggccagcgccucaacgucucccagcucaccaucaacaccgccaucgucuacaugcaccgcuucuacaugauccaguccuucacccaguuccccggcaacuccgucgcccccgccgcccucuuccucgccgccaaggucgaggagcagcccaagaagcucgagcacgucaucaaggucgcccacaccugccuccacccccaggagucccuccccgacacccgcuccgaggccuaccuccagcagguccaggaccucgucauccucgaguccaucauccuccagacccucggcuucgagcucaccaucgaccacccccacacccacgucgucaagugcacccagcucguccgcgccuccaaggaccucgcccagaccuccuacuucauggccaccaacucccuccaccucaccaccuucucccuccaguacaccccccccgucgucgccugcgucugcauccaccucgccugcaagugguccaacugggagauccccgucuccaccgacggcaagcacuggugggaguacgucgacgccaccgucacccucgagcuccucgacgagcucacccacgaguuccuccagauccucgagaagacccccaaccgccucaagcgcaucuggaacuggcgcgccugcgaggccgccaagaagaccaaggccgacgaccgcggcaccgacgagaagaccuccgagcagaccauccucaacaugaucucccaguccuccuccgacaccaccaucgccggccucauguccauguccaccuccaccaccuccgccguccccucccuccccgucuccgaggaguccuccuccaaccucaccuccgucgagaugcuccccggcaagcgcuggcucuccucccagcccuccuucaagcucgagcccacccagggccaccgcaccuccgagaaccucgcccucaccggcgucgaccacucccucccccaggacggcuccaacgccuucaucucccagaagcagaacuccaaguccguccccuccgccaaggucucccucaaggaguaccgcgccaagcacgccgaggagcucgccgcccagaagcgccagcucgagaacauggaggccaacgucaagucccaguacgccuacgccgcccagaaccuccucucccaccacgacucccacuccuccgucauccucaagaugcccaucgagggcuccgagaaccccgagcgccccuuccucgagaaggccgacaagaccgcccucaagaugcgcauccccgucgccggcggcgacaaggccgccuccuccaagcccgaggagaucaagaugcgcaucaagguccacgccgccgccgacaagcacaacuccgucgaggacuccgucaccaagucccgcgagcacaaggagaagcacaagacccaccccuccaaccaccaccaccaccacaaccaccacucccacaagcacucccacucccagcuccccgucggcaccggcaacaagcgccccggcgaccccaagcacuccucccagaccuccaaccucgcccacaagaccuacucccucuccuccuccuucuccuccuccuccuccacccgcaagcgcggccccuccgaggagaccggcggcgccgucuucgaccaccccgccaagaucgccaaguccaccaaguccuccucccucaacuucuccuuccccucccuccccaccaugggccagaugcccggccacuccuccgacaccuccggccucuccuucucccagcccuccugcaagacccgcgucccccacuccaagcucgacaagggccccaccggcgccaacggccacaacaccacccagaccaucgacuaccaggacaccgucaacaugcuccacucccuccucuccgcccagggcguccagcccacccagcccaccgccuucgaguucguccgccccuacuccgacuaccucaacccccgcuccggcggcaucuccucccgcuccggcaacaccgacaagccccgcccccccccccuccccuccgagcccccccccccccuccccccccuccccaaguga

SEQ ID NO: 40938 - RNA, 951 nt, Artificial Sequence
  derived and/or modified sequence opt2 from CCNY__Homo_sapiens__NP_001269781
augggcaacaccaccuccugcugcgucuccuccucccccaagcuccgccgcaacgcccacucccgccucgaguccuaccgccccgacaccgaccucucccgcgaggacaccggcugcaaccuccagcacaucuccgaccgcgagaacaucgacguccgcgagaagcgcaagucccucuucaucaaccaccacccccccggccagaucgcccgcaaguacuccuccugcuccaccaucuuccucgacgacuccaccgucucccagcccaaccucaaguacaccaucaagugcgucgcccucgccaucuacuaccacaucaagaaccgcgaccccgacggccgcaugcuccucgacaucuucgacgagaaccuccacccccucuccaaguccgaggucccccccgacuacgacaagcacaaccccgagcagaagcagaucuaccgcuucguccgcacccucuucuccgccgcccagcucaccgccgagugcgccaucgucacccucgucuaccucgagcgccuccucaccuacgccgagaucgacaucugccccgccaacuggaagcgcaucguccucggcgccauccuccucgccuccaaggucugggacgaccaggccgucuggaacgucgacuacugccagauccucaaggacaucaccgucgaggacaugaacgagcucgagcgccaguuccucgagcuccuccaguucaacaucaacguccccuccuccgucuacgccaaguacuacuucgaccuccgcucccucgccgaggccaacaaccucuccuucccccucgagccccucucccgcgagcgcgcccacaagcucgaggccaucucccgccucugcgaggacaaguacaaggaccuccgccgcuccgcccgcaagcgcuccgccuccgccgacaaccucacccucccccgcuggucccccgccaucaucuccuga

SEQ ID NO: 40939 - RNA, 2976 nt, Artificial Sequence
  derived and/or modified sequence opt2 from CCP110__Homo_sapiens__NP_055526
auggaggaguacgagaaguucugcgagaagucccucgcccgcauccaggaggccucccucuccaccgaguccuuccuccccgcccaguccgaguccaucucccucauccgcuuccacggcgucgccauccucuccccccuccucaacaucgagaagcgcaaggagaugcagcaggagaagcagaaggcccucgacgucgaggcccgcaagcaggucaaccgcaagaaggcccuccucacccgcguccaggagauccucgacaacguccagguccgcaaggcccccaacgccuccgacuucgaccagugggagauggagaccgucuacuccaacuccgagguccgcaaccucaacguccccgccaccuuccccaacuccuuccccucccacaccgagcacuccaccgccgccaagcucgacaagaucgccggcauccucccccucgacaacgaggaccagugcaagaccgacggcaucgaccucgcccgcgacuccgagggcuucaacucccccaagcagugcgacuccuccaacaucucccacgucgagaacgaggccuuccccaagaccuccuccgccaccccccaggagacccucaucuccgacggccccuucuccgucaacgagcagcaggaccucccccuccucgccgaggucauccccgaccccuacgucaugucccuccagaaccucaugaagaaguccaaggaguacaucgagcgcgagcagucccgccgcucccuccgcggcuccaugaaccgcaucgucaacgagucccaccucgacaaggagcacgacgccgucgaggucgccgacugcgucaaggagaagggccagcucaccggcaagcacugcgucuccgucauccccgacaagcccucccucaacaaguccaacguccuccuccagggcgccuccacccaggccuccuccauguccaugcccguccucgccuccuucuccaaggucgacauccccauccgcaccggccaccccaccguccucgaguccaacuccgacuucaaggucauccccaccuucgucaccgagaacaacgucaucaagucccucaccggcuccuacgccaagcuccccucccccgagcccuccaugucccccaagaugcaccgccgccgcucccgcaccuccuccgccugccacauccucaucaacaaccccaucaacgccugcgagcucucccccaagggcaaggagcaggccauggaccucaucauccaggacaccgacgagaacaccaacguccccgagaucaugcccaagcuccccaccgaccucgccggcgucugcuccuccaaggucuacgucggcaagaacaccuccgaggucaaggaggacgucguccucggcaaguccaaccaggucugccaguccuccggcaaccaccucgagaacaaggucacccacggccucgucaccgucgagggccagcucaccuccgacgagcgcggcgcccacaucaugaacuccaccugcgccgccaugcccaagcuccacgagcccuacgccuccucccagugcaucgccucccccaacuucggcaccgucuccggccucaagcccgccuccaugcucgagaagaacugcucccuccagaccgagcucaacaaguccuacgacgucaagaaccccuccccccuccucaugcagaaccagaacacccgccagcagauggacacccccauggucuccugcggcaacgagcaguuccucgacaacuccuucgagaaggucaagcgccgccucgaccucgacaucgacggccuccagaaggagaacugccccuacgucaucaccuccggcaucaccgagcaggagcgccagcaccuccccgagaagcgcuaccccaagggcuccggcuucgucaacaagaacaagaugcucggcaccuccuccaaggaguccgaggagcuccucaaguccaagaugcucgccuucgaggagaugcgcaagcgccucgaggagcagcacgcccagcagcucucccuccucaucgccgagcaggagcgcgagcaggagcgccuccagaaggagaucgaggagcaggagaagaugcucaaggagaagaaggccaugaccgccgaggccuccgagcucgacaucaacaacgccgucgagcucgaguggcgcaagaucuccgacuccucccuccucgagaccaugcucucccaggccgacucccuccacaccuccaacuccaacuccuccggcuucaccaacuccgccaugcaguacuccuucgucuccgccaacgaggcccccuucuaccucuggggcuccuccaccuccggccucaccaagcucuccgucacccgccccuucggccgcgccaagacccgcuggucccaggucuucucccucgagauccaggccaaguucaacaagaucaccgccgucgccaagggcuuccucacccgccgccucaugcagaccgacaagcucaagcagcuccgccagaccgucaaggacaccauggaguucauccgcuccuuccaguccgaggccccccucaagcgcggcaucgucuccgcccaggacgccucccuccaggagcgcguccucgcccagcuccgcgccgcccucuacggcauccacgacaucuucuucgucauggacgccgccgagcgcauguccauccuccaccacgaccgcgagguccgcaaggagaagaugcuccgccagauggacaagaugaaguccccccgcgucgcccucuccgccgccacccagaagucccucgaccgcaagaaguacaugaaggccgccgagaugggcaugcccaacaagaaguuccucgucaagcagaaccccuccgagacccgcguccuccagcccaaccagggccagaacgcccccguccaccgccuccucucccgccagggcuccaucugccgcaagaaccccaagaaggccgccaagugcugcgacaaccuccgccgccagcacucccucggcuga

SEQ ID NO: 40940 - RNA, 1089 nt, Artificial Sequence
  derived and/or modified sequence opt2 from CCR10__Homo_sapiens__NP_057686
augggcaccgaggccaccgagcaggucuccuggggccacuacuccggcgacgaggaggacgccuacuccgccgagccccuccccgagcucugcuacaaggccgacguccaggccuucucccgcgccuuccagcccuccgucucccucaccgucgccgcccucggccucgccggcaacggccucguccucgccacccaccucgccgcccgccgcgccgcccgcucccccaccuccgcccaccuccuccagcucgcccucgccgaccuccuccucgcccucacccuccccuucgccgccgccggcgcccuccagggcuggucccucggcuccgccaccugccgcaccaucuccggccucuacuccgccuccuuccacgccggcuuccucuuccucgccugcaucuccgccgaccgcuacgucgccaucgcccgcgcccuccccgccggcccccgccccuccacccccggccgcgcccaccucgucuccgucaucgucuggcuccucucccuccuccucgcccuccccgcccuccucuucucccaggacggccagcgcgagggccagcgccgcugccgccucaucuuccccgagggccucacccagaccgucaagggcgccuccgccgucgcccaggucgcccucggcuucgcccucccccucggcgucauggucgccugcuacgcccuccucggccgcacccuccucgccgcccgcggccccgagcgccgccgcgcccuccgcgucgucgucgcccucgucgccgccuucgucguccuccagcuccccuacucccucgcccuccuccucgacaccgccgaccuccucgccgcccgcgagcgcuccugccccgccuccaagcgcaaggacgucgcccuccucgucaccuccggccucgcccucgcccgcugcggccucaaccccguccucuacgccuuccucggccuccgcuuccgccaggaccuccgccgccuccuccgcggcggcuccugccccuccggcccccagccccgccgcggcugcccccgccgcccccgccucuccuccugcuccgcccccaccgagacccacucccucuccugggacaacuga

SEQ ID NO: 40941 - RNA, 1068 nt, Artificial Sequence
  derived and/or modified sequence opt2 from CCR1__Homo_sapiens__NP_001286
auggagacccccaacaccaccgaggacuacgacaccaccaccgaguucgacuacggcgacgccacccccugccagaaggucaacgagcgcgccuucggcgcccagcuccuccccccccucuacucccucgucuucgucaucggccucgucggcaacauccucgucguccucguccucguccaguacaagcgccucaagaacaugaccuccaucuaccuccucaaccucgccaucuccgaccuccucuuccucuucacccuccccuucuggaucgacuacaagcucaaggacgacugggucuucggcgacgccaugugcaagauccucuccggcuucuacuacaccggccucuacuccgagaucuucuucaucauccuccucaccaucgaccgcuaccucgccaucguccacgccgucuucgcccuccgcgcccgcaccgucaccuucggcgucaucaccuccaucaucaucugggcccucgccauccucgccuccaugcccggccucuacuucuccaagacccagugggaguucacccaccacaccugcucccuccacuucccccacgagucccuccgcgaguggaagcucuuccaggcccucaagcucaaccucuucggccucguccucccccuccucgucaugaucaucugcuacaccggcaucaucaagauccuccuccgccgccccaacgagaagaaguccaaggccguccgccucaucuucgucaucaugaucaucuucuuccucuucuggacccccuacaaccucaccauccucaucuccgucuuccaggacuuccucuucacccacgagugcgagcagucccgccaccucgaccucgccguccaggucaccgaggucaucgccuacacccacugcugcgucaaccccgucaucuacgccuucgucggcgagcgcuuccgcaaguaccuccgccagcucuuccaccgccgcgucgccguccaccucgucaaguggcuccccuuccucuccgucgaccgccucgagcgcgucuccuccaccucccccuccaccggcgagcacgagcucuccgccggcuucuga

SEQ ID NO: 40942 - RNA, 1125 nt, Artificial Sequence
  derived and/or modified sequence opt2 from CCR2__Homo_sapiens__NP_001116513
augcucuccaccucccgcucccgcuucauccgcaacaccaacgaguccggcgaggaggucaccaccuucuucgacuacgacuacggcgcccccugccacaaguucgacgucaagcagaucggcgcccagcuccuccccccccucuacucccucgucuucaucuucggcuucgucggcaacaugcucgucguccucauccucaucaacugcaagaagcucaagugccucaccgacaucuaccuccucaaccucgccaucuccgaccuccucuuccucaucacccucccccucugggcccacuccgccgccaacgagugggucuucggcaacgccaugugcaagcucuucaccggccucuaccacaucggcuacuucggcggcaucuucuucaucauccuccucaccaucgaccgcuaccucgccaucguccacgccgucuucgcccucaaggcccgcaccgucaccuucggcgucgucaccuccgucaucaccuggcucgucgccgucuucgccuccguccccggcaucaucuucaccaagugccagaaggaggacuccgucuacgucugcggccccuacuucccccgcggcuggaacaacuuccacaccaucaugcgcaacauccucggccucguccucccccuccucaucauggucaucugcuacuccggcauccucaagacccuccuccgcugccgcaacgagaagaagcgccaccgcgccguccgcgucaucuucaccaucaugaucgucuacuuccucuucuggacccccuacaacaucgucauccuccucaacaccuuccaggaguucuucggccucuccaacugcgaguccaccucccagcucgaccaggccacccaggucaccgagacccucggcaugacccacugcugcaucaaccccaucaucuacgccuucgucggcgagaaguuccgcucccucuuccacaucgcccucggcugccgcaucgccccccuccagaagcccgucugcggcggccccggcguccgccccggcaagaacgucaaggucaccacccagggccuccucgacggccgcggcaagggcaaguccaucggccgcgcccccgaggccucccuccaggacaaggagggcgccuga

SEQ ID NO: 40943 - RNA, 1122 nt, Artificial Sequence
  derived and/or modified sequence opt2 from CCR3__Homo_sapiens__NP_001158152
augcccuucggcauccgcaugcuccuccgcgcccacaagcccggccgcuccgagaugaccaccucccucgacaccgucgagaccuucggcaccaccuccuacuacgacgacgucggccuccucugcgagaaggccgacacccgcgcccucauggcccaguucguccccccccucuacucccucgucuucaccgucggccuccucggcaacgucgucgucgucaugauccucaucaaguaccgccgccuccgcaucaugaccaacaucuaccuccucaaccucgccaucuccgaccuccucuuccucgucacccuccccuucuggauccacuacguccgcggccacaacugggucuucggccacggcaugugcaagcuccucuccggcuucuaccacaccggccucuacuccgagaucuucuucaucauccuccucaccaucgaccgcuaccucgccaucguccacgccgucuucgcccuccgcgcccgcaccgucaccuucggcgucaucaccuccaucgucaccuggggccucgccguccucgccgcccuccccgaguucaucuucuacgagaccgaggagcucuucgaggagacccucugcuccgcccucuaccccgaggacaccgucuacuccuggcgccacuuccacacccuccgcaugaccaucuucugccucguccucccccuccucgucauggccaucugcuacaccggcaucaucaagacccuccuccgcugccccuccaagaagaaguacaaggccauccgccucaucuucgucaucauggccgucuucuucaucuucuggacccccuacaacgucgccauccuccucuccuccuaccaguccauccucuucggcaacgacugcgagcgcuccaagcaccucgaccucgucaugcucgucaccgaggucaucgccuacucccacugcugcaugaaccccgucaucuacgccuucgucggcgagcgcuuccgcaaguaccuccgccacuucuuccaccgccaccuccucaugcaccucggccgcuacauccccuuccuccccuccgagaagcucgagcgcaccuccuccgucucccccuccaccgccgagcccgagcucuccaucgucuucuga

SEQ ID NO: 40944 - RNA, 1083 nt, Artificial Sequence
  derived and/or modified sequence opt2 from CCR4__Homo_sapiens__NP_005499
augaaccccaccgacaucgccgacaccacccucgacgaguccaucuacuccaacuacuaccucuacgaguccauccccaagcccugcaccaaggagggcaucaaggccuucggcgagcucuuccuccccccccucuacucccucgucuucgucuucggccuccucggcaacuccgucgucguccucguccucuucaaguacaagcgccuccgcuccaugaccgacgucuaccuccucaaccucgccaucuccgaccuccucuucgucuucucccuccccuucuggggcuacuacgccgccgaccagugggucuucggccucggccucugcaagaugaucuccuggauguaccucgucggcuucuacuccggcaucuucuucgucaugcucauguccaucgaccgcuaccucgccaucguccacgccgucuucucccuccgcgcccgcacccucaccuacggcgucaucaccucccucgccaccugguccgucgccgucuucgccucccuccccggcuuccucuucuccaccugcuacaccgagcgcaaccacaccuacugcaagaccaaguacucccucaacuccaccaccuggaagguccucuccucccucgagaucaacauccucggccucgucaucccccucggcaucaugcucuucugcuacuccaugaucauccgcacccuccagcacugcaagaacgagaagaagaacaaggccgucaagaugaucuucgccgucgucguccucuuccucggcuucuggacccccuacaacaucguccucuuccucgagacccucgucgagcucgagguccuccaggacugcaccuucgagcgcuaccucgacuacgccauccaggccaccgagacccucgccuucguccacugcugccucaaccccaucaucuacuucuuccucggcgagaaguuccgcaaguacauccuccagcucuucaagaccugccgcggccucuucguccucugccaguacugcggccuccuccagaucuacuccgccgacacccccuccuccuccuacacccaguccaccauggaccacgaccuccacgacgcccucuga

SEQ ID NO: 40945 - RNA, 1059 nt, Artificial Sequence
  derived and/or modified sequence opt2 from CCR5__Homo_sapiens__NP_000570
auggacuaccaggucuccucccccaucuacgacaucaacuacuacaccuccgagcccugccagaagaucaacgucaagcagaucgccgcccgccuccuccccccccucuacucccucgucuucaucuucggcuucgucggcaacaugcucgucauccucauccucaucaacugcaagcgccucaaguccaugaccgacaucuaccuccucaaccucgccaucuccgaccucuucuuccuccucaccguccccuucugggcccacuacgccgccgcccagugggacuucggcaacaccaugugccagcuccucaccggccucuacuucaucggcuucuucuccggcaucuucuucaucauccuccucaccaucgaccgcuaccucgccgucguccacgccgucuucgcccucaaggcccgcaccgucaccuucggcgucgucaccuccgucaucaccugggucgucgccgucuucgccucccuccccggcaucaucuucacccgcucccagaaggagggccuccacuacaccugcuccucccacuuccccuacucccaguaccaguucuggaagaacuuccagacccucaagaucgucauccucggccucguccucccccuccucgucauggucaucugcuacuccggcauccucaagacccuccuccgcugccgcaacgagaagaagcgccaccgcgccguccgccucaucuucaccaucaugaucgucuacuuccucuucugggcccccuacaacaucguccuccuccucaacaccuuccaggaguucuucggccucaacaacugcuccuccuccaaccgccucgaccaggccaugcaggucaccgagacccucggcaugacccacugcugcaucaaccccaucaucuacgccuucgucggcgagaaguuccgcaacuaccuccucgucuucuuccagaagcacaucgccaagcgcuucugcaagugcugcuccaucuuccagcaggaggcccccgagcgcgccuccuccgucuacacccgcuccaccggcgagcaggagaucuccgucggccucuga

SEQ ID NO: 40946 - RNA, 1125 nt, Artificial Sequence
  derived and/or modified sequence opt2 from CCR6__Homo_sapiens__NP_004358
auguccggcgaguccaugaacuucuccgacgucuucgacuccuccgaggacuacuucgucuccgucaacaccuccuacuacuccgucgacuccgagaugcuccucugcucccuccaggagguccgccaguucucccgccucuucguccccaucgccuacucccucaucugcgucuucggccuccucggcaacauccucgucgucaucaccuucgccuucuacaagaaggcccgcuccaugaccgacgucuaccuccucaacauggccaucgccgacauccucuucguccucacccuccccuucugggccgucucccacgccaccggcgccugggucuucuccaacgccaccugcaagcuccucaagggcaucuacgccaucaacuucaacugcggcaugcuccuccucaccugcaucuccauggaccgcuacaucgccaucguccaggccaccaaguccuuccgccuccgcucccgcacccucccccgcuccaagaucaucugccucgucgucuggggccucuccgucaucaucuccuccuccaccuucgucuucaaccagaaguacaacacccagggcuccgacgucugcgagcccaaguaccagaccgucuccgagcccauccgcuggaagcuccucaugcucggccucgagcuccucuucggcuucuucaucccccucauguucaugaucuucugcuacaccuucaucgucaagacccucguccaggcccagaacuccaagcgccacaaggccauccgcgucaucaucgccgucguccucgucuuccucgccugccagaucccccacaacaugguccuccucgucaccgccgccaaccucggcaagaugaaccgcuccugccaguccgagaagcucaucggcuacaccaagaccgucaccgagguccucgccuuccuccacugcugccucaaccccguccucuacgccuucaucggccagaaguuccgcaacuacuuccucaagauccucaaggaccucuggugcguccgccgcaaguacaaguccuccggcuucuccugcgccggccgcuacuccgagaacaucucccgccagaccuccgagaccgccgacaacgacaacgccuccuccuucaccauguga

SEQ ID NO: 40947 - RNA, 1137 nt, Artificial Sequence
  derived and/or modified sequence opt2 from CCR7__Homo_sapiens__NP_001829
auggaccucggcaagcccaugaaguccguccucgucgucgcccuccucgucaucuuccaggucugccucugccaggacgaggucaccgacgacuacaucggcgacaacaccaccgucgacuacacccucuucgagucccucugcuccaagaaggacguccgcaacuucaaggccugguuccuccccaucauguacuccaucaucugcuucgucggccuccucggcaacggccucgucguccucaccuacaucuacuucaagcgccucaagaccaugaccgacaccuaccuccucaaccucgccgucgccgacauccucuuccuccucacccuccccuucugggccuacuccgccgccaaguccugggucuucggcguccacuucugcaagcucaucuucgccaucuacaagauguccuucuucuccggcaugcuccuccuccucugcaucuccaucgaccgcuacgucgccaucguccaggccgucuccgcccaccgccaccgcgcccgcguccuccucaucuccaagcucuccugcgucggcaucuggauccucgccaccguccucuccauccccgagcuccucuacuccgaccuccagcgcuccuccuccgagcaggccaugcgcugcucccucaucaccgagcacgucgaggccuucaucaccauccaggucgcccagauggucaucggcuuccucgucccccuccucgccauguccuucugcuaccucgucaucauccgcacccuccuccaggcccgcaacuucgagcgcaacaaggccaucaaggucaucaucgccgucgucgucgucuucaucgucuuccagcuccccuacaacggcgucguccucgcccagaccgucgccaacuucaacaucaccuccuccaccugcgagcucuccaagcagcucaacaucgccuacgacgucaccuacucccucgccugcguccgcugcugcgucaaccccuuccucuacgccuucaucggcgucaaguuccgcaacgaccucuucaagcucuucaaggaccucggcugccucucccaggagcagcuccgccagugguccuccugccgccacauccgccgcuccuccauguccgucgaggccgagaccaccaccaccuucucccccuga

SEQ ID NO: 40948 - RNA, 1068 nt, Artificial Sequence
  derived and/or modified sequence opt2 from CCR8__Homo_sapiens__NP_005192
auggacuacacccucgaccucuccgucaccaccgucaccgacuacuacuaccccgacaucuucuccucccccugcgacgccgagcucauccagaccaacggcaagcuccuccucgccgucuucuacugccuccucuucgucuucucccuccucggcaacucccucgucauccucguccucgucgucugcaagaagcuccgcuccaucaccgacgucuaccuccucaaccucgcccucuccgaccuccucuucgucuucuccuuccccuuccagaccuacuaccuccucgaccagugggucuucggcaccgucaugugcaaggucgucuccggcuucuacuacaucggcuucuacuccuccauguucuucaucacccucauguccgucgaccgcuaccucgccgucguccacgccgucuacgcccucaagguccgcaccauccgcaugggcaccacccucugccucgccgucuggcucaccgccaucauggccaccaucccccuccucgucuucuaccaggucgccuccgaggacggcguccuccagugcuacuccuucuacaaccagcagacccucaaguggaagaucuucaccaacuucaagaugaacauccucggccuccucauccccuucaccaucuucauguucugcuacaucaagauccuccaccagcucaagcgcugccagaaccacaacaagaccaaggccauccgccucguccucaucgucgucaucgccucccuccucuucuggguccccuucaacgucguccucuuccucaccucccuccacuccaugcacauccucgacggcugcuccaucucccagcagcucaccuacgccacccacgucaccgagaucaucuccuucacccacugcugcgucaaccccgucaucuacgccuucgucggcgagaaguucaagaagcaccucuccgagaucuuccagaaguccugcucccagaucuucaacuaccucggccgccagaugccccgcgaguccugcgagaaguccuccuccugccagcagcacuccucccgcuccuccuccgucgacuacauccucuga

SEQ ID NO: 40949 - RNA, 1074 nt, Artificial Sequence
  derived and/or modified sequence opt2 from CCR9__Homo_sapiens__NP_001243298
auggccgacgacuacggcuccgaguccaccuccuccauggaggacuacgucaacuucaacuucaccgacuucuacugcgagaagaacaacguccgccaguucgccucccacuuccuccccccccucuacuggcucgucuucaucgucggcgcccucggcaacucccucgucauccucgucuacugguacugcacccgcgucaagaccaugaccgacauguuccuccucaaccucgccaucgccgaccuccucuuccucgucacccuccccuucugggccaucgccgccgccgaccaguggaaguuccagaccuucaugugcaaggucgucaacuccauguacaagaugaacuucuacuccugcguccuccucaucaugugcaucuccgucgaccgcuacaucgccaucgcccaggccaugcgcgcccacaccuggcgcgagaagcgccuccucuacuccaagauggucugcuucaccaucuggguccucgccgccgcccucugcauccccgagauccucuacucccagaucaaggaggaguccggcaucgccaucugcaccauggucuaccccuccgacgaguccaccaagcucaaguccgccguccucacccucaaggucauccucggcuucuuccuccccuucgucgucauggccugcugcuacaccaucaucauccacacccucauccaggccaagaaguccuccaagcacaaggcccucaaggucaccaucaccguccucaccgucuucguccucucccaguuccccuacaacugcauccuccucguccagaccaucgacgccuacgccauguucaucuccaacugcgccgucuccaccaacaucgacaucugcuuccaggucacccagaccaucgccuucuuccacuccugccucaaccccguccucuacgucuucgucggcgagcgcuuccgccgcgaccucgucaagacccucaagaaccucggcugcaucucccaggcccagugggucuccuucacccgccgcgagggcucccucaagcucuccuccaugcuccucgagaccaccuccggcgcccucucccucuga

SEQ ID NO: 40950 - RNA, 1071 nt, Artificial Sequence
  derived and/or modified sequence opt2 from CCRL2__Homo_sapiens__NP_001124382
augaucuacacccgcuuccucaagggcucccucaagauggccaacuacacccucgcccccgaggacgaguacgacguccucaucgagggcgagcucgaguccgacgaggccgagcagugcgacaaguacgacgcccaggcccucuccgcccagcucguccccucccucugcuccgccgucuucgucaucggcguccucgacaaccuccucgucguccucauccucgucaaguacaagggccucaagcgcgucgagaacaucuaccuccucaaccucgccgucuccaaccucugcuuccuccucacccuccccuucugggcccacgccggcggcgaccccaugugcaagauccucaucggccucuacuucgucggccucuacuccgagaccuucuucaacugccuccucaccguccagcgcuaccucgucuuccuccacaagggcaacuucuucuccgcccgccgccgcguccccugcggcaucaucaccuccguccucgccugggucaccgccauccucgccacccuccccgaguucgucgucuacaagccccagauggaggaccagaaguacaagugcgccuucucccgcacccccuuccuccccgccgacgagaccuucuggaagcacuuccucacccucaagaugaacaucuccguccucguccucccccucuucaucuucaccuuccucuacguccagaugcgcaagacccuccgcuuccgcgagcagcgcuacucccucuucaagcucgucuucgccaucauggucgucuuccuccucaugugggcccccuacaacaucgccuucuuccucuccaccuucaaggagcacuucucccucuccgacugcaaguccuccuacaaccucgacaaguccguccacaucaccaagcucaucgccaccacccacugcugcaucaacccccuccucuacgccuuccucgacggcaccuucuccaaguaccucugccgcugcuuccaccuccgcuccaacaccccccuccagccccgcggccaguccgcccagggcaccucccgcgaggagcccgaccacuccaccgaggucuga

SEQ ID NO: 40951 - RNA, 1296 nt, Artificial Sequence
  derived and/or modified sequence opt2 from CCRN4L__Homo_sapiens__NP_036250
auguuccacuccccccgccgccucugcuccgcccuccuccagcgcgacgcccccggccuccgccgccuccccgcccccggccuccgccgcccccucuccccccccgccgccgucccccgccccgccuccccccgccuccucgccgccgccuccgccgccuccggcgccgcccgcuccugcucccgcaccgucugcuccaugggcaccggcaccucccgccucuacuccgcccucgccaagacccucaacuccuccgccgccucccagcaccccgaguaccucgucucccccgaccccgagcaccucgagcccaucgaccccaaggagcuccucgaggagugccgcgccguccuccacacccgccccccccgcuuccagcgcgacuucgucgaccuccgcaccgacugccccuccacccacccccccauccgcgucaugcaguggaacauccucgcccaggcccucggcgagggcaaggacaacuucguccagugccccgucgaggcccucaagugggaggagcgcaagugccucauccucgaggagauccucgccuaccagcccgacauccucugccuccaggaggucgaccacuacuucgacaccuuccagccccuccucucccgccucggcuaccagggcaccuucuuccccaagcccuggucccccugccucgacgucgagcacaacaacggccccgacggcugcgcccucuucuuccuccagaaccgcuucaagcucgucaacuccgccaacauccgccucaccgccaugacccucaagaccaaccaggucgccaucgcccagacccucgagugcaaggaguccggccgccaguucugcaucgccgucacccaccucaaggcccgcaccggcugggagcgcuuccgcuccgcccagggcugcgaccuccuccagaaccuccagaacaucacccagggcgccaagaucccccucaucgucugcggcgacuucaacgccgagcccaccgaggaggucuacaagcacuucgccuccuccucccucaaccucaacuccgccuacaagcuccucuccgccgacggccaguccgagccccccuacaccaccuggaagauccgcaccuccggcgagugccgccacacccucgacuacaucugguacuccaagcacgcccucaacguccgcuccgcccucgaccuccucaccgaggagcagaucggccccaaccgccuccccuccuucaacuaccccuccgaccaccucucccucgucugcgacuucuccuucaccgaggaguccgacggccucuccuga

SEQ ID NO: 40952 - RNA, 2703 nt, Artificial Sequence
  derived and/or modified sequence opt2 from CCSER1__Homo_sapiens__NP_001138537
augggcgacuccggcucccgccgcuccacccucgucucccgccuccccaucuuccgccgcuccaucaaccgccgccacgacucccuccccuccucccccuccuccuccaacaccgucggcguccacuccuccucccccuccuccaccaacuccuccuccggcuccaccggcaagcgccgcuccaucuuccgcacccccuccaucuccuuccaccacaagaagggcuccgagcccaagcaggagcccaccaaccagaaccucuccaucuccaacggcgcccagcccggccacuccaacaugcagaagcucucccucgaggagcacaucaagacccgcggccgccacuccgucggcuucuccuccucccgcaacaagaagaucacccgcucccucaccgaggacuucgagcgcgagaaggagcacuccaccaacaagaacgucuucaucaacugccucuccuccggcaaguccgagggcgacgacuccggcuucaccgaggaccagacccgccgcuccgucaagcaguccacccgcaagcuccuccccaaguccuucuccucccacuacaaguucuccaagcccguccuccagucccaguccaucucccucguccagcaguccgaguucucccucgaggucacccaguaccaggagcgcgagcccguccucguccgcgccucccccuccugcuccgucgacgucaccgagcgcgccggcuccucccuccaguccccccuccucuccgccgaccucaccaccgcccagacccccuccgaguuccucgcccucaccgaggacuccgucuccgagauggacgccuucuccaaguccggcuccauggccucccacugcgacaacuucggccacaacgacuccaccucccagaugucccucaacuccgccgccgucaccaagaccaccaccgagcucaccggcaccguccccugcgccaucaugucccccggcaaguaccgccucgagggccagugcuccaccgaguccaacucccuccccgagaccuccgccgccaaccagaaggagguccuccuccagaucgccgagcuccccgccaccuccgucucccacuccgaguccaaccuccccgccgacuccgagcgcgaggagaacaucggccuccagaacggcgagaccaugcucggcaccaacuccccccgcaagcucggcuucuacgagcagcacaaggccaucgccgagcacgucaagggcauccaccccaucuccgacuccaagaucauccccaccuccggcgaccaccacaucuucaacaagaccucccacggcuacgaggccaaccccgccaagguccucgccuccucccucucccccuuccgcgagggccgcuucaucgagcgccgccuccgcuccuccuccgagggcaccgccggcuccucccgcaugauccucaagcccaaggacggcaacaucgaggaggucaacucccuccgcaagcagcgcgccggcuccuccuccuccaagaugaacucccucgacguccucaacaaccucggcuccugcgagcucgacgaggacgaccucaugcucgaccucgaguuccucgaggagcagucccuccaccccuccgucugccgcgaggacuccuaccacuccgucgucuccugcgccgccgucguccucacccccauggagcccaugaucgagaugaagaagcgcgaggagcccgaguuccccgagcccuccaagcagaaccucucccucaagcucaccaaggacgucgaccaggaggcccgcugcucccacaucucccgcaugcccaacucccccuccgccgacuggccccuccagggcgucgaggagaacggcggcaucgacucccuccccuuccgccucaugcuccaggacugcaccgccgucaagacccuccuccucaagaugaagcgcguccuccaggaguccgccgacaugucccccgccuccuccaccaccucccuccccgucuccccccucaccgaggagcccguccccuucaaggacaucaugaaggacgagugcuccaugcucaagcuccagcucaaggagaaggacgagcucaucucccagcuccaggaggagcucggcaagguccgccaccuccagaaggccuucgccucccgcgucgacaaguccacccagaccgagcuccucugcuacgacggccucaaccucaagcgccucgagaccguccagggcggccgcgaggccaccuaccgcaaccgcaucgucucccagaaccucuccacccgcgaccgcaaggccauccacacccccaccgaggaccgcuuccgcuacuccgccgccgaccagaccucccccuacaagaacaagaccugccagcuccccucccucugccucuccaacuuccucaaggacaaggagcucgccgaggucaucaagcacucccgcggcaccuacgagacccucaccuccgacgucacccagaaccuccgcgccaccgucggccaguccucccucaagcccaccgccaagaccgagggccucuccaccuuccucgagaagcccaaggaccaggucgccaccgcccgccagcacuccaccuucaccggccgcuucggccagcccccccgcggccccaucucccuccacauguacucccgcaagaacgucuuccuccaccacaaccuccacuccaccgagcuccagacccucggccagcaggacggcuga

SEQ ID NO: 40953 - RNA, 825 nt, Artificial Sequence
  derived and/or modified sequence opt2 from CCS__Homo_sapiens__NP_005116
auggccuccgacuccggcaaccagggcacccucugcacccucgaguucgccguccagaugaccugccaguccugcgucgacgccguccgcaagucccuccagggcgucgccggcguccaggacgucgagguccaccucgaggaccagaugguccucguccacaccacccuccccucccaggagguccaggcccuccucgagggcaccggccgccaggccguccucaagggcaugggcuccggccagcuccagaaccucggcgccgccgucgccauccucggcggccccggcaccguccagggcgucguccgcuuccuccagcucacccccgagcgcugccucaucgagggcaccaucgacggccucgagcccggccuccacggccuccacguccaccaguacggcgaccucaccaacaacugcaacuccugcggcaaccacuucaaccccgacggcgccucccacggcggcccccaggacuccgaccgccaccgcggcgaccucggcaacguccgcgccgacgccgacggccgcgccaucuuccgcauggaggacgagcagcucaaggucugggacgucaucggccgcucccucaucaucgacgagggcgaggacgaccucggccgcggcggccacccccucuccaagaucaccggcaacuccggcgagcgccucgccugcggcaucaucgcccgcuccgccggccucuuccagaaccccaagcagaucugcuccugcgacggccucaccaucugggaggagcgcggccgccccaucgccggcaagggccgcaaggaguccgcccagccccccgcccaccucuga

SEQ ID NO: 40954 - RNA, 1608 nt, Artificial Sequence
  derived and/or modified sequence opt2 from CCT2__Homo_sapiens__NP_006422
auggccucccucucccucgcccccgucaacaucuucaaggccggcgccgacgaggagcgcgccgagaccgcccgccucaccuccuucaucggcgccaucgccaucggcgaccucgucaaguccacccucggccccaagggcauggacaagauccuccucuccuccggccgcgacgccucccucauggucaccaacgacggcgccaccauccucaagaacaucggcgucgacaaccccgccgccaagguccucgucgacaugucccgcguccaggacgacgaggucggcgacggcaccaccuccgucaccguccucgccgccgagcuccuccgcgaggccgagucccucaucgccaagaagauccacccccagaccaucaucgccggcuggcgcgaggccaccaaggccgcccgcgaggcccuccucuccuccgccgucgaccacggcuccgacgaggucaaguuccgccaggaccucaugaacaucgccggcaccacccucuccuccaagcuccucacccaccacaaggaccacuucaccaagcucgccgucgaggccguccuccgccucaagggcuccggcaaccucgaggccauccacaucaucaagaagcucggcggcucccucgccgacuccuaccucgacgagggcuuccuccucgacaagaagaucggcgucaaccagcccaagcgcaucgagaacgccaagauccucaucgccaacaccggcauggacaccgacaagaucaagaucuucggcucccgcguccgcgucgacuccaccgccaaggucgccgagaucgagcacgccgagaaggagaagaugaaggagaaggucgagcgcauccucaagcacggcaucaacugcuucaucaaccgccagcucaucuacaacuaccccgagcagcucuucggcgccgccggcgucauggccaucgagcacgccgacuucgccggcgucgagcgccucgcccucgucaccggcggcgagaucgccuccaccuucgaccaccccgagcucgucaagcucggcuccugcaagcucaucgaggaggucaugaucggcgaggacaagcucauccacuucuccggcgucgcccucggcgaggccugcaccaucguccuccgcggcgccacccagcagauccucgacgaggccgagcgcucccuccacgacgcccucugcguccucgcccagaccgucaaggacucccgcaccgucuacggcggcggcugcuccgagaugcucauggcccacgccgucacccagcucgccaaccgcacccccggcaaggaggccgucgccauggaguccuacgccaaggcccuccgcaugcuccccaccaucaucgccgacaacgccggcuacgacuccgccgaccucgucgcccagcuccgcgccgcccacuccgagggcaacaccaccgccggccucgacaugcgcgagggcaccaucggcgacauggccauccucggcaucaccgaguccuuccaggucaagcgccagguccuccucuccgccgccgaggccgccgaggucauccuccgcgucgacaacaucaucaaggccgccccccgcaagcgcguccccgaccaccaccccugcuga

SEQ ID NO: 40955 - RNA, 1524 nt, Artificial Sequence
  derived and/or modified sequence opt2 from CCT3__Homo_sapiens__NP_001008800
augaugggccaccgccccguccucguccucucccagaacaccaagcgcgaguccggccgcaagguccaguccggcaacaucaacgccgccaagauccagguccagcaccccgccgccaaguccaugaucgagaucucccgcacccaggacgaggaggucggcgacggcaccaccuccgucaucauccucgccggcgagaugcucuccgucgccgagcacuuccucgagcagcagaugcaccccaccgucgucaucuccgccuaccgcaaggcccucgacgacaugaucuccacccucaagaagaucuccauccccgucgacaucuccgacuccgacaugaugcucaacaucaucaacuccuccaucaccaccaaggccaucucccgcugguccucccucgccugcaacaucgcccucgacgccgucaagaugguccaguucgaggagaacggccgcaaggagaucgacaucaagaaguacgcccgcgucgagaagauccccggcggcaucaucgaggacuccugcguccuccgcggcgucaugaucaacaaggacgucacccacccccgcaugcgccgcuacaucaagaacccccgcaucguccuccucgacuccucccucgaguacaagaagggcgagucccagaccgacaucgagaucacccgcgaggaggacuucacccgcauccuccagauggaggaggaguacauccagcagcucugcgaggacaucauccagcucaagcccgacgucgucaucaccgagaagggcaucuccgaccucgcccagcacuaccucaugcgcgccaacaucaccgccauccgccgcguccgcaagaccgacaacaaccgcaucgcccgcgccugcggcgcccgcaucgucucccgccccgaggagcuccgcgaggacgacgucggcaccggcgccggccuccucgagaucaagaagaucggcgacgaguacuucaccuucaucaccgacugcaaggaccccaaggccugcaccauccuccuccgcggcgccuccaaggagauccucuccgaggucgagcgcaaccuccaggacgccaugcaggucugccgcaacguccuccucgacccccagcucguccccggcggcggcgccuccgagauggccgucgcccacgcccucaccgagaaguccaaggccaugaccggcgucgagcaguggcccuaccgcgccgucgcccaggcccucgaggucaucccccgcacccucauccagaacugcggcgccuccaccauccgccuccucaccucccuccgcgccaagcacacccaggagaacugcgagaccuggggcgucaacggcgagaccggcacccucgucgacaugaaggagcucggcaucugggagccccucgccgucaagcuccagaccuacaagaccgccgucgagaccgccguccuccuccuccgcaucgacgacaucgucuccggccacaagaagaagggcgacgaccagucccgccagggcggcgcccccgacgccggccaggaguga

SEQ ID NO: 40956 - RNA, 1530 nt, Artificial Sequence
  derived and/or modified sequence opt2 from CCT4__Homo_sapiens__NP_001243650
augcccgagaacgucgccccccgcuccggcgccaccgccggcgccgccggcggccgcggcaagggcgccuaccaggaccgcgacaagcccgcccagauccgcuucuccaacaucuccgccgccaaggccgucgccgacgccauccgcaccucccucggccccaagggcauggacaagaugcucgucgagcucuccaaggcccaggacaucgaggccggcgacggcaccaccuccgucgucaucaucgccggcucccuccucgacuccugcaccaagcuccuccagaagggcauccaccccaccaucaucuccgaguccuuccagaaggcccucgagaagggcaucgagauccucaccgacaugucccgccccgucgagcucuccgaccgcgagacccuccucaacuccgccaccaccucccucaacuccaaggucgucucccaguacuccucccuccucucccccauguccgucaacgccgucaugaaggucaucgaccccgccaccgccaccuccgucgaccuccgcgacaucaagaucgucaagaagcucggcggcaccaucgacgacugcgagcucgucgagggccucguccucacccagaaggucuccaacuccggcaucacccgcgucgagaaggccaagaucggccucauccaguucugccucuccgcccccaagaccgacauggacaaccagaucgucgucuccgacuacgcccagauggaccgcguccuccgcgaggagcgcgccuacauccucaaccucgucaagcagaucaagaagaccggcugcaacguccuccucauccagaaguccauccuccgcgacgcccucuccgaccucgcccuccacuuccucaacaagaugaagaucauggucaucaaggacaucgagcgcgaggacaucgaguucaucugcaagaccaucggcaccaagcccgucgcccacaucgaccaguucaccgccgacaugcucggcuccgccgagcucgccgaggaggucaaccucaacggcuccggcaagcuccucaagaucaccggcugcgccucccccggcaagaccgucaccaucgucguccgcggcuccaacaagcucgucaucgaggaggccgagcgcuccauccacgacgcccucugcgucauccgcugccucgucaagaagcgcgcccucaucgccggcggcggcgcccccgagaucgagcucgcccuccgccucaccgaguacucccgcacccucuccggcauggaguccuacugcguccgcgccuucgccgacgccauggaggucauccccuccacccucgccgagaacgccggccucaaccccaucuccaccgucaccgagcuccgcaaccgccacgcccagggcgagaagaccgccggcaucaacguccgcaagggcggcaucuccaacauccucgaggagcucgucguccagccccuccucgucuccgucuccgcccucacccucgccaccgagaccguccgcuccauccucaagaucgacgacgucgucaacacccgcuga

SEQ ID NO: 40957 - RNA, 1626 nt, Artificial Sequence
  derived and/or modified sequence opt2 from CCT5__Homo_sapiens__NP_036205
auggccuccaugggcacccucgccuucgacgaguacggccgccccuuccucaucaucaaggaccaggaccgcaagucccgccucaugggccucgaggcccucaagucccacaucauggccgccaaggccgucgccaacaccaugcgcaccucccucggccccaacggccucgacaagaugauggucgacaaggacggcgacgucaccgucaccaacgacggcgccaccauccucuccaugauggacgucgaccaccagaucgccaagcucauggucgagcucuccaagucccaggacgacgagaucggcgacggcaccaccggcgucgucguccucgccggcgcccuccucgaggaggccgagcagcuccucgaccgcggcauccaccccauccgcaucgccgacggcuacgagcaggccgcccgcgucgccaucgagcaccucgacaagaucuccgacuccguccucgucgacaucaaggacaccgagccccucauccagaccgccaagaccacccucggcuccaaggucgucaacuccugccaccgccagauggccgagaucgccgucaacgccguccucaccgucgccgacauggagcgccgcgacgucgacuucgagcucaucaaggucgagggcaaggucggcggccgccucgaggacaccaagcucaucaagggcgucaucgucgacaaggacuucucccacccccagaugcccaagaaggucgaggacgccaagaucgccauccucaccugccccuucgagccccccaagcccaagaccaagcacaagcucgacgucaccuccgucgaggacuacaaggcccuccagaaguacgagaaggagaaguucgaggagaugauccagcagaucaaggagaccggcgccaaccucgccaucugccaguggggcuucgacgacgaggccaaccaccuccuccuccagaacaaccuccccgccguccgcugggucggcggccccgagaucgagcucaucgccaucgccaccggcggccgcaucgucccccgcuucuccgagcucaccgccgagaagcucggcuucgccggccucguccaggagaucuccuucggcaccaccaaggacaagaugcucgucaucgagcagugcaagaacucccgcgccgucaccaucuucauccgcggcggcaacaagaugaucaucgaggaggccaagcgcucccuccacgacgcccucugcgucauccgcaaccucauccgcgacaaccgcgucgucuacggcggcggcgccgccgagaucuccugcgcccucgccgucucccaggaggccgacaagugccccacccucgagcaguacgccaugcgcgccuucgccgacgcccucgaggucauccccauggcccucuccgagaacuccggcaugaaccccauccagaccaugaccgagguccgcgcccgccaggucaaggagaugaaccccgcccucggcaucgacugccuccacaagggcaccaacgacaugaagcagcagcacgucaucgagacccucaucggcaagaagcagcagaucucccucgccacccagaugguccgcaugauccucaagaucgacgacauccgcaagcccggcgaguccgaggaguga

SEQ ID NO: 40958 - RNA, 1461 nt, Artificial Sequence
  derived and/or modified sequence opt2 from CCT6A__Homo_sapiens__NP_001009186
auggccgccgucaagacccucaaccccaaggccgaggucgcccgcgcccaggccgcccucgccgucaacaucuccgccgcccgcggccuccaggacguccuccgcaccaaccucggccccaagggcaccaugaagaugcucgucuccggcgccggcgacaucaagcucaccaaggacggcaacguccuccuccacgagaugggccuccacccccgcaucaucaccgagggcuucgaggccgccaaggagaaggcccuccaguuccucgaggaggucaaggucucccgcgagauggaccgcgagacccucaucgacgucgcccgcaccucccuccgcaccaagguccacgccgagcucgccgacguccucaccgaggccgucgucgacuccauccucgccaucaagaagcaggacgagcccaucgaccucuucaugaucgagaucauggagaugaagcacaaguccgagaccgacaccucccucauccgcggccucguccucgaccacggcgcccgccaccccgacaugaagaagcgcgucgaggacgccuacauccucaccugcaacgucucccucgaguacgagaagaccgaggucaacuccggcuucuucuacaaguccgccgaggagcgcgagaagcucgucaaggccgagcgcaaguucaucgaggaccgcgucaagaagaucaucgagcucaagcgcaaggucugcggcgacuccgacaagggcuucgucgucaucaaccagaagggcaucgaccccuucucccucgacgcccucuccaaggagggcaucgucgcccuccgccgcgccaagcgccgcaacauggagcgccucacccucgccugcggcggcgucgcccucaacuccuucgacgaccucucccccgacugccucggccacgccggccucgucuacgaguacacccucggcgaggagaaguucaccuucaucgagaagugcaacaacccccgcuccgucacccuccucaucaagggccccaacaagcacacccucacccagaucaaggacgccguccgcgacggccuccgcgccgucaagaacgccaucgacgacggcugcgucguccccggcgccggcgccgucgaggucgccauggccgaggcccucaucaagcacaagcccuccgucaagggccgcgcccagcucggcguccaggccuucgccgacgcccuccucaucauccccaagguccucgcccagaacuccggcuucgaccuccaggagacccucgucaagauccaggccgagcacuccgaguccggccagcucgucggcgucgaccucaacaccggcgagcccauggucgccgccgaggucggcgucugggacaacuacugcgucaagaagcagcuccuccacuccugcaccgucaucgccaccaacauccuccucgucgacgagaucaugcgcgccggcauguccucccucaagggcuga

SEQ ID NO: 40959 - RNA, 1482 nt, Artificial Sequence
  derived and/or modified sequence opt2 from CCT6B__Homo_sapiens__NP_001180458
auggccgccaucaaggccgucaacuccaaggccgaggucgcccgcgcccgcgccgcccucgccgucaacaucugcgccgcccgcggccuccaggacguccuccgcaccaaccucggccccaagggcaccaugaagaugcucgucuccggcgccggcgacaucaagcucaccaaggacggcaacguccuccucgacgagaugcagauccagcaccccaccgccucccucaucgccaaggucgccaccgcccaggacgacgucaccggcgacggcaccaccuccaacguccucaucaucggcgagcuccucaagcaggccgaccucuacaucuccgagggccuccacccccgcaucaucgccgagggcuucgaggccgccaagaucaaggcccucgagguccucgaggaggucaaggucaccaaggagaugaagcgcaagauccuccucgacgucgcccgcaccucccuccagaccaagguccacgccgagcucgccgacguccucaccgaggucgucgucgacuccguccucgccguccgccgccccggcuaccccaucgaccucuucauggucgagaucauggagaugaagcacaagcucggcaccgacaccaaggaggucaacuccggcuucuucuacaagaccgccgaggagaaggagaagcucgucaaggccgagcgcaaguucaucgaggaccgcguccagaagaucaucgaccucaaggacaaggucugcgcccaguccaacaagggcuucgucgucaucaaccagaagggcaucgaccccuucucccucgacucccucgccaagcacggcaucgucgcccuccgccgcgccaagcgccgcaacauggagcgccucucccucgccugcggcggcauggccgucaacuccuucgaggaccucaccgucgacugccucggccacgccggccucgucuacgaguacacccucggcgaggagaaguucaccuucaucgaggagugcgucaaccccugcuccgucacccuccucgucaagggccccaacaagcacacccucacccaggucaaggacgccauccgcgacggccuccgcgccaucaagaacgccaucgaggacggcugcaugguccccggcgccggcgccaucgaggucgccauggccgaggcccucgucaccuacaagaacuccaucaagggccgcgcccgccucggcguccaggccuucgccgacgcccuccucaucauccccaagguccucgcccagaacgccggcuacgacccccaggagacccucgucaagguccaggccgagcacgucgaguccaagcagcucgucggcgucgaccucaacaccggcgagcccauggucgccgccgacgccggcgucugggacaacuacugcgucaagaagcagcuccuccacuccugcaccgucaucgccaccaacauccuccucgucgacgagaucaugcgcgccggcauguccucccucaaguga

SEQ ID NO: 40960 - RNA, 1020 nt, Artificial Sequence
  derived and/or modified sequence opt2 from CCT7__Homo_sapiens__NP_001009570
augauggacucccagcucgucgccggcgucgccuucaagaagaccuucuccuacgccggcuucgagaugcagcccaagaaguaccacaaccccaagaucgcccuccucaacgucgagcucgagcucaaggccgagaaggacaacgccgagauccgcguccacaccgucgaggacuaccaggccaucgucgacgccgaguggaacauccucuacgacaagcucgagaagauccaccacuccggcgccaaggucguccucuccaagcuccccaucggcgacgucgccacccaguacuucgccgaccgcgacauguucugcgccggccgcguccccgaggaggaccucaagcgcaccaugauggccugcggcggcuccauccagaccuccgucaacgcccucuccgccgacguccucggccgcugccaggucuucgaggagacccagaucggcggcgagcgcuacaacuucuucaccggcugccccaaggccaagaccugcaccuucauccuccgcggcggcgccgagcaguucauggaggagaccgagcgcucccuccacgacgccaucaugaucguccgccgcgccaucaagaacgacuccgucgucgccggcggcggcgccaucgagauggagcucuccaaguaccuccgcgacuacucccgcaccauccccggcaagcagcagcuccucaucggcgccuacgccaaggcccucgagaucaucccccgccagcucugcgacaacgccggcuucgacgccaccaacauccucaacaagcuccgcgcccgccacgcccagggcggcaccugguacggcgucgacaucaacaacgaggacaucgccgacaacuucgaggccuucgucugggagcccgccaugguccgcaucaacgcccucaccgccgccuccgaggccgccugccucaucgucuccgucgacgagaccaucaagaacccccgcuccaccgucgacgcccccaccgccgccggccgcggccgcggccgcggccgcccccacuga

SEQ ID NO: 40961 - RNA, 4287 nt, Artificial Sequence
  derived and/or modified sequence opt2 from CD109__Homo_sapiens__NP_001153059
augcagggccccccccuccucaccgccgcccaccuccucugcgucugcaccgccgcccucgccgucgcccccggcccccgcuuccucgucaccgcccccggcaucauccgccccggcggcaacgucaccaucggcgucgagcuccucgagcacugccccucccaggucaccgucaaggccgagcuccucaagaccgccuccaaccucaccgucuccguccucgaggccgagggcgucuucgagaagggcuccuucaagacccucacccuccccucccucccccucaacuccgccgacgagaucuacgagcuccgcgucaccggccgcacccaggacgagauccucuucuccaacuccacccgccucuccuucgagaccaagcgcaucuccgucuucauccagaccgacaaggcccucuacaagcccaagcaggaggucaaguuccgcaucgucacccucuucuccgacuucaagcccuacaagaccucccucaacauccucaucaaggaccccaaguccaaccucauccagcaguggcucucccagcaguccgaccucggcgucaucuccaagaccuuccagcucuccucccaccccauccucggcgacugguccauccagguccaggucaacgaccagaccuacuaccaguccuuccaggucuccgaguacguccuccccaaguucgaggucacccuccagaccccccucuacugcuccaugaacuccaagcaccucaacggcaccaucaccgccaaguacaccuacggcaagcccgucaagggcgacgucacccucaccuuccucccccucuccuucuggggcaagaagaagaacaucaccaagaccuucaagaucaacggcuccgccaacuucuccuucaacgacgaggagaugaagaacgucauggacuccuccaacggccucuccgaguaccucgaccucuccucccccggccccgucgagauccucaccaccgucaccgaguccgucaccggcaucucccgcaacgucuccaccaacgucuucuucaagcagcacgacuacaucaucgaguucuucgacuacaccaccguccucaagcccucccucaacuucaccgccaccgucaaggucacccgcgccgacggcaaccagcucacccucgaggagcgccgcaacaacgucgucaucaccgucacccagcgcaacuacaccgaguacugguccggcuccaacuccggcaaccagaagauggaggccguccagaagaucaacuacaccgucccccaguccggcaccuucaagaucgaguuccccauccucgaggacuccuccgagcuccagcucaaggccuacuuccucggcuccaaguccuccauggccguccacucccucuucaagucccccuccaagaccuacauccagcucaagacccgcgacgagaacaucaaggucggcucccccuucgagcucgucgucuccggcaacaagcgccucaaggagcucuccuacauggucgucucccgcggccagcucgucgccgucggcaagcagaacuccaccauguucucccucacccccgagaacuccuggacccccaaggccugcgucaucgucuacuacaucgaggacgacggcgagaucaucuccgacguccucaagauccccguccagcucgucuucaagaacaagaucaagcucuacugguccaaggucaaggccgagcccuccgagaaggucucccuccgcaucuccgucacccagcccgacuccaucgucggcaucgucgccgucgacaaguccgucaaccucaugaacgccuccaacgacaucaccauggagaacgucguccacgagcucgagcucuacaacaccggcuacuaccucggcauguucaugaacuccuucgccgucuuccaggagugcggccucuggguccucaccgacgccaaccucaccaaggacuacaucgacggcgucuacgacaacgccgaguacgccgagcgcuucauggaggagaacgagggccacaucgucgacauccacgacuucucccucggcuccuccccccacguccgcaagcacuuccccgagaccuggaucuggcucgacaccaacaugggcuaccgcaucuaccaggaguucgaggucaccguccccgacuccaucaccuccugggucgccaccggcuucgucaucuccgaggaccucggccucggccucaccaccacccccgucgagcuccaggccuuccagcccuucuucaucuuccucaaccuccccuacuccgucauccgcggcgaggaguucgcccucgagaucaccaucuucaacuaccucaaggacgccaccgaggucaaggucaucaucgagaaguccgacaaguucgacauccucaugaccuccaacgagaucaacgccaccggccaccagcagacccuccucguccccuccgaggacggcgccaccguccucuuccccauccgccccacccaccucggcgagauccccaucaccgucaccgcccucucccccaccgccuccgacgccgucacccagaugauccucgucaaggccgagggcaucgagaaguccuacucccaguccauccuccucgaccucaccgacaaccgccuccaguccacccucaagacccucuccuucuccuucccccccaacaccgucaccggcuccgagcgcguccagaucaccgccaucggcgacguccucggccccuccaucaacggccucgccucccucauccgcaugcccuacggcugcggcgagcagaacaugaucaacuucgcccccaacaucuacauccucgacuaccucaccaagaagaagcagcucaccgacaaccucaaggagaaggcccucuccuucaugcgccagggcuaccagcgcgagcuccucuaccagcgcgaggacggcuccuucuccgccuucggcaacuacgaccccuccggcuccaccuggcucuccgccuucguccuccgcugcuuccucgaggccgaccccuacaucgacaucgaccagaacguccuccaccgcaccuacaccuggcucaagggccaccagaaguccaacggcgaguucugggaccccggccgcgucauccacuccgagcuccagggcggcaacaagucccccgucacccucaccgccuacaucgucaccucccuccucggcuaccgcaaguaccagcccaacaucgacguccaggaguccauccacuuccucgaguccgaguucucccgcggcaucuccgacaacuacacccucgcccucaucaccuacgcccucuccuccgucggcucccccaaggccaaggaggcccucaacaugcucaccuggcgcgccgagcaggagggcggcaugcaguucugggucuccuccgaguccaagcucuccgacuccuggcagccccgcucccucgacaucgaggucgccgccuacgcccuccucucccacuuccuccaguuccagaccuccgagggcauccccaucaugcgcuggcucucccgccagcgcaacucccucggcggcuucgccuccacccaggacaccaccgucgcccucaaggcccucuccgaguucgccgcccucaugaacaccgagcgcaccaacauccaggucaccgucaccggccccuccucccccuccccccucgccgucguccagcccaccgccgucaacaucuccgccaacggcuucggcuucgccaucugccagcucaacgucgucuacaacgucaaggccuccggcuccucccgccgccgccgcuccauccagaaccaggaggccuucgaccucgacgucgccgucaaggagaacaaggacgaccucaaccacgucgaccucaacgucugcaccuccuucuccggccccggccgcuccggcauggcccucauggaggucaaccuccucuccggcuucaugguccccuccgaggccaucucccucuccgagaccgucaagaaggucgaguacgaccacggcaagcucaaccucuaccucgacuccgucaacgagacccaguucugcgucaacauccccgccguccgcaacuucaaggucuccaacacccaggacgccuccgucuccaucgucgacuacuacgagccccgccgccaggccguccgcuccuacaacuccgaggucaagcucuccuccugcgaccucugcuccgacguccagggcugccgccccugcgaggacggcgccuccggcucccaccaccacuccuccgucaucuucaucuucugcuucaagcuccucuacuucauggagcucuggcucuga

SEQ ID NO: 40962 - RNA, 1128 nt, Artificial Sequence
  derived and/or modified sequence opt2 from CD14__Homo_sapiens__NP_001167576
auggagcgcgccuccugccuccuccuccuccuccucccccucguccacgucuccgccaccacccccgagcccugcgagcucgacgacgaggacuuccgcugcgucugcaacuucuccgagccccagcccgacugguccgaggccuuccagugcgucuccgccgucgaggucgagauccacgccggcggccucaaccucgagcccuuccucaagcgcgucgacgccgacgccgacccccgccaguacgccgacaccgucaaggcccuccgcguccgccgccucaccgucggcgccgcccagguccccgcccagcuccucgucggcgcccuccgcguccucgccuacucccgccucaaggagcucacccucgaggaccucaagaucaccggcaccaugcccccccucccccucgaggccaccggccucgcccucuccucccuccgccuccgcaacgucuccugggccaccggccgcuccuggcucgccgagcuccagcaguggcucaagcccggccucaagguccucuccaucgcccaggcccacucccccgccuucuccugcgagcagguccgcgccuuccccgcccucaccucccucgaccucuccgacaaccccggccucggcgagcgcggccucauggccgcccucugcccccacaaguuccccgccauccagaaccucgcccuccgcaacaccggcauggagacccccaccggcgucugcgccgcccucgccgccgccggcguccagccccacucccucgaccucucccacaacucccuccgcgccaccgucaaccccuccgccccccgcugcaugugguccuccgcccucaacucccucaaccucuccuucgccggccucgagcagguccccaagggccuccccgccaagcuccgcguccucgaccucuccugcaaccgccucaaccgcgccccccagcccgacgagcuccccgaggucgacaaccucacccucgacggcaaccccuuccucguccccggcaccgcccucccccacgagggcuccaugaacuccggcgucguccccgccugcgcccgcuccacccucuccgucggcgucuccggcacccucguccuccuccagggcgcccgcggcuucgccuga

SEQ ID NO: 40963 - RNA, 762 nt, Artificial Sequence
  derived and/or modified sequence opt2 from CD151__Homo_sapiens__NP_001034579
augggcgaguucaacgagaagaagaccaccugcggcaccgucugccucaaguaccuccucuucaccuacaacugcugcuucuggcucgccggccucgccgucauggccgucggcaucuggacccucgcccucaaguccgacuacaucucccuccucgccuccggcaccuaccucgccaccgccuacauccucgucgucgccggcaccgucgucauggucaccggcguccucggcugcugcgccaccuucaaggagcgccgcaaccuccuccgccucuacuucauccuccuccucaucaucuuccuccucgagaucaucgccggcauccucgccuacgccuacuaccagcagcucaacaccgagcucaaggagaaccucaaggacaccaugaccaagcgcuaccaccagcccggccacgaggccgucaccuccgccgucgaccagcuccagcaggaguuccacugcugcggcuccaacaacucccaggacuggcgcgacuccgaguggauccgcucccaggaggccggcggccgcgucguccccgacuccugcugcaagaccgucgucgcccucugcggccagcgcgaccacgccuccaacaucuacaaggucgagggcggcugcaucaccaagcucgagaccuucauccaggagcaccuccgcgucaucggcgccgucggcaucggcaucgccugcguccaggucuucggcaugaucuucaccugcugccucuaccgcucccucaagcucgagcacuacuga

SEQ ID NO: 40964 - RNA, 3471 nt, Artificial Sequence
  derived and/or modified sequence opt2 from CD163__Homo_sapiens__NP_004235
auguccaagcuccgcaugguccuccucgaggacuccggcuccgccgacuuccgccgccacuucgucaaccucucccccuucaccaucaccgucguccuccuccucuccgccugcuucgucaccuccucccucggcggcaccgacaaggagcuccgccucgucgacggcgagaacaagugcuccggccgcgucgaggucaagguccaggaggaguggggcaccgucugcaacaacggcugguccauggaggccgucuccgucaucugcaaccagcucggcugccccaccgccaucaaggcccccggcugggccaacuccuccgccggcuccggccgcaucuggauggaccacgucuccugccgcggcaacgaguccgcccucugggacugcaagcacgacggcuggggcaagcacuccaacugcacccaccagcaggacgccggcgucaccugcuccgacggcuccaaccucgagaugcgccucacccgcggcggcaacaugugcuccggccgcaucgagaucaaguuccagggccgcuggggcaccgucugcgacgacaacuucaacaucgaccacgccuccgucaucugccgccagcucgagugcggcuccgccgucuccuucuccggcuccuccaacuucggcgagggcuccggccccaucugguucgacgaccucaucugcaacggcaacgaguccgcccucuggaacugcaagcaccagggcuggggcaagcacaacugcgaccacgccgaggacgccggcgucaucugcuccaagggcgccgaccucucccuccgccucgucgacggcgucaccgagugcuccggccgccucgagguccgcuuccagggcgaguggggcaccaucugcgacgacggcugggacuccuacgacgccgccgucgccugcaagcagcucggcugccccaccgccgucaccgccaucggccgcgucaacgccuccaagggcuucggccacaucuggcucgacuccgucuccugccagggccacgagcccgccaucuggcagugcaagcaccacgaguggggcaagcacuacugcaaccacaacgaggacgccggcgucaccugcuccgacggcuccgaccucgagcuccgccuccgcggcggcggcucccgcugcgccggcaccgucgaggucgagauccagcgccuccucggcaaggucugcgaccgcggcuggggccucaaggaggccgacgucgucugccgccagcucggcugcggcuccgcccucaagaccuccuaccaggucuacuccaagauccaggccaccaacaccuggcucuuccucuccuccugcaacggcaacgagaccucccucugggacugcaagaacuggcaguggggcggccucaccugcgaccacuacgaggaggccaagaucaccugcuccgcccaccgcgagccccgccucgucggcggcgacauccccugcuccggccgcgucgaggucaagcacggcgacaccuggggcuccaucugcgacuccgacuucucccucgaggccgccuccguccucugccgcgagcuccagugcggcaccgucgucuccauccucggcggcgcccacuucggcgagggcaacggccagaucugggccgaggaguuccagugcgagggccacgagucccaccucucccucugccccgucgccccccgccccgagggcaccugcucccacucccgcgacgucggcgucgucugcucccgcuacaccgagauccgccucgucaacggcaagacccccugcgagggccgcgucgagcucaagacccucggcgccuggggcucccucugcaacucccacugggacaucgaggacgcccacguccucugccagcagcucaagugcggcgucgcccucuccacccccggcggcgcccgcuucggcaagggcaacggccagaucuggcgccacauguuccacugcaccggcaccgagcagcacaugggcgacugccccgucaccgcccucggcgccucccucugccccuccgagcaggucgccuccgucaucugcuccggcaaccagucccagacccucuccuccugcaacuccuccucccucggccccacccgccccaccauccccgaggaguccgccgucgccugcaucgaguccggccagcuccgccucgucaacggcggcggccgcugcgccggccgcgucgagaucuaccacgagggcuccuggggcaccaucugcgacgacuccugggaccucuccgacgcccacgucgucugccgccagcucggcugcggcgaggccaucaacgccaccggcuccgcccacuucggcgagggcaccggccccaucuggcucgacgagaugaagugcaacggcaaggagucccgcaucuggcagugccacucccacggcuggggccagcagaacugccgccacaaggaggacgccggcgucaucugcuccgaguucaugucccuccgccucaccuccgaggccucccgcgaggccugcgccggccgccucgaggucuucuacaacggcgccuggggcaccgucggcaaguccuccauguccgagaccaccgucggcgucgucugccgccagcucggcugcgccgacaagggcaagaucaaccccgccucccucgacaaggccauguccauccccaugugggucgacaacguccagugccccaagggccccgacacccucuggcagugccccuccucccccugggagaagcgccucgccucccccuccgaggagaccuggaucaccugcgacaacaagauccgccuccaggagggccccaccuccugcuccggccgcgucgagaucuggcacggcggcuccuggggcaccgucugcgacgacuccugggaccucgacgacgcccaggucgucugccagcagcucggcugcggccccgcccucaaggccuucaaggaggccgaguucggccagggcaccggccccaucuggcucaacgaggucaagugcaagggcaacgaguccucccucugggacugccccgcccgccgcuggggccacuccgagugcggccacaaggaggacgccgccgucaacugcaccgacaucuccguccagaagaccccccagaaggccaccaccggccgcuccucccgccaguccuccuucaucgccgucggcauccucggcgucguccuccucgccaucuucgucgcccucuucuuccucaccaagaagcgccgccagcgccagcgccucgccgucuccucccgcggcgagaaccucguccaccagauccaguaccgcgagaugaacuccugccucaacgccgacgaccucgaccucaugaacuccuccgagaacucccacgaguccgccgacuucuccgccgccgagcucaucuccgucuccaaguuccuccccaucuccggcauggagaaggaggccauccucucccacaccgagaaggagaacggcaaccucuga

SEQ ID NO: 40965 - RNA, 4362 nt, Artificial Sequence
  derived and/or modified sequence opt2 from CD163L1__Homo_sapiens__NP_777601
augaugcucccccagaacuccuggcacaucgacuucggccgcugcugcugccaccagaaccucuucuccgccgucgucaccugcauccuccuccucaacuccugcuuccucaucuccuccuucaacggcaccgaccucgagcuccgccucgucaacggcgacggccccugcuccggcaccgucgaggucaaguuccagggccaguggggcaccgucugcgacgacggcuggaacaccaccgccuccaccgucgucugcaagcagcucggcugccccuucuccuucgccauguuccgcuucggccaggccgucacccgccacggcaagaucuggcucgacgacgucuccugcuacggcaacgaguccgcccucugggagugccagcaccgcgaguggggcucccacaacugcuaccacggcgaggacgucggcgucaacugcuacggcgaggccaaccucggccuccgccucgucgacggcaacaacuccugcuccggccgcgucgaggucaaguuccaggagcgcuggggcaccaucugcgacgacggcuggaaccucaacaccgccgccgucgucugccgccagcucggcugccccuccuccuucaucuccuccggcgucgucaacucccccgccguccuccgccccaucuggcucgacgacauccucugccagggcaacgagcucgcccucuggaacugccgccaccgcggcuggggcaaccacgacugcucccacaacgaggacgucacccucaccugcuacgacuccuccgaccucgagcuccgccucgucggcggcaccaaccgcugcaugggccgcgucgagcucaagauccagggccgcuggggcaccgucugccaccacaaguggaacaacgccgccgccgacgucgucugcaagcagcucggcugcggcaccgcccuccacuucgccggccucccccaccuccaguccggcuccgacgucgucuggcucgacggcgucuccugcuccggcaacgaguccuuccucugggacugccgccacuccggcaccgucaacuucgacugccuccaccagaacgacgucuccgucaucugcuccgacggcgccgaccucgagcuccgccucgccgacggcuccaacaacugcuccggccgcgucgagguccgcauccacgagcagugguggaccaucugcgaccagaacuggaagaacgagcaggcccucgucgucugcaagcagcucggcugccccuucuccgucuucggcucccgccgcgccaagcccuccaacgaggcccgcgacaucuggaucaacuccaucuccugcaccggcaacgaguccgcccucugggacugcaccuacgacggcaaggccaagcgcaccugcuuccgccgcuccgacgccggcgucaucugcuccgacaaggccgaccucgaccuccgccucgucggcgcccacucccccugcuacggccgccucgaggucaaguaccagggcgaguggggcaccgucugccacgaccgcugguccacccgcaacgccgccgucgucugcaagcagcucggcugcggcaagcccaugcacgucuucggcaugaccuacuucaaggaggccuccggccccaucuggcucgacgacgucuccugcaucggcaacgaguccaacaucugggacugcgagcacuccggcuggggcaagcacaacugcguccaccgcgaggacgucaucgucaccugcuccggcgacgccaccuggggccuccgccucgucggcggcuccaaccgcugcuccggccgccucgaggucuacuuccagggccgcuggggcaccgucugcgacgacggcuggaacuccaaggccgccgccgucgucugcucccagcucgacugccccuccuccaucaucggcaugggccucggcaacgccuccaccggcuacggcaagaucuggcucgacgacgucuccugcgacggcgacgaguccgaccucugguccugccgcaacuccggcuggggcaacaacgacugcucccacuccgaggacgucggcgucaucugcuccgacgccuccgacauggagcuccgccucgucggcggcuccucccgcugcgccggcaaggucgaggucaacguccagggcgccgucggcauccucugcgccaacggcuggggcaugaacaucgccgaggucgucugccgccagcucgagugcggcuccgccauccgcgucucccgcgagccccacuucaccgagcgcacccuccacauccucauguccaacuccggcugcaccggcggcgaggccucccucugggacugcauccgcugggaguggaagcagaccgccugccaccucaacauggaggccucccucaucugcuccgcccaccgccagccccgccucgucggcgccgacaugcccugcuccggccgcgucgaggucaagcacgccgacaccuggcgcuccgucugcgacuccgacuucucccuccacgccgccaacguccucugccgcgagcucaacugcggcgacgccaucucccucuccgucggcgaccacuucggcaagggcaacggccucaccugggccgagaaguuccagugcgagggcuccgagacccaccucgcccucugccccaucguccagcaccccgaggacaccugcauccacucccgcgaggucggcgucgucugcucccgcuacaccgacguccgccucgucaacggcaagucccagugcgacggccaggucgagaucaacguccucggccacuggggcucccucugcgacacccacugggaccccgaggacgcccgcguccucugccgccagcucuccugcggcaccgcccucuccaccaccggcggcaaguacaucggcgagcgcuccguccgcgucuggggccaccgcuuccacugccucggcaacgagucccuccucgacaacugccagaugaccguccucggcgccccccccugcauccacggcaacaccgucuccgucaucugcaccggcucccucacccagccccucuuccccugccucgccaacgucuccgaccccuaccucuccgccguccccgagggcuccgcccucaucugccucgaggacaagcgccuccgccucgucgacggcgacucccgcugcgccggccgcgucgagaucuaccacgacggcuucuggggcaccaucugcgacgacggcugggaccucuccgacgcccacgucgucugccagaagcucggcugcggcgucgccuucaacgccaccgucuccgcccacuucggcgagggcuccggccccaucuggcucgacgaccucaacugcaccggcauggagucccaccucuggcagugccccucccgcggcuggggccagcacgacugccgccacaaggaggacgccggcgucaucugcuccgaguucaccgcccuccgccucuacuccgagaccgagaccgaguccugcgccggccgccucgaggucuucuacaacggcaccuggggcuccgucggccgccgcaacaucaccaccgccaucgccggcaucgucugccgccagcucggcugcggcgagaacggcgucgucucccucgccccccucuccaagaccggcuccggcuucaugugggucgacgacauccagugccccaagacccacaucuccaucuggcagugccucuccgcccccugggagcgccgcaucuccucccccgccgaggagaccuggaucaccugcgaggaccgcauccgcguccgcggcggcgacaccgagugcuccggccgcgucgagaucuggcacgccggcuccuggggcaccgucugcgacgacuccugggaccucgccgaggccgaggucgucugccagcagcucggcugcggcuccgcccucgccgcccuccgcgacgccuccuucggccagggcaccggcaccaucuggcucgacgacaugcgcugcaagggcaacgaguccuuccucugggacugccacgccaagcccuggggccaguccgacugcggccacaaggaggacgccggcguccgcugcuccggccagucccucaagucccucaacgccuccuccggccaccucgcccucauccucuccuccaucuucggccuccuccuccucguccucuucauccucuuccucaccuggugccgcguccagaagcagaagcaccucccccuccgcgucuccacccgccgccgcggcucccucgaggagaaccucuuccacgagauggagaccugccucaagcgcgaggacccccacggcacccgcaccuccgacgacacccccaaccacggcugcgaggacgccuccgacaccucccuccucggcguccuccccgccuccgaggccaccaaguga

SEQ ID NO: 40966 - RNA, 555 nt, Artificial Sequence
  derived and/or modified sequence opt2 from CD164__Homo_sapiens__NP_001135873
augucccgccucucccgcucccuccucugggccgccaccugccucggcguccucugcguccucuccgccgacaagaacaccacccagcaccccaacgucaccacccucgcccccaucuccaacgucaccuccgcccccgucaccucccucccccucgucaccacccccgcccccgagaccugcgagggccgcaacuccugcgucuccugcuucaacgucuccgucgucaacaccaccugcuucuggaucgagugcaaggacgaguccuacugcucccacaacuccaccgucuccgacugccaggucggcaacaccaccgacuucugcuccgccaagcccaccguccagcccucccccuccaccaccuccaagaccgucaccaccuccggcaccaccaacaacaccgucacccccaccucccagcccguccgcaaguccaccuucgacgccgccuccuucaucggcggcaucguccucguccucggcguccaggccgucaucuucuuccucuacaaguucugcaaguccaaggagcgcaacuaccacacccucuga

SEQ ID NO: 40967 - RNA, 1314 nt, Artificial Sequence
  derived and/or modified sequence opt2 from CD177__Homo_sapiens__NP_065139
auguccgccguccuccuccucgcccuccucggcuucauccucccccuccccggcguccaggcccuccucugccaguucggcaccguccagcacgucuggaaggucuccgaccucccccgccaguggacccccaagaacaccuccugcgacuccggccucggcugccaggacacccucaugcucaucgaguccggcccccaggucucccucguccucuccaagggcugcaccgaggccaaggaccaggagccccgcgucaccgagcaccgcaugggccccggccucucccucaucuccuacaccuucgucugccgccaggaggacuucugcaacaaccucgucaacucccucccccucugggccccccagccccccgccgaccccggcucccuccgcugccccgucugccucuccauggagggcugccucgagggcaccaccgaggagaucugccccaagggcaccacccacugcuacgacggccuccuccgccuccgcggcggcggcaucuucuccaaccuccgcguccagggcugcaugccccagcccgucugcaaccuccucaacggcacccaggagaucggccccgucggcaugaccgagaacugcgacaugaaggacuuccucaccugccaccgcggcaccaccaucaugacccacggcaaccucgcccaggagcccaccgacuggaccaccuccaacaccgagaugugcgaggucggccaggucugccaggagacccuccuccuccucgacgucggccucaccuccacccucgucggcaccaagggcugcuccaccgucggcgcccagaacucccagaagaccaccauccacuccgccccccccggcguccucgucgccuccuacacccacuucugcuccuccgaccucugcaacuccgccuccuccuccuccguccuccucaacucccuccccccccaggccgcccccguccccggcgaccgccagugccccaccugcguccagccccucggcaccugcuccuccggcuccccccgcaugaccugcccccgcggcgccacccacugcuacgacggcuacauccaccucuccggcggcggccucuccaccaagauguccauccagggcugcgucgcccagcccuccuccuuccuccucaaccacacccgccagaucggcaucuucuccgcccgcgagaagcgcgacguccagccccccgccucccagcacgagggcggcggcgccgagggccucgagucccucaccuggggcgucggccucgcccucgcccccgcccucugguggggcgucgucugccccuccugcuga

SEQ ID NO: 40968 - RNA, 1986 nt, Artificial Sequence
  derived and/or modified sequence opt2 from CD180__Homo_sapiens__NP_005573
auggccuucgacgucuccugcuucuucugggucguccucuucuccgccggcugcaaggucaucaccuccugggaccagaugugcaucgagaaggaggccaacaagaccuacaacugcgagaaccucggccucuccgagauccccgacacccuccccaacaccaccgaguuccucgaguucuccuucaacuuccuccccaccauccacaaccgcaccuucucccgccucaugaaccucaccuuccucgaccucacccgcugccagaucaacuggauccacgaggacaccuuccagucccaccaccagcucuccacccucguccucaccggcaacccccucaucuucauggccgagaccucccucaacggccccaagucccucaagcaccucuuccucauccagaccggcaucuccaaccucgaguucauccccguccacaaccucgagaaccucgagucccucuaccucggcuccaaccacaucuccuccaucaaguuccccaaggacuuccccgcccgcaaccucaagguccucgacuuccagaacaacgccauccacuacaucucccgcgaggacaugcgcucccucgagcaggccaucaaccucucccucaacuucaacggcaacaacgucaagggcaucgagcucggcgccuucgacuccaccaucuuccagucccucaacuucggcggcacccccaaccucuccgucaucuucaacggccuccagaacuccaccacccagucccucuggcucggcaccuucgaggacaucgacgacgaggacaucuccuccgccaugcucaagggccucugcgagauguccgucgagucccucaaccuccaggagcaccgcuucuccgacaucuccuccaccaccuuccagugcuucacccagcuccaggagcucgaccucaccgccacccaccucaagggccuccccuccggcaugaagggccucaaccuccucaagaagcucguccucuccgucaaccacuucgaccagcucugccagaucuccgccgccaacuuccccucccucacccaccucuacauccgcggcaacgucaagaagcuccaccucggcgucggcugccucgagaagcucggcaaccuccagacccucgaccucucccacaacgacaucgaggccuccgacugcugcucccuccagcucaagaaccucucccaccuccagacccucaaccucucccacaacgagccccucggccuccagucccaggccuucaaggagugcccccagcucgagcuccucgaccucgccuucacccgccuccacaucaacgccccccagucccccuuccagaaccuccacuuccuccagguccucaaccucaccuacugcuuccucgacaccuccaaccagcaccuccucgccggccuccccguccuccgccaccucaaccucaagggcaaccacuuccaggacggcaccaucaccaagaccaaccuccuccagaccgucggcucccucgagguccucauccucuccuccugcggccuccucuccaucgaccagcaggccuuccacucccucggcaagaugucccacgucgaccucucccacaacucccucaccugcgacuccaucgacucccucucccaccucaagggcaucuaccucaaccucgccgccaacuccaucaacaucaucuccccccgccuccuccccauccucucccagcaguccaccaucaaccucucccacaacccccucgacugcaccugcuccaacauccacuuccucaccugguacaaggagaaccuccacaagcucgagggcuccgaggagaccaccugcgccaacccccccucccuccgcggcgucaagcucuccgacgucaagcucuccugcggcaucaccgccaucggcaucuucuuccucaucgucuuccuccuccuccucgccauccuccucuucuucgccgucaaguaccuccuccgcuggaaguaccagcacaucuga

SEQ ID NO: 40969 - RNA, 1674 nt, Artificial Sequence
  derived and/or modified sequence opt2 from CD19__Homo_sapiens__NP_001171569
augccccccccccgccuccucuucuuccuccucuuccucacccccauggagguccgccccgaggagccccucgucgucaaggucgaggagggcgacaacgccguccuccagugccucaagggcaccuccgacggccccacccagcagcucaccuggucccgcgaguccccccucaagcccuuccucaagcucucccucggccuccccggccucggcauccacaugcgcccccucgccaucuggcucuucaucuucaacgucucccagcagaugggcggcuucuaccucugccagcccggcccccccuccgagaaggccuggcagcccggcuggaccgucaacgucgagggcuccggcgagcucuuccgcuggaacgucuccgaccucggcggccucggcugcggccucaagaaccgcuccuccgagggccccuccucccccuccggcaagcucaugucccccaagcucuacgucugggccaaggaccgccccgagaucugggagggcgagccccccugccuccccccccgcgacucccucaaccagucccucucccaggaccucaccauggcccccggcuccacccucuggcucuccugcggcgucccccccgacuccgucucccgcggcccccucuccuggacccacguccaccccaagggccccaagucccuccucucccucgagcucaaggacgaccgccccgcccgcgacaugugggucauggagaccggccuccuccucccccgcgccaccgcccaggacgccggcaaguacuacugccaccgcggcaaccucaccauguccuuccaccucgagaucaccgcccgccccguccucuggcacuggcuccuccgcaccggcggcuggaaggucuccgccgucacccucgccuaccucaucuucugccucugcucccucgucggcauccuccaccuccagcgcgcccucguccuccgccgcaagcgcaagcgcaugaccgaccccacccgccgcuucuucaaggucacccccccccccggcuccggcccccagaaccaguacggcaacguccucucccuccccacccccaccuccggccucggccgcgcccagcgcugggccgccggccucggcggcaccgcccccuccuacggcaaccccuccuccgacguccaggccgacggcgcccucggcucccgcuccccccccggcgucggccccgaggaggaggagggcgagggcuacgaggagcccgacuccgaggaggacuccgaguucuacgagaacgacuccaaccucggccaggaccagcucucccaggacggcuccggcuacgagaaccccgaggacgagccccucggccccgaggacgaggacuccuucuccaacgccgaguccuacgagaacgaggacgaggagcucacccagcccgucgcccgcaccauggacuuccucuccccccacggcuccgccugggaccccucccgcgaggccaccucccucgccggcucccaguccuacgaggacaugcgcggcauccucuacgccgccccccagcuccgcuccauccgcggccagcccggccccaaccacgaggaggacgccgacuccuacgagaacauggacaaccccgacggccccgaccccgccuggggcggcggcggccgcaugggcaccugguccacccgcuga

SEQ ID NO: 40970 - RNA, 984 nt, Artificial Sequence
  derived and/or modified sequence opt2 from CD1A__Homo_sapiens__NP_001754
augcucuuccuccuccucccccuccucgccguccuccccggcgacggcaacgccgacggccucaaggagccccucuccuuccacgucaccuggaucgccuccuucuacaaccacuccuggaagcagaaccucgucuccggcuggcucuccgaccuccagacccacaccugggacuccaacuccuccaccaucgucuuccucugccccuggucccgcggcaacuucuccaacgaggaguggaaggagcucgagacccucuuccgcauccgcaccauccgcuccuucgagggcauccgccgcuacgcccacgagcuccaguucgaguaccccuucgagauccaggucaccggcggcugcgagcuccacuccggcaaggucuccggcuccuuccuccagcucgccuaccagggcuccgacuucgucuccuuccagaacaacuccuggcuccccuaccccgucgccggcaacauggccaagcacuucugcaagguccucaaccagaaccagcacgagaacgacaucacccacaaccuccucuccgacaccugcccccgcuucauccucggccuccucgacgccggcaaggcccaccuccagcgccaggucaagcccgaggccuggcucucccacggccccucccccggccccggccaccuccagcucgucugccacgucuccggcuucuaccccaagcccgucugggucauguggaugcgcggcgagcaggagcagcagggcacccagcgcggcgacauccuccccuccgccgacggcaccugguaccuccgcgccacccucgaggucgccgccggcgaggccgccgaccucuccugccgcgucaagcacuccucccucgagggccaggacaucguccucuacugggagcaccacuccuccgucggcuucaucauccucgccgucaucgucccccuccuccuccucaucggccucgcccucugguuccgcaagcgcugcuucugcuga

SEQ ID NO: 40971 - RNA, 1002 nt, Artificial Sequence
  derived and/or modified sequence opt2 from CD1B__Homo_sapiens__NP_001755
augcuccuccuccccuuccagcuccucgccguccucuuccccggcggcaacuccgagcacgccuuccagggccccaccuccuuccacgucauccagaccuccuccuucaccaacuccaccugggcccagacccagggcuccggcuggcucgacgaccuccagauccacggcugggacuccgacuccggcaccgccaucuuccucaagcccugguccaagggcaacuucuccgacaaggaggucgccgagcucgaggagaucuuccgcgucuacaucuucggcuucgcccgcgagguccaggacuucgccggcgacuuccagaugaaguaccccuucgagauccagggcaucgccggcugcgagcuccacuccggcggcgccaucgucuccuuccuccgcggcgcccucggcggccucgacuuccucuccgucaagaacgccuccugcguccccucccccgagggcggcucccgcgcccagaaguucugcgcccucaucauccaguaccagggcaucauggagaccguccgcauccuccucuacgagaccugcccccgcuaccuccucggcguccucaacgccggcaaggccgaccuccagcgccaggucaagcccgaggccuggcucuccuccggccccucccccggccccggccgccuccagcucgucugccacgucuccggcuucuaccccaagcccgucugggucauguggaugcgcggcgagcaggagcagcagggcacccagcucggcgacauccuccccaacgccaacuggaccugguaccuccgcgccacccucgacgucgccgacggcgaggccgccggccucuccugccgcgucaagcacuccucccucgagggccaggacaucauccucuacuggcgcaaccccaccuccaucggcuccaucguccucgccaucaucguccccucccuccuccuccuccucugccucgcccucugguacaugcgccgccgcuccuaccagaacauccccuga

SEQ ID NO: 40972 - RNA, 1002 nt, Artificial Sequence
  derived and/or modified sequence opt2 from CD1C__Homo_sapiens__NP_001756
augcucuuccuccaguuccuccuccucgcccuccuccuccccggcggcgacaacgccgacgccucccaggagcacgucuccuuccacgucauccagaucuucuccuucgucaaccaguccugggcccgcggccagggcuccggcuggcucgacgagcuccagacccacggcugggacuccgaguccggcaccaucaucuuccuccacaacugguccaagggcaacuucuccaacgaggagcucuccgaccucgagcuccucuuccgcuucuaccucuucggccucacccgcgagauccaggaccacgccucccaggacuacuccaaguaccccuucgagguccaggucaaggccggcugcgagcuccacuccggcaagucccccgagggcuucuuccaggucgccuucaacggccucgaccuccucuccuuccagaacaccaccuggguccccucccccggcugcggcucccucgcccaguccgucugccaccuccucaaccaccaguacgagggcgucaccgagaccgucuacaaccucauccgcuccaccugcccccgcuuccuccucggccuccucgacgccggcaagauguacguccaccgccagguccgccccgaggccuggcucuccucccgccccucccucggcuccggccagcuccuccucgucugccacgccuccggcuucuaccccaagcccgucugggucaccuggaugcgcaacgagcaggagcagcucggcaccaagcacggcgacauccuccccaacgccgacggcaccugguaccuccaggucauccucgaggucgccuccgaggagcccgccggccucuccugccgcguccgccacuccucccucggcggccaggacaucauccucuacuggggccaccacuucuccaugaacuggaucgcccucgucgucaucgucccccucgucauccucaucguccucguccucugguucaagaagcacugcuccuaccaggacauccucuga

SEQ ID NO: 40973 - RNA, 1008 nt, Artificial Sequence
  derived and/or modified sequence opt2 from CD1D__Homo_sapiens__NP_001757
augggcugccuccucuuccuccuccucugggcccuccuccaggccuggggcuccgccgaggucccccagcgccucuucccccuccgcugccuccagaucuccuccuucgccaacuccuccuggacccgcaccgacggccucgccuggcucggcgagcuccagacccacuccugguccaacgacuccgacaccguccgcucccucaagcccuggucccagggcaccuucuccgaccagcagugggagacccuccagcacaucuuccgcgucuaccgcuccuccuucacccgcgacgucaaggaguucgccaagaugcuccgccucuccuacccccucgagcuccaggucuccgccggcugcgagguccaccccggcaacgccuccaacaacuucuuccacgucgccuuccagggcaaggacauccucuccuuccagggcaccuccugggagcccacccaggaggccccccucugggucaaccucgccauccagguccucaaccaggacaaguggacccgcgagaccguccaguggcuccucaacggcaccugcccccaguucgucuccggccuccucgaguccggcaaguccgagcucaagaagcaggucaagcccaaggccuggcucucccgcggccccucccccggccccggccgccuccuccucgucugccacgucuccggcuucuaccccaagcccgucugggucaaguggaugcgcggcgagcaggagcagcagggcacccagcccggcgacauccuccccaacgccgacgagaccugguaccuccgcgccacccucgacgucgucgccggcgaggccgccggccucuccugccgcgucaagcacuccucccucgagggccaggacaucguccucuacuggggcggcuccuacaccuccaugggccucaucgcccucgccguccucgccugccuccucuuccuccucaucgucggcuucaccucccgcuucaagcgccagaccuccuaccagggcguccucuga

SEQ ID NO: 40974 - RNA, 1131 nt, Artificial Sequence
  derived and/or modified sequence opt2 from CD1E__Homo_sapiens__NP_001036048
augcuccuccucuuccuccucuucgagggccucugcugccccggcgagaacaccgccgccccccaggcccuccaguccuaccaccucgccgccgaggagcagcucuccuuccgcaugcuccagaccuccuccuucgccaaccacuccugggcccacuccgagggcuccggcuggcucggcgaccuccagacccacggcugggacaccguccucggcaccauccgcuuccucaagcccuggucccacggcaacuucuccaagcaggagcucaagaaccuccagucccucuuccagcucuacuuccacuccuucauccagaucguccaggccuccgccggccaguuccagcucgaguaccccuucgagauccagauccucgccggcugccgcaugaacgccccccagaucuuccucaacauggccuaccagggcuccgacuuccucuccuuccagggcaucuccugggagcccucccccggcgccggcauccgcgcccagaacaucugcaagguccucaaccgcuaccucgacaucaaggagauccuccagucccuccucggccacaccugcccccgcuuccucgccggccucauggaggccggcgaguccgagcucaagcgcaaggucaagcccgaggccuggcucuccugcggccccucccccggccccggccgccuccagcucgucugccacgucuccggcuucuaccccaagcccgucugggucauguggaugcgcggcgagcaggagcagcgcggcacccagcgcggcgacguccuccccaacgccgacgagaccugguaccuccgcgccacccucgacgucgccgccggcgaggccgccggccucuccugccgcgucaagcacuccucccucggcggccacgaccucaucauccacuggggcggcuacuccaucuuccucauccucaucugccucaccgucaucgucacccucgucauccucgucgucgucgacucccgccucaagaagcagucccccgucuuccucaugggcgccaacacccaggacaccaagaacucccgccaccaguucugccucgcccaggucuccuggaucaagaaccgcguccucaagaaguggaagacccgccucaaccagcucugguga

SEQ ID NO: 40975 - RNA, 885 nt, Artificial Sequence
  derived and/or modified sequence opt2 from CD200__Homo_sapiens__NP_001004196
auggagcgccucacccucacccgcaccaucggcggcccccuccucaccgccacccuccucggcaagaccaccaucaacgacuaccaggucauccgcaugcccuucucccaccucuccaccuacucccucgucugggucauggccgccgucguccucugcaccgcccagguccaggucgucacccaggacgagcgcgagcagcucuacacccccgccucccucaagugcucccuccagaacgcccaggaggcccucaucgucaccuggcagaagaagaaggccgucucccccgagaacauggucaccuucuccgagaaccacggcgucgucauccagcccgccuacaaggacaagaucaacaucacccagcucggccuccagaacuccaccaucaccuucuggaacaucacccucgaggacgagggcugcuacaugugccucuucaacaccuucggcuucggcaagaucuccggcaccgccugccucaccgucuacguccagcccaucgucucccuccacuacaaguucuccgaggaccaccucaacaucaccugcuccgccaccgcccgccccgcccccauggucuucuggaaggucccccgcuccggcaucgagaacuccaccgucacccucucccaccccaacggcaccaccuccgucaccuccauccuccacaucaaggaccccaagaaccaggucggcaaggaggucaucugccagguccuccaccucggcaccgucaccgacuucaagcagaccgucaacaagggcuacugguucuccgucccccuccuccucuccaucgucucccucgucauccuccucguccucaucuccauccuccucuacuggaagcgccaccgcaaccaggaccgcgagcccuga

SEQ ID NO: 40976 - RNA, 1047 nt, Artificial Sequence
  derived and/or modified sequence opt2 from CD200R1__Homo_sapiens__NP_620161
augcucugccccuggcgcaccgccaaccucggccuccuccucauccucaccaucuuccucgucgccgaggccgagggcgccgcccagcccaacaacucccucaugcuccagaccuccaaggagaaccacgcccucgccuccuccucccucugcauggacgagaagcagaucacccagaacuacuccaagguccucgccgaggucaacaccuccuggcccgucaagauggccaccaacgccguccucugcugcccccccaucgcccuccgcaaccucaucaucaucaccugggagaucauccuccgcggccagcccuccugcaccaaggccuacaagaaggagaccaacgagaccaaggagaccaacugcaccgacgagcgcaucaccugggucucccgccccgaccagaacuccgaccuccagauccgcaccgucgccaucacccacgacggcuacuaccgcugcaucauggucacccccgacggcaacuuccaccgcggcuaccaccuccagguccucgucacccccgaggucacccucuuccagaaccgcaaccgcaccgccgucugcaaggccgucgccggcaagcccgccgcccacaucuccuggauccccgagggcgacugcgccaccaagcaggaguacugguccaacggcaccgucaccgucaaguccaccugccacugggagguccacaacgucuccaccgucaccugccacgucucccaccucaccggcaacaagucccucuacaucgagcuccuccccguccccggcgccaagaaguccgccaagcucuacauccccuacaucauccucaccaucaucauccucaccaucgucggcuucaucuggcuccucaaggucaacggcugccgcaaguacaagcucaacaagaccgaguccacccccgucgucgaggaggacgagaugcagcccuacgccuccuacaccgagaagaacaacccccucuacgacaccaccaacaaggucaaggccuccgaggcccuccaguccgaggucgacaccgaccuccacacccucuga

SEQ ID NO: 40977 - RNA, 987 nt, Artificial Sequence
  derived and/or modified sequence opt2 from CD207__Homo_sapiens__NP_056532
augaccgucgagaaggaggcccccgacgcccacuucaccgucgacaagcagaacaucucccucuggccccgcgagcccccccccaaguccggccccucccucguccccggcaagacccccaccguccgcgccgcccucaucugccucacccucguccucgucgccuccguccuccuccaggccguccucuacccccgcuucaugggcaccaucuccgacgucaagaccaacguccagcuccucaagggccgcgucgacaacaucuccacccucgacuccgagaucaagaagaacuccgacggcauggaggccgccggcguccagauccagauggucaacgagucccucggcuacguccgcucccaguuccucaagcucaagaccuccgucgagaaggccaacgcccagauccagauccucacccgcuccugggaggaggucuccacccucaacgcccagauccccgagcucaaguccgaccucgagaaggccuccgcccucaacaccaagauccgcgcccuccagggcucccucgagaacauguccaagcuccucaagcgccagaacgacauccuccaggucgucucccagggcuggaaguacuucaagggcaacuucuacuacuucucccucauccccaagaccugguacuccgccgagcaguucugcgucucccgcaacucccaccucaccuccgucaccuccgaguccgagcaggaguuccucuacaagaccgccggcggccucaucuacuggaucggccucaccaaggccggcauggagggcgacugguccugggucgacgacacccccuucaacaagguccaguccguccgcuucuggauccccggcgagcccaacaacgccggcaacaacgagcacugcggcaacaucaaggcccccucccuccaggccuggaacgacgcccccugcgacaagaccuuccucuucaucugcaagcgccccuacguccccuccgagcccuga

SEQ ID NO: 40978 - RNA, 807 nt, Artificial Sequence
  derived and/or modified sequence opt2 from CD209__Homo_sapiens__NP_001138365
auguccgacuccaaggagccccgccuccagcagcucggccuccucgucuccaagguccccuccuccaucucccaggagcagucccgccaggacgccaucuaccagaaccucacccagcucaaggccgccgucggcgagcucuccgagaaguccaagcuccaggagaucuaccaggagcucacccagcucaaggccgccgucggcgagcuccccgagaaguccaagcuccaggagaucuaccaggagcucacccgccucaaggccgccgucggcgagcuccccgagaaguccaagcuccaggagaucuaccaggagcucaccuggcucaaggccgccgucgagcgccucugccaccccugccccugggaguggaccuucuuccagggcaacugcuacuucauguccaacucccagcgcaacuggcacgacuccaucaccgccugcaaggaggucggcgcccagcucgucgucaucaaguccgccgaggagcagaacuuccuccagcuccaguccucccgcuccaaccgcuucaccuggaugggccucuccgaccucaaccaggagggcaccuggcagugggucgacggcuccccccuccuccccuccuucaagcaguacuggaaccgcggcgagcccaacaacgucggcgaggaggacugcgccgaguucuccggcaacggcuggaacgacgacaagugcaaccucgccaaguucuggaucugcaagaaguccgccgccuccugcucccgcgacgaggagcaguuccucucccccgcccccgccacccccaaccccccccccgccuga

SEQ ID NO: 40979 - RNA, 1011 nt, Artificial Sequence
  derived and/or modified sequence opt2 from CD226__Homo_sapiens__NP_001290547
auggacuaccccacccuccuccucgcccuccuccacgucuaccgcgcccucugcgaggagguccucuggcacaccuccguccccuucgccgagaacaugucccucgagugcgucuaccccuccaugggcauccucacccaggucgagugguucaagaucggcacccagcaggacuccaucgccaucuucucccccacccacggcauggucauccgcaagcccuacgccgagcgcgucuacuuccucaacuccaccauggccuccaacaacaugacccucuucuuccgcaacgccuccgaggacgacgucggcuacuacuccugcucccucuacaccuacccccagggcaccuggcagaaggucauccaggucguccaguccgacuccuucgaggccgccguccccuccaacucccacaucgucuccgagcccggcaagaacgucacccucaccugccagccccagaugaccuggcccguccaggccguccgcugggagaagauccagccccgccagaucgaccuccucaccuacugcaaccucguccacggccgcaacuucaccuccaaguucccccgccagaucgucuccaacugcucccacggccgcugguccgucaucgucauccccgacgucaccgucuccgacuccggccucuaccgcugcuaccuccaggccuccgccggcgagaacgagaccuucgucaugcgccucaccgucgccgagggcaagaccgacaaccaguacacccucuucgucgccggcggcaccguccuccuccuccucuucgucaucuccaucaccaccaucaucgucaucuuccucaaccgccgccgccgccgcgagcgccgcgaccucuucaccgaguccugggacacccagaaggcccccaacaacuaccgcucccccaucuccaccucccagcccaccaaccaguccauggacgacacccgcgaggacaucuacgucaacuaccccaccuucucccgccgccccaagacccgcgucuga

SEQ ID NO: 40980 - RNA, 2280 nt, Artificial Sequence
  derived and/or modified sequence opt2 from CD22__Homo_sapiens__NP_001172028
augcaccuccucggccccuggcuccuccuccucguccucgaguaccucgccuucuccgacuccuccaagugggucuucgagcaccccgagacccucuacgccugggagggcgccugcgucuggauccccugcaccuaccgcgcccucgacggcgaccucgaguccuucauccucuuccacaaccccgaguacaacaagaacaccuccaaguucgacggcacccgccucuacgaguccaccaaggacggcaagguccccuccgagcagaagcgcguccaguuccucggcgacaagaacaagaacugcacccucuccauccaccccguccaccucaacgacuccggccagcucggccuccgcauggaguccaagaccgagaaguggauggagcgcauccaccucaacgucuccgagcgccccuuccccccccacauccagcucccccccgagauccaggagucccaggaggucacccucaccugccuccucaacuucuccugcuacggcuaccccauccagcuccaguggcuccucgagggcguccccaugcgccaggccgccgucaccuccaccucccucaccaucaaguccgucuucacccgcuccgagcucaaguucuccccccaguggucccaccacggcaagaucgucaccugccagcuccaggacgccgacggcaaguuccucuccaacgacaccguccagcucaacgucaagcacacccccaagcucgagaucaaggucacccccuccgacgccaucguccgcgagggcgacuccgucaccaugaccugcgaggucuccuccuccaaccccgaguacaccaccgucuccuggcucaaggacggcaccucccucaagaagcagaacaccuucacccucaaccuccgcgaggucaccaaggaccaguccggcaaguacugcugccaggucuccaacgacgucggccccggccgcuccgaggaggucuuccuccagguccaguacccccccaagaaggucaccaccgucauccagaaccccaugcccauccgcgagggcgacaccgucacccucuccugcaacuacaacuccuccaaccccuccgucacccgcuacgaguggaagccccacggcgccugggaggagcccucccucggcguccucaagauccagaacgucggcugggacaacaccaccaucgccugcgccgccugcaacuccuggugcuccugggccucccccgucgcccucaacguccaguacgccccccgcgacguccgcguccgcaagaucaagccccucuccgagauccacuccggcaacuccgucucccuccagugcgacuucuccuccucccaccccaaggagguccaguucuucugggagaagaacggccgccuccucggcaaggagucccagcucaacuucgacuccaucucccccgaggacgccggcuccuacuccugcugggucaacaacuccaucggccagaccgccuccaaggccuggacccucgagguccucuacgccccccgccgccuccgcgucuccaugucccccggcgaccaggucauggagggcaaguccgccacccucaccugcgaguccgacgccaacccccccgucucccacuacaccugguucgacuggaacaaccagucccuccccuaccacucccagaagcuccgccucgagcccgucaagguccagcacuccggcgccuacuggugccagggcaccaacuccgucggcaagggccgcuccccccucuccacccucaccgucuacuacucccccgagaccaucggccgccgcgucgccgucggccucggcuccugccucgccauccucauccucgccaucugcggccucaagcuccagcgccgcuggaagcgcacccagucccagcagggccuccaggagaacuccuccggccaguccuucuucguccgcaacaagaagguccgccgcgccccccucuccgagggcccccacucccucggcugcuacaaccccaugauggaggacggcaucuccuacaccacccuccgcuuccccgagaugaacaucccccgcaccggcgacgccgaguccuccgagaugcagcgccccccccccgacugcgacgacaccgucaccuacuccgcccuccacaagcgccaggucggcgacuacgagaacgucauccccgacuuccccgaggacgagggcauccacuacuccgagcucauccaguucggcgucggcgagcgcccccaggcccaggagaacgucgacuacgucauccucaagcacuga

SEQ ID NO: 40981 - RNA, 1113 nt, Artificial Sequence
  derived and/or modified sequence opt2 from CD244__Homo_sapiens__NP_001160135
augcucggccaggucgucacccucauccuccuccuccuccucaaggucuaccagggcaagggcugccagggcuccgccgaccacgucgucuccaucuccggcgucccccuccagcuccagcccaacuccauccagaccaaggucgacuccaucgccuggaagaagcuccuccccucccagaacggcuuccaccacauccucaagugggagaacggcucccuccccuccaacaccuccaacgaccgcuucuccuucaucgucaagaaccucucccuccucaucaaggccgcccagcagcaggacuccggccucuacugccucgaggucaccuccaucuccggcaagguccagaccgccaccuuccaggucuucgucuucgagucccuccuccccgacaaggucgagaagccccgccuccagggccagggcaagauccucgaccgcggccgcugccaggucgcccucuccugccucgucucccgcgacggcaacgucuccuacgccugguaccgcggcuccaagcucauccagaccgccggcaaccucaccuaccucgacgaggaggucgacaucaacggcacccacaccuacaccugcaacgucuccaaccccgucuccugggagucccacacccucaaccucacccaggacugccagaacgcccaccaggaguuccgcuucuggcccuuccucgucaucaucgucauccucuccgcccucuuccucggcacccucgccugcuucugcgucuggcgccgcaagcgcaaggagaagcaguccgagaccucccccaaggaguuccucaccaucuacgaggacgucaaggaccucaagacccgccgcaaccacgagcaggagcagaccuuccccggcggcggcuccaccaucuacuccaugauccagucccaguccuccgcccccaccucccaggagcccgccuacacccucuacucccucauccagcccucccgcaaguccggcucccgcaagcgcaaccacucccccuccuucaacuccaccaucuacgaggucaucggcaagucccagcccaaggcccagaaccccgcccgccucucccgcaaggagcucgagaacuucgacgucuacuccuga

SEQ ID NO: 40982 - RNA, 492 nt, Artificial Sequence
  derived and/or modified sequence opt2 from CD247__Homo_sapiens__NP_000725
augaaguggaaggcccucuucaccgccgccauccuccaggcccagcuccccaucaccgaggcccaguccuucggccuccucgaccccaagcucugcuaccuccucgacggcauccucuucaucuacggcgucauccucaccgcccucuuccuccgcgucaaguucucccgcuccgccgacgcccccgccuaccagcagggccagaaccagcucuacaacgagcucaaccucggccgccgcgaggaguacgacguccucgacaagcgccgcggccgcgaccccgagaugggcggcaagccccgccgcaagaacccccaggagggccucuacaacgagcuccagaaggacaagauggccgaggccuacuccgagaucggcaugaagggcgagcgccgccgcggcaagggccacgacggccucuaccagggccucuccaccgccaccaaggacaccuacgacgcccuccacaugcaggcccuccccccccgcuga

SEQ ID NO: 40983 - RNA, 2274 nt, Artificial Sequence
  derived and/or modified sequence opt2 from CD248__Homo_sapiens__NP_065137
augcuccuccgccuccuccucgccugggccgccgccggccccacccucggccaggaccccugggccgccgagccccgcgccgccugcggccccuccuccugcuacgcccucuucccccgccgccgcaccuuccucgaggccuggcgcgccugccgcgagcucggcggcgaccucgccaccccccgcacccccgaggaggcccagcgcgucgacucccucgucggcgccggccccgccucccgccuccucuggaucggccuccagcgccaggcccgccagugccagcuccagcgcccccuccgcggcuucaccuggaccaccggcgaccaggacaccgccuucaccaacugggcccagcccgccuccggcggccccugccccgcccagcgcugcgucgcccucgaggccuccggcgagcaccgcuggcucgagggcuccugcacccucgccgucgacggcuaccucugccaguucggcuucgagggcgccugccccgcccuccaggacgaggccggccaggccggccccgccgucuacaccacccccuuccaccucgucuccaccgaguucgaguggcuccccuucggcuccgucgccgccguccagugccaggccggccgcggcgccucccuccucugcgucaagcagcccgagggcggcgucggcuggucccgcgccggcccccucugccucggcaccggcugcucccccgacaacggcggcugcgagcacgagugcgucgaggaggucgacggccacgucuccugccgcugcaccgagggcuuccgccucgccgccgacggccgcuccugcgaggaccccugcgcccaggcccccugcgagcagcagugcgagcccggcggcccccagggcuacuccugccacugccgccucggcuuccgccccgccgaggacgacccccaccgcugcgucgacaccgacgagugccagaucgccggcgucugccagcagaugugcgucaacuacgucggcggcuucgagugcuacugcuccgagggccacgagcucgaggccgacggcaucuccugcucccccgccggcgccaugggcgcccaggccucccaggaccucggcgacgagcuccucgacgacggcgaggacgaggaggacgaggacgaggccuggaaggccuucaacggcggcuggaccgagaugcccggcauccucuggauggagcccacccagccccccgacuucgcccucgccuaccgccccuccuuccccgaggaccgcgagccccagauccccuaccccgagcccaccuggccccccccccucuccgccccccgcguccccuaccacuccuccguccucuccgucacccgccccgucgucgucuccgccacccaccccacccuccccuccgcccaccagccccccgucauccccgccacccaccccgcccucucccgcgaccaccagauccccgucaucgccgccaacuaccccgaccuccccuccgccuaccagcccggcauccucuccgucucccacuccgcccagccccccgcccaccagccccccaugaucuccaccaaguaccccgagcucuuccccgcccaccagucccccauguuccccgacacccgcgucgccggcacccagaccaccacccaccuccccggcaucccccccaaccacgccccccucgucaccacccucggcgcccagcuccccccccaggcccccgacgcccucguccuccgcacccaggccacccagcuccccaucauccccaccgcccagcccucccucaccaccaccucccgcucccccgucucccccgcccaccagaucuccguccccgccgccacccagcccgccgcccuccccacccuccuccccucccagucccccaccaaccagaccucccccaucucccccacccacccccacuccaaggccccccagaucccccgcgaggacggccccucccccaagcucgcccucuggcuccccucccccgcccccaccgccgcccccaccgcccucggcgaggccggccucgccgagcacucccagcgcgacgaccgcuggcuccucgucgcccuccucguccccaccugcgucuuccucgucguccuccucgcccucggcaucgucuacugcacccgcugcggcccccacgcccccaacaagcgcaucaccgacugcuaccgcugggucauccacgccggcuccaagucccccaccgagcccaugcccccccgcggcucccucaccggcguccagaccugccgcaccuccgucuga

SEQ ID NO: 40984 - RNA, 411 nt, Artificial Sequence
  derived and/or modified sequence opt2 from CD24__Homo_sapiens__XP_011533677
augcgcacccgcgacgcccccgucuccucccuccgccucgccgacacccgccgcucccagaacaaggcccgcgccuccggccgcgcccgcccccgcggccgcgcccgccgcucccuccgcacccgcaccccccccgcccgcuccgccgaccagcccggccgcguccgcgcccgccgccgccccggccccgucggccagggccucgccggcuccccccgcuccccccccugccuccgcccccccggcgccuccggcucccccuccacccagcaccccgcccgccgcgccgcccaccgccgccgcggccacggccaguccaacggcggccaggcccgcgccggcgccgccgccgccggcaccgcccccacccacgccguccgcugcgcccccgagcccuccuccauccucuga

SEQ ID NO: 40985 - RNA, 531 nt, Artificial Sequence
  derived and/or modified sequence opt2 from CD274__Homo_sapiens__NP_001254635
augcgcaucuucgccgucuucaucuucaugaccuacuggcaccuccucaacgcccccuacaacaagaucaaccagcgcauccucgucgucgaccccgucaccuccgagcacgagcucaccugccaggccgagggcuaccccaaggccgaggucaucuggaccuccuccgaccaccagguccucuccggcaagaccaccaccaccaacuccaagcgcgaggagaagcucuucaacgucaccuccacccuccgcaucaacaccaccaccaacgagaucuucuacugcaccuuccgccgccucgaccccgaggagaaccacaccgccgagcucgucauccccgagcucccccucgcccacccccccaacgagcgcacccaccucgucauccucggcgccauccuccucugccucggcgucgcccucaccuucaucuuccgccuccgcaagggccgcaugauggacgucaagaagugcggcauccaggacaccaacuccaagaagcaguccgacacccaccucgaggagaccuga

SEQ ID NO: 40986 - RNA, 951 nt, Artificial Sequence
  derived and/or modified sequence opt2 from CD276__Homo_sapiens__NP_079516
augcuccgccgccgcggcucccccggcaugggcguccacgucggcgccgcccucggcgcccucugguucugccucaccggcgcccucgagguccagguccccgaggaccccgucgucgcccucgucggcaccgacgccacccucugcugcuccuucucccccgagcccggcuucucccucgcccagcucaaccucaucuggcagcucaccgacaccaagcagcucguccacuccuucgccgagggccaggaccagggcuccgccuacgccaaccgcaccgcccucuuccccgaccuccucgcccagggcaacgccucccuccgccuccagcgcguccgcgucgccgacgagggcuccuucaccugcuucgucuccauccgcgacuucggcuccgccgccgucucccuccaggucgccgcccccuacuccaagcccuccaugacccucgagcccaacaaggaccuccgccccggcgacaccgucaccaucaccugcuccuccuaccgcggcuaccccgaggccgaggucuucuggcaggacggccagggcgucccccucaccggcaacgucaccaccucccagauggccaacgagcagggccucuucgacguccacuccguccuccgcgucguccucggcgccaacggcaccuacuccugccucguccgcaaccccguccuccagcaggacgcccacggcuccgucaccaucaccggccagcccaugaccuucccccccgaggcccucugggucaccgucggccucuccgucugccucaucgcccuccucgucgcccucgccuucgucugcuggcgcaagaucaagcaguccugcgaggaggagaacgccggcgccgaggaccaggacggcgagggcgagggcuccaagaccgcccuccagccccucaagcacuccgacuccaaggaggacgacggccaggagaucgccuga

SEQ ID NO: 40987 - RNA, 783 nt, Artificial Sequence
  derived and/or modified sequence opt2 from CD27__Homo_sapiens__NP_001233
auggcccgcccccaccccugguggcucugcguccucggcacccucgucggccucuccgccacccccgcccccaaguccugccccgagcgccacuacugggcccagggcaagcucugcugccagaugugcgagcccggcaccuuccucgucaaggacugcgaccagcaccgcaaggccgcccagugcgaccccugcauccccggcgucuccuucucccccgaccaccacacccgcccccacugcgaguccugccgccacugcaacuccggccuccucguccgcaacugcaccaucaccgccaacgccgagugcgccugccgcaacggcuggcagugccgcgacaaggagugcaccgagugcgacccccuccccaaccccucccucaccgcccgcuccucccaggcccucuccccccacccccagcccacccaccuccccuacgucuccgagaugcucgaggcccgcaccgccggccacaugcagacccucgccgacuuccgccagcuccccgcccgcacccucuccacccacuggcccccccagcgcucccucugcuccuccgacuucauccgcauccucgucaucuucuccggcauguuccucgucuucacccucgccggcgcccucuuccuccaccagcgccgcaaguaccgcuccaacaagggcgagucccccgucgagcccgccgagcccugccgcuacuccugcccccgcgaggaggagggcuccaccauccccauccaggaggacuaccgcaagcccgagcccgccugcucccccuga

SEQ ID NO: 40988 - RNA, 306 nt, Artificial Sequence
  derived and/or modified sequence opt2 from CD28__Homo_sapiens__NP_001230007
augcuccgccuccuccucgcccucaaccucuuccccuccauccaggucaccggcaagcaccucugccccuccccccucuuccccggccccuccaagcccuucuggguccucgucgucgucggcggcguccucgccugcuacucccuccucgucaccgucgccuucaucaucuucuggguccgcuccaagcgcucccgccuccuccacuccgacuacaugaacaugaccccccgccgccccggccccacccgcaagcacuaccagcccuacgcccccccccgcgacuucgccgccuaccgcuccuga

SEQ ID NO: 40989 - RNA, 1920 nt, Artificial Sequence
  derived and/or modified sequence opt2 from CD2AP__Homo_sapiens__NP_036252
auggucgacuacaucgucgaguacgacuacgacgccguccacgacgacgagcucaccauccgcgucggcgagaucauccgcaacgucaagaagcuccaggaggagggcuggcucgagggcgagcucaacggccgccgcggcauguuccccgacaacuucgucaaggagaucaagcgcgagaccgaguucaaggacgacucccuccccaucaagcgcgagcgccacggcaacgucgccucccucguccagcgcaucuccaccuacggccuccccgccggcggcauccagccccacccccagaccaagaacaucaagaagaagaccaagaagcgccagugcaagguccucuucgaguacaucccccagaacgaggacgagcucgagcucaaggucggcgacaucaucgacaucaacgaggaggucgaggagggcuggugguccggcacccucaacaacaagcucggccucuuccccuccaacuucgucaaggagcucgaggucaccgacgacggcgagacccacgaggcccaggacgacuccgagaccguccucgccggccccaccucccccauccccucccucggcaacgucuccgagaccgccuccggcuccgucacccagcccaagaagauccgcggcaucggcuucggcgacaucuucaaggagggcuccgucaagcuccgcacccgcaccuccuccuccgagaccgaggagaagaagcccgagaagccccucauccuccagucccucggccccaagacccaguccgucgagaucaccaagaccgacaccgagggcaagaucaaggccaaggaguacugccgcacccucuucgccuacgagggcaccaacgaggacgagcucaccuucaaggagggcgagaucauccaccucaucuccaaggagaccggcgaggccggcugguggcgcggcgagcucaacggcaaggagggcgucuuccccgacaacuucgccguccagaucaacgagcucgacaaggacuuccccaagcccaagaagccccccccccccgccaaggcccccgcccccaagcccgagcucaucgccgccgagaagaaguacuucucccucaagcccgaggagaaggacgagaaguccacccucgagcagaagcccuccaagcccgccgccccccaggucccccccaagaagcccaccccccccaccaaggccuccaaccuccuccgcuccuccggcaccgucuaccccaagcgccccgagaagcccguccccccccccccccccaucgccaagaucaacggcgaggucuccuccaucuccuccaaguucgagaccgagcccgucuccaagcucaagcucgacuccgagcagcucccccuccgccccaaguccgucgacuucgacucccucaccguccgcaccuccaaggagaccgacgucgucaacuucgacgacaucgccuccuccgagaaccuccuccaccucaccgccaaccgccccaagaugcccggccgccgccuccccggccgcuucaacggcggccacucccccacccacucccccgagaagauccucaagcuccccaaggaggaggacuccgccaaccucaagcccuccgagcucaagaaggacaccugcuacucccccaagcccuccgucuaccucuccacccccuccuccgccuccaaggccaacaccaccgccuuccucaccccccucgagaucaaggccaaggucgagaccgacgacgucaagaagaacucccucgacgagcuccgcgcccagaucaucgagcuccucugcaucgucgaggcccucaagaaggaccacggcaaggagcucgagaagcuccgcaaggaccucgaggaggagaagaccaugcgcuccaaccucgagauggagaucgagaagcucaagaaggccguccucuccuccuga

SEQ ID NO: 40990 - RNA, 561 nt, Artificial Sequence
  derived and/or modified sequence opt2 from CD300A__Homo_sapiens__NP_001243770
auguggcuccccugggcccuccuccuccucuggguccccgccuccaccuccaugacccccgccuccaucaccgccgccaagaccuccaccaucaccaccgccuucccccccgucuccuccaccacccucuucgccgucggcgccacccacuccgccuccauccaggaggagaccgaggaggucgucaacucccagcucccccuccuccucucccuccucgcccuccuccuccuccuccucgucggcgccucccuccucgccuggcgcauguuccagaaguggaucaaggccggcgaccacuccgagcucucccagaaccccaagcaggccgccacccaguccgagcuccacuacgccaaccucgagcuccucauguggccccuccaggagaagcccgcccccccccgcgaggucgaggucgaguacuccaccgucgccuccccccgcgaggagcuccacuacgccuccgucgucuucgacuccaacaccaaccgcaucgccgcccagcgcccccgcgaggaggagcccgacuccgacuacuccgucauccgcaagaccuga

SEQ ID NO: 40991 - RNA, 675 nt, Artificial Sequence
  derived and/or modified sequence opt2 from CD300C__Homo_sapiens__NP_006669
augaccgcccgcgccugggccuccuggcgcuccuccgcccuccuccuccuccucguccccggcuacuucccccucucccaccccaugaccgucgccggccccgucggcggcucccucuccguccagugccgcuacgagaaggagcaccgcacccucaacaaguucuggugccgccccccccagauccuccgcugcgacaagaucgucgagaccaagggcuccgccggcaagcgcaacggccgcgucuccauccgcgacucccccgccaaccucuccuucaccgucacccucgagaaccucaccgaggaggacgccggcaccuacuggugcggcgucgacacccccuggcuccgcgacuuccacgaccccaucgucgaggucgaggucuccgucuuccccgccggcaccaccaccgccuccuccccccaguccuccaugggcaccuccggcccccccaccaagcuccccguccacaccuggcccuccgucacccgcaaggacucccccgagcccuccccccaccccggcucccucuucuccaacguccgcuuccuccuccucguccuccucgagcucccccuccuccucuccaugcucggcgccguccucugggucaaccgcccccagcgcuccucccgcucccgccagaacuggcccaagggcgagaaccaguga

SEQ ID NO: 40992 - RNA, 585 nt, Artificial Sequence
  derived and/or modified sequence opt2 from CD300LF__Homo_sapiens__NP_001276011
auguggcucccccagcucgaccucaugcgcgucaucuccgccaagucccagggcuacuccaucgucacccagaucaccggccccaccaccgucaacggccucgagcgcggcucccucaccguccagugcgucuaccgcuccggcugggagaccuaccucaagugguggugccgcggcgccaucuggcgcgacugcaagauccucgucaagaccuccggcuccgagcaggaggucaagcgcgaccgcgucuccaucaaggacaaccagaagaaccgcaccuucaccgucaccauggaggaccucaugaagaccgacgccgacaccuacuggugcggcaucgagaagaccggcaacgaccucggcgucaccguccaggucaccaucgaccccgcccccgucacccaggaggagaccuccuccucccccacccucaccggccaccaccucgacaacuccucccgcgacgucccccgcgccggcaccgccgcccccggcggccgcccccuccucugccgccccgaccccgccgccggccgcaaccuccccgccaagggcuaccacgaggccuuccucugccccggcuga

SEQ ID NO: 40993 - RNA, 525 nt, Artificial Sequence
  derived and/or modified sequence opt2 from CD302__Homo_sapiens__NP_001185692
augcuccgcgccgcccuccccgcccuccuccucccccuccucggccucgccgccgccgccgucgccgacugccccuccuccaccuggauccaguuccaggacuccugcuacaucuuccuccaggaggccaucaaggucgaguccaucgaggacguccgcaaccagugcaccgaccacggcgccgacaugaucuccauccacaacgaggaggagaacgccuucauccucgacacccucaagaagcaguggaagggccccgacgacauccuccucggcauguucuacgacaccgacguccccuacaagcgcaaguaccucuccgacaaccacauccucaucuccgcccucgucaucgccuccaccgucauccucaccguccucggcgccaucaucugguuccucuacaagaagcacuccgacucccgcuucaccaccgucuucuccaccgccccccagucccccuacaacgaggacugcguccucgucgucggcgaggagaacgaguaccccguccaguucgacuga

SEQ ID NO: 40994 - RNA, 723 nt, Artificial Sequence
  derived and/or modified sequence opt2 from CD320__Homo_sapiens__NP_001159367
auguccggcggcuggauggcccaggucggcgccuggcgcaccggcgcccucggccucgcccuccuccuccuccucggccucggccucggccucgaggccgccgccuccccccucuccacccccaccuccgcccaggccgccggcaucgagcccugcacccagaagggccagugcccccccccccccggccuccccugccccugcaccggcgucuccgacugcuccggcggcaccgacaagaagcuccgcaacugcucccgccucgccugccucgccggcgagcuccgcugcacccucuccgacgacugcaucccccucaccuggcgcugcgacggccaccccgacugccccgacuccuccgacgagcucggcugcggcaccaacgagauccuccccgagggcgacgccaccaccaugggcccccccgucacccucgaguccgucaccucccuccgcaacgccaccaccaugggcccccccgucacccucgaguccguccccuccgucggcaacgccaccuccuccuccgccggcgaccaguccggcucccccaccgccuacggcgucaucgccgccgccgccguccucuccgccucccucgucaccgccacccuccuccuccucuccuggcuccgcgcccaggagcgccuccgcccccucggccuccucgucgccaugaaggagucccuccuccucuccgagcagaagaccucccuccccuga

SEQ ID NO: 40995 - RNA, 714 nt, Artificial Sequence
  derived and/or modified sequence opt2 from CD33__Homo_sapiens__NP_001076087
augccccuccuccuccuccucccccuccucugggccgaccucacccaccgccccaagauccucauccccggcacccucgagcccggccacuccaagaaccucaccugcuccgucuccugggccugcgagcagggcaccccccccaucuucuccuggcucuccgccgcccccaccucccucggcccccgcaccacccacuccuccguccucaucaucaccccccgcccccaggaccacggcaccaaccucaccugccaggucaaguucgccggcgccggcgucaccaccgagcgcaccauccagcucaacgucaccuacgucccccagaaccccaccaccggcaucuuccccggcgacggcuccggcaagcaggagacccgcgccggcgucguccacggcgccaucggcggcgccggcgucaccgcccuccucgcccucugccucugccucaucuucuucaucgucaagacccaccgccgcaaggccgcccgcaccgccgucggccgcaacgacacccaccccaccaccggcuccgccucccccaagcaccagaagaaguccaagcuccacggccccaccgagaccuccuccugcuccggcgccgcccccaccgucgagauggacgaggagcuccacuacgccucccucaacuuccacggcaugaaccccuccaaggacaccuccaccgaguacuccgagguccgcacccaguga

SEQ ID NO: 40996 - RNA, 1158 nt, Artificial Sequence
  derived and/or modified sequence opt2 from CD34__Homo_sapiens__NP_001020280
augcucguccgccgcggcgcccgcgccggcccccgcaugccccgcggcuggaccgcccucugccuccucucccuccuccccuccggcuucaugucccucgacaacaacggcaccgccacccccgagcuccccacccagggcaccuucuccaacgucuccaccaacgucuccuaccaggagaccaccacccccuccacccucggcuccaccucccuccaccccgucucccagcacggcaacgaggccaccaccaacaucaccgagaccaccgucaaguucaccuccaccuccgucaucaccuccgucuacggcaacaccaacuccuccguccagucccagaccuccgucaucuccaccgucuucaccacccccgccaacgucuccacccccgagaccacccucaagcccucccucucccccggcaacgucuccgaccucuccaccaccuccaccucccucgccaccucccccaccaagcccuacaccuccuccucccccauccucuccgacaucaaggccgagaucaagugcuccggcauccgcgaggucaagcucacccagggcaucugccucgagcagaacaagaccuccuccugcgccgaguucaagaaggaccgcggcgagggccucgcccgcguccucugcggcgaggagcaggccgacgccgacgccggcgcccaggucugcucccuccuccucgcccaguccgagguccgcccccagugccuccuccucguccucgccaaccgcaccgagaucuccuccaagcuccagcucaugaagaagcaccaguccgaccucaagaagcucggcauccucgacuucaccgagcaggacgucgccucccaccaguccuacucccagaagacccucaucgcccucgucaccuccggcgcccuccucgccguccucggcaucaccggcuacuuccucaugaaccgccgcuccuggucccccaccggcgagcgccucggcgaggaccccuacuacaccgagaacggcggcggccagggcuacuccuccggccccggcaccucccccgaggcccagggcaaggccuccgucaaccgcggcgcccaggagaacggcaccggccaggccaccucccgcaacggccacuccgcccgccagcacgucgucgccgacaccgagcucuga

SEQ ID NO: 40997 - RNA, 1419 nt, Artificial Sequence
  derived and/or modified sequence opt2 from CD36__Homo_sapiens__NP_001001547
augggcugcgaccgcaacugcggccucaucgccggcgccgucaucggcgccguccucgccgucuucggcggcauccucaugcccgucggcgaccuccucauccagaagaccaucaagaagcaggucguccucgaggagggcaccaucgccuucaagaacugggucaagaccggcaccgaggucuaccgccaguucuggaucuucgacguccagaacccccaggaggucaugaugaacuccuccaacauccaggucaagcagcgcggccccuacaccuaccgcguccgcuuccucgccaaggagaacgucacccaggacgccgaggacaacaccgucuccuuccuccagcccaacggcgccaucuucgagcccucccucuccgucggcaccgaggccgacaacuucaccguccucaaccucgccgucgccgccgccucccacaucuaccagaaccaguucguccagaugauccucaacucccucaucaacaaguccaaguccuccauguuccagguccgcacccuccgcgagcuccucuggggcuaccgcgaccccuuccucucccucguccccuaccccgucaccaccaccgucggccucuucuaccccuacaacaacaccgccgacggcgucuacaaggucuucaacggcaaggacaacaucuccaaggucgccaucaucgacaccuacaagggcaagcgcaaccucuccuacugggagucccacugcgacaugaucaacggcaccgacgccgccuccuucccccccuucgucgagaagucccagguccuccaguucuucuccuccgacaucugccgcuccaucuacgccgucuucgaguccgacgucaaccucaagggcauccccgucuaccgcuucguccuccccuccaaggccuucgccucccccgucgagaaccccgacaacuacugcuucugcaccgagaagaucaucuccaagaacugcaccuccuacggcguccucgacaucuccaagugcaaggagggccgccccgucuacaucucccucccccacuuccucuacgccucccccgacgucuccgagcccaucgacggccucaaccccaacgaggaggagcaccgcaccuaccucgacaucgagcccaucaccggcuucacccuccaguucgccaagcgccuccaggucaaccuccucgucaagcccuccgagaagauccagguccucaagaaccucaagcgcaacuacaucguccccauccucuggcucaacgagaccggcaccaucggcgacgagaaggccaacauguuccgcucccaggucaccggcaagaucaaccuccucggccucaucgagaugauccuccucuccgucggcgucgucauguucgucgccuucaugaucuccuacugcgccugccgcuccaagaccaucaaguga

SEQ ID NO: 40998 - RNA, 846 nt, Artificial Sequence
  derived and/or modified sequence opt2 from CD37__Homo_sapiens__NP_001765
auguccgcccaggaguccugccucucccucaucaaguacuuccucuucgucuucaaccucuucuucuucguccucggcucccucaucuucugcuucggcaucuggauccucaucgacaagaccuccuucgucuccuucgucggccucgccuucgucccccuccagaucugguccaagguccucgccaucuccggcaucuucaccaugggcaucgcccuccucggcugcgucggcgcccucaaggagcuccgcugccuccucggccucuacuucggcaugcuccuccuccucuucgccacccagaucacccucggcauccucaucuccacccagcgcgcccagcucgagcgcucccuccgcgacgucgucgagaagaccauccagaaguacggcaccaaccccgaggagaccgccgccgaggaguccugggacuacguccaguuccagcuccgcugcugcggcuggcacuacccccaggacugguuccagguccucauccuccgcggcaacggcuccgaggcccaccgcguccccugcuccugcuacaaccucuccgccaccaacgacuccaccauccucgacaaggucauccucccccagcucucccgccucggccaccucgcccgcucccgccacuccgccgacaucugcgccguccccgccgagucccacaucuaccgcgagggcugcgcccagggccuccagaaguggcuccacaacaaccucaucuccaucgucggcaucugccucggcgucggccuccucgagcucggcuucaugacccucuccaucuuccucugccgcaaccucgaccacgucuacaaccgccucgcccgcuaccgcuga

SEQ ID NO: 40999 - RNA, 903 nt, Artificial Sequence
  derived and/or modified sequence opt2 from CD38__Homo_sapiens__NP_001766
auggccaacugcgaguucucccccgucuccggcgacaagcccugcugccgccucucccgccgcgcccagcucugccucggcgucuccauccucguccucauccucgucgucguccucgccgucgucgucccccgcuggcgccagcagugguccggccccggcaccaccaagcgcuuccccgagaccguccucgcccgcugcgucaaguacaccgagauccaccccgagaugcgccacgucgacugccaguccgucugggacgccuucaagggcgccuucaucuccaagcaccccugcaacaucaccgaggaggacuaccagccccucaugaagcucggcacccagaccguccccugcaacaagauccuccucuggucccgcaucaaggaccucgcccaccaguucacccagguccagcgcgacauguucacccucgaggacacccuccucggcuaccucgccgacgaccucaccuggugcggcgaguucaacaccuccaagaucaacuaccaguccugccccgacuggcgcaaggacugcuccaacaaccccgucuccgucuucuggaagaccgucucccgccgcuucgccgaggccgccugcgacgucguccacgucaugcucaacggcucccgcuccaagaucuucgacaagaacuccaccuucggcuccgucgagguccacaaccuccagcccgagaagguccagacccucgaggccugggucauccacggcggccgcgaggacucccgcgaccucugccaggaccccaccaucaaggagcucgaguccaucaucuccaagcgcaacauccaguucuccugcaagaacaucuaccgccccgacaaguuccuccagugcgucaagaaccccgaggacuccuccugcaccuccgagaucuga

SEQ ID NO: 41000 - RNA, 516 nt, Artificial Sequence
  derived and/or modified sequence opt2 from CD3D__Homo_sapiens__NP_000723
auggagcacuccaccuuccucuccggccucguccucgccacccuccucucccaggucucccccuucaagauccccaucgaggagcucgaggaccgcgucuucgucaacugcaacaccuccaucaccugggucgagggcaccgucggcacccuccucuccgacaucacccgccucgaccucggcaagcgcauccucgacccccgcggcaucuaccgcugcaacggcaccgacaucuacaaggacaaggaguccaccguccagguccacuaccgcaugugccaguccugcgucgagcucgaccccgccaccgucgccggcaucaucgucaccgacgucaucgccacccuccuccucgcccucggcgucuucugcuucgccggccacgagaccggccgccucuccggcgccgccgacacccaggcccuccuccgcaacgaccaggucuaccagccccuccgcgaccgcgacgacgcccaguacucccaccucggcggcaacugggcccgcaacaaguga

SEQ ID NO: 41001 - RNA, 1533 nt, Artificial Sequence
  derived and/or modified sequence opt2 from CD3EAP__Homo_sapiens__NP_036231
auggaggagccccaggccggcgacgccgcccgcuucuccugcccccccaacuucaccgccaagccccccgccuccgaguccccccgcuucucccucgaggcccucaccggccccgacaccgagcucuggcucauccaggcccccgccgacuucgcccccgagugcuucaacggccgccacgucccccucuccggcucccagaucgucaagggcaagcucgccggcaagcgccaccgcuaccgcguccucuccuccugcccccaggccggcgaggccacccuccucgcccccuccaccgaggccggcggcggccucaccugcgccuccgccccccagggcacccuccgcauccucgagggcccccagcagucccucuccggcuccccccuccagcccauccccgccuccccccccccccagaucccccccggccuccgcccccgcuucugcgccuucggcggcaacccccccgucaccggcccccgcuccgcccucgcccccaaccuccucaccuccggcaagaagaagaaggagaugcaggucaccgaggcccccgucacccaggaggccgucaacggccacggcgcccucgaggucgacauggcccucggcucccccgagauggacguccgcaagaagaagaagaagaagaaccagcagcucaaggagcccgaggccgccggccccgucggcaccgagcccaccgucgagacccucgagccccucggcguccucuuccccuccaccaccaagaagcgcaagaagcccaagggcaaggagaccuucgagcccgaggacaagaccgucaagcaggagcagaucaacaccgagccccucgaggacaccguccucucccccaccaagaagcgcaagcgccagaagggcaccgagggcauggagcccgaggagggcgucaccgucgagucccagccccaggucaaggucgagccccucgaggaggccaucccccucccccccaccaagaagcgcaagaaggagaagggccagauggccaugauggagcccggcaccgaggccauggagcccgucgagcccgagaugaagccccucgagucccccggcggcaccauggccccccagcagcccgagggcgccaagccccaggcccaggccgcccucgccgcccccaagaagaagaccaagaaggagaagcagcaggacgccaccgucgagcccgagaccgaggucgucggccccgagcuccccgacgaccucgagccccaggccgcccccaccuccaccaagaagaagaagaagaagaaggagcgcggccacaccgucaccgagcccauccagccccucgagcccgagcuccccggcgagggccagcccgaggcccgcgccacccccggcuccaccaagaagcgcaagaagcagucccaggagucccgcaugcccgagaccgucccccaggaggagaugcccggccccccccucaacuccgaguccggcgaggaggcccccaccggccgcgacaagaagcgcaagcagcagcagcagcagcccgucuga

SEQ ID NO: 41002 - RNA, 624 nt, Artificial Sequence
  derived and/or modified sequence opt2 from CD3E__Homo_sapiens__NP_000724
augcaguccggcacccacuggcgcguccucggccucugccuccucuccgucggcgucuggggccaggacggcaacgaggagaugggcggcaucacccagacccccuacaaggucuccaucuccggcaccaccgucauccucaccugcccccaguaccccggcuccgagauccucuggcagcacaacgacaagaacaucggcggcgacgaggacgacaagaacaucggcuccgacgaggaccaccucucccucaaggaguucuccgagcucgagcaguccggcuacuacgucugcuacccccgcggcuccaagcccgaggacgccaacuucuaccucuaccuccgcgcccgcgucugcgagaacugcauggagauggacgucauguccgucgccaccaucgucaucgucgacaucugcaucaccggcggccuccuccuccucgucuacuacugguccaagaaccgcaaggccaaggccaagcccgucacccgcggcgccggcgccggcggccgccagcgcggccagaacaaggagcgccccccccccguccccaaccccgacuacgagcccauccgcaagggccagcgcgaccucuacuccggccucaaccagcgccgcaucuga

SEQ ID NO: 41003 - RNA, 549 nt, Artificial Sequence
  derived and/or modified sequence opt2 from CD3G__Homo_sapiens__NP_000064
auggagcagggcaagggccucgccguccucauccucgccaucauccuccuccagggcacccucgcccaguccaucaagggcaaccaccucgucaaggucuacgacuaccaggaggacggcuccguccuccucaccugcgacgccgaggccaagaacaucaccugguucaaggacggcaagaugaucggcuuccucaccgaggacaagaagaaguggaaccucggcuccaacgccaaggacccccgcggcauguaccagugcaagggcucccagaacaaguccaagccccuccaggucuacuaccgcaugugccagaacugcaucgagcucaacgccgccaccaucuccggcuuccucuucgccgagaucgucuccaucuucguccucgccgucggcgucuacuucaucgccggccaggacggcguccgccagucccgcgccuccgacaagcagacccuccuccccaacgaccagcucuaccagccccucaaggaccgcgaggacgaccaguacucccaccuccagggcaaccagcuccgccgcaacuga

SEQ ID NO: 41004 - RNA, 834 nt, Artificial Sequence
  derived and/or modified sequence opt2 from CD40__Homo_sapiens__NP_001241
augguccgccucccccuccagugcguccucuggggcugccuccucaccgccguccaccccgagccccccaccgccugccgcgagaagcaguaccucaucaacucccagugcugcucccucugccagcccggccagaagcucgucuccgacugcaccgaguucaccgagaccgagugccuccccugcggcgaguccgaguuccucgacaccuggaaccgcgagacccacugccaccagcacaaguacugcgaccccaaccucggccuccgcguccagcagaagggcaccuccgagaccgacaccaucugcaccugcgaggagggcuggcacugcaccuccgaggccugcgaguccugcguccuccaccgcuccugcucccccggcuucggcgucaagcagaucgccaccggcgucuccgacaccaucugcgagcccugccccgucggcuucuucuccaacgucuccuccgccuucgagaagugccaccccuggaccuccugcgagaccaaggaccucgucguccagcaggccggcaccaacaagaccgacgucgucugcggcccccaggaccgccuccgcgcccucgucgucauccccaucaucuucggcauccucuucgccauccuccucguccucgucuucaucaagaaggucgccaagaagcccaccaacaaggccccccaccccaagcaggagccccaggagaucaacuuccccgacgaccuccccggcuccaacaccgccgcccccguccaggagacccuccacggcugccagcccgucacccaggaggacggcaaggagucccgcaucuccguccaggagcgccaguga

SEQ ID NO: 41005 - RNA, 786 nt, Artificial Sequence
  derived and/or modified sequence opt2 from CD40LG__Homo_sapiens__NP_000065
augaucgagaccuacaaccagaccuccccccgcuccgccgccaccggccuccccaucuccaugaagaucuucauguaccuccucaccgucuuccucaucacccagaugaucggcuccgcccucuucgccgucuaccuccaccgccgccucgacaagaucgaggacgagcgcaaccuccacgaggacuucgucuucaugaagaccauccagcgcugcaacaccggcgagcgcucccucucccuccucaacugcgaggagaucaagucccaguucgagggcuucgucaaggacaucaugcucaacaaggaggagaccaagaaggagaacuccuucgagaugcagaagggcgaccagaacccccagaucgccgcccacgucaucuccgaggccuccuccaagaccaccuccguccuccagugggccgagaagggcuacuacaccauguccaacaaccucgucacccucgagaacggcaagcagcucaccgucaagcgccagggccucuacuacaucuacgcccaggucaccuucugcuccaaccgcgaggccuccucccaggcccccuucaucgccucccucugccucaagucccccggccgcuucgagcgcauccuccuccgcgccgccaacacccacuccuccgccaagcccugcggccagcaguccauccaccucggcggcgucuucgagcuccagcccggcgccuccgucuucgucaacgucaccgaccccucccaggucucccacggcaccggcuucaccuccuucggccuccucaagcucuga

SEQ ID NO: 41006 - RNA, 2229 nt, Artificial Sequence
  derived and/or modified sequence opt2 from CD44__Homo_sapiens__NP_000601
auggacaaguucugguggcacgccgccuggggccucugccucgucccccucucccucgcccagaucgaccucaacaucaccugccgcuucgccggcgucuuccacgucgagaagaacggccgcuacuccaucucccgcaccgaggccgccgaccucugcaaggccuucaacuccacccuccccaccauggcccagauggagaaggcccucuccaucggcuucgagaccugccgcuacggcuucaucgagggccacgucgucaucccccgcauccaccccaacuccaucugcgccgccaacaacaccggcgucuacauccucaccuccaacaccucccaguacgacaccuacugcuucaacgccuccgccccccccgaggaggacugcaccuccgucaccgaccuccccaacgccuucgacggccccaucaccaucaccaucgucaaccgcgacggcacccgcuacguccagaagggcgaguaccgcaccaaccccgaggacaucuaccccuccaaccccaccgacgacgacgucuccuccggcuccuccuccgagcgcuccuccaccuccggcggcuacaucuucuacaccuucuccaccguccaccccauccccgacgaggacucccccuggaucaccgacuccaccgaccgcauccccgccaccacccucauguccaccuccgccaccgccaccgagaccgccaccaagcgccaggagaccugggacugguucuccuggcucuuccuccccuccgaguccaagaaccaccuccacaccaccacccagauggccggcaccuccuccaacaccaucuccgccggcugggagcccaacgaggagaacgaggacgagcgcgaccgccaccucuccuucuccggcuccggcaucgacgacgacgaggacuucaucuccuccaccaucuccaccaccccccgcgccuucgaccacaccaagcagaaccaggacuggacccaguggaaccccucccacuccaaccccgagguccuccuccagaccaccacccgcaugaccgacgucgaccgcaacggcaccaccgccuacgagggcaacuggaaccccgaggcccaccccccccucauccaccacgagcaccacgaggaggaggagaccccccacuccaccuccaccauccaggccacccccuccuccaccaccgaggagaccgccacccagaaggagcagugguucggcaaccgcuggcacgagggcuaccgccagacccccaaggaggacucccacuccaccaccggcaccgccgccgccuccgcccacaccucccaccccaugcagggccgcaccacccccucccccgaggacuccuccuggaccgacuucuucaaccccaucucccaccccaugggccgcggccaccaggccggccgccgcauggacauggacuccucccacuccaucacccuccagcccaccgccaaccccaacaccggccucgucgaggaccucgaccgcaccggcccccucuccaugaccacccagcaguccaacucccaguccuucuccaccucccacgagggccucgaggaggacaaggaccaccccaccaccuccacccucaccuccuccaaccgcaacgacgucaccggcggccgccgcgaccccaaccacuccgagggcuccaccacccuccucgagggcuacaccucccacuacccccacaccaaggagucccgcaccuucauccccgucaccuccgccaagaccggcuccuucggcgucaccgccgucaccgucggcgacuccaacuccaacgucaaccgcucccucuccggcgaccaggacaccuuccaccccuccggcggcucccacaccacccacggcuccgaguccgacggccacucccacggcucccaggagggcggcgccaacaccaccuccggccccauccgcaccccccagauccccgaguggcucaucauccucgccucccuccucgcccucgcccucauccucgccgucugcaucgccgucaacucccgccgccgcugcggccagaagaagaagcucgucaucaacuccggcaacggcgccgucgaggaccgcaagcccuccggccucaacggcgaggccuccaagucccaggagaugguccaccucgucaacaaggaguccuccgagacccccgaccaguucaugaccgccgacgagacccgcaaccuccagaacgucgacaugaagaucggcgucuga

SEQ ID NO: 41007 - RNA, 1179 nt, Artificial Sequence
  derived and/or modified sequence opt2 from CD46__Homo_sapiens__NP_002380
auggagccccccggccgccgcgagugccccuuccccuccuggcgcuuccccggccuccuccucgccgccaugguccuccuccucuacuccuucuccgacgccugcgaggagccccccaccuucgaggccauggagcucaucggcaagcccaagcccuacuacgagaucggcgagcgcgucgacuacaagugcaagaagggcuacuucuacauccccccccucgccacccacaccaucugcgaccgcaaccacaccuggcuccccgucuccgacgacgccugcuaccgcgagaccugccccuacauccgcgacccccucaacggccaggccguccccgccaacggcaccuacgaguucggcuaccagaugcacuucaucugcaacgagggcuacuaccucaucggcgaggagauccucuacugcgagcucaagggcuccgucgccaucugguccggcaagccccccaucugcgagaagguccucugcacccccccccccaagaucaagaacggcaagcacaccuucuccgaggucgaggucuucgaguaccucgacgccgucaccuacuccugcgaccccgcccccggccccgaccccuucucccucaucggcgaguccaccaucuacugcggcgacaacuccgucuggucccgcgccgcccccgagugcaaggucgucaagugccgcuuccccgucgucgagaacggcaagcagaucuccggcuucggcaagaaguucuacuacaaggccaccgucauguucgagugcgacaagggcuucuaccucgacggcuccgacaccaucgucugcgacuccaacuccaccugggacccccccguccccaagugccucaagguccucccccccuccuccaccaagccccccgcccucucccacuccgucuccaccuccuccaccaccaagucccccgccuccuccgccuccggcccccgccccaccuacaagccccccgucuccaacuaccccggcuaccccaagcccgaggagggcauccucgacucccucgacgucugggucaucgccgucaucgucaucgccaucgucgucggcgucgccgucaucugcgucguccccuaccgcuaccuccagcgccgcaagaagaagggcaccuaccucaccgacgagacccaccgcgaggucaaguucaccucccucuga

SEQ ID NO: 41008 - RNA, 972 nt, Artificial Sequence
  derived and/or modified sequence opt2 from CD47__Homo_sapiens__NP_001768
auguggccccucgucgccgcccuccuccucggcuccgccugcugcggcuccgcccagcuccucuucaacaagaccaaguccgucgaguucaccuucugcaacgacaccgucgucauccccugcuucgucaccaacauggaggcccagaacaccaccgaggucuacgucaaguggaaguucaagggccgcgacaucuacaccuucgacggcgcccucaacaaguccaccguccccaccgacuucuccuccgccaagaucgaggucucccagcuccucaagggcgacgccucccucaagauggacaaguccgacgccgucucccacaccggcaacuacaccugcgaggucaccgagcucacccgcgagggcgagaccaucaucgagcucaaguaccgcgucgucuccugguucucccccaacgagaacauccucaucgucaucuuccccaucuucgccauccuccucuucuggggccaguucggcaucaagacccucaaguaccgcuccggcggcauggacgagaagaccaucgcccuccucgucgccggccucgucaucaccgucaucgucaucgucggcgccauccucuucguccccggcgaguacucccucaagaacgccaccggccucggccucaucgucaccuccaccggcauccucauccuccuccacuacuacgucuucuccaccgccaucggccucaccuccuucgucaucgccauccucgucauccaggucaucgccuacauccucgccgucgucggccucucccucugcaucgccgccugcauccccaugcacggcccccuccucaucuccggccucuccauccucgcccucgcccagcuccucggccucgucuacaugaaguucgucgccuccaaccagaagaccauccagcccccccgcaaggccgucgaggagccccucaacgccuucaaggaguccaagggcaugaugaacgacgaguga

SEQ ID NO: 41009 - RNA, 732 nt, Artificial Sequence
  derived and/or modified sequence opt2 from CD48__Homo_sapiens__NP_001769
augugcucccgcggcugggacuccugccucgcccucgagcuccuccuccucccccucucccuccucgucaccuccauccagggccaccucguccacaugaccgucgucuccggcuccaacgucacccucaacaucuccgagucccuccccgagaacuacaagcagcucaccugguucuacaccuucgaccagaagaucgucgagugggacucccgcaaguccaaguacuucgaguccaaguucaagggccgcguccgccucgacccccaguccggcgcccucuacaucuccaagguccagaaggaggacaacuccaccuacaucaugcgcguccucaagaagaccggcaacgagcaggaguggaagaucaagcuccagguccucgaccccguccccaagcccgucaucaagaucgagaagaucgaggacauggacgacaacugcuaccucaagcucuccugcgucauccccggcgaguccgucaacuacaccugguacggcgacaagcgccccuuccccaaggagcuccagaacuccguccucgagaccacccucaugccccacaacuacucccgcugcuacaccugccaggucuccaacuccgucuccuccaagaacggcaccgucugccucuccccccccugcacccucgcccgcuccuucggcgucgaguggaucgccuccuggcucgucgucaccguccccaccauccucggccuccuccucaccuga

SEQ ID NO: 41010 - RNA, 1377 nt, Artificial Sequence
  derived and/or modified sequence opt2 from CD4__Homo_sapiens__NP_000607
augaaccgcggcguccccuuccgccaccuccuccucguccuccagcucgcccuccuccccgccgccacccagggcaagaaggucguccucggcaagaagggcgacaccgucgagcucaccugcaccgccucccagaagaaguccauccaguuccacuggaagaacuccaaccagaucaagauccucggcaaccagggcuccuuccucaccaagggccccuccaagcucaacgaccgcgccgacucccgccgcucccucugggaccagggcaacuucccccucaucaucaagaaccucaagaucgaggacuccgacaccuacaucugcgaggucgaggaccagaaggaggagguccagcuccucgucuucggccucaccgccaacuccgacacccaccuccuccagggccagucccucacccucacccucgaguccccccccggcuccucccccuccguccagugccgcuccccccgcggcaagaacauccagggcggcaagacccucuccgucucccagcucgagcuccaggacuccggcaccuggaccugcaccguccuccagaaccagaagaaggucgaguucaagaucgacaucgucguccucgccuuccagaaggccuccuccaucgucuacaagaaggagggcgagcaggucgaguucuccuucccccucgccuucaccgucgagaagcucaccggcuccggcgagcucugguggcaggccgagcgcgccuccuccuccaaguccuggaucaccuucgaccucaagaacaaggaggucuccgucaagcgcgucacccaggaccccaagcuccagaugggcaagaagcucccccuccaccucacccucccccaggcccucccccaguacgccggcuccggcaaccucacccucgcccucgaggccaagaccggcaagcuccaccaggaggucaaccucgucgucaugcgcgccacccagcuccagaagaaccucaccugcgaggucuggggccccaccucccccaagcucaugcucucccucaagcucgagaacaaggaggccaaggucuccaagcgcgagaaggccgucuggguccucaaccccgaggccggcauguggcagugccuccucuccgacuccggccagguccuccucgaguccaacaucaagguccuccccaccugguccacccccguccagcccauggcccucaucguccucggcggcgucgccggccuccuccucuucaucggccucggcaucuucuucugcguccgcugccgccaccgccgccgccaggccgagcgcaugucccagaucaagcgccuccucuccgagaagaagaccugccagugcccccaccgcuuccagaagaccugcucccccaucuga

SEQ ID NO: 41011 - RNA, 1146 nt, Artificial Sequence
  derived and/or modified sequence opt2 from CD55__Homo_sapiens__NP_000565
augaccgucgcccgccccuccguccccgccgcccucccccuccucggcgagcucccccgccuccuccuccucguccuccucugccuccccgccgucuggggcgacugcggccucccccccgacguccccaacgcccagcccgcccucgagggccgcaccuccuuccccgaggacaccgucaucaccuacaagugcgaggaguccuucgucaagauccccggcgagaaggacuccgucaucugccucaagggcucccagugguccgacaucgaggaguucugcaaccgcuccugcgagguccccacccgccucaacuccgccucccucaagcagcccuacaucacccagaacuacuuccccgucggcaccgucgucgaguacgagugccgccccggcuaccgccgcgagcccucccucucccccaagcucaccugccuccagaaccucaagugguccaccgccgucgaguucugcaagaagaaguccugccccaaccccggcgagauccgcaacggccagaucgacguccccggcggcauccucuucggcgccaccaucuccuucuccugcaacaccggcuacaagcucuucggcuccaccuccuccuucugccucaucuccggcuccuccguccagugguccgacccccuccccgagugccgcgagaucuacugccccgcccccccccagaucgacaacggcaucauccagggcgagcgcgaccacuacggcuaccgccaguccgucaccuacgccugcaacaagggcuucaccaugaucggcgagcacuccaucuacugcaccgucaacaacgacgagggcgagugguccggccccccccccgagugccgcggcaagucccucaccuccaaggucccccccaccguccagaagcccaccaccgucaacguccccaccaccgaggucucccccaccucccagaagaccaccaccaagaccaccacccccaacgcccaggccacccgcuccacccccgucucccgcaccaccaagcacuuccacgagaccacccccaacaagggcuccggcaccaccuccggcaccacccgccuccucuccggccacaccugcuucacccucaccggccuccucggcacccucgucaccaugggccuccucaccuga

SEQ ID NO: 41012 - RNA, 387 nt, Artificial Sequence
  derived and/or modified sequence opt2 from CD59__Homo_sapiens__NP_001120695
augggcauccagggcggcuccguccucuucggccuccuccucguccucgccgucuucugccacuccggccacucccuccagugcuacaacugccccaaccccaccgccgacugcaagaccgccgucaacugcuccuccgacuucgacgccugccucaucaccaaggccggccuccaggucuacaacaagugcuggaaguucgagcacugcaacuucaacgacgucaccacccgccuccgcgagaacgagcucaccuacuacugcugcaagaaggaccucugcaacuucaacgagcagcucgagaacggcggcaccucccucuccgagaagaccguccuccuccucgucacccccuuccucgccgccgccuggucccuccaccccuga

SEQ ID NO: 41013 - RNA, 1488 nt, Artificial Sequence
  derived and/or modified sequence opt2 from CD5__Homo_sapiens__NP_055022
augcccaugggcucccuccagccccucgccacccucuaccuccucggcaugcucgucgccuccugccucggccgccucuccugguacgaccccgacuuccaggcccgccucacccgcuccaacuccaagugccagggccagcucgaggucuaccucaaggacggcuggcacauggucugcucccaguccuggggccgcuccuccaagcagugggaggaccccucccaggccuccaaggucugccagcgccucaacugcggcgucccccucucccucggccccuuccucgucaccuacaccccccaguccuccaucaucugcuacggccagcucggcuccuucuccaacugcucccacucccgcaacgacaugugccacucccucggccucaccugccucgagccccagaagaccaccccccccaccacccgccccccccccaccaccacccccgagcccaccgcccccccccgccuccagcucgucgcccaguccggcggccagcacugcgccggcgucgucgaguucuacuccggcucccucggcggcaccaucuccuacgaggcccaggacaagacccaggaccucgagaacuuccucugcaacaaccuccagugcggcuccuuccucaagcaccuccccgagaccgaggccggccgcgcccaggaccccggcgagccccgcgagcaccagccccuccccauccaguggaagauccagaacuccuccugcaccucccucgagcacugcuuccgcaagaucaagccccagaaguccggccgcguccucgcccuccucugcuccggcuuccagcccaagguccagucccgccucgucggcggcuccuccaucugcgagggcaccgucgagguccgccagggcgcccagugggccgcccucugcgacuccuccuccgcccgcuccucccuccgcugggaggaggucugccgcgagcagcagugcggcuccgucaacuccuaccgcguccucgacgccggcgaccccaccucccgcggccucuucugcccccaccagaagcucucccagugccacgagcucugggagcgcaacuccuacugcaagaaggucuucgucaccugccaggaccccaaccccgccggccucgccgccggcaccgucgccuccaucauccucgcccucguccuccucgucguccuccucgucgucugcggcccccucgccuacaagaagcucgucaagaaguuccgccagaagaagcagcgccaguggaucggccccaccggcaugaaccagaacauguccuuccaccgcaaccacaccgccaccguccgcucccacgccgagaaccccaccgccucccacgucgacaacgaguacucccagcccccccgcaacucccaccucuccgccuaccccgcccucgagggcgcccuccaccgcuccuccaugcagcccgacaacuccuccgacuccgacuacgaccuccacggcgcccagcgccucuga

SEQ ID NO: 41014 - RNA, 1044 nt, Artificial Sequence
  derived and/or modified sequence opt2 from CD5L__Homo_sapiens__NP_005885
auggcccuccucuucucccucauccucgccaucugcacccgccccggcuuccucgccucccccuccggcguccgccucgucggcggccuccaccgcugcgagggccgcgucgaggucgagcagaagggccaguggggcaccgucugcgacgacggcugggacaucaaggacgucgccguccucugccgcgagcucggcugcggcgccgccuccggcacccccuccggcauccucuacgagccccccgccgagaaggagcagaagguccucauccaguccgucuccugcaccggcaccgaggacacccucgcccagugcgagcaggaggaggucuacgacugcucccacgacgaggacgccggcgccuccugcgagaaccccgaguccuccuucucccccguccccgagggcguccgccucgccgacggccccggccacugcaagggccgcgucgaggucaagcaccagaaccagugguacaccgucugccagaccggcuggucccuccgcgccgccaaggucgucugccgccagcucggcugcggccgcgccguccucacccagaagcgcugcaacaagcacgccuacggccgcaagcccaucuggcucucccagauguccugcuccggccgcgaggccacccuccaggacugccccuccggccccuggggcaagaacaccugcaaccacgacgaggacaccugggucgagugcgaggaccccuucgaccuccgccucgucggcggcgacaaccucugcuccggccgccucgagguccuccacaagggcgucuggggcuccgucugcgacgacaacuggggcgagaaggaggaccaggucgucugcaagcagcucggcugcggcaagucccucucccccuccuuccgcgaccgcaagugcuacggccccggcgucggccgcaucuggcucgacaacguccgcugcuccggcgaggagcagucccucgagcagugccagcaccgcuucuggggcuuccacgacugcacccaccaggaggacgucgccgucaucugcuccggcuga

SEQ ID NO: 41015 - RNA, 648 nt, Artificial Sequence
  derived and/or modified sequence opt2 from CD63__Homo_sapiens__NP_001244321
auggccgucgagggcggcaugaagugcgucaaguuccuccucuacguccuccuccucgccuucugcggcgccacccccggcucccuccuccccgucgucaucaucgccgucggcgucuuccucuuccucgucgccuucgucggcugcugcggcgccugcaaggagaacuacugccucaugaucaccuucgccaucuuccucucccucaucaugcucgucgaggucgccgccgccaucgccggcuacgucuuccgcgacaaggucauguccgaguucaacaacaacuuccgccagcagauggagaacuaccccaagaacaaccacaccgccuccauccucgaccgcaugcaggccgacuucaagugcugcggcgccgccaacuacaccgacugggagaagauccccuccauguccaagaaccgcguccccgacuccugcugcaucaacgucaccgucggcugcggcaucaacuucaacgagaaggccauccacaaggagggcugcgucgagaagaucggcggcuggcuccgcaagaacguccucgucgucgccgccgccgcccucggcaucgccuucgucgagguccucggcaucgucuucgccugcugccucgucaaguccauccgcuccggcuacgaggucauguga

SEQ ID NO: 41016 - RNA, 984 nt, Artificial Sequence
  derived and/or modified sequence opt2 from CD68__Homo_sapiens__NP_001035148
augcgccucgccguccucuucuccggcgcccuccucggccuccucgccgaguccaccggcaccaccucccaccgcaccaccaagucccacaagaccaccacccaccgcaccaccaccaccggcaccaccucccacggccccaccaccgccacccacaaccccaccaccaccucccacggcaacgucaccguccaccccaccuccaacuccaccgccaccucccagggccccuccaccgccacccacucccccgccaccaccucccacggcaacgccaccguccaccccaccuccaacuccaccgccaccucccccggcuucaccuccuccgcccaccccgagccccccccccccucccccucccccucccccaccuccaaggagaccaucggcgacuacaccuggaccaacggcucccagcccugcguccaccuccaggcccagauccagauccgcgucauguacaccacccagggcggcggcgaggccuggggcaucuccguccucaaccccaacaagaccaagguccagggcuccugcgagggcgcccacccccaccuccuccucuccuuccccuacggccaccucuccuucggcuucaugcaggaccuccagcagaaggucgucuaccucuccuacauggccgucgaguacaacgucuccuucccccacgccgcccaguggaccuucuccgcccagaacgccucccuccgcgaccuccaggccccccucggccaguccuucuccugcuccaacuccuccaucauccucucccccgccguccaccucgaccuccucucccuccgccuccaggccgcccagcucccccacaccggcgucuucggccaguccuucuccugccccuccgaccgcuccauccuccucccccucaucaucggccucauccuccucggccuccucgcccucguccucaucgccuucugcaucauccgccgccgccccuccgccuaccaggcccucuga

SEQ ID NO: 41017 - RNA, 600 nt, Artificial Sequence
  derived and/or modified sequence opt2 from CD69__Homo_sapiens__NP_001772
auguccuccgagaacugcuucgucgccgagaacuccucccuccaccccgaguccggccaggagaacgacgccaccuccccccacuucuccacccgccacgagggcuccuuccagguccccguccucugcgccgucaugaacgucgucuucaucaccauccucaucaucgcccucaucgcccucuccgucggccaguacaacugccccggccaguacaccuucuccaugcccuccgacucccacgucuccuccugcuccgaggacugggucggcuaccagcgcaagugcuacuucaucuccaccgucaagcgcuccuggaccuccgcccagaacgccugcuccgagcacggcgccacccucgccgucaucgacuccgagaaggacaugaacuuccucaagcgcuacgccggccgcgaggagcacugggucggccucaagaaggagcccggccaccccuggaagugguccaacggcaaggaguucaacaacugguucaacgucaccggcuccgacaagugcgucuuccucaagaacaccgaggucuccuccauggagugcgagaagaaccucuacuggaucugcaacaagcccuacaaguga

SEQ ID NO: 41018 - RNA, 1806 nt, Artificial Sequence
  derived and/or modified sequence opt2 from CD6__Homo_sapiens__NP_001241679
auguggcucuucuucggcaucaccggccuccucaccgccgcccucuccggccaccccucccccgccccccccgaccagcucaacaccuccuccgccgaguccgagcucugggagcccggcgagcgccuccccguccgccucaccaacggcuccuccuccugcuccggcaccgucgagguccgccucgaggccuccugggagcccgccugcggcgcccucugggacucccgcgccgccgaggccgucugccgcgcccucggcugcggcggcgccgaggccgccucccagcucgccccccccacccccgagcucccccccccccccgccgccggcaacaccuccgucgccgccaacgccacccucgccggcgcccccgcccuccucugcuccggcgccgaguggcgccucugcgaggucgucgagcacgccugccgcuccgacggccgccgcgcccgcgucaccugcgccgagaaccgcgcccuccgccucgucgacggcggcggcgccugcgccggccgcgucgagaugcucgagcacggcgaguggggcuccgucugcgacgacaccugggaccucgaggacgcccacgucgucugccgccagcucggcugcggcugggccguccaggcccuccccggccuccacuucacccccggccgcggccccauccaccgcgaccaggucaacugcuccggcgccgaggccuaccucugggacugccccggccuccccggccagcacuacugcggccacaaggaggacgccggcgccgucugcuccgagcaccaguccuggcgccucaccggcggcgccgaccgcugcgagggccaggucgagguccacuuccgcggcgucuggaacaccgucugcgacuccgagugguaccccuccgaggccaagguccucugccagucccucggcugcggcaccgccgucgagcgccccaagggccucccccacucccucuccggccgcauguacuacuccugcaacggcgaggagcucacccucuccaacugcuccuggcgcuucaacaacuccaaccucugcucccagucccucgccgcccgcguccucugcuccgccucccgcucccuccacaaccucuccacccccgagguccccgccuccguccagaccgucaccaucgaguccuccgucaccgucaagaucgagaacaaggagucccgcgagcucaugcuccucauccccuccaucguccucggcauccuccuccucggcucccucaucuucaucgccuucauccuccuccgcaucaagggcaaguacgucuucaugcuccccauccagguccaggcccccccccccgaggacuccgacuccggcuccgacuccgacuacgagcacuacgacuucuccgcccagccccccgucgcccucaccaccuucuacaacucccagcgccaccgcgucaccgacgaggagguccagcagucccgcuuccagaugcccccccucgaggagggccucgaggagcuccacgccucccacauccccaccgccaaccccggccacugcaucaccgacccccccucccucggcccccaguaccacccccgcuccaacuccgaguccuccaccuccuccggcgaggacuacugcaacucccccaaguccaagcucccccccuggaacccccaggucuucuccuccgagcgcuccuccuuccucgagcagccccccaaccucgagcucgccggcacccagcccgccuucuccggcucccccuccccccagcccgacuccaccgacaacgacgacuacgacgacaucuccgccgccuga

SEQ ID NO: 41019 - RNA, 1080 nt, Artificial Sequence
  derived and/or modified sequence opt2 from CD72__Homo_sapiens__NP_001773
auggccgaggccaucaccuacgccgaccuccgcuucgucaaggccccccucaagaaguccaucuccucccgccucggccaggaccccggcgccgacgacgacggcgagaucaccuacgagaacguccagguccccgccguccucggcguccccuccucccucgccuccuccguccucggcgacaaggccgccgucaaguccgagcagcccaccgccuccuggcgcgccgucaccucccccgccgucggccgcauccuccccugccgcaccaccugccuccgcuaccuccuccucggccuccuccucaccugccuccuccucggcgucaccgccaucugccucggcguccgcuaccuccaggucucccagcagcuccagcagaccaaccgcguccucgaggucaccaacuccucccuccgccagcagcuccgccucaagaucacccagcucggccaguccgccgaggaccuccagggcucccgccgcgagcucgcccagucccaggaggcccuccaggucgagcagcgcgcccaccaggccgccgagggccagcuccaggccugccaggccgaccgccagaagaccaaggagacccuccaguccgaggagcagcagcgccgcgcccucgagcagaagcucuccaacauggagaaccgccucaagcccuucuucaccugcggcuccgccgacaccugcugccccuccggcuggaucaugcaccagaaguccugcuucuacaucucccucaccuccaagaacuggcaggagucccagaagcagugcgagacccucuccuccaagcucgccaccuucuccgagaucuacccccagucccacuccuacuacuuccucaacucccuccuccccaacggcggcuccggcaacuccuacuggaccggccucuccuccaacaaggacuggaagcucaccgacgacacccagcgcacccgcaccuacgcccaguccuccaagugcaacaagguccacaagaccugguccugguggacccucgaguccgaguccugccgcuccucccuccccuacaucugcgagaugaccgccuuccgcuuccccgacuga

SEQ ID NO: 41020 - RNA, 483 nt, Artificial Sequence
  derived and/or modified sequence opt2 from CD74__Homo_sapiens__NP_001020329
augcaccgccgccgcucccgcuccugccgcgaggaccagaagcccgucauggacgaccagcgcgaccucaucuccaacaacgagcagcuccccaugcucggccgccgccccggcgcccccgaguccaagugcucccgcggcgcccucuacaccggcuucuccauccucgucacccuccuccucgccggccaggccaccaccgccuacuuccucuaccagcagcagggccgccucgacaagcucaccgucaccucccagaaccuccagcucgagaaccuccgcaugaagcuccccaagccccccaagcccgucuccaagaugcgcauggccaccccccuccucaugcaggcccuccccaugggcgcccucccccagggccccaugcagaacgccaccaaguacggcaacaugaccgaggaccacgucaugcaccuccuccagucccacuggaacuggcgcacccgccuccucggcugggucuga

SEQ ID NO: 41021 - RNA, 681 nt, Artificial Sequence
  derived and/or modified sequence opt2 from CD79A__Homo_sapiens__NP_001774
augcccggcggccccggcguccuccaggcccuccccgccaccaucuuccuccucuuccuccucuccgccgucuaccucggccccggcugccaggcccucuggaugcacaagguccccgccucccucauggucucccucggcgaggacgcccacuuccagugcccccacaacuccuccaacaacgccaacgucaccugguggcgcguccuccacggcaacuacaccuggccccccgaguuccucggccccggcgaggaccccaacggcacccucaucauccagaacgucaacaagucccacggcggcaucuacgucugccgcguccaggagggcaacgaguccuaccagcaguccugcggcaccuaccuccgcguccgccagccccccccccgccccuuccucgacaugggcgagggcaccaagaaccgcaucaucaccgccgagggcaucauccuccucuucugcgccgucguccccggcacccuccuccucuuccgcaagcgcuggcagaacgagaagcucggccucgacgccggcgacgaguacgaggacgagaaccucuacgagggccucaaccucgacgacugcuccauguacgaggacaucucccgcggccuccagggcaccuaccaggacgucggcucccucaacaucggcgacguccagcucgagaagcccuga

SEQ ID NO: 41022 - RNA, 690 nt, Artificial Sequence
  derived and/or modified sequence opt2 from CD79B__Homo_sapiens__NP_000617
auggcccgccucgcccucucccccguccccucccacuggauggucgcccuccuccuccuccucuccgccgagcccguccccgccgcccgcuccgaggaccgcuaccgcaaccccaagggcuccgccugcucccgcaucuggcaguccccccgcuucaucgcccgcaagcgcggcuucaccgucaagaugcacugcuacaugaacuccgccuccggcaacgucuccuggcucuggaagcaggagauggacgagaacccccagcagcucaagcucgagaagggccgcauggaggagucccagaacgagucccucgccacccucaccauccagggcauccgcuucgaggacaacggcaucuacuucugccagcagaagugcaacaacaccuccgaggucuaccagggcugcggcaccgagcuccgcgucaugggcuucuccacccucgcccagcucaagcagcgcaacacccucaaggacggcaucaucaugauccagacccuccucaucauccucuucaucaucguccccaucuuccuccuccucgacaaggacgacuccaaggccggcauggaggaggaccacaccuacgagggccucgacaucgaccagaccgccaccuacgaggacaucgucacccuccgcaccggcgaggucaagugguccgucggcgagcaccccggccaggaguga

SEQ ID NO: 41023 - RNA, 723 nt, Artificial Sequence
  derived and/or modified sequence opt2 from CD7__Homo_sapiens__NP_006128
auggccggccccccccgccuccuccuccucccccuccuccucgcccucgcccgcggccuccccggcgcccucgccgcccaggagguccagcaguccccccacugcaccaccguccccgucggcgccuccgucaacaucaccugcuccaccuccggcggccuccgcggcaucuaccuccgccagcucggcccccagccccaggacaucaucuacuacgaggacggcgucguccccaccaccgaccgccgcuuccgcggccgcaucgacuucuccggcucccaggacaaccucaccaucaccaugcaccgccuccagcucuccgacaccggcaccuacaccugccaggccaucaccgaggucaacgucuacggcuccggcacccucguccucgucaccgaggagcagucccagggcuggcaccgcugcuccgacgcccccccccgcgccuccgcccuccccgccccccccaccggcuccgcccuccccgacccccagaccgccuccgcccuccccgacccccccgccgccuccgcccuccccgccgcccucgccgucaucuccuuccuccucggccucggccucggcgucgccugcguccucgcccgcacccagaucaagaagcucugcuccuggcgcgacaagaacuccgccgccugcgucgucuacgaggacaugucccacucccgcugcaacacccucuccucccccaaccaguaccaguga

SEQ ID NO: 41024 - RNA, 867 nt, Artificial Sequence
  derived and/or modified sequence opt2 from CD80__Homo_sapiens__NP_005182
augggccacacccgccgccagggcaccucccccuccaagugccccuaccucaacuucuuccagcuccucguccucgccggccucucccacuucugcuccggcgucauccacgucaccaaggaggucaaggaggucgccacccucuccugcggccacaacgucuccgucgaggagcucgcccagacccgcaucuacuggcagaaggagaagaagaugguccucaccaugauguccggcgacaugaacaucuggcccgaguacaagaaccgcaccaucuucgacaucaccaacaaccucuccaucgucauccucgcccuccgccccuccgacgagggcaccuacgagugcgucguccucaaguacgagaaggacgccuucaagcgcgagcaccucgccgaggucacccucuccgucaaggccgacuuccccacccccuccaucuccgacuucgagauccccaccuccaacauccgccgcaucaucugcuccaccuccggcggcuuccccgagccccaccucuccuggcucgagaacggcgaggagcucaacgccaucaacaccaccgucucccaggaccccgagaccgagcucuacgccgucuccuccaagcucgacuucaacaugaccaccaaccacuccuucaugugccucaucaaguacggccaccuccgcgucaaccagaccuucaacuggaacaccaccaagcaggagcacuuccccgacaaccuccuccccuccugggccaucacccucaucuccgucaacggcaucuucgucaucugcugccucaccuacugcuucgccccccgcugccgcgagcgccgccgcaacgagcgccuccgccgcgaguccguccgccccgucuga

SEQ ID NO: 41025 - RNA, 711 nt, Artificial Sequence
  derived and/or modified sequence opt2 from CD81__Homo_sapiens__NP_004347
augggcgucgagggcugcaccaagugcaucaaguaccuccucuucgucuucaacuucgucuucuggcucgccggcggcgucauccucggcgucgcccucuggcuccgccacgacccccagaccaccaaccuccucuaccucgagcucggcgacaagcccgcccccaacaccuucuacgucggcaucuacauccucaucgccgucggcgccgucaugauguucgucggcuuccucggcugcuacggcgccauccaggagucccagugccuccucggcaccuucuucaccugccucgucauccucuucgccugcgaggucgccgccggcaucuggggcuucgucaacaaggaccagaucgccaaggacgucaagcaguucuacgaccaggcccuccagcaggccgucgucgacgacgacgccaacaacgccaaggccgucgucaagaccuuccacgagacccucgacugcugcggcuccuccacccucaccgcccucaccaccuccguccucaagaacaaccucugccccuccggcuccaacaucaucuccaaccucuucaaggaggacugccaccagaagaucgacgaccucuucuccggcaagcucuaccucaucggcaucgccgccaucgucgucgccgucaucaugaucuucgagaugauccucuccaugguccucugcugcggcauccgcaacuccuccgucuacuga

SEQ ID NO: 41026 - RNA, 729 nt, Artificial Sequence
  derived and/or modified sequence opt2 from CD82__Homo_sapiens__NP_001020015
augggcuccgccugcaucaaggucaccaaguacuuccucuuccucuucaaccucaucuucuucauccucggcgccgucauccucggcuucggcgucuggauccucgccgacaaguccuccuucaucuccguccuccagaccuccuccuccucccuccgcaugggcgccuacgucuucaucggcgucggcgccgucaccaugcucaugggcuuccucggcugcaucggcgccgucaacgagguccgcugccuccucggccuccucaagcaggagaugggcggcaucgucaccgagcucauccgcgacuacaacuccucccgcgaggacucccuccaggacgccugggacuacguccaggcccaggucaagugcugcggcugggucuccuucuacaacuggaccgacaacgccgagcucaugaaccgccccgaggucaccuaccccugcuccugcgaggucaagggcgaggaggacaacucccucuccguccgcaagggcuucugcgaggcccccggcaaccgcacccaguccggcaaccaccccgaggacuggcccgucuaccaggagggcugcauggagaagguccaggccuggcuccaggagaaccucggcaucauccucggcgucggcgucggcgucgccaucaucgagcuccucggcaugguccucuccaucugccucugccgccacguccacuccgaggacuacuccaagguccccaaguacuga

SEQ ID NO: 41027 - RNA, 618 nt, Artificial Sequence
  derived and/or modified sequence opt2 from CD83__Homo_sapiens__NP_004224
augucccgcggccuccagcuccuccuccucuccugcgccuacucccucgcccccgccacccccgaggucaaggucgccugcuccgaggacgucgaccuccccugcaccgcccccugggacccccagguccccuacaccgucuccugggucaagcuccucgagggcggcgaggagcgcauggagaccccccaggaggaccaccuccgcggccagcacuaccaccagaagggccagaacggcuccuucgacgcccccaacgagcgccccuacucccucaagauccgcaacaccaccuccugcaacuccggcaccuaccgcugcacccuccaggaccccgacggccagcgcaaccucuccggcaaggucauccuccgcgucaccggcugccccgcccagcgcaaggaggagaccuucaagaaguaccgcgccgagaucguccuccuccucgcccucgucaucuucuaccucacccucaucaucuucaccugcaaguucgcccgccuccaguccaucuuccccgacuucuccaaggccggcauggagcgcgccuuccuccccgucaccucccccaacaagcaccucggccucgucaccccccacaagaccgagcucgucuga

SEQ ID NO: 41028 - RNA, 1038 nt, Artificial Sequence
  derived and/or modified sequence opt2 from CD84__Homo_sapiens__NP_001171808
auggcccagcaccaccucuggauccuccuccucugccuccagaccuggcccgaggccgccggcaaggacuccgagaucuucaccgucaacggcauccucggcgaguccgucaccuuccccgucaacauccaggagccccgccaggucaagaucaucgccuggaccuccaagaccuccgucgccuacgucacccccggcgacuccgagaccgcccccgucgucaccgucacccaccgcaacuacuacgagcgcauccacgcccucggccccaacuacaaccucgucaucuccgaccuccgcauggaggacgccggcgacuacaaggccgacaucaacacccaggccgaccccuacaccaccaccaagcgcuacaaccuccagaucuaccgccgccucggcaagcccaagaucacccagucccucauggccuccgucaacuccaccugcaacgucacccucaccugcuccgucgagaaggaggagaagaacgucaccuacaacugguccccccucggcgaggagggcaacguccuccagaucuuccagacccccgaggaccaggagcucaccuacaccugcaccgcccagaaccccgucuccaacaacuccgacuccaucuccgcccgccagcucugcgccgacaucgccaugggcuuccgcacccaccacaccggccuccucuccguccucgccauguucuuccuccucguccucauccucuccuccgucuuccucuuccgccucuucaagcgccgccagggccgcaucuuccccgagggcuccugccucaacaccuucaccaagaaccccuacgccgccuccaagaagaccaucuacaccuacaucauggccucccgcaacacccagcccgccgagucccgcaucuacgacgagauccuccaguccaagguccuccccuccaaggaggagcccgucaacaccgucuacuccgagguccaguucgccgacaagaugggcaaggccuccacccaggacuccaagccccccggcaccuccuccuacgagaucgucaucuga

SEQ ID NO: 41029 - RNA, 654 nt, Artificial Sequence
  derived and/or modified sequence opt2 from CD86__Homo_sapiens__NP_001193853
auggacccccagugcaccaugggccucuccaacauccucuucgucauggccuuccuccucuccgccaacuucucccagcccgagaucguccccaucuccaacaucaccgagaacgucuacaucaaccucaccugcuccuccauccacggcuaccccgagcccaagaagauguccguccuccuccgcaccaagaacuccaccaucgaguacgacggcaucaugcagaagucccaggacaacgucaccgagcucuacgacgucuccaucucccucuccgucuccuuccccgacgucaccuccaacaugaccaucuucugcauccucgagaccgacaagacccgccuccucuccucccccuucuccaucgagcucgaggacccccagcccccccccgaccacauccccuggaucaccgccguccuccccaccgucaucaucugcgucauggucuucugccucauccucuggaaguggaagaagaagaagcgcccccgcaacuccuacaagugcggcaccaacaccauggagcgcgaggaguccgagcagaccaagaagcgcgagaagauccacauccccgagcgcuccgacgaggcccagcgcgucuucaaguccuccaagaccuccuccugcgacaaguccgacaccugcuucuga

SEQ ID NO: 41030 - RNA, 708 nt, Artificial Sequence
  derived and/or modified sequence opt2 from CD8A__Homo_sapiens__NP_001759
auggcccuccccgucaccgcccuccuccucccccucgcccuccuccuccacgccgcccgccccucccaguuccgcgucuccccccucgaccgcaccuggaaccucggcgagaccgucgagcucaagugccagguccuccucuccaaccccaccuccggcugcuccuggcucuuccagccccgcggcgccgccgccucccccaccuuccuccucuaccucucccagaacaagcccaaggccgccgagggccucgacacccagcgcuucuccggcaagcgccucggcgacaccuucguccucacccucuccgacuuccgccgcgagaacgagggcuacuacuucugcuccgcccucuccaacuccaucauguacuucucccacuucguccccgucuuccuccccgccaagcccaccaccacccccgccccccgcccccccacccccgcccccaccaucgccucccagccccucucccuccgccccgaggccugccgccccgccgccggcggcgccguccacacccgcggccucgacuucgccugcgacaucuacaucugggccccccucgccggcaccugcggcguccuccuccucucccucgucaucacccucuacugcaaccaccgcaaccgccgccgcgucugcaagugcccccgccccgucgucaaguccggcgacaagcccucccucuccgcccgcuacgucuga

SEQ ID NO: 41031 - RNA, 597 nt, Artificial Sequence
  derived and/or modified sequence opt2 from CD8B__Homo_sapiens__NP_001171571
augcgcccccgccucuggcuccuccucgccgcccagcucaccguccuccacggcaacuccguccuccagcagacccccgccuacaucaagguccagaccaacaagauggucaugcucuccugcgaggccaagaucucccucuccaacaugcgcaucuacuggcuccgccagcgccaggcccccuccuccgacucccaccacgaguuccucgcccucugggacuccgccaagggcaccauccacggcgaggaggucgagcaggagaagaucgccgucuuccgcgacgccucccgcuucauccucaaccucaccuccgucaagcccgaggacuccggcaucuacuucugcaugaucgucggcucccccgagcucaccuucggcaagggcacccagcucuccgucgucgacuuccuccccaccaccgcccagcccaccaagaaguccacccucaagaagcgcgucugccgccucccccgccccgagacccagaagggccucaagggcaaggucuaccaggagccccucucccccaacgccugcauggacaccaccgccauccuccagccccaccgcuccugccucacccacggcuccuga

SEQ ID NO: 41032 - RNA, 1959 nt, Artificial Sequence
  derived and/or modified sequence opt2 from CD93__Homo_sapiens__NP_036204
auggccaccuccaugggccuccuccuccuccuccuccuccuccucacccagcccggcgccggcaccggcgccgacaccgaggccgucgucugcgucggcaccgccugcuacaccgcccacuccggcaagcucuccgccgccgaggcccagaaccacugcaaccagaacggcggcaaccucgccaccgucaaguccaaggaggaggcccagcacguccagcgcguccucgcccagcuccuccgccgcgaggccgcccucaccgcccgcauguccaaguucuggaucggccuccagcgcgagaagggcaagugccucgaccccucccucccccucaagggcuucuccugggucggcggcggcgaggacacccccuacuccaacuggcacaaggagcuccgcaacuccugcaucuccaagcgcugcgucucccuccuccucgaccucucccagccccuccuccccucccgccuccccaagugguccgagggccccugcggcucccccggcucccccggcuccaacaucgagggcuucgucugcaaguucuccuucaagggcaugugccgcccccucgcccucggcggccccggccaggucaccuacaccacccccuuccagaccaccuccuccucccucgaggccguccccuucgccuccgccgccaacgucgccugcggcgagggcgacaaggacgagacccagucccacuacuuccucugcaaggagaaggcccccgacgucuucgacuggggcuccuccggcccccucugcgucucccccaaguacggcugcaacuucaacaacggcggcugccaccaggacugcuucgagggcggcgacggcuccuuccucugcggcugccgccccggcuuccgccuccucgacgaccucgucaccugcgccucccgcaaccccugcuccuccucccccugccgcggcggcgccaccugcguccucggcccccacggcaagaacuacaccugccgcugcccccagggcuaccagcucgacuccucccagcucgacugcgucgacgucgacgagugccaggacucccccugcgcccaggagugcgucaacacccccggcggcuuccgcugcgagugcugggucggcuacgagcccggcggccccggcgagggcgccugccaggacgucgacgagugcgcccucggccgcucccccugcgcccagggcugcaccaacaccgacggcuccuuccacugcuccugcgaggagggcuacguccucgccggcgaggacggcacccagugccaggacgucgacgagugcgucggccccggcggcccccucugcgacucccucugcuucaacacccagggcuccuuccacugcggcugccuccccggcuggguccucgcccccaacggcgucuccugcaccaugggccccgucucccucggcccccccuccggcccccccgacgaggaggacaagggcgagaaggagggcuccaccgucccccgcgccgccaccgccucccccacccgcggccccgagggcacccccaaggccacccccaccaccucccgccccucccucuccuccgacgcccccaucaccuccgccccccucaagaugcucgcccccuccggcucccccggcgucuggcgcgagcccuccauccaccacgccaccgccgccuccggcccccaggagcccgccggcggcgacuccuccgucgccacccagaacaacgacggcaccgacggccagaagcuccuccucuucuacauccucggcaccgucgucgccauccuccuccuccucgcccucgcccucggccuccucgucuaccgcaagcgccgcgccaagcgcgaggagaagaaggagaagaagccccagaacgccgccgacuccuacuccuggguccccgagcgcgccgagucccgcgccauggagaaccaguacucccccacccccggcaccgacugcuga

SEQ ID NO: 41033 - RNA, 1710 nt, Artificial Sequence
  derived and/or modified sequence opt2 from CD96__Homo_sapiens__NP_005807
auggagaagaaguggaaguacugcgccgucuacuacaucauccagauccacuucgucaagggcgucugggagaagaccgucaacaccgaggagaacgucuacgccacccucggcuccgacgucaaccucaccugccagacccagaccgucggcuucuucguccagaugcagugguccaaggucaccaacaagaucgaccucaucgccgucuaccacccccaguacggcuucuacugcgccuacggccgccccugcgagucccucgucaccuucaccgagacccccgagaacggcuccaaguggacccuccaccuccgcaacauguccugcuccgucuccggccgcuacgagugcaugcucguccucuaccccgagggcauccagaccaagaucuacaaccuccucauccagacccacgucaccgccgacgaguggaacuccaaccacaccaucgagaucgagaucaaccagacccucgagauccccugcuuccagaacuccuccuccaagaucuccuccgaguucaccuacgccugguccgucgaggacaacggcacccaggagacccucaucucccagaaccaccucaucuccaacuccacccuccucaaggaccgcgucaagcucggcaccgacuaccgccuccaccucucccccguccagaucuucgacgacggccgcaaguucuccugccacauccgcgucggccccaacaagauccuccgcuccuccaccaccgucaaggucuucgccaagcccgagauccccgucaucgucgagaacaacuccaccgacguccucgucgagcgccgcuucaccugccuccucaagaacgucuuccccaaggccaacaucaccugguucaucgacggcuccuuccuccacgacgagaaggagggcaucuacaucaccaacgaggagcgcaagggcaaggacggcuuccucgagcucaaguccguccucacccgcguccacuccaacaagcccgcccaguccgacaaccucaccaucuggugcauggcccucucccccguccccggcaacaaggucuggaacaucuccuccgagaagaucaccuuccuccucggcuccgagaucuccuccaccgaccccccccucuccgucaccgaguccacccucgacacccagcccucccccgccuccuccgucucccccgcccgcuaccccgccaccuccuccgucacccucgucgacgucuccgcccuccgccccaacaccaccccccagcccuccaacuccuccaugaccacccgcggcuucaacuaccccuggaccuccuccggcaccgacaccaagaaguccgucucccgcauccccuccgagaccuacuccuccucccccuccggcgccggcuccacccuccacgacaacgucuucaccuccaccgcccgcgccuucuccgagguccccaccaccgccaacggcuccaccaagaccaaccacguccacaucaccggcaucgucgucaacaagcccaaggacggcauguccuggcccgucaucgucgccgcccuccucuucugcugcaugauccucuucggccucggcguccgcaaguggugccaguaccagaaggagaucauggagcgccccccccccuucaagcccccccccccccccaucaaguacaccugcauccaggagcccaacgaguccgaccuccccuaccacgagauggagacccucuga

SEQ ID NO: 41034 - RNA, 510 nt, Artificial Sequence
  derived and/or modified sequence opt2 from CD99__Homo_sapiens__NP_001116370
auggcccgcggcgccgcccucgcccuccuccucuucggccuccucggcguccucgucgccgcccccgacggcggcuucgaccucuccgacgcccuccccggcgacgacuucgaccucggcgacgccgucgucgacggcgagaacgacgacccccgcccccccaacccccccaagcccaugcccaaccccaaccccaaccaccccuccuccuccggcuccuucuccgacgccgaccucgccgacggcgucuccggcggcgagggcaagggcggcuccgacggcggcggcucccaccgcaaggagggcgaggaggccgacgcccccggcgucauccccggcaucgucggcgccgucgucgucgccgucgccggcgccaucuccuccuucaucgccuaccagaagaagaagcucugcuucaaggagaacgccgagcagggcgaggucgacauggagucccaccgcaacgccaacgccgagcccgccguccagcgcacccuccucgagaaguga

SEQ ID NO: 41035 - RNA, 687 nt, Artificial Sequence
  derived and/or modified sequence opt2 from CD9__Homo_sapiens__NP_001760
augcccgucaagggcggcaccaagugcaucaaguaccuccucuucggcuucaacuucaucuucuggcucgccggcaucgccguccucgccaucggccucuggcuccgcuucgacucccagaccaaguccaucuucgagcaggagaccaacaacaacaacuccuccuucuacaccggcgucuacauccucaucggcgccggcgcccucaugaugcucgucggcuuccucggcugcugcggcgccguccaggagucccagugcaugcucggccucuucuucggcuuccuccucgucaucuucgccaucgagaucgccgccgccaucuggggcuacucccacaaggacgaggucaucaaggagguccaggaguucuacaaggacaccuacaacaagcucaagaccaaggacgagccccagcgcgagacccucaaggccauccacuacgcccucaacugcugcggccucgccggcggcgucgagcaguucaucuccgacaucugccccaagaaggacguccucgagaccuucaccgucaaguccugccccgacgccaucaaggaggucuucgacaacaaguuccacaucaucggcgccgucggcaucggcaucgccgucgucaugaucuucggcaugaucuucuccaugauccucugcugcgccauccgccgcaaccgcgagauggucuga

SEQ ID NO: 41036 - RNA, 1476 nt, Artificial Sequence
  derived and/or modified sequence opt2 from CDADC1__Homo_sapiens__NP_001180407
augaaggaggccggccagaugcagaaccucgaguccgcccgcgccggccgcuccgucuccacccagaccggcuccaugaccggccagaucccccgccucuccaaggucaaccucuucacccuccucucccucuggauggagcucuuccccgccgaggcccagcgccagaagucccagaagaacgaggagggcaagcacggcccccucggcgacaacgaggagcgcacccgcgucuccaccgacaagcgccaggucaagcgcaccggccucgucgucgucaagaacaugaagaucgucggccuccacugcuccuccgaggaccuccacgccggccagaucgcccucaucaagcacggcucccgccucaagaacugcgaccucuacuucucccgcaagcccugcuccgccugccucaagaugaucgucaacgccggcgucaaccgcaucuccuacuggcccgccgaccccgagaucucccuccucaccgaggccuccuccuccgaggacgccaagcucgacgccaaggccgucgagcgccucaaguccaacucccgcgcccacgucugcguccuccuccagccccucgucugcuacaugguccaguucgucgaggagaccuccuacaagugcgacuucauccagaagaucaccaagacccuccccgacgccaacaccgacuucuacuacgagugcaagcaggagcgcaucaaggaguacgagaugcucuuccucgucuccaacgaggagaugcacaagcagauccucaugaccaucggccucgagaaccucugcgagaaccccuacuucuccaaccuccgccagaacaugaaggaccucauccuccuccucgccaccgucgccuccuccguccccaacuucaagcacuucggcuucuaccgcuccaaccccgagcagaucaacgagauccacaaccagucccucccccaggagaucgcccgccacugcaugguccaggcccgccuccucgccuaccgcaccgaggaccacaagaccggcgucggcgccgucaucugggccgagggcaagucccgcuccugcgacggcaccggcgccauguacuucgucggcugcggcuacaacgccuuccccgucggcuccgaguacgccgacuucccccacauggacgacaagcagaaggaccgcgagauccgcaaguuccgcuacaucauccacgccgagcagaacgcccucaccuuccgcugccaggagaucaagcccgaggagcgcuccaugaucuucgucaccaagugccccugcgacgagugcgucccccucaucaagggcgccggcaucaagcagaucuacgccggcgacgucgacgucggcaagaagaaggccgacaucuccuacaugcgcuucggcgagcucgagggcgucuccaaguucaccuggcagcucaaccccuccggcgccuacggccucgagcagaacgagcccgagcgccgcgaguccuga

SEQ ID NO: 41037 - RNA, 3684 nt, Artificial Sequence
  derived and/or modified sequence opt2 from CDAN1__Homo_sapiens__NP_612486
auggccgccguccucgagucccuccuccgcgaggaggucuccgucgccgccgucguccgcuggaucgcccgcuccacccagggcuccgaggacaacgccggcgaggccgccgcccucuccucccuccgcgcccuccgcaaggaguucguccccuuccuccucaacuuccuccgcgagcaguccucccgcguccucccccagggcccccccacccccgccaagacccccggcgccuccgccgcccuccccggccgccccggcggccccccccgcggcucccgcggcgcccgcucccagcucuucccccccaccgaggcccaguccaccgccgccgaggccccccucgcccgccgcggcggccgccgccgcggccccggccccgcccgcgagcgcggcggccgcggccucgaggagggcgucuccggcgagucccuccccggcgccggcggccgccgccuccgcggcuccggcucccccucccgccccucccucacccucuccgacccccccaaccucuccaaccucgaggaguucccccccgucggcuccgucccccccggccccaccggcaccaagcccucccgccgcaucaaccccacccccgucuccgaggagcgcucccucuccaagcccaagaccugcuucaccuccccccccaucuccugcguccccuccucccagcccuccgcccucgacaccucccccuggggccucggccucccccccggcugccgcucccuccaggaggagcgcgagaugcuccgcaaggagcgcuccaagcagcuccagcagucccccacccccaccugccccacccccgagcucggcuccccccuccccucccgcaccggcucccucaccgacgagcccgccgaccccgcccgcgucuccucccgccagcgccucgagcucgucgcccucgucuacuccuccugcaucgccgagaaccucguccccaaccucuuccucgagcucuucuucgucuuccagcuccucaccgcccgccgcauggucaccgccaaggacuccgaccccgagcucucccccgccguccucgacucccucgaguccccccucuuccaguccauccacgacugcgucuucuucgccguccagguccucgagugccacuuccagguccucuccaaccucgacaagggcacccucaagcuccucgccgagaacgagcgccuccucugcuucucccccgcccuccagggccgccuccgcgccgccuacgagggcuccgucgccaaggucucccucgucaugccccccuccacccaggccgucuccuuccagcccgagaccgacaaccgcgccaacuucuccuccgaccgcgccuuccacaccuucaagaagcagcgcgacgucuucuacgagguccuccgcgagugggaggaccaccacgaggagcccggcugggacuucgagaagggccucggcucccgcauccgcgccaugaugggccagcucuccgccgccugcucccacucccacuucguccgccucuuccagaagcagcuccuccagaugugccagucccccggcggcgccggcggcaccguccucggcgaggcccccgacguccucuccaugcucggcgccgacaagcucggccgccucuggcgccuccaggagcgccucauggccccccaguccuccggcggccccugccccccccccaccuuccccggcugccagggcuucuuccgcgacuucauccucuccgccuccuccuuccaguucaaccagcaccucauggacucccucucccucaagauccaggagcucaacggccucgcccucccccagcacgagcccaacgacgaggacggcgaguccgacgucgacuggcagggcgagcgcaagcaguucgccgucguccuccucucccuccgccuccucgccaaguuccucggcuucgucgccuuccuccccuaccgcggccccgagcccccccccaccggcgagcuccaggacuccauccucgcccuccgcucccaggucccccccguccucgacguccgcacccuccuccagcgcggccuccaggcccgccgcgccguccucaccguccccuggcucgucgaguuccucuccuucgccgaccacgucgucccccuccucgaguacuaccgcgacaucuucacccuccuccuccgccuccaccgcucccucguccucucccaggaguccgagggcaagaugugcuuccucaacaagcuccuccuccucgccguccucggcuggcucuuccagauccccaccguccccgaggaccucuucuuccucgaggagggccccuccuacgccuucgaggucgacaccgucgcccccgagcacggccucgacaacgcccccgucgucgaccagcagcuccucuacaccugcugccccuacaucggcgagcuccgcaagcuccucgccuccugggucuccggcuccuccggccgcuccggcggcuucaugcgcaagaucacccccaccaccaccaccucccucggcgcccagcccucccagaccucccagggccuccaggcccagcucgcccaggccuucuuccacaaccagccccccucccuccgccgcaccgucgaguucgucgccgagcgcaucggcuccaacugcgucaagcacaucaaggccacccucgucgccgaccucguccgccaggccgagucccuccuccaggagcagcucgucacccagggcgaggagggcggcgaccccgcccagcuccucgagauccucugcucccagcucugcccccacggcgcccaggcccucgcccucggccgcgaguucugccagcgcaagucccccggcgccguccgcgcccuccuccccgaggagacccccgccgccguccucuccuccgccgagaacaucgccgucggccucgccaccgagaaggccugcgccuggcucuccgccaacaucaccgcccucauccgccgcgaggucaaggccgccgucucccgcacccuccgcgcccagggccccgagcccgccgcccgcggcgagcgccgcggcugcucccgcgccugcgagcaccacgccccccuccccucccaccucaucuccgagaucaaggacguccucucccucgccgucggcccccgcgaccccgacgagggcgucucccccgagcaccucgagcagcuccucggccagcucggccagacccuccgcugccgccaguuccucugcccccccgccgagcagcaccucgccaagugcuccgucgagcucgccucccuccucgucgccgaccagauccccauccucggcccccccgcccaguaccgccucgagcgcggccaggcccgccgccuccuccacaugcuccucucccucuggaaggaggacuuccagggccccgucccccuccagcuccuccucuccccccgcaacgucggccuccucgccgacacccgcccccgcgagugggaccuccuccucuuccuccuccgcgagcucgucgagaagggccucaugggccgcauggagaucgaggccugccucggcucccuccaccaggcccaguggcccggcgacuucgccgaggagcucgccacccucuccaaccucuuccucgccgagccccaccuccccgagccccagcuccgcgccugcgagcucguccagcccaaccgcggcaccguccucgcccaguccuga

SEQ ID NO: 41038 - RNA, 1011 nt, Artificial Sequence
  derived and/or modified sequence opt2 from CDC123__Homo_sapiens__NP_006014
augaagaaggagcacguccuccacugccaguucuccgccugguaccccuucuuccgcggcgucaccaucaaguccgucauccucccccucccccagaacgucaaggacuaccuccucgacgacggcacccucgucgucuccggccgcgacgacccccccacccacucccagcccgacuccgacgacgaggccgaggagauccagugguccgacgacgagaacaccgccacccucaccgcccccgaguuccccgaguucgccaccaagguccaggaggccaucaacucccucggcggcuccgucuuccccaagcucaacugguccgccccccgcgacgccuacuggaucgccaugaacuccucccucaagugcaagacccucuccgacaucuuccuccucuucaaguccuccgacuucaucacccgcgacuucacccagcccuucauccacugcaccgacgacucccccgaccccugcaucgaguacgagcucguccuccgcaaguggugcgagcucauccccggcgccgaguuccgcugcuucgucaaggagaacaagcucaucggcaucucccagcgcgacuacacccaguacuacgaccacaucuccaagcagaaggaggagauccgccgcugcauccaggacuucuucaagaagcacauccaguacaaguuccucgacgaggacuucgucuucgacaucuaccgcgacucccgcggcaaggucuggcucaucgacuucaaccccuucggcgaggucaccgacucccuccucuucaccugggaggagcucaucuccgagaacaaccucaacggcgacuucuccgaggucgacgcccaggagcaggacucccccgccuuccgcugcaccaacuccgaggucaccguccagcccucccccuaccucuccuaccgccuccccaaggacuucgucgaccucuccaccggcgaggacgcccacaagcucaucgacuuccucaagcucaagcgcaaccagcaggaggacgacuga

SEQ ID NO: 41039 - RNA, 1836 nt, Artificial Sequence
  derived and/or modified sequence opt2 from CDC14A__Homo_sapiens__XP_011540643
auggacuucccccucggccagugccgccucgucugcuccucccucuacauguggcucgccaagcgcgaggacggcgccgccauccucaacaugcccucccccuccuucuacgccgacuucggcccccucaaccucgccauggucuaccgcuacugcugcaagcucaacaagaagcucaaguccuacucccucucccgcaagaagaucguccacuacaccugcuucgaccagcgcaagcgcgccaacgccgccuuccucaucggcgccuacgccgucaucuaccucaagaagacccccgaggaggccuaccgcgcccuccucuccggcuccaacccccccuaccuccccuuccgcgacgccuccuucggcaacugcaccuacaaccucaccauccucgacugccuccagggcauccgcaagggccuccagcacggcuucuucgacuucgagaccuucgacgucgacgaguacgagcacuacgagcgcgucgagaacggcgacuucaacuggaucguccccggcaaguuccucgccuucuccggcccccaccccaaguccaagaucgagaacggcuacccccuccacgcccccgaggccuacuuccccuacuucaagaagcacaacgucaccgccgucguccgccucaacaagaagaucuacgaggccaagcgcuucaccgacgccggcuucgagcacuacgaccucuucuucaucgacggcuccacccccuccgacaacaucguccgccgcuuccucaacaucugcgagaacaccgagggcgccaucgccguccacugcaaggccggccucggccgcaccggcacccucaucgccugcuacgucaugaagcacuaccgcuucacccacgccgagaucaucgccuggauccgcaucugccgccccggcuccaucaucggcccccagcagcacuuccucgaggagaagcaggccucccucuggguccagggcgacaucuuccgcuccaagcucaagaaccgccccuccuccgagggcuccaucaacaagauccucuccggccucgacgacauguccaucggcggcaaccucuccaagacccagaacauggagcgcuucggcgaggacaaccucgaggacgacgacgucgagaugaagaacggcaucacccagggcgacaagcuccgcgcccucaagucccagcgccagccccgcaccucccccuccugcgccuuccgcuccgacgacaccaagggccacccccgcgccgucucccagcccuuccgccucuccuccucccuccagggcuccgccgucacccucaagaccuccaagauggcccucucccccuccgccaccgccaagcgcaucaaccgcaccucccucuccuccggcgccaccguccgcuccuucuccaucaacucccgccucgccuccucccucggcaaccucaacgccgccaccgacgaccccgagaacaagaagaccuccuccuccuccaaggccggcuucaccgccucccccuucaccaaccuccucaacggcuccucccagcccaccacccgcaacuaccccgagcucaacaacaaccaguacaaccgcuccuccaacuccaacggcggcaaccucaacuccccccccggcccccacuccgccaagaccgaggagcacaccaccauccuccgccccuccuacaccggccucuccuccuccuccgcccgcuuccucucccgcuccauccccgucuccgcccagacccccccccccggcccccagaaccccgagugcaacuucugcgcccuccccucccagccccgccucccccccaagaaguucaacuccgccaaggaggccuucuga

SEQ ID NO: 41040 - RNA, 1386 nt, Artificial Sequence
  derived and/or modified sequence opt2 from CDC14B__Homo_sapiens__NP_001070649
augucccgcgagggcgccggcgccgcccucgucgccgaggucaucaaggaccgccucugcuucgccauccucuacucccgccccaaguccgccuccaacguccacuacuucuccaucgacaacgagcucgaguacgagaacuucuacgccgacuucggcccccucaaccucgccauggucuaccgcuacugcugcaagaucaacaagaagcucaaguccaucaccaugcuccgcaagaagaucguccacuucaccggcuccgaccagcgcaagcaggccaacgccgccuuccucgucggcugcuacauggucaucuaccucggccgcacccccgaggaggccuaccgcauccucaucuucggcgagaccuccuacauccccuuccgcgacgccgccuacggcuccugcaacuucuacaucacccuccucgacugcuuccacgccgucaagaaggccaugcaguacggcuuccucaacuucaacuccuucaaccucgacgaguacgagcacuacgagaaggccgagaacggcgaccucaacuggaucauccccgaccgcuucaucgccuucugcggcccccacucccgcgcccgccucgaguccggcuaccaccagcacucccccgagaccuacauccaguacuucaagaaccacaacgucaccaccaucauccgccucaacaagcgcauguacgacgccaagcgcuucaccgacgccggcuucgaccaccacgaccucuucuucgccgacggcuccacccccaccgacgccaucgucaaggaguuccucgacaucugcgagaacgccgagggcgccaucgccguccacugcaaggccggccucggccgcaccggcacccucaucgccugcuacaucaugaagcacuaccgcaugaccgccgccgagaccaucgccuggguccgcaucugccgccccggcuccgucaucggcccccagcagcaguuccucgucaugaagcagaccaaccucuggcucgagggcgacuacuuccgccagaagcucaagggccaggagaacggccagcaccgcgccgccuucuccaagcuccucuccggcgucgacgacaucuccaucaacggcgucgagaaccaggaccagcaggagcccgagcccuacuccgacgacgacgagaucaacggcgucacccagggcgaccgccuccgcgcccucaagucccgccgccaguccaagaccaacgccaucccccucaccgucauccuccaguccuccguccaguccugcaagaccuccgagcccaacaucuccggcuccgccggcaucaccaagcgcaccacccgcuccgccucccgcaaguccuccgucaagucccucuccaucucccgcaccaagaccguccuccgcuga

SEQ ID NO: 41041 - RNA, 1863 nt, Artificial Sequence
  derived and/or modified sequence opt2 from CDC16__Homo_sapiens__NP_003894
augaaccucgagcgccuccgcaagcgcguccgccaguaccucgaccagcagcaguaccaguccgcccucuucugggccgacaaggucgccucccucucccgcgaggagccccaggacaucuacuggcucgcccagugccucuaccucaccgcccaguaccaccgcgccgcccacgcccuccgcucccgcaagcucgacaagcucuacgaggccugccgcuaccucgccgcccgcugccacuacgccgccaaggagcaccagcaggcccucgacguccucgacauggaggagcccaucaacaagcgccucuucgagaaguaccucaaggacgaguccggcuucaaggaccccuccuccgacugggagaugucccaguccuccaucaaguccuccaucugccuccuccgcggcaagaucuacgacgcccucgacaaccgcacccucgccaccuacuccuacaaggaggcccucaagcucgacgucuacugcuucgaggccuucgaccuccucaccucccaccacaugcucaccgcccaggaggagaaggagcuccucgagucccucccccucuccaagcucugcaacgaggagcaggagcuccuccgcuuccucuucgagaacaagcucaagaaguacaacaagcccuccgagaccgucauccccgaguccgucgacggccuccaggagaaccucgacgucgucgucucccucgccgagcgccacuacuacaacugcgacuucaagaugugcuacaagcucaccuccgucgucauggagaaggaccccuuccacgccuccugccuccccguccacaucggcacccucgucgagcucaacaaggccaacgagcucuucuaccucucccacaagcucgucgaccucuaccccuccaaccccgucuccugguucgccgucggcugcuacuaccucauggucggccacaagaacgagcacgcccgccgcuaccucuccaaggccaccacccucgagaagaccuacggccccgccuggaucgccuacggccacuccuucgccgucgaguccgagcacgaccaggccauggccgccuacuucaccgccgcccagcucaugaagggcugccaccuccccaugcucuacaucggccucgaguacggccucaccaacaacuccaagcucgccgagcgcuucuucucccaggcccucuccaucgcccccgaggaccccuucgucaugcacgaggucggcgucgucgccuuccagaacggcgaguggaagaccgccgagaagugguuccucgacgcccucgagaagaucaaggccaucggcaacgaggucaccgucgacaagugggagccccuccucaacaaccucggccacgucugccgcaagcucaagaaguacgccgaggcccucgacuaccaccgccaggcccucguccucaucccccagaacgccuccaccuacuccgccaucggcuacauccacucccucaugggcaacuucgagaacgccgucgacuacuuccacaccgcccucggccuccgccgcgacgacaccuucuccgucaccaugcucggccacugcaucgagauguacaucggcgacuccgaggccuacaucggcgccgacaucaaggacaagcucaagugcuacgacuucgacguccacaccaugaagacccucaagaacaucaucuccccccccugggacuuccgcgaguucgaggucgagaagcagaccgccgaggagaccggccucaccccccucgagaccucccgcaagacccccgacucccgccccucccucgaggagaccuucgagaucgagaugaacgaguccgacaugaugcucgagaccuccauguccgaccacuccaccuga

SEQ ID NO: 41042 - RNA, 1434 nt, Artificial Sequence
  derived and/or modified sequence opt2 from CDC20B__Homo_sapiens__NP_001139206
auggaguggaagcucgagcgcaccgccccccgccgcguccgcaccgaggaggagaugcucugggaguccaucaugcgcguccucuccaaggaccucaagcagaagcgcucccaggacuccgccaacguccucgacuccgucaacgccaccuacuccgacuucaaguccaacuucgccaagcgccucuccgccgagguccccgucgccuccucccccaucaccacccgcuggcagcagucccagacccgcgcccucuccuccgacuccuucggcgaggagcaguccaccaccuaccuccccgaggccuccggcuccguccucaagaccccccccgagaaggagacccucacccucggcucccgcaaggagcagcucaagacccccuccaagggcaucuccgagaccuccaacuccgcccuccacuucugcaaggccccccacgccauggaccgcgacuggaaggaguccgucgccuccaagggccagaagugccucaagcagcucuucgucacccagaacgucguccagcaggccaacggcaagaugcagcucugcgagcaguccgagugcgucuggaagggcugcaaggacggcguccgcgacgaguccuuccaccucaaguccuccggcgacaucaacgacuccauccuccagcccgaggucaagauccacaucaccggccuccgcaacgacuacuaccucaacauccucgacugguccuuccagaaccucgucgccaucgcccucggcuccgccgucuacaucuggaacggcgagaaccacaacggcaucgagaacaucgaccucucccucaccugcaacuacaucuccuccgucuccuggaucaaggagggcaccugccucgccgucggcaccuccgagggcgagguccagcucugggacgucgucaccaagaagcgccuccgcaacaugcucggccaccucuccgucgucggcgcccucuccuggaaccacuucauccucuccuccggcucccgccucggccgcgucuaccaccacgacguccgcgucgcccagcaccacgucggcacccuccgccacaagcaggccgucugcgcccucaaguggucccccgacggccgccuccucuccuccggcugcuccgacggccuccucaccaucuggccccacgaccccggcgccuccgcccagggccagccccucaaggucaucacccaguccaccgccgucaagaucugcucccucaucuggcuccccaagaccaaggagaucgccaccggccagggcacccccaagaacgacgucaccgucuggaccugccccaccgucucccgcuccggcggcuucuucggccaccgcggccgcguccuccaccucucccucucccccgaccagacccgcgucuucuccgccgccgccgacggcaccgccuccgucuggaacugcuacuga

SEQ ID NO: 41043 - RNA, 1794 nt, Artificial Sequence
  derived and/or modified sequence opt2 from CDC23__Homo_sapiens__NP_004652
auggccgccuccaccuccaugguccccgucgccgucaccgccgccgucgcccccguccucuccaucaacuccgacuucuccgaccuccgcgagaucaagaagcagcuccuccucaucgccggccucacccgcgagcgcggccuccuccacuccuccaagugguccgccgagcucgccuucucccuccccgcccucccccucgccgagcuccagccccccccccccaucaccgaggaggacgcccaggacauggacgccuacacccucgccaaggccuacuucgacgucaaggaguacgaccgcgccgcccacuuccuccacggcugcaacuccaagaaggccuacuuccucuacauguacucccgcuaccucuccggcgagaagaagaaggacgacgagaccgucgacucccucggcccccucgagaagggccaggucaagaacgaggcccuccgcgagcuccgcgucgagcucuccaagaagcaccaggcccgcgagcucgacggcuucggccucuaccucuacggcgucguccuccgcaagcucgaccucgucaaggaggccaucgacgucuucgucgaggccacccacguccucccccuccacuggggcgccuggcucgagcucugcaaccucaucaccgacaaggagaugcucaaguuccucucccuccccgacaccuggaugaaggaguucuuccucgcccacaucuacaccgagcuccagcucaucgaggaggcccuccagaaguaccagaaccucaucgacgucggcuucuccaaguccuccuacaucgucucccagaucgccgucgccuaccacaacauccgcgacaucgacaaggcccucuccaucuucaacgagcuccgcaagcaggaccccuaccgcaucgagaacauggacaccuucuccaaccuccucuacguccgcuccaugaaguccgagcucuccuaccucgcccacaaccucugcgagaucgacaaguaccgcgucgagaccugcugcgucaucggcaacuacuacucccuccgcucccagcacgagaaggccgcccucuacuuccagcgcgcccucaagcucaacccccgcuaccucggcgccuggacccucaugggccacgaguacauggagaugaagaacaccuccgccgccauccaggccuaccgccacgccaucgaggucaacaagcgcgacuaccgcgccugguacggccucggccagaccuacgagauccucaagaugcccuucuacugccucuacuacuaccgccgcgcccaccagcuccgccccaacgacucccgcaugcucgucgcccucggcgagugcuacgagaagcucaaccagcucgucgaggccaagaagugcuacuggcgcgccuacgccgucggcgacgucgagaagauggcccucgucaagcucgccaagcuccacgagcagcucaccgaguccgagcaggccgcccagugcuacaucaaguacauccaggacaucuacuccugcggcgagaucgucgagcaccucgaggaguccaccgccuuccgcuaccucgcccaguacuacuucaagugcaagcucugggacgaggccuccaccugcgcccagaagugcugcgccuucaacgacacccgcgaggagggcaaggcccuccuccgccagauccuccagcuccgcaaccagggcgagacccccaccaccgagguccccgcccccuucuuccuccccgccucccucuccgccaacaacacccccacccgccgcgucuccccccucaaccucuccuccgucacccccuga

SEQ ID NO: 41044 - RNA, 1575 nt, Artificial Sequence
  derived and/or modified sequence opt2 from CDC25A__Homo_sapiens__NP_001780
auggagcucggccccgagcccccccaccgccgccgccuccucuucgccugcucccccccccccgccucccagcccgucgucaaggcccucuucggcgccuccgccgccggcggccucucccccgucaccaaccucaccgucaccauggaccagcuccagggccucggcuccgacuacgagcagccccucgaggucaagaacaacuccaaccuccagcgcaugggcuccuccgaguccaccgacuccggcuucugccucgacucccccggcccccucgacuccaaggagaaccucgagaaccccaugcgccgcauccacucccucccccagaagcuccucggcugcucccccgcccucaagcgcucccacuccgacucccucgaccacgacaucuuccagcucaucgaccccgacgagaacaaggagaacgaggccuucgaguucaagaagcccguccgccccgucucccgcggcugccuccacucccacggccuccaggagggcaaggaccucuucacccagcgccagaacuccgcccccgcccgcaugcucuccuccaacgagcgcgacuccuccgagcccggcaacuucaucccccucuucaccccccagucccccgucaccgccacccucuccgacgaggacgacggcuucgucgaccuccucgacggcgagaaccucaagaacgaggaggagacccccuccugcauggccucccucuggaccgccccccucgucaugcgcaccaccaaccucgacaaccgcugcaagcucuucgacucccccucccucugcuccuccuccacccgcuccguccucaagcgccccgagcgcucccaggaggaguccccccccggcuccaccaagcgccgcaaguccauguccggcgccucccccaaggaguccaccaaccccgagaaggcccacgagacccuccaccagucccucucccucgccuccucccccaagggcaccaucgagaacauccucgacaacgacccccgcgaccucaucggcgacuucuccaagggcuaccucuuccacaccgucgccggcaagcaccaggaccucaaguacaucucccccgagaucauggccuccguccucaacggcaaguucgccaaccucaucaaggaguucgucaucaucgacugccgcuaccccuacgaguacgagggcggccacaucaagggcgccgucaaccuccacauggaggaggaggucgaggacuuccuccucaagaagcccaucguccccaccgacggcaagcgcgucaucgucgucuuccacugcgaguucuccuccgagcgcggcccccgcaugugccgcuacguccgcgagcgcgaccgccucggcaacgaguaccccaagcuccacuaccccgagcucuacguccucaagggcggcuacaaggaguucuucaugaagugccaguccuacugcgagccccccuccuaccgccccaugcaccacgaggacuucaaggaggaccucaagaaguuccgcaccaagucccgcaccugggccggcgagaaguccaagcgcgagauguacucccgccucaagaagcucuga

SEQ ID NO: 41045 - RNA, 1551 nt, Artificial Sequence
  derived and/or modified sequence opt2 from CDC25B__Homo_sapiens__NP_001274445
augcacuccgagacccccaagucccaggucggcacccuccucuuccgcucccgcucccgccucacccaccucucccucucccgccgcgccuccgaguccucccucuccuccgaguccuccgaguccuccgacgccggccucugcauggacucccccucccccauggacccccacauggccgagcagaccuucgagcaggccauccaggccgccucccgcaucauccgcaacgagcaguucgccauccgccgcuuccaguccaugcccguccgccuccucggccacucccccguccuccgcaacaucaccaacucccaggcccccgacggccgccgcaaguccgaggccggcuccggcgccgccuccuccuccggcgaggacaaggagaacgacggcuucgucuucaagaugcccuggaagcccacccaccccuccuccacccacgcccucgccgagugggccucccgccgcgaggccuucgcccagcgccccuccuccgcccccgaccucaugugccucucccccgaccgcaagauggaggucgaggagcucuccccccucgcccucggccgcuucucccucacccccgccgagggcgacaccgaggaggacgacggcuucgucgacauccucgaguccgaccucaaggacgacgacgccgucccccccggcauggagucccucaucuccgccccccucgucaagacccucgagaaggaggaggagaaggaccucgucauguacuccaagugccagcgccucuuccgcucccccuccaugcccugcuccgucauccgccccauccucaagcgccucgagcgcccccaggaccgcgacacccccguccagaacaagcgccgccgcuccgucaccccccccgaggagcagcaggaggccgaggagcccaaggcccgcguccuccgcuccaagucccucugccacgacgagaucgagaaccuccucgacuccgaccaccgcgagcucaucggcgacuacuccaaggccuuccuccuccagaccgucgacggcaagcaccaggaccucaaguacaucucccccgagaccauggucgcccuccucaccggcaaguucuccaacaucgucgacaaguucgucaucgucgacugccgcuaccccuacgaguacgagggcggccacaucaagaccgccgucaaccucccccucgagcgcgacgccgaguccuuccuccucaagucccccaucgcccccugcucccucgacaagcgcgucauccucaucuuccacugcgaguucuccuccgagcgcggcccccgcaugugccgcuucauccgcgagcgcgaccgcgccgucaacgacuaccccucccucuacuaccccgagauguacauccucaagggcggcuacaaggaguucuucccccagcaccccaacuucugcgagccccaggacuaccgccccaugaaccacgaggccuucaaggacgagcucaagaccuuccgccucaagacccgcuccugggccggcgagcgcucccgccgcgagcucugcucccgccuccaggaccaguga

SEQ ID NO: 41046 - RNA, 1422 nt, Artificial Sequence
  derived and/or modified sequence opt2 from CDC25C__Homo_sapiens__NP_001274511
auguccaccgagcucuucuccuccacccgcgaggagggcuccuccggcuccggccccuccuuccgcuccaaccagcgcaagaugcucaaccuccuccucgagcgcgacaccuccuucaccgucugccccgacgucccccgcacccccgucggcaaguuccucggcgacuccgccaaccucuccauccucuccggcggcacccccaagcgcugccucgaccucuccaaccucuccuccggcgagaucaccgccacccagcucaccaccuccgccgaccucgacgagaccggccaccucgacuccuccggccuccaggagguccaccucgccggcaugaaccacgaccagcaccucaugaagugcucccccgcccagcuccucugcuccacccccaacggccucgaccgcggccaccgcaagcgcgacgccaugugcuccuccuccgccaacaaggagaacgacaacggcaaccucgucgacuccgagaugaaguaccucggcucccccaucaccaccguccccaagcucgacaagaaccccaaccucggcgaggaccaggccgaggagaucuccgacgagcucauggaguucucccucaaggaccaggaggccaaggucucccgcuccggccucuaccgcucccccuccaugcccgagaaccucaaccgcccccgccucaagcaggucgagaaguucaaggacaacaccauccccgacaaggucaagaagaaguacuucuccggccagggcaagcuccgcaagggccucugccucaagaagaccgucucccucugcgacaucaccaucacccagaugcucgaggaggacuccaaccagggccaccucaucggcgacuucuccaaggucugcgcccuccccaccgucuccggcaagcaccaggaccucaaguacgucaaccccgagaccgucgccgcccuccucuccggcaaguuccagggccucaucgagaaguucuacgucaucgacugccgcuaccccuacgaguaccucggcggccacauccagggcgcccucaaccucuacucccaggaggagcucuucaacuucuuccucaagaagcccaucgucccccucgacacccagaagcgcaucaucaucgucuuccacugcgaguucuccuccgagcgcggcccccgcaugugccgcugccuccgcgaggaggaccgcucccucaaccaguaccccgcccucuacuaccccgagcucuacauccucaagggcggcuaccgcgacuucuuccccgaguacauggagcucugcgagccccaguccuacugccccaugcaccaccaggaccacaagaccgagcuccuccgcugccgcucccaguccaagguccaggagggcgagcgccagcuccgcgagcagaucgcccuccucgucaaggacaugucccccuga

SEQ ID NO: 41047 - RNA, 2493 nt, Artificial Sequence
  derived and/or modified sequence opt2 from CDC27__Homo_sapiens__NP_001107563
augaccguccuccaggagcccguccaggccgccaucuggcaggcccucaaccacuacgccuaccgcgacgccgucuuccucgccgagcgccucuacgccgagguccacuccgaggaggcccucuuccuccucgccaccugcuacuaccgcuccggcaaggccuacaaggccuaccgccuccucaagggccacuccugcaccaccccccagugcaaguaccuccucgccaagugcugcgucgaccucuccaagcucgccgagggcgagcagauccucuccggcggcgucuucaacaagcagaagucccacgacgacaucgucaccgaguucggcgacuccgccugcuucacccucucccuccucggccacgucuacugcaagaccgaccgccucgccaagggcuccgagugcuaccagaagucccucucccucaaccccuuccucuggucccccuucgagucccucugcgagaucggcgagaagcccgaccccgaccagaccuucaaguucaccucccuccagaacuucuccaacugccuccccaacuccugcaccacccagguccccaaccacucccucucccaccgccagcccgagaccguccucaccgagaccccccaggacaccaucgagcucaaccgccucaaccucgaguccuccaacuccaaguacucccucaacaccgacuccuccgucuccuacaucgacuccgccgucaucucccccgacaccgucccccucggcaccggcaccuccauccucuccaagcagguccagaacaagcccaagaccggccgcucccuccucggcggccccgccgcccucuccccccucacccccuccuucggcauccucccccucgagacccccucccccggcgacggcuccuaccuccagaacuacaccaacaccccccccgucaucgacguccccuccaccggcgcccccuccaagaagaccuuccgcguccuccaguccgucgcccgcaucggccagaccggcaccaaguccgucuucucccaguccggcaacucccgcgaggucacccccauccucgcccagacccaguccuccggcccccagaccuccaccaccccccagguccucucccccaccaucaccuccccccccaacgcccucccccgccgcuccucccgccucuucaccuccgacuccuccaccaccaaggagaacuccaagaagcucaagaugaaguucccccccaagauccccaaccgcaagaccaaguccaagaccaacaagggcggcaucacccagcccaacaucaacgacucccucgagaucaccaagcucgacuccuccaucaucuccgagggcaagaucuccaccaucaccccccagauccaggccuucaaccuccagaaggccgccgccgagggccucaugucccuccuccgcgagaugggcaagggcuaccucgcccucugcuccuacaacugcaaggaggccaucaacauccucucccaccuccccucccaccacuacaacaccggcuggguccucugccagaucggccgcgccuacuucgagcucuccgaguacaugcaggccgagcgcaucuucuccgagguccgccgcaucgagaacuaccgcgucgagggcauggagaucuacuccaccacccucuggcaccuccagaaggacgucgcccucuccguccucuccaaggaccucaccgacauggacaagaacucccccgaggccuggugcgccgccggcaacugcuucucccuccagcgcgagcacgacaucgccaucaaguucuuccagcgcgccauccaggucgaccccaacuacgccuacgccuacacccuccucggccacgaguucguccucaccgaggagcucgacaaggcccucgccugcuuccgcaacgccauccgcgucaacccccgccacuacaacgccugguacggccucggcaugaucuacuacaagcaggagaaguucucccucgccgagaugcacuuccagaaggcccucgacaucaacccccaguccuccguccuccucugccacaucggcgucguccagcacgcccucaagaaguccgagaaggcccucgacacccucaacaaggccaucgucaucgaccccaagaacccccucugcaaguuccaccgcgccuccguccucuucgccaacgagaaguacaaguccgcccuccaggagcucgaggagcucaagcagaucguccccaaggagucccucgucuacuuccucaucggcaaggucuacaagaagcucggccagacccaccucgcccucaugaacuucuccugggccauggaccucgaccccaagggcgccaacaaccagaucaaggaggccaucgacaagcgcuaccuccccgacgacgaggagcccaucacccaggaggagcagaucaugggcaccgacgagucccaggaguccuccaugaccgacgccgacgacacccagcuccacgccgccgaguccgacgaguucuga

SEQ ID NO: 41048 - RNA, 711 nt, Artificial Sequence
  derived and/or modified sequence opt2 from CDC34__Homo_sapiens__NP_004350
auggcccgcccccucguccccuccucccagaaggcccuccuccucgagcucaagggccuccaggaggagcccgucgagggcuuccgcgucacccucgucgacgagggcgaccucuacaacugggaggucgccaucuucggcccccccaacaccuacuacgagggcggcuacuucaaggcccgccucaaguuccccaucgacuaccccuacuccccccccgccuuccgcuuccucaccaagauguggcaccccaacaucuacgagaccggcgacgucugcaucuccauccuccacccccccgucgacgacccccaguccggcgagcuccccuccgagcgcuggaaccccacccagaacguccgcaccauccuccucuccgucaucucccuccucaacgagcccaacaccuucucccccgccaacgucgacgccuccgucauguaccgcaaguggaaggaguccaagggcaaggaccgcgaguacaccgacaucauccgcaagcagguccucggcaccaaggucgacgccgagcgcgacggcgucaagguccccaccacccucgccgaguacugcgucaagaccaaggcccccgcccccgacgagggcuccgaccucuucuacgacgacuacuacgaggacggcgaggucgaggaggaggccgacuccugcuucggcgacgacgaggacgacuccggcaccgaggaguccuga

SEQ ID NO: 41049 - RNA, 1137 nt, Artificial Sequence
  derived and/or modified sequence opt2 from CDC37__Homo_sapiens__NP_008996
auggucgacuacuccgucugggaccacaucgaggucuccgacgacgaggacgagacccaccccaacaucgacaccgccucccucuuccgcuggcgccaccaggcccgcgucgagcgcauggagcaguuccagaaggagaaggaggagcucgaccgcggcugccgcgagugcaagcgcaaggucgccgagugccagcgcaagcucaaggagcucgaggucgccgagggcggcaaggccgagcucgagcgccuccaggccgaggcccagcagcuccgcaaggaggagcgcuccugggagcagaagcucgaggagaugcgcaagaaggagaaguccaugcccuggaacgucgacacccucuccaaggacggcuucuccaaguccauggucaacaccaagcccgagaagaccgaggaggacuccgaggagguccgcgagcagaagcacaagaccuucgucgagaaguacgagaagcagaucaagcacuucggcaugcuccgccgcugggacgacucccagaaguaccucuccgacaacguccaccucgucugcgaggagaccgccaacuaccucgucaucuggugcaucgaccucgaggucgaggagaagugcgcccucauggagcaggucgcccaccagaccaucgucaugcaguucauccucgagcucgccaagucccucaaggucgacccccgcgccugcuuccgccaguucuucaccaagaucaagaccgccgaccgccaguacauggagggcuucaacgacgagcucgaggccuucaaggagcgcguccgcggccgcgccaagcuccgcaucgagaaggccaugaaggaguacgaggaggaggagcgcaagaagcgccucggccccggcggccucgaccccgucgaggucuacgagucccuccccgaggagcuccagaagugcuucgacgucaaggacguccagaugcuccaggacgccaucuccaagauggaccccaccgacgccaaguaccacaugcagcgcugcaucgacuccggccucuggguccccaacuccaaggccuccgaggccaaggagggcgaggaggccggccccggcgacccccuccucgaggccguccccaagaccggcgacgagaaggacgucuccgucuga

SEQ ID NO: 41050 - RNA, 1014 nt, Artificial Sequence
  derived and/or modified sequence opt2 from CDC37L1__Homo_sapiens__NP_060383
auggagcagcccuggcccccccccggccccuggucccucccccgcgccgagggcgaggccgaggaggaguccgacuucgacgucuuccccuccuccccccgcugcccccagcuccccggcggcggcgcccagauguacucccacggcaucgagcucgccugccagaagcagaaggaguucgucaaguccuccgucgccugcaaguggaaccucgccgaggcccagcagaagcucggcucccucgcccuccacaacuccgagucccucgaccaggagcacgccaaggcccagaccgccgucuccgagcuccgccagcgcgaggaggaguggcgccagaaggaggaggcccucguccagcgcgagaagaugugccucugguccaccgacgccaucuccaaggacgucuucaacaaguccuucaucaaccaggacaagcgcaaggacaccgaggacgaggacaaguccgaguccuucaugcagaaguacgagcagaagauccgccacuucggcaugcucucccgcugggacgacucccagcgcuuccucuccgaccaccccuaccucgucugcgaggagaccgccaaguaccucauccucuggugcuuccaccucgaggccgagaagaagggcgcccucauggagcagaucgcccaccaggccgucgucaugcaguucaucauggagauggccaagaacugcaacgucgacccccgcggcugcuuccgccucuucuuccagaaggccaaggccgaggaggagggcuacuucgaggccuucaagaacgagcucgaggccuucaagucccgcguccgccucuacucccagucccaguccuuccagcccaugaccguccagaaccacgucccccacuccggcgucggcuccaucggccuccucgagucccucccccagaaccccgacuaccuccaguacuccaucuccaccgcccucugcucccucaacuccgucguccacaaggaggacgacgagcccaagaugauggacaccgucuga

SEQ ID NO: 41051 - RNA, 5160 nt, Artificial Sequence
  derived and/or modified sequence opt2 from CDC42BPA__Homo_sapiens__NP_003598
auguccggcgagguccgccuccgccagcucgagcaguucauccucgacggccccgcccagaccaacggccagugcuucuccgucgagacccuccucgacauccucaucugccucuacgacgagugcaacaacuccccccuccgccgcgagaagaacauccucgaguaccucgagugggccaagcccuucaccuccaaggucaagcagaugcgccuccaccgcgaggacuucgagauccucaaggucaucggccgcggcgccuucggcgaggucgccgucgucaagcucaagaacgccgacaaggucuucgccaugaagauccucaacaagugggagaugcucaagcgcgccgagaccgccugcuuccgcgaggagcgcgacguccucgucaacggcgacaacaaguggaucaccacccuccacuacgccuuccaggacgacaacaaccucuaccucgucauggacuacuacgucggcggcgaccuccucacccuccucuccaaguucgaggaccgccuccccgaggacauggcccgcuucuaccucgccgagauggucaucgccaucgacuccguccaccagcuccacuacguccaccgcgacaucaagcccgacaacauccucauggacaugaacggccacauccgccucgccgacuucggcuccugccucaagcucauggaggacggcaccguccaguccuccgucgccgucggcacccccgacuacaucucccccgagauccuccaggccauggaggacggcaagggccgcuacggccccgagugcgacugguggucccucggcgucugcauguacgagaugcucuacggcgagacccccuucuacgccgagucccucgucgagaccuacggcaagaucaugaaccacaaggagcgcuuccaguuccccgcccaggucaccgacgucuccgagaacgccaaggaccucauccgccgccucaucugcucccgcgagcaccgccucggccagaacggcaucgaggacuucaagaagcaccccuucuucuccggcaucgacugggacaacauccgcaacugcgaggcccccuacauccccgaggucuccucccccaccgacaccuccaacuucgacgucgacgacgacugccucaagaacuccgagaccaugcccccccccacccacaccgccuucuccggccaccaccuccccuucgucggcuucaccuacaccuccuccugcguccucuccgaccgcuccugccuccgcgucaccgccggccccaccucccucgaccucgacgucaacguccagcgcacccucgacaacaaccucgccaccgaggccuacgagcgccgcaucaagcgccucgagcaggagaagcucgagcucucccgcaagcuccaggaguccacccagaccguccaggcccuccaguacuccaccgucgacggcccccucaccgccuccaaggaccucgagaucaagaaccucaaggaggagaucgagaagcuccgcaagcaggucaccgaguccucccaccucgagcagcagcucgaggaggccaacgccguccgccaggagcucgacgacgccuuccgccagaucaaggccuacgagaagcagaucaagacccuccagcaggagcgcgaggaccucaacaaggagcucguccaggccuccgagcgccucaagaaccaguccaaggagcucaaggacgcccacugccagcgcaagcucgccaugcaggaguucauggagaucaacgagcgccucaccgagcuccacacccagaagcagaagcucgcccgccacguccgcgacaaggaggaggaggucgaccucgucaugcagaaggucgagucccuccgccaggagcuccgccgcaccgagcgcgccaagaaggagcucgagguccacaccgaggcccucgccgccgaggccuccaaggaccgcaagcuccgcgagcaguccgagcacuacuccaagcagcucgagaacgagcucgagggccucaagcagaagcagaucuccuacucccccggcgucugcuccaucgagcaccagcaggagaucaccaagcucaagaccgaccucgagaagaaguccaucuucuacgaggaggagcucuccaagcgcgagggcauccacgccaacgagaucaagaaccucaagaaggagcuccacgacuccgagggccagcagcucgcccucaacaaggagaucaugauccucaaggacaagcucgagaagacccgccgcgagucccaguccgagcgcgaggaguucgaguccgaguucaagcagcaguacgagcgcgagaagguccuccucaccgaggagaacaagaagcucaccuccgagcucgacaagcucaccacccucuacgagaaccucuccauccacaaccagcagcucgaggaggaggucaaggaccucgccgacaagaaggaguccgucgcccacugggaggcccagaucaccgagaucauccagugggucuccgacgagaaggacgcccgcggcuaccuccaggcccucgccuccaagaugaccgaggagcucgaggcccuccgcaacuccucccucggcacccgcgccaccgacaugcccuggaagaugcgccgcuucgccaagcucgacauguccgcccgccucgagcuccaguccgcccucgacgccgagauccgcgccaagcaggccauccaggaggagcucaacaaggucaaggccuccaacaucaucaccgagugcaagcucaaggacuccgagaagaagaaccucgagcuccucuccgagaucgagcagcucaucaaggacaccgaggagcuccgcuccgagaagggcaucgagcaccaggacucccagcacuccuuccucgccuuccucaacacccccaccgacgcccucgaccaguucgagaccgucgacuccaccccccucuccguccacacccccacccuccgcaagaagggcugccccggcuccaccggcuucccccccaagcgcaagacccaccaguucuucgucaaguccuucaccacccccaccaagugccaccagugcaccucccucauggucggccucauccgccagggcugcuccugcgaggucugcggcuucuccugccacaucaccugcgucaacaaggcccccaccaccugccccgucccccccgagcagaccaagggcccccucggcaucgacccccagaagggcaucggcaccgccuacgagggccacguccgcauccccaagcccgccggcgucaagaagggcuggcagcgcgcccucgccaucgucugcgacuucaagcucuuccucuacgacaucgccgagggcaaggccucccagcccuccgucgucaucucccaggucaucgacaugcgcgacgaggaguucuccgucuccuccguccucgccuccgacgucauccacgccucccgcaaggacauccccugcaucuuccgcgucaccgccucccagcucuccgccuccaacaacaagugcuccauccucaugcucgccgacaccgagaacgagaagaacaagugggucggcguccucuccgagcuccacaagauccucaagaagaacaaguuccgcgaccgcuccgucuacguccccaaggaggccuacgacuccacccucccccucaucaagaccacccaggccgccgccaucaucgaccacgagcgcaucgcccucggcaacgaggagggccucuucgucguccacgucaccaaggacgagaucauccgcgucggcgacaacaagaagauccaccagaucgagcucauccccaacgaccagcucgucgccgucaucuccggccgcaaccgccacguccgccucuuccccauguccgcccucgacggccgcgagaccgacuucuacaagcucuccgagaccaagggcugccagaccgucaccuccggcaagguccgccacggcgcccucaccugccucugcgucgccaugaagcgccagguccucugcuacgagcucuuccaguccaagacccgccaccgcaaguucaaggagauccagguccccuacaacguccaguggauggccaucuucuccgagcagcucugcgucggcuuccaguccggcuuccuccgcuacccccucaacggcgagggcaaccccuacuccaugcuccacuccaacgaccacacccucuccuucaucgcccaccagcccauggacgccaucugcgccgucgagaucuccuccaaggaguaccuccucugcuucaacuccaucggcaucuacaccgacugccagggccgccgcucccgccagcaggagcucauguggcccgccaaccccuccuccugcugcuacaacgcccccuaccucuccgucuacuccgagaacgccgucgacaucuucgacgucaacuccauggaguggauccagacccucccccucaagaagguccgcccccucaacaacgagggcucccucaaccuccucggccucgagaccauccgccucaucuacuucaagaacaagauggccgagggcgacgagcucgucguccccgagaccuccgacaacucccgcaagcagaugguccgcaacaucaacaacaagcgccgcuacuccuuccgcguccccgaggaggagcgcaugcagcagcgccgcgagaugcuccgcgaccccgagaugcgcaacaagcucaucuccaaccccaccaacuucaaccacaucgcccacaugggccccggcgacggcauccagauccucaaggaccuccccaugaacccccgcccccaggagucccgcaccgucuucuccggcuccgucuccauccccuccaucaccaagucccgccccgagcccggccgcuccauguccgccuccuccggccucuccgcccgcuccuccgcccagaacggcuccgcccucaagcgcgaguucuccggcggcuccuacuccgccaagcgccagcccaugcccucccccuccgagggcucccucuccuccggcggcauggaccagggcuccgacgcccccgcccgcgacuucgacggcgaggacuccgacuccccccgccacuccaccgccuccaacuccuccaaccucuccuccccccccucccccgccuccccccgcaagaccaagucccucucccucgaguccaccgaccgcggcuccugggaccccuga

SEQ ID NO: 41052 - RNA, 5136 nt, Artificial Sequence
  derived and/or modified sequence opt2 from CDC42BPB__Homo_sapiens__NP_006026
auguccgccaagguccgccucaagaagcucgagcagcuccuccucgacggccccuggcgcaacgaguccgcccucuccgucgagacccuccucgacguccucgucugccucuacaccgagugcucccacuccgcccuccgccgcgacaaguacgucgccgaguuccucgagugggccaagcccuucacccagcucgucaaggagaugcagcuccaccgcgaggacuucgagaucaucaaggucaucggccgcggcgccuucggcgaggucgccgucgucaagaugaagaacaccgagcgcaucuacgccaugaagauccucaacaagugggagaugcucaagcgcgccgagaccgccugcuuccgcgaggagcgcgacguccucgucaacggcgacugccaguggaucaccgcccuccacuacgccuuccaggacgagaaccaccucuaccucgucauggacuacuacgucggcggcgaccuccucacccuccucuccaaguucgaggacaagcuccccgaggacauggcccgcuucuacaucggcgagaugguccucgccaucgacuccauccaccagcuccacuacguccaccgcgacaucaagcccgacaacguccuccucgacgucaacggccacauccgccucgccgacuucggcuccugccucaagaugaacgacgacggcaccguccaguccuccgucgccgucggcacccccgacuacaucucccccgagauccuccaggccauggaggacggcaugggcaaguacggccccgagugcgacugguggucccucggcgucugcauguacgagaugcucuacggcgagacccccuucuacgccgagucccucgucgagaccuacggcaagaucaugaaccacgaggagcgcuuccaguuccccucccacgucaccgacgucuccgaggaggccaaggaccucauccagcgccucaucugcucccgcgagcgccgccucggccagaacggcaucgaggacuucaagaagcacgccuucuucgagggccucaacugggagaacauccgcaaccucgaggcccccuacauccccgacgucuccucccccuccgacaccuccaacuucgacgucgacgacgacguccuccgcaacaccgagauccucccccccggcucccacaccggcuucuccggccuccaccuccccuucaucggcuucaccuucaccaccgaguccugcuucuccgaccgcggcucccucaaguccaucaugcaguccaacacccucaccaaggacgaggacguccagcgcgaccucgagcacucccuccagauggaggccuacgagcgccgcauccgccgccucgagcaggagaagcucgagcucucccgcaagcuccaggaguccacccagaccguccagucccuccacggcuccucccgcgcccucuccaacuccaaccgcgacaaggagaucaagaagcucaacgaggagaucgagcgccucaagaacaagaucgccgacuccaaccgccucgagcgccagcucgaggacaccgucgcccuccgccaggagcgcgaggacuccacccagcgccuccgcggccucgagaagcagcaccgcgucguccgccaggagaaggaggagcuccacaagcagcucgucgaggccuccgagcgccucaagucccaggccaaggagcucaaggacgcccaccagcagcgcaagcucgcccuccaggaguucuccgagcucaacgagcgcauggccgagcuccgcgcccagaagcagaaggucucccgccagcuccgcgacaaggaggaggagauggaggucgccacccagaaggucgacgccaugcgccaggagaugcgccgcgccgagaagcuccgcaaggagcucgaggcccagcucgacgacgccgucgccgaggccuccaaggagcgcaagcuccgcgagcacuccgagaacuucugcaagcagauggaguccgagcucgaggcccucaaggucaagcagggcggccgcggcgccggcgccacccucgagcaccagcaggagaucuccaagaucaaguccgagcucgagaagaagguccucuucuacgaggaggagcucguccgccgcgaggccucccacguccucgaggucaagaacgucaagaaggagguccacgacuccgagucccaccagcucgcccuccagaaggagauccucaugcucaaggacaagcucgagaaguccaagcgcgagcgccacaacgagauggaggaggccgucggcaccaucaaggacaaguacgagcgcgagcgcgccaugcucuucgacgagaacaagaagcucaccgccgagaacgagaagcucugcuccuucgucgacaagcucaccgcccagaaccgccagcucgaggacgagcuccaggaccucgccgccaagaaggaguccgucgcccacugggaggcccagaucgccgagaucauccagugggucuccgacgagaaggacgcccgcggcuaccuccaggcccucgccuccaagaugaccgaggagcucgaggcccuccgcuccuccucccucggcucccgcacccucgacccccucuggaagguccgccgcucccagaagcucgacauguccgcccgccucgagcuccaguccgcccucgaggccgagauccgcgccaagcagcucguccaggaggagcuccgcaaggucaaggacgccaaccucacccucgaguccaagcucaaggacuccgaggccaagaaccgcgagcuccucgaggagauggagauccucaagaagaagauggaggagaaguuccgcgccgacaccggccucaagcuccccgacuuccaggacuccaucuucgaguacuucaacaccgccccccucgcccacgaccucaccuuccgcaccuccuccgccuccgagcaggagacccaggcccccaagcccgaggccucccccuccauguccgucgccgccuccgagcagcaggaggacauggcccgccccccccagcgccccuccgccgucccccuccccaccacccaggcccucgcccucgccggccccaagcccaaggcccaccaguucuccaucaaguccuucuccucccccacccagugcucccacugcaccucccucauggucggccucauccgccagggcuacgccugcgaggucugcuccuucgccugccacgucuccugcaaggacggcgccccccaggucugccccaucccccccgagcaguccaagcgcccccucggcgucgacguccagcgcggcaucggcaccgccuacaagggccacgucaagguccccaagcccaccggcgucaagaagggcuggcagcgcgccuacgccgucgucugcgacugcaagcucuuccucuacgaccuccccgagggcaaguccacccagcccggcgucaucgccucccagguccucgaccuccgcgacgacgaguucuccgucuccuccguccucgccuccgacgucauccacgccacccgccgcgacauccccugcaucuuccgcgucaccgccucccuccucggcgcccccuccaagaccuccucccuccucauccucaccgagaacgagaacgagaagcgcaagugggucggcauccucgagggccuccaguccauccuccacaagaaccgccuccgcaaccaggucguccacgucccccucgaggccuacgacuccucccucccccucaucaaggccauccucaccgccgccaucgucgacgccgaccgcaucgccgucggccucgaggagggccucuacgucaucgaggucacccgcgacgucaucguccgcgccgccgacugcaagaagguccaccagaucgagcucgccccccgcgagaagaucgucauccuccucugcggccgcaaccaccacguccaccucuaccccugguccucccucgacggcgccgagggcuccuucgacaucaagcuccccgagaccaagggcugccagcucauggccaccgccacccucaagcgcaacuccggcaccugccucuucgucgccgucaagcgccucauccucugcuacgagauccagcgcaccaagcccuuccaccgcaaguucaacgagaucgucgcccccggcuccguccagugccucgccguccuccgcgaccgccucugcgucggcuaccccuccggcuucugccuccucuccauccagggcgacggccagccccucaaccucgucaaccccaacgaccccucccucgccuuccucucccagcaguccuucgacgcccucugcgccgucgagcucgaguccgaggaguaccuccucugcuucucccacaugggccucuacgucgacccccagggccgccgcgcccgcgcccaggagcucauguggcccgccgcccccgucgccugcuccugcucccccacccacgucaccgucuacuccgaguacggcgucgacgucuucgacguccgcaccauggaguggguccagaccaucggccuccgccgcauccgcccccucaacuccgagggcacccucaaccuccucaacugcgagcccccccgccucaucuacuucaaguccaaguucuccggcgccguccucaacguccccgacaccuccgacaacuccaagaagcagaugcuccgcacccgcuccaagcgccgcuucgucuucaagguccccgaggaggagcgccuccagcagcgccgcgagaugcuccgcgaccccgagcuccgcuccaagaugaucuccaaccccaccaacuucaaccacgucgcccacaugggccccggcgacggcaugcagguccucauggaccucccccucuccgccgucccccccucccaggaggagcgccccggccccgcccccaccaaccucgcccgccagccccccucccgcaacaagcccuacaucuccuggcccuccuccggcggcuccgagcccuccgucaccgucccccuccgcuccauguccgaccccgaccaggacuucgacaaggagcccgacuccgacuccaccaagcacuccacccccuccaacuccuccaaccccuccggcccccccucccccaacuccccccaccgcucccagcucccccucgagggccucgagcagcccgccugcgacaccuga

SEQ ID NO: 41053 - RNA, 4656 nt, Artificial Sequence
  derived and/or modified sequence opt2 from CDC42BPG__Homo_sapiens__NP_059995
auggagcgccgccuccgcgcccucgagcagcucgcccgcggcgaggccggcggcugccccggccucgacggccuccucgaccuccuccucgcccuccaccacgagcucuccuccggcccccuccgccgcgagcgcuccgucgcccaguuccucuccugggccucccccuucgucuccaaggucaaggagcuccgccuccagcgcgacgacuucgagauccucaaggucaucggccgcggcgccuucggcgaggucaccgucguccgccagcgcgacaccggccagaucuucgccaugaagaugcuccacaagugggagaugcucaagcgcgccgagaccgccugcuuccgcgaggagcgcgacguccucgucaagggcgacucccgcugggucaccacccuccacuacgccuuccaggacgaggaguaccucuaccucgucauggacuacuacgccggcggcgaccuccucacccuccucucccgcuucgaggaccgccucccccccgagcucgcccaguucuaccucgccgagaugguccucgccauccacucccuccaccagcucggcuacguccaccgcgacgucaagcccgacaacguccuccucgacgucaacggccacauccgccucgccgacuucggcuccugccuccgccucaacaccaacggcauggucgacuccuccgucgccgucggcacccccgacuacaucucccccgagauccuccaggccauggaggagggcaagggccacuacggcccccagugcgacugguggucccucggcgucugcgccuacgagcuccucuucggcgagacccccuucuacgccgagucccucgucgagaccuacggcaagaucaugaaccacgaggaccaccuccaguucccccccgacguccccgacguccccgccuccgcccaggaccucauccgccagcuccucugccgccaggaggagcgccucggccgcggcggccucgacgacuuccgcaaccaccccuucuucgagggcgucgacugggagcgccucgccuccuccaccgcccccuacauccccgagcuccgcggccccauggacaccuccaacuucgacgucgacgacgacacccucaaccaccccggcacccuccccccccccucccacggcgccuucuccggccaccaccuccccuucgucggcuucaccuacaccuccggcucccacucccccgaguccuccuccgaggccugggccgcccucgagcgcaagcuccagugccucgagcaggagaaggucgagcucucccgcaagcaccaggaggcccuccacgcccccaccgaccaccgcgagcucgagcagcuccgcaaggagguccagacccuccgcgaccgccuccccgagaugcuccgcgacaaggccucccucucccagaccgacggcccccccgccggcucccccggccaggacuccgaccuccgccaggagcucgaccgccuccaccgcgagcucgccgagggccgcgccggccuccaggcccaggagcaggagcucugccgcgcccagggccagcaggaggagcuccuccagcgccuccaggaggcccaggagcgcgaggccgccaccgccucccagacccgcgcccucuccucccagcucgaggaggcccgcgccgcccagcgcgagcucgaggcccaggucuccucccucucccgccaggucacccagcuccagggccagugggagcagcgccucgaggaguccucccaggccaagaccauccacaccgccuccgagaccaacggcaugggcccccccgagggcggcccccaggaggcccagcuccgcaaggaggucgccgcccuccgcgagcagcucgagcaggcccacucccaccgccccuccggcaaggaggaggcccucugccagcuccaggaggagaaccgccgccucucccgcgagcaggagcgccucgaggccgagcucgcccaggagcaggaguccaagcagcgccucgagggcgagcgccgcgagaccgaguccaacugggaggcccagcucgccgacauccucuccugggucaacgacgagaaggucucccgcggcuaccuccaggcccucgccaccaagauggccgaggagcucgagucccuccgcaacgucggcacccagacccuccccgcccgcccccucgaccaccaguggaaggcccgccgccuccagaagauggaggccuccgcccgccucgagcuccaguccgcccucgaggccgagauccgcgccaagcagggccuccaggagcgccucacccagguccaggaggcccagcuccaggccgagcgccgccuccaggaggccgagaagcagucccaggcccuccagcaggagcucgccaugcuccgcgaggagcuccgcgcccgcggccccgucgacaccaagcccuccaacucccucauccccuuccucuccuuccgcuccuccgagaaggacuccgccaaggaccccggcaucuccggcgaggccacccgccacggcggcgagcccgaccuccgccccgagggccgccgcucccuccgcaugggcgccgucuucccccgcgcccccaccgccaacaccgccuccaccgagggccuccccgccaagcccggcucccacacccuccgcccccgcuccuuccccucccccaccaagugccuccgcugcaccucccucaugcucggccucggccgccagggccucggcugcgacgccugcggcuacuucugccacaccaccugcgccccccaggccccccccugccccgucccccccgaccuccuccgcaccgcccucggcguccaccccgagaccggcaccggcaccgccuacgagggcuuccucuccgucccccgccccuccggcguccgccgcggcuggcagcgcgucuucgccgcccucuccgacucccgccuccuccucuucgacgcccccgaccuccgccucuccccccccuccggcgcccuccuccagguccucgaccuccgcgacccccaguucuccgccacccccguccucgccuccgacgucauccacgcccagucccgcgaccucccccgcaucuuccgcgucaccaccucccagcucgccgucccccccaccaccugcaccguccuccuccucgccgaguccgagggcgagcgcgagcgcuggcuccagguccucggcgagcuccagcgccuccuccucgacgcccgcccccgcccccgccccgucuacacccucaaggaggccuacgacaacggccucccccuccucccccacacccucugcgccgccauccucgaccaggaccgccucgcccucggcaccgaggagggccucuucgucauccaccuccgcuccaacgacaucuuccaggucggcgagugccgccgcguccagcagcucacccucucccccuccgccggccuccucgucguccucugcggccgcggccccuccguccgccucuucgcccucgccgagcucgagaacaucgaggucgccggcgccaagauccccgagucccgcggcugccagguccucgccgccggcuccauccuccaggcccgcacccccguccucugcgucgccgucaagcgccagguccucugcuaccagcucggccccggccccggccccuggcagcgccgcauccgcgagcuccaggcccccgccaccguccagucccucggccuccucggcgaccgccucugcgucggcgccgccggcggcuucgcccucuacccccuccucaacgaggccgccccccucgcccucggcgccggccucguccccgaggagcucccccccucccgcggcggccucggcgaggcccucggcgccgucgagcucucccucuccgaguuccuccuccucuucaccaccgccggcaucuacgucgacggcgccggccgcaagucccgcggccacgagcuccucuggcccgccgcccccaugggcuggggcuacgccgcccccuaccucaccgucuucuccgagaacuccaucgacgucuucgacguccgccgcgccgaguggguccagaccgucccccucaagaagguccgcccccucaaccccgagggcucccucuuccucuacggcaccgagaagguccgccucaccuaccuccgcaaccagcucgccgagaaggacgaguucgacauccccgaccucaccgacaacucccgccgccagcucuuccgcaccaaguccaagcgccgcuucuucuuccgcgucuccgaggagcagcagaagcagcagcgccgcgagaugcucaaggaccccuucguccgcuccaagcucaucuccccccccaccaacuucaaccaccucguccacgucggccccgccaacggccgccccggcgcccgcgacaagucccccgcccccgaggagaagggccgcgucgcccgcggcuccggcccccagcgcccccacuccuucuccgaggcccuccgccgccccgccuccaugggcuccgagggccucggcggcgacgccgaccccaugaagcgcaagcccuggaccucccucuccuccgaguccgucuccugcccccagggcucccucucccccgccaccucccucaugcaggucuccgagcgcccccgcucccucccccucucccccgagcucgaguccucccccuga

SEQ ID NO: 41054 - RNA, 1176 nt, Artificial Sequence
  derived and/or modified sequence opt2 from CDC42EP1__Homo_sapiens__NP_689449
augcccggcccccagggcggccgcggcgccgccaccaugucccucggcaagcucucccccgucggcugggucuccuccucccagggcaagcgccgccucaccgccgacaugaucucccacccccucggcgacuuccgccacaccaugcacgucggccgcggcggcgacgucuucggcgacaccuccuuccucuccaaccacggcggcuccuccggcuccacccaccgcuccccccgcuccuuccucgccaagaagcuccagcucguccgccgcgucggcgcccccccccgccgcauggccuccccccccgcccccucccccgccccccccgccaucucccccaucaucaagaacgccaucucccucccccagcucaaccaggccgccuacgacucccucgucgucggcaagcucuccuucgacuccucccccaccuccuccaccgacggccacuccuccuacggccucgacuccggcuucugcaccaucucccgccucccccgcuccgagaagccccacgaccgcgaccgcgacggcuccuuccccuccgagcccggccuccgccgcuccgacucccuccucuccuuccgccucgaccucgaccucggccccucccuccucuccgagcuccucggcgucaugucccuccccgaggcccccgccgccgagacccccgcccccgccgccaacccccccgcccccaccgccaaccccaccggccccgccgccaacccccccgccaccaccgccaacccccccgcccccgccgccaaccccuccgcccccgccgccacccccaccggccccgccgccaacccccccgcccccgccgccuccuccaccccccacggccacugccccaacggcgucaccgccggccucggccccgucgccgaggucaaguccucccccgucggcggcggcccccgcggccccgccggccccgcccucggccgccacuggggcgccggcugggacggcggccaccacuaccccgagauggacgcccgccaggagcgcgucgagguccucccccaggcccgcgccuccugggagucccucgacgaggaguggcgcgccccccaggccggcucccgcacccccguccccuccaccguccaggccaacaccuucgaguucgccgacgccgaggaggacgacgaggucaaggucuga

SEQ ID NO: 41055 - RNA, 765 nt, Artificial Sequence
  derived and/or modified sequence opt2 from CDC42EP3__Homo_sapiens__NP_006440
augcccgccaagacccccaucuaccucaaggccgccaacaacaagaagggcaagaaguucaagcuccgcgacauccucucccccgacaugaucucccccccccucggcgacuuccgccacaccauccacaucggcaaggagggccagcacgacgucuucggcgacaucuccuuccuccagggcaacuacgagcuccuccccggcaaccaggagaaggcccaccucggccaguuccccggccacaacgaguucuuccgcgccaacuccaccuccgacuccgucuucaccgagacccccucccccguccucaagaacgccaucucccuccccaccaucggcggcucccaggcccucaugcucccccuccucucccccgucaccuucaacuccaagcaggaguccuucggccccgccaagcucccccgccucuccugcgagcccgucauggaggagaaggcccaggagaaguccucccuccucgagaacggcaccguccaccagggcgacaccuccuggggcuccuccggcuccgccucccaguccucccagggccgcgacucccacuccuccucccucuccgagcaguaccccgacuggcccgccgaggacauguucgaccaccccacccccugcgagcucaucaagggcaagaccaaguccgaggagucccucuccgaccucaccggcucccuccucucccuccagcucgaccucggccccucccuccucgacgagguccucaacgucauggacaagaacaaguga

SEQ ID NO: 41056 - RNA, 255 nt, Artificial Sequence
  derived and/or modified sequence opt2 from CDC42SE2__Homo_sapiens__NP_001033791
auguccgaguucuggcucugcuucaacugcugcaucgccgagcagccccagcccaagcgccgccgccgcaucgaccgcuccaugaucggcgagcccaccaacuucguccacaccgcccacgucggcuccggcgaccucuucuccggcaugaacuccgucuccuccauccagaaccagaugcaguccaagggcggcuacggcggcggcaugcccgccaacguccagaugcagcucgucgacaccaaggccggcuga

SEQ ID NO: 41057 - RNA, 1797 nt, Artificial Sequence
  derived and/or modified sequence opt2 from CDC45__Homo_sapiens__XP_005261342
auguucgucuccgacuuccgcaaggaguucuacgaggucguccagucccagcgcguccuccucuucgucgccuccgacgucgacgcccucugcgccugcaagauccuccaggcccucuuccagugcgaccacguccaguacacccucguccccgucuccggcuggcaggagcucgagaccgccuuccucgagcacaaggagcaguuccacuacuucauccucaucaacugcggcgccaacgucgaccuccucgacauccuccagcccgacgaggacaccaucuucuucgucugcgacacccaccgccccgucaacgucgucaacgucuacaacgacacccagaucaagcuccucaucaagcaggacgacgaccucgagguccccgccuacgaggacaucuuccgcgacgaggaggaggacgaggagcacuccggcaacgacuccgacggcuccgagcccuccgagaagcgcacccgccucgaggaggagaucgucgagcagaccaugcgccgccgccagcgccgcgagugggaggcccgcuccggcuccggcuccgagcccgucgccgccgcccucgagaaguccucccgccucuucgccggccccauguccgaccgcaccgccccccgcuccccccgccgcgacauccucuucgacuacgagcaguacgaguaccacggcaccuccuccgccauggucauguucgagcucgccuggaugcucuccaaggaccucaacgacaugcucuggugggccaucgucggccucaccgaccaguggguccaggacaagaucacccagaugaaguacgucaccgacgucggcguccuccagcgccacgucucccgccacaaccaccgcaacgaggacgaggagaacacccucuccgucgacugcacccgcaucuccuucgaguacgaccuccgccucguccucuaccagcacuggucccuccacgacucccucugcaacaccuccuacaccgccgcccgcuucaagcucugguccguccacggccagaagcgccuccaggaguuccucgccgacaugggccucccccucaagcaggucaagcagaaguuccaggccauggacaucucccucaaggagaaccuccgcgagaugaucgaggaguccgccaacaaguucggcaugaaggacaugcgcguccagaccuucuccauccacuucggcuucaagcacaaguuccucgccuccgacgucgucuucgccaccaugucccucauggagucccccgagaaggacggcuccggcaccgaccacuucauccaggcccucgacucccucucccgcuccaaccucgacaagcucuaccacggccucgagcucgccaagaagcagcuccgcgccacccagcagaccaucgccuccugccucugcaccaaccucgucaucucccagggccccuuccucuacugcucccucauggagggcacccccgacgucaugcucuucucccgccccgccucccucucccuccucuccaagcaccuccucaaguccuucgucugcuccaccaagaaccgccgcugcaagcuccucccccucgucauggccgccccccucuccauggagcacggcaccgucaccgucgucggcaucccccccgagaccgacuccuccgaccgcaagaacuucuucggccgcgccuucgagaaggccgccgaguccaccuccucccgcaugcuccacaaccacuucgaccucuccgucaucgagcucaaggccgaggaccgcuccaaguuccucgacgcccucaucucccuccucuccuga

SEQ ID NO: 41058 - RNA, 2409 nt, Artificial Sequence
  derived and/or modified sequence opt2 from CDC5L__Homo_sapiens__NP_001244
augccccgcaucaugaucaagggcggcgucuggcgcaacaccgaggacgagauccucaaggccgccgucaugaaguacggcaagaaccaguggucccgcaucgccucccuccuccaccgcaaguccgccaagcagugcaaggcccgcugguacgaguggcucgaccccuccaucaagaagaccgaguggucccgcgaggaggaggagaagcuccuccaccucgccaagcucaugcccacccaguggcgcaccaucgcccccaucaucggccgcaccgccgcccagugccucgagcacuacgaguuccuccucgacaaggccgcccagcgcgacaacgaggaggagaccaccgacgacccccgcaagcucaagcccggcgagaucgaccccaaccccgagaccaagcccgcccgccccgaccccaucgacauggacgaggacgagcucgagaugcucuccgaggcccgcgcccgccucgccaacacccagggcaagaaggccaagcgcaaggcccgcgagaagcagcucgaggaggcccgccgccucgccgcccuccagaagcgccgcgagcuccgcgccgccggcaucgagauccagaagaagcgcaagcgcaagcgcggcgucgacuacaacgccgagauccccuucgagaagaagcccgcccucggcuucuacgacaccuccgaggagaacuaccaggcccucgacgccgacuuccgcaagcuccgccagcaggaccucgacggcgagcuccgcuccgagaaggagggccgcgaccgcaagaaggacaagcagcaccucaagcgcaagaaggaguccgaccuccccuccgccauccuccagaccuccggcgucuccgaguucaccaagaagcgcuccaagcucguccuccccgccccccagaucuccgacgccgagcuccaggaggucgucaaggucggccaggccuccgagaucgcccgccagaccgccgaggaguccggcaucaccaacuccgccuccuccacccuccucuccgaguacaacgucaccaacaacuccgucgcccuccgcaccccccgcacccccgccucccaggaccgcauccuccaggaggcccagaaccucauggcccucaccaacgucgacaccccccucaagggcggccucaacaccccccuccacgaguccgacuucuccggcgucaccccccagcgccaggucguccagacccccaacaccguccucuccacccccuuccgcacccccuccaacggcgccgagggccucaccccccgcuccggcaccacccccaagcccgucaucaacuccacccccggccgcaccccccuccgcgacaagcucaacaucaaccccgaggacggcauggccgacuacuccgaccccuccuacgucaagcagauggagcgcgagucccgcgagcaccuccgccucggccuccucggccuccccgcccccaagaacgacuucgagaucguccuccccgagaacgccgagaaggagcucgaggagcgcgagaucgacgacaccuacaucgaggacgccgccgacgucgacgcccgcaagcaggccauccgcgacgccgagcgcgucaaggagaugaagcgcaugcacaaggccguccagaaggaccucccccgccccuccgaggucaacgagaccauccuccgcccccucaacgucgagcccccccucaccgaccuccagaaguccgaggagcucaucaagaaggagaugaucaccaugcuccacuacgaccuccuccaccaccccuacgagcccuccggcaacaagaagggcaagaccgucggcuucggcaccaacaacuccgagcacaucaccuaccucgagcacaaccccuacgagaaguucuccaaggaggagcucaagaaggcccaggacguccucguccaggagauggaggucgucaagcagggcaugucccacggcgagcucuccuccgaggccuacaaccaggucugggaggagugcuacucccagguccucuaccuccccggccagucccgcuacacccgcgccaaccucgccuccaagaaggaccgcaucgagucccucgagaagcgccucgagaucaaccgcggccacaugaccaccgaggccaagcgcgccgccaagauggagaagaagaugaagauccuccucggcggcuaccagucccgcgccaugggccucaugaagcagcucaacgaccucugggaccagaucgagcaggcccaccucgagcuccgcaccuucgaggagcucaagaagcacgaggacuccgccaucccccgccgccucgagugccucaaggaggacguccagcgccagcaggagcgcgagaaggagcuccagcaccgcuacgccgaccuccuccucgagaaggagacccucaaguccaaguucuga

SEQ ID NO: 41059 - RNA, 1683 nt, Artificial Sequence
  derived and/or modified sequence opt2 from CDC6__Homo_sapiens__NP_001245
augccccagacccgcucccaggcccaggccaccaucuccuuccccaagcgcaagcucucccgcgcccucaacaaggccaagaacuccuccgacgccaagcucgagcccaccaacguccagaccgucaccugcuccccccgcgucaaggcccucccccucuccccccgcaagcgccucggcgacgacaaccucugcaacaccccccaccucccccccugcuccccccccaagcagggcaagaaggagaacggccccccccacucccacacccucaagggccgccgccucgucuucgacaaccagcucaccaucaagucccccuccaagcgcgagcucgccaagguccaccagaacaagauccucuccuccguccgcaagucccaggagaucaccaccaacuccgagcagcgcugcccccucaagaaggaguccgccugcguccgccucuucaagcaggagggcaccugcuaccagcaggccaagcucguccucaacaccgccguccccgaccgccuccccgcccgcgagcgcgagauggacgucauccgcaacuuccuccgcgagcacaucugcggcaagaaggccggcucccucuaccucuccggcgcccccggcaccggcaagaccgccugccucucccgcauccuccaggaccucaagaaggagcucaagggcuucaagaccaucaugcucaacugcaugucccuccgcaccgcccaggccgucuuccccgccaucgcccaggagaucugccaggaggaggucucccgccccgccggcaaggacaugaugcgcaagcucgagaagcacaugaccgccgagaagggccccaugaucguccucguccucgacgagauggaccagcucgacuccaagggccaggacguccucuacacccucuucgaguggcccuggcucuccaacucccaccucguccucaucggcaucgccaacacccucgaccucaccgaccgcauccucccccgccuccaggcccgcgagaagugcaagccccagcuccucaacuucccccccuacacccgcaaccagaucgucaccauccuccaggaccgccucaaccaggucucccgcgaccagguccucgacaacgccgccguccaguucugcgcccgcaaggucuccgccgucuccggcgacguccgcaaggcccucgacgucugccgccgcgccaucgagaucgucgaguccgacgucaagucccagaccauccucaagccccucuccgagugcaagucccccuccgagccccucauccccaagcgcgucggccucauccacaucucccaggucaucuccgaggucgacggcaaccgcaugacccucucccaggagggcgcccaggacuccuucccccuccagcagaagauccucgucugcucccucaugcuccucauccgccagcucaagaucaaggaggucacccucggcaagcucuacgaggccuacuccaaggucugccgcaagcagcaggucgccgccgucgaccaguccgagugccucucccucuccggccuccucgaggcccgcggcauccucggccucaagcgcaacaaggagacccgccucaccaaggucuucuucaagaucgaggagaaggagaucgagcacgcccucaaggacaaggcccucaucggcaacauccucgccaccggccuccccuga

SEQ ID NO: 41060 - RNA, 1596 nt, Artificial Sequence
  derived and/or modified sequence opt2 from CDC73__Homo_sapiens__NP_078805
auggccgacguccucuccguccuccgccaguacaacauccagaagaaggagaucgucgucaagggcgacgaggucaucuucggcgaguucuccuggcccaagaacgucaagaccaacuacgucgucuggggcaccggcaaggagggccagccccgcgaguacuacacccucgacuccauccucuuccuccucaacaacguccaccucucccaccccgucuacguccgccgcgccgccaccgagaacauccccgucguccgccgccccgaccgcaaggaccuccucggcuaccucaacggcgaggccuccaccuccgccuccaucgaccgcuccgccccccucgagaucggccuccagcgcuccacccaggucaagcgcgccgccgacgagguccucgccgaggccaagaagccccgcaucgaggacgaggagugcguccgccucgacaaggagcgccucgccgcccgccucgagggccacaaggagggcaucguccagaccgagcagauccgcucccucuccgaggccauguccgucgagaagaucgccgccaucaaggccaagaucauggccaagaagcgcuccaccaucaagaccgaccucgacgacgacaucaccgcccucaagcagcgcuccuucgucgacgccgaggucgacgucacccgcgacaucgucucccgcgagcgcgucuggcgcacccgcaccaccauccuccaguccaccggcaagaacuucuccaagaacaucuucgccauccuccaguccgucaaggcccgcgaggagggccgcgcccccgagcagcgccccgcccccaacgccgcccccgucgaccccacccuccgcaccaagcagcccauccccgccgccuacaaccgcuacgaccaggagcgcuucaagggcaaggaggagaccgagggcuucaagaucgacaccaugggcaccuaccacggcaugacccucaaguccgucaccgagggcgccuccgcccgcaagacccagacccccgccgcccagcccgucccccgccccgucucccaggcccgccccccccccaaccagaagaagggcucccgcacccccaucaucaucauccccgccgccaccaccucccucaucaccaugcucaacgccaaggaccuccuccaggaccucaaguucguccccuccgacgagaagaagaagcagggcugccagcgcgagaacgagacccucauccagcgccgcaaggaccagaugcagcccggcggcaccgccaucuccgucaccguccccuaccgcgucgucgaccagccccucaagcucaugccccaggacugggaccgcgucgucgccgucuucguccagggccccgccuggcaguucaagggcuggcccuggcuccuccccgacggcucccccgucgacaucuucgccaagaucaaggccuuccaccucaaguacgacgagguccgccucgaccccaacguccagaagugggacgucaccguccucgagcucuccuaccacaagcgccaccucgaccgccccgucuuccuccgcuucugggagacccucgaccgcuacauggucaagcacaagucccaccuccgcuucuga

SEQ ID NO: 41061 - RNA, 1725 nt, Artificial Sequence
  derived and/or modified sequence opt2 from CDC7__Homo_sapiens__XP_011540528
auggaggccucccucggcauccagauggacgagcccauggccuucuccccccagcgcgaccgcuuccaggccgagggcucccucaagaagaacgagcagaacuucaagcucgccggcgucaagaaggacaucgagaagcucuacgaggccgucccccagcucuccaacgucuucaagaucgaggacaagaucggcgagggcaccuucuccuccgucuaccucgccaccgcccagcuccaggucggccccgaggagaagaucgcccucaagcaccucauccccaccucccaccccauccgcaucgccgccgagcuccagugccucaccgucgccggcggccaggacaacgucaugggcgucaaguacugcuuccgcaagaacgaccacgucgucaucgccaugcccuaccucgagcacgaguccuuccucgacauccucaacucccucuccuuccaggagguccgcgaguacaugcucaaccucuucaaggcccucaagcgcauccaccaguucggcaucguccaccgcgacgucaagcccuccaacuuccucuacaaccgccgccucaagaaguacgcccucgucgacuucggccucgcccagggcacccacgacaccaagaucgagcuccucaaguucguccaguccgaggcccagcaggagcgcugcucccagaacaagucccacaucaucaccggcaacaagaucccccucuccggccccguccccaaggagcucgaccagcaguccaccaccaaggccuccgucaagcgccccuacaccaacgcccagauccagaucaagcagggcaaggacggcaaggagggcuccgucggccucuccguccagcgcuccgucuucggcgagcgcaacuucaacauccacuccuccaucucccacgagucccccgccgucaagcucaugaagcaguccaagaccgucgacguccucucccgcaagcucgccaccaagaagaaggccaucuccaccaaggucaugaacuccgccgucaugcgcaagaccgccuccuccugccccgccucccucaccugcgacugcuacgccaccgacaaggucugcuccaucugccucucccgccgccagcaggucgccccccgcgccggcacccccggcuuccgcgcccccgagguccucaccaagugccccaaccagaccaccgccaucgacaugugguccgccggcgucaucuuccucucccuccucuccggccgcuaccccuucuacaaggccuccgacgaccucaccgcccucgcccagaucaugaccauccgcggcucccgcgagaccauccaggccgccaagaccuucggcaaguccauccucugcuccaaggagguccccgcccaggaccuccgcaagcucugcgagcgccuccgcggcauggacuccuccacccccaagcucaccuccgacauccagggccacgccucccaccagcccgccaucuccgagaagaccgaccacaaggccuccugccucguccagaccccccccggccaguacuccggcaacuccuucaagaagggcgacuccaacuccugcgagcacugcuucgacgaguacaacaccaaccucgagggcuggaacgagguccccgacgaggccuacgaccuccucgacaagcuccucgaccucaaccccgccucccgcaucaccgccgaggaggcccuccuccaccccuucuucaaggacaugucccucuga

SEQ ID NO: 41062 - RNA, 3072 nt, Artificial Sequence
  derived and/or modified sequence opt2 from CDCA2__Homo_sapiens__NP_689775
auggacgccaacuccaaggacaagccccccgagaccaaggaguccgccaugaacaacgccggcaacgccuccuucauccucggcaccggcaagaucgucaccccccagaagcacgccgagcucccccccaaccccugcacccccgacaccuucaaguccccccucaacuucuccaccgucaccgucgagcagcucggcaucacccccgaguccuucguccgcaacuccgccggcaaguccuccuccuaccucaagaagugccgccgccgcuccgccgucggcgcccgcggcucccccgagaccaaccaccucauccgcuucaucgcccgccagcagaacaucaagaacgcccgcaaguccccccucgcccaggacucccccucccagggcucccccgcccucuaccgcaacgucaacacccuccgcgagcgcaucuccgccuuccaguccgccuuccacuccaucaaggagaacgagaagaugaccggcugccucgaguucuccgaggccggcaaggaguccgagaugaccgaccucacccgcaaggagggccucuccgccugccagcaguccggcuuccccgccguccucuccuccaagcgccgccgcaucuccuaccagcgcgacuccgacgagaaccucaccgacgccgagggcaaggucaucggccuccagaucuucaacaucgacaccgaccgcgccugcgccgucgagaccuccgucgaccucuccgagaucuccuccaagcucggcuccacccaguccggcuuccucgucgaggagucccucccccucuccgagcucaccgagaccuccaacgcccucaaggucgccgacugcgucgucggcaagggcuccuccgacgccgucucccccgacaccuucaccgccgaggucuccuccgacgccguccccgacguccgcucccccgccacccccgccugccgccgcgaccuccccacccccaagaccuucguccuccgcuccguccucaagaagcccuccgucaagaugugccucgagucccuccaggagcacugcaacaaccucuacgacgacgacggcacccaccccucccucaucuccaaccuccccaacugcugcaaggagaaggaggccgaggacgaggagaacuucgaggcccccgccuuccucaacaugcgcaagcgcaagcgcgucaccuucggcgaggaccucucccccgaggucuucgacgagucccuccccgccaacaccccccuccgcaagggcggcacccccgucugcaagaaggacuucuccggccucuccucccuccuccucgagcagucccccguccccgagccccucccccagcccgacuucgacgacaagggcgagaaccucgagaacaucgagccccuccaggucuccuucgccguccucuccucccccaacaaguccuccaucuccgagacccucuccggcaccgacaccuucuccuccuccaacaaccacgagaagaucuccucccccaaggucggccgcaucacccgcaccuccaaccgccgcaaccagcucgucuccgucgucgaggaguccgucugcaaccuccucaacaccgagguccagcccugcaaggagaagaagaucaaccgccgcaagucccaggagaccaagugcaccaagcgcgcccuccccaagaagucccagguccucaaguccugccgcaagaagaagggcaagggcaagaaguccguccagaagucccucuacggcgagcgcgacaucgccuccaagaagccccuccucucccccauccccgagcuccccgagguccccgagaugacccccuccauccccuccauccgccgccucggcuccggcuacuucuccuccaacggcaagcucgaggaggucaagacccccaagaaccccgucaagcgcaaggaccuccuccgccacgaccccgaccuccacaugcaccagggcuacgacaaguacgacgucuccgaguucugcuccuacaucaaguccuccuccucccucggcaacgccaccuccgacgaggaccccaacaccaacaucaugaacaucaacgagaacaagaacauccccaaggccaagaacaaguccgaguccgagaacgagcccaaggccggcaccgacucccccgucuccugcgccuccgucaccgaggagcgcgucgccuccgacucccccaagcccgcccucacccuccagcagggccaggaguucuccgccggcggccagaacgccgagaaccucugccaguucuucaagaucucccccgaccucaacaucaagugcgagcgcaaggacgacuuccucggcgccgccgagggcaagcuccagugcaaccgccucaugcccaacucccagaaggacugccacugccucggcgacguccucaucgagaacaccaaggaguccaagucccaguccgaggaccucggccgcaagcccauggaguccuccuccgucgucuccugccgcgaccgcaaggaccgccgccgcuccaugugcuacuccgacggccgcucccuccaccucgagaagaacggcaaccacacccccuccuccuccgucggcuccuccgucgagaucucccucgagaacuccgagcucuucaaggaccucuccgacgccaucgagcagaccuuccagcgccgcaacuccgagaccaagguccgccgcuccacccgccuccagaaggaccucgagaacgagggccucgucuggaucucccucccccuccccuccaccucccagaaggccaagcgccgcaccaucugcaccuucgacuccuccggcuucgaguccaugucccccaucaaggagaccgucuccucccgccagaagccccagauggccccccccgucuccgaccccgagaacucccagggccccgccgccggcuccuccgacgagcccggcaagcgccgcaaguccuucugcaucuccacccucgccaacaccaaggccaccucccaguucaagggcuaccgccgccgcuccucccucaacggcaagggcgaguccucccucaccgcccucgagcgcaucgagcacaacggcgagcgcaagcaguga

SEQ ID NO: 41063 - RNA, 807 nt, Artificial Sequence
  derived and/or modified sequence opt2 from CDCA3__Homo_sapiens__NP_112589
augggcuccgccaaguccguccccgucacccccgcccgcccccccccccacaacaagcaccucgcccgcgucgccgacccccgcucccccuccgccggcauccuccgcacccccauccaggucgaguccuccccccagcccggccuccccgccggcgagcagcucgagggccucaagcacgcccaggacuccgacccccgcucccccacccucggcaucgcccgcacccccaugaagaccuccuccggcgacccccccuccccccucgucaagcagcucuccgaggucuucgagaccgaggacuccaaguccaaccucccccccgagcccguccucccccccgaggccccccucuccuccgagcucgaccucccccucggcacccagcucuccgucgaggagcagaugccccccuggaaccagaccgaguuccccuccaagcaggucuucuccaaggaggaggcccgccagcccaccgagacccccgucgccucccaguccuccgacaagcccucccgcgaccccgagaccccccgcuccuccggcuccaugcgcaaccgcuggaagcccaacuccuccaagguccucggccgcuccccccucaccauccuccaggacgacaacucccccggcacccucacccuccgccagggcaagcgccccuccccccucuccgagaacgucuccgagcucaaggagggcgccauccucggcaccggccgccuccucaagaccggcggccgcgccugggagcagggccaggaccacgacaaggagaaccagcacuucccccucgucgaguccuga

SEQ ID NO: 41064 - RNA, 759 nt, Artificial Sequence
  derived and/or modified sequence opt2 from CDCA5__Homo_sapiens__NP_542399
auguccggccgccgcacccgcuccggcggcgccgcccagcgcuccggcccccgcgcccccucccccaccaagccccuccgccgcucccagcgcaaguccggcuccgagcuccccuccauccuccccgagaucuggcccaagacccccuccgccgccgccguccgcaagcccaucguccucaagcgcaucgucgcccacgccgucgagguccccgccguccaguccccccgccgcuccccccgcaucuccuucuuccucgagaaggagaacgagccccccggccgcgagcucaccaaggaggaccucuucaagacccacuccguccccgccacccccaccuccacccccguccccaaccccgaggccgaguccuccuccaaggagggcgagcucgacgcccgcgaccucgagauguccaagaagguccgccgcuccuacucccgccucgagacccucggcuccgccuccaccuccacccccggccgccgcuccugcuucggcuucgagggccuccucggcgccgaggaccucuccggcgucucccccgucgucugcuccaagcucaccgaggucccccgcgucugcgccaagcccugggcccccgacaugacccuccccggcaucucccccccccccgagaagcagaagcgcaagaagaagaagaugcccgagauccucaagaccgagcucgacgagugggccgccgccaugaacgccgaguucgaggccgccgagcaguucgaccuccucgucgaguga

SEQ ID NO: 41065 - RNA, 1353 nt, Artificial Sequence
  derived and/or modified sequence opt2 from CDCA7__Homo_sapiens__NP_114148
auggacgcccgccgcgucccccagaaggaccuccgcgucaagaagaaccucaagaaguuccgcuacgucaagcucaucuccauggagaccuccuccuccuccgacgacuccugcgacuccuucgccuccgacaacuucgccaacaccaagcccaaguuccgcuccgacaucuccgaggagcucgccaacgucuucuacgaggacuccgacaacgaguccuucugcggcuucuccgaguccgagguccaggacguccucgaccacugcggcuuccuccagaagccccgccccgacgucaccaacgagcucgccggcaucuuccacgccgacuccgacgacgaguccuucugcggcuucuccgaguccgagauccaggacggcaugcgccuccaguccguccgcgagggcugccgcacccgcucccagugccgccacuccggcccccuccgcgucgccaugaaguuccccgcccgcuccacccgcggcgccaccaacaagaaggccgagucccgccagcccuccgagaacuccgucaccgacuccaacuccgacuccgaggacgaguccggcaugaacuuccucgagaagcgcgcccucaacaucaagcagaacaaggccaugcucgccaagcucauguccgagcucgaguccuuccccggcuccuuccgcggccgccacccccuccccggcuccgacucccagucccgccgcccccgccgccgcaccuuccccggcgucgccucccgccgcaaccccgagcgccgcgcccgcccccucacccgcucccgcucccgcauccucggcucccucgacgcccuccccauggaggaggaggaggaggaggacaaguacaugcucguccgcaagcgcaagaccgucgacggcuacaugaacgaggacgaccucccccgcucccgccgcucccgcuccuccgucacccucccccacaucauccgccccgucgaggagaucaccgaggaggagcucgagaacgucugcuccaacucccgcgagaagaucuacaaccgcucccucggcuccaccugccaccagugccgccagaagaccaucgacaccaagaccaacugccgcaaccccgacugcuggggcguccgcggccaguucugcggccccugccuccgcaaccgcuacggcgaggagguccgcgacgcccuccucgaccccaacuggcacugcccccccugccgcggcaucugcaacugcuccuucugccgccagcgcgacggccgcugcgccaccggcguccucgucuaccucgccaaguaccacggcuucggcaacguccacgccuaccucaagucccucaagcaggaguucgagaugcaggccuga

SEQ ID NO: 41066 - RNA, 1263 nt, Artificial Sequence
  derived and/or modified sequence opt2 from CDCA7L__Homo_sapiens__NP_001120842
auggagacccucuccuccgaggaguccugcgacuccuucgacucccucgaguccggcaagcagcaggacguccgcuuccacuccaaguacuucaccgaggagcuccgccgcaucuucaucgaggacaccgacuccgagaccgaggacuucgccggcuucacccaguccgaccucaacggcaagaccaaccccgaggucauggucgucgaguccgaccucuccgacgacggcaaggccucccucgucuccgaggaggaggaggacgaggaggaggacaaggccaccccccgccgcucccgcucccgccgcuccuccaucggccuccgcgucgccuuccaguuccccaccaagaagcucgccaacaagcccgacaagaacuccuccuccgagcagcucuucuccuccgcccgccuccagaacgagaagaagaccauccucgagcgcaagaaggacugccgccaggucauccagcgcgaggacuccaccuccgaguccgaggacgacucccgcgacgagucccaggaguccuccgacgcccuccucaagcgcaccaugaacaucaaggagaacaaggccaugcucgcccagcuccucgccgagcucaacuccaugcccgacuucuuccccguccgcacccccaccuccgccucccgcaagaagaccguccgccgcgccuucuccgagggccagaucacccgccgcaugaaccccacccgcuccgcccgcccccccgagaaguucgcccucgagaacuucaccgucuccgccgccaaguucgccgaggaguucuacuccuuccgccgccgcaagaccaucggcggcaagugccgcgaguaccgccgccgccaccgcaucuccuccuuccgccccgucgaggacaucaccgaggaggaccucgagaacgucgccaucaccguccgcgacaagaucuacgacaagguccucggcaacaccugccaccagugccgccagaagaccaucgacaccaagaccgucugccgcaaccagggcugcugcggcguccgcggccaguucugcggccccugccuccgcaaccgcuacggcgaggacguccgcuccgcccuccucgaccccgacugggucugcccccccugccgcggcaucugcaacugcuccuacugccgcaagcgcgacggccgcugcgccaccggcauccucauccaccucgccaaguucuacggcuacgacaacgucaaggaguaccucgagucccuccagaaggagcucgucgaggacaacuga

SEQ ID NO: 41067 - RNA, 2511 nt, Artificial Sequence
  derived and/or modified sequence opt2 from CDCP1__Homo_sapiens__NP_073753
auggccggccucaacugcggcgucuccaucgcccuccucggcguccuccuccucggcgccgcccgccucccccgcggcgccgaggccuucgagaucgcccucccccgcgaguccaacaucaccguccucaucaagcucggcacccccacccuccucgccaagcccugcuacaucgucaucuccaagcgccacaucaccaugcucuccaucaaguccggcgagcgcaucgucuucaccuucuccugccagucccccgagaaccacuucgucaucgagauccagaagaacaucgacugcauguccggccccugccccuucggcgagguccagcuccagcccuccaccucccuccuccccacccucaaccgcaccuucaucugggacgucaaggcccacaaguccaucggccucgagcuccaguucuccaucccccgccuccgccagaucggccccggcgaguccugccccgacggcgucacccacuccaucuccggccgcaucgacgccaccgucguccgcaucggcaccuucugcuccaacggcaccgucucccgcaucaagaugcaggagggcgucaagauggcccuccaccuccccugguuccacccccgcaacgucuccggcuucuccaucgccaaccgcuccuccaucaagcgccucugcaucaucgaguccgucuucgagggcgagggcuccgccacccucauguccgccaacuaccccgagggcuuccccgaggacgagcucaugaccuggcaguucgucguccccgcccaccuccgcgccuccgucuccuuccucaacuucaaccucuccaacugcgagcgcaaggaggagcgcgucgaguacuacauccccggcuccaccaccaaccccgaggucuucaagcucgaggacaagcagcccggcaacauggccggcaacuucaaccucucccuccagggcugcgaccaggacgcccagucccccggcauccuccgccuccaguuccagguccucguccagcacccccagaacgaguccaacaagaucuacgucgucgaccucuccaacgagcgcgccaugucccucaccaucgagccccgccccgucaagcagucccgcaaguucguccccggcugcuucgucugccucgagucccgcaccugcuccuccaaccucacccucaccuccggcuccaagcacaagaucuccuuccucugcgacgaccucacccgccucuggaugaacgucgagaagaccaucuccugcaccgaccaccgcuacugccagcgcaaguccuacucccuccagguccccuccgacauccuccaccuccccgucgagcuccacgacuucuccuggaagcuccucguccccaaggaccgccucucccucguccucguccccgcccagaagcuccagcagcacacccacgagaagcccugcaacaccuccuucuccuaccucgucgccuccgccauccccucccaggaccucuacuucggcuccuucugccccggcggcuccaucaagcagauccaggucaagcagaacaucuccgucacccuccgcaccuucgcccccuccuuccagcaggaggccucccgccagggccucaccgucuccuucauccccuacuucaaggaggagggcgucuucaccgucacccccgacaccaaguccaaggucuaccuccgcacccccaacugggaccgcggccuccccucccucaccuccgucuccuggaacaucuccgucccccgcgaccaggucgccugccucaccuucuucaaggagcgcuccggcgucgucugccagaccggccgcgccuucaugaucauccaggagcagcgcacccgcgccgaggagaucuucucccucgacgaggacguccuccccaagcccuccuuccaccaccacuccuucugggucaacaucuccaacugcucccccaccuccggcaagcagcucgaccuccucuucuccgucacccucaccccccgcaccgucgaccucaccgucauccucaucgccgccgucggcggcggcguccuccuccucuccgcccucggccucaucaucugcugcgucaagaagaagaagaagaagaccaacaagggccccgccgucggcaucuacaacgacaacaucaacaccgagaugccccgccagcccaagaaguuccagaagggccgcaaggacaacgacucccacgucuacgccgucaucgaggacaccauggucuacggccaccuccuccaggacuccuccggcuccuuccuccagcccgaggucgacaccuaccgccccuuccagggcaccaugggcgucugcccccccuccccccccaccaucugcucccgcgcccccaccgccaagcucgccaccgaggagccccccccccgcuccccccccgaguccgaguccgagcccuacaccuucucccaccccaacaacggcgacgucuccuccaaggacaccgacaucccccuccucaacacccaggagcccauggagcccgccgaguga

SEQ ID NO: 41068 - RNA, 2367 nt, Artificial Sequence
  derived and/or modified sequence opt2 from CDH10__Homo_sapiens__NP_006718
augaccauccaccaguuccuccuccucuuccucuucugggucugccucccccacuucugcucccccgagaucauguuccgccgcacccccgucccccagcagcgcauccucuccucccgcgucccccgcuccgacggcaagauccuccaccgccagaagcgcggcuggauguggaaccaguucuuccuccucgaggaguacaccggcuccgacuaccaguacgucggcaagcuccacuccgaccaggacaagggcgacggcucccucaaguacauccucuccggcgacggcgccggcacccucuucaucaucgacgagaagaccggcgacauccacgccacccgccgcaucgaccgcgaggagaaggccuucuacacccuccgcgcccaggccaucaaccgccgcacccuccgccccgucgagcccgaguccgaguucgucaucaagauccacgacaucaacgacaacgagcccaccuuccccgaggagaucuacaccgccuccguccccgagauguccgucgucggcaccuccgucguccaggucaccgccaccgacgccgacgaccccuccuacggcaacuccgcccgcgucaucuacuccauccuccagggccagcccuacuucuccgucgagcccgagaccggcaucauccgcaccgcccuccccaacaugaaccgcgagaaccgcgagcaguaccaggucgucauccaggccaaggacaugggcggccagaugggcggccucuccggcaccaccaccgucaacaucacccucaccgacgucaacgacaaccccccccgcuucccccagaacaccauccaccuccgcguccucgaguccucccccgucggcaccgccaucggcuccgucaaggccaccgacgccgacaccggcaagaacgccgaggucgaguaccgcaucaucgacggcgacggcaccgacauguucgacaucgucaccgagaaggacacccaggagggcaucaucaccgucaagaagccccucgacuacgagucccgccgccucuacacccucaaggucgaggccgagaacacccacgucgacccccgcuucuacuaccucggccccuucaaggacaccaccaucgucaagaucuccaucgaggacgucgacgagccccccgucuucucccgcuccuccuaccucuucgagguccacgaggacaucgaggucggcaccaucaucggcaccgucauggcccgcgaccccgacuccaucuccucccccauccgcuucucccucgaccgccacaccgaccucgaccgcaucuucaacauccacuccggcaacggcucccucuacaccuccaagccccucgaccgcgagcucucccaguggcacaaccucaccgucaucgccgccgagaucaacaaccccaaggagaccacccgcgucgccgucuucguccgcauccucgacgucaacgacaacgccccccaguucgccgucuucuacgacaccuucgucugcgagaacgcccgccccggccagcucauccagaccaucuccgccgucgacaaggacgacccccucggcggccagaaguucuucuucucccucgccgccgucaaccccaacuucaccguccaggacaacgaggacaacaccgcccgcauccucacccgcaagaacggcuucaaccgccacgagaucuccaccuaccuccuccccgucgucaucuccgacaacgacuaccccauccaguccuccaccggcacccucaccauccgcgucugcgccugcgacucccagggcaacaugcaguccugcuccgccgaggcccuccuccuccccgccggccucuccaccggcgcccucaucgccauccuccucugcaucaucauccuccucgucaucgucguccucuucgccgcccucaagcgccagcgcaagaaggagccccucauccucuccaaggaggacauccgcgacaacaucgucuccuacaacgacgagggcggcggcgaggaggacacccaggccuucgacaucggcacccuccgcaaccccgccgccaucgaggagaagaagcuccgccgcgacaucauccccgagacccucuucaucccccgccgcacccccaccgcccccgacaacaccgacguccgcgacuucaucaacgagcgccucaaggagcacgaccucgaccccaccgccccccccuacgacucccucgccaccuacgccuacgagggcaacgacuccaucgccgagucccucuccucccucgaguccggcaccaccgagggcgaccagaacuacgacuaccuccgcgaguggggcccccgcuucaacaagcucgccgagauguacggcggcggcgaguccgacaaggacuccuga

SEQ ID NO: 41069 - RNA, 2391 nt, Artificial Sequence
  derived and/or modified sequence opt2 from CDH11__Homo_sapiens__NP_001788
augaaggagaacuacugccuccaggccgcccucgucugccucggcaugcucugccacucccacgccuucgcccccgagcgccgcggccaccuccgccccuccuuccacggccaccacgagaagggcaaggagggccagguccuccagcgcuccaagcgcggcugggucuggaaccaguucuucgucaucgaggaguacaccggccccgaccccguccucgucggccgccuccacuccgacaucgacuccggcgacggcaacaucaaguacauccucuccggcgagggcgccggcaccaucuucgucaucgacgacaaguccggcaacauccacgccaccaagacccucgaccgcgaggagcgcgcccaguacacccucauggcccaggccgucgaccgcgacaccaaccgcccccucgagccccccuccgaguucaucgucaagguccaggacaucaacgacaacccccccgaguuccuccacgagaccuaccacgccaacguccccgagcgcuccaacgucggcaccuccgucauccaggucaccgccuccgacgccgacgaccccaccuacggcaacuccgccaagcucgucuacuccauccucgagggccagcccuacuucuccgucgaggcccagaccggcaucauccgcaccgcccuccccaacauggaccgcgaggccaaggaggaguaccacgucgucauccaggccaaggacaugggcggccacaugggcggccucuccggcaccaccaaggucaccaucacccucaccgacgucaacgacaacccccccaaguucccccaguccgucuaccagauguccgucuccgaggccgccguccccggcgaggaggucggccgcgucaaggccaaggaccccgacaucggcgagaacggccucgucaccuacaacaucgucgacggcgacggcauggaguccuucgagaucaccaccgacuacgagacccaggagggcgucaucaagcucaagaagcccgucgacuucgagaccaagcgcgccuacucccucaaggucgaggccgccaacguccacaucgaccccaaguucaucuccaacggccccuucaaggacaccgucaccgucaagaucuccgucgaggacgccgacgagccccccauguuccucgcccccuccuacauccacgagguccaggagaacgccgccgccggcaccgucgucggccgcguccacgccaaggaccccgacgccgccaacucccccauccgcuacuccaucgaccgccacaccgaccucgaccgcuucuucaccaucaaccccgaggacggcuucaucaagaccaccaagccccucgaccgcgaggagaccgccuggcucaacaucaccgucuucgccgccgagauccacaaccgccaccaggaggccaagguccccgucgccauccgcguccucgacgucaacgacaacgcccccaaguucgccgcccccuacgagggcuucaucugcgaguccgaccagaccaagccccucuccaaccagcccaucgucaccaucuccgccgacgacaaggacgacaccgccaacggcccccgcuucaucuucucccucccccccgagaucauccacaaccccaacuucaccguccgcgacaaccgcgacaacaccgccggcgucuacgcccgccgcggcggcuucucccgccagaagcaggaccucuaccuccuccccaucgucaucuccgacggcggcaucccccccauguccuccaccaacacccucaccaucaaggucugcggcugcgacgucaacggcgcccuccucuccugcaacgccgaggccuacauccucaacgccggccucuccaccggcgcccucaucgccauccucgccugcaucgucauccuccucgucaucgucguccucuucgucacccuccgccgccagaagaaggagccccucaucgucuucgaggaggaggacguccgcgagaacaucaucaccuacgacgacgagggcggcggcgaggaggacaccgaggccuucgacaucgccacccuccagaaccccgacggcaucaacggcuucaucccccgcaaggacaucaagcccgaguaccaguacaugccccgccccggccuccgccccgcccccaacuccgucgacgucgacgacuucaucaacacccgcauccaggaggccgacaacgaccccaccgccccccccuacgacuccauccagaucuacggcuacgagggccgcggcuccgucgccggcucccucuccucccucgaguccgccaccaccgacuccgaccucgacuacgacuaccuccagaacuggggcccccgcuucaagaagcucgccgaccucuacggcuccaaggacaccuucgacgacgacuccuga

SEQ ID NO: 41070 - RNA, 2283 nt, Artificial Sequence
  derived and/or modified sequence opt2 from CDH13__Homo_sapiens__NP_001207417
augaagaccccccccggcgccuccucccgcaccaagugcucccgcgagcuccgcuccuucugcgccuucuccugcccccgcgccaagcagcccaccugcaccgccugguucccccagcaggagcaccccuccgagaacggcccccagaugcccggccgcgacccccccgccgccuccaccaugcagguccuccuccucaccuccgccgaggaccucgacugcacccccggcuuccagcagaaggucuuccacaucaaccagcccgccgaguucaucgaggaccaguccauccucaaccucaccuucuccgacugcaagggcaacgacaagcuccgcuacgaggucuccucccccuacuucaaggucaacuccgacggcggccucgucgcccuccgcaacaucaccgccgucggcaagacccucuucguccacgcccgcaccccccacgccgaggacauggccgagcucgucaucgucggcggcaaggacauccagggcucccuccaggacaucuucaaguucgcccgcaccucccccgucccccgccagaagcgcuccaucgucgucucccccauccucauccccgagaaccagcgccagcccuucccccgcgacgucggcaaggucgucgacuccgaccgccccgagcgcuccaaguuccgccucaccggcaagggcgucgaccaggagcccaagggcaucuuccgcaucaacgagaacaccggcuccgucuccgucacccgcacccucgaccgcgaggucaucgccgucuaccagcucuucgucgagaccaccgacgucaacggcaagacccucgagggccccgucccccucgaggucaucgucaucgaccagaacgacaaccgccccaucuuccgcgagggccccuacaucggccacgucauggagggcucccccaccggcaccaccgucaugcgcaugaccgccuucgacgccgacgaccccgccaccgacaacgcccuccuccgcuacaacauccgccagcagacccccgacaagcccucccccaacauguucuacaucgaccccgagaagggcgacaucgucaccgucgucucccccgcccuccucgaccgcgagacccucgagaaccccaaguacgagcucaucaucgaggcccaggacauggccggccucgacgucggccucaccggcaccgccaccgccaccaucaugaucgacgacaagaacgaccacucccccaaguucaccaagaaggaguuccaggccaccgucgaggagggcgccgucggcgucaucgucaaccucaccgucgaggacaaggacgaccccaccaccggcgccuggcgcgccgccuacaccaucaucaacggcaaccccggccaguccuucgagauccacaccaacccccagaccaacgagggcaugcucuccgucgucaagccccucgacuacgagaucuccgccuuccacacccuccucaucaaggucgagaacgaggacccccucguccccgacgucuccuacggccccuccuccaccgccaccguccacaucaccguccucgacgucaacgagggccccgucuucuaccccgaccccaugauggucacccgccaggaggaccucuccgucggcuccguccuccucaccgucaacgccaccgaccccgacucccuccagcaccagaccauccgcuacuccgucuacaaggaccccgccggcuggcucaacaucaaccccaucaacggcaccgucgacaccaccgccguccucgaccgcgagucccccuucgucgacaacuccgucuacaccgcccucuuccucgccaucgacuccggcaacccccccgccaccggcaccggcacccuccucaucacccucgaggacgucaacgacaacgcccccuucaucuaccccaccgucgccgaggucugcgacgacgccaagaaccucuccgucgucauccucggcgccuccgacaaggaccuccaccccaacaccgaccccuucaaguucgagauccacaagcaggccguccccgacaaggucuggaagaucuccaagaucaacaacacccacgcccucgucucccuccuccagaaccucaacaaggccaacuacaaccuccccaucauggucaccgacuccggcaagccccccaugaccaacaucaccgaccuccgcguccaggucugcuccugccgcaacuccaaggucgacugcaacgccgccggcgcccuccgcuucucccuccccuccguccuccuccucucccucuucucccucgccugccucuga

SEQ ID NO: 41071 - RNA, 2445 nt, Artificial Sequence
  derived and/or modified sequence opt2 from CDH15__Homo_sapiens__NP_004924
auggacgccgccuuccuccucguccucggccuccucgcccagucccucugccucucccucggcguccccggcuggcgccgccccaccacccucuaccccuggcgccgcgcccccgcccucucccgcguccgccgcgccugggucaucccccccaucuccgucuccgagaaccacaagcgccuccccuacccccucguccagaucaaguccgacaagcagcagcucggcuccgucaucuacuccauccagggccccggcgucgacgaggagccccgcggcgucuucuccaucgacaaguucaccggcaaggucuuccucaacgccaugcucgaccgcgagaagaccgaccgcuuccgccuccgcgccuucgcccucgaccucggcggcuccacccucgaggaccccaccgaccucgagaucgucgucgucgaccagaacgacaaccgccccgccuuccuccaggaggccuucaccggccgcguccucgagggcgccguccccggcaccuacgucacccgcgccgaggccaccgacgccgacgaccccgagaccgacaacgccgcccuccgcuucuccauccuccagcagggcucccccgagcucuucuccaucgacgagcucaccggcgagauccgcaccguccaggucggccucgaccgcgaggucgucgccgucuacaaccucacccuccaggucgccgacauguccggcgacggccucaccgccaccgccuccgccaucaucacccucgacgacaucaacgacaacgcccccgaguucacccgcgacgaguucuucauggaggccaucgaggccgucuccggcgucgacgucggccgccucgaggucgaggaccgcgaccuccccggcucccccaacugggucgcccgcuucaccauccucgagggcgaccccgacggccaguucaccauccgcaccgaccccaagaccaacgagggcguccucuccaucgucaaggcccucgacuacgaguccugcgagcacuacgagcucaaggucuccguccagaacgaggccccccuccaggccgccgcccuccgcgccgagcgcggccaggccaagguccgcguccacguccaggacaccaacgagccccccgucuuccaggagaacccccuccgcaccucccucgccgagggcgccccccccggcacccucgucgccaccuucuccgcccgcgaccccgacaccgagcagcuccagcgccucuccuacuccaaggacuacgaccccgaggacuggcuccaggucgacgccgccaccggccgcauccagacccagcacguccucucccccgccucccccuuccucaagggcggcugguaccgcgccaucguccucgcccaggacgacgccucccagccccgcaccgccaccggcacccucuccaucgagauccucgaggucaacgaccacgcccccguccucgccccccccccccccggcucccucugcuccgagccccaccagggccccggccuccuccucggcgccaccgacgaggaccuccccccccacggcgcccccuuccacuuccagcucuccccccgccuccccgagcucggccgcaacuggucccucucccaggucaacgucucccacgcccgccuccgcccccgccaccagguccccgagggccuccaccgccucucccuccuccuccgcgacuccggccagcccccccagcagcgcgagcagccccucaacgucaccgucugccgcugcggcaaggacggcgucugccuccccggcgccgccgcccuccucgccggcggcaccggccucucccucggcgcccucgucaucguccucgccuccgcccuccuccuccucguccucguccuccucgucgcccuccgcgcccgcuucuggaagcagucccgcggcaagggccuccuccacggcccccaggacgaccuccgcgacaacguccucaacuacgacgagcagggcggcggcgaggaggaccaggacgccuacgacaucucccagcuccgccaccccaccgcccucucccucccccucggcccccccccccuccgccgcgacgccccccagggccgccuccacccccagcccccccgcguccuccccaccuccccccucgacaucgccgacuucaucaacgacggccucgaggccgccgacuccgaccccuccgucccccccuacgacaccgcccucaucuacgacuacgagggcgacggcuccgucgccggcacccucuccuccauccucuccucccagggcgacgaggaccaggacuacgacuaccuccgcgacuggggcccccgcuucgcccgccucgccgacauguacggccaccccugcggccucgaguacggcgcccgcugggaccaccaggcccgcgagggccucucccccggcgcccuccucccccgccaccgcggccgcaccgccuga

SEQ ID NO: 41072 - RNA, 2424 nt, Artificial Sequence
  derived and/or modified sequence opt2 from CDH16__Homo_sapiens__NP_001191673
augguccccgccuggcucuggcuccucugcgucuccgucccccaggcccuccccaaggcccagcccgccgagcucuccgucgagguccccgagaacuacggcggcaacuucccccucuaccucaccaagcucccccucccccgcgagggcgccgagggccagaucguccucuccggcgacuccggcaaggccaccgagggccccuucgccauggaccccgacuccggcuuccuccucgucacccgcgcccucgaccgcgaggagcaggccgaguaccagcuccaggucacccucgagaugcaggacggccacguccucuggggcccccagcccguccucguccacgucaaggacgagaacgaccaggucccccacuucucccaggccaucuaccgcgcccgccucucccgcggcacccgccccggcauccccuuccucuuccucgaggccuccgaccgcgacgagcccggcaccgccaacuccgaccuccgcuuccacauccucucccaggcccccgcccagcccucccccgacauguuccagcucgagccccgccucggcgcccucgcccucucccccaagggcuccaccucccucgaccacgcccucgagcgcaccuaccagcuccucguccaggucaaggacaugggcgaccaggccuccggccaccaggccaccgccaccgucgaggucuccaucaucgaguccaccugggucucccucgagcccauccaccucgccgagaaccucaagguccucuacccccaccacauggcccagguccacugguccggcggcgacguccacuaccaccucgagucccacccccccggccccuucgaggucaacgccgagggcaaccucuacgucacccgcgagcucgaccgcgaggcccaggccgaguaccuccuccagguccgcgcccagaacucccacggcgaggacuacgccgccccccucgagcuccacguccucgucauggacgagaacgacaacguccccaucugccccccccgcgaccccaccgucuccauccccgagcucuccccccccggcaccgaggucacccgccucuccgccgaggacgccgacgcccccggcucccccaacucccacgucgucuaccagcuccucucccccgagcccgaggacggcgucgagggccgcgccuuccaggucgaccccaccuccggcuccgucacccucggcguccucccccuccgcgccggccagaacauccuccuccucguccucgccauggaccucgccggcgccgagggcggcuucuccuccaccugcgaggucgaggucgccgucaccgacaucaacgaccacgcccccgaguucaucaccucccagaucggccccaucucccuccccgaggacgucgagcccggcacccucgucgccaugcucaccgccaucgacgccgaccucgagcccgccuuccgccucauggacuucgccaucgagcgcggcgacaccgagggcaccuucggccucgacugggagcccgacuccggccacguccgccuccgccucugcaagaaccucuccuacgaggccgcccccucccacgaggucgucgucgucguccaguccgucgccaagcucgucggccccggccccggccccggcgccaccgccaccgucaccguccucgucgagcgcgucaugcccccccccaagcucgaccaggaguccuacgaggccuccguccccaucuccgcccccgccggcuccuuccuccucaccauccagcccuccgaccccaucucccgcacccuccgcuucucccucgucaacgacuccgagggcuggcucugcaucgagaaguucuccggcgagguccacaccgcccagucccuccagggcgcccagcccggcgacaccuacaccguccucgucgaggcccaggacaccgcccucacccucgcccccguccccucccaguaccucugcaccccccgccaggaccacggccucaucgucuccggccccuccaaggaccccgaccucgccuccggccacggccccuacuccuucacccucggccccaaccccaccguccagcgcgacuggcgccuccagacccucaacggcucccacgccuaccucacccucgcccuccacugggucgagccccgcgagcacaucauccccgucgucgucucccacaacgcccagauguggcagcuccucguccgcgucaucgucugccgcugcaacgucgagggccagugcaugcgcaaggucggccgcaugaagggcaugcccaccaagcucuccgccgucggcauccucgucggcacccucgucgccaucggcaucuuccucauccucaucuucacccacuggaccaugucccgcaagaaggaccccgaccagcccgccgacuccgucccccucaaggccaccgucuga

SEQ ID NO: 41073 - RNA, 2499 nt, Artificial Sequence
  derived and/or modified sequence opt2 from CDH17__Homo_sapiens__NP_001138135
augauccuccaggcccaccuccacucccucugccuccucaugcucuaccucgccaccggcuacggccaggagggcaaguucuccggcccccucaagcccaugaccuucuccaucuacgagggccaggagcccucccagaucaucuuccaguucaaggccaacccccccgccgucaccuucgagcucaccggcgagaccgacaacaucuucgucaucgagcgcgagggccuccucuacuacaaccgcgcccucgaccgcgagacccgcuccacccacaaccuccaggucgccgcccucgacgccaacggcaucaucgucgagggccccguccccaucaccaucaaggucaaggacaucaacgacaaccgccccaccuuccuccaguccaaguacgagggcuccguccgccagaacucccgccccggcaagcccuuccucuacgucaacgccaccgaccucgacgaccccgccacccccaacggccagcucuacuaccagaucgucauccagcuccccaugaucaacaacgucauguacuuccagaucaacaacaagaccggcgccaucucccucacccgcgagggcucccaggagcucaaccccgccaagaaccccuccuacaaccucgucaucuccgucaaggacaugggcggccaguccgagaacuccuucuccgacaccaccuccgucgacaucaucgucaccgagaacaucuggaaggcccccaagcccgucgagauggucgagaacuccaccgacccccaccccaucaagaucacccagguccgcuggaacgaccccggcgcccaguacucccucgucgacaaggagaagcucccccgcuuccccuucuccaucgaccaggagggcgacaucuacgucacccagccccucgaccgcgaggagaaggacgccuacgucuucuacgccgucgccaaggacgaguacggcaagccccucuccuacccccucgagauccacgucaaggucaaggacaucaacgacaacccccccaccugccccucccccgucaccgucuucgagguccaggagaacgagcgccucggcaacuccaucggcacccucaccgcccacgaccgcgacgaggagaacaccgccaacuccuuccucaacuaccgcaucgucgagcagacccccaagcuccccauggacggccucuuccucauccagaccuacgccggcaugcuccagcucgccaagcagucccucaagaagcaggacaccccccaguacaaccucaccaucgaggucuccgacaaggacuucaagacccucugcuucguccagaucaacgucaucgacaucaacgaccagauccccaucuucgagaaguccgacuacggcaaccucacccucgccgaggacaccaacaucggcuccaccauccucaccauccaggccaccgacgccgacgagcccuucaccggcuccuccaagauccucuaccacaucaucaagggcgacuccgagggccgccucggcgucgacaccgacccccacaccaacaccggcuacgucaucaucaagaagccccucgacuucgagaccgccgccgucuccaacaucgucuucaaggccgagaaccccgagccccucgucuucggcgucaaguacaacgccuccuccuucgccaaguucacccucaucgucaccgacgucaacgaggccccccaguucucccagcacgucuuccaggccaaggucuccgaggacgucgccaucggcaccaaggucggcaacgucaccgccaaggaccccgagggccucgacaucuccuacucccuccgcggcgacacccgcggcuggcucaagaucgaccacgucaccggcgagaucuucuccgucgccccccucgaccgcgaggccggcucccccuaccgcguccaggucgucgccaccgaggucggcggcuccucccucuccuccgucuccgaguuccaccucauccucauggacgucaacgacaaccccccccgccucgccaaggacuacaccggccucuucuucugccacccccucuccgcccccggcucccucaucuucgaggccaccgacgacgaccagcaccucuuccgcggcccccacuucaccuucucccucggcuccggcucccuccagaacgacugggaggucuccaagaucaacggcacccacgcccgccucuccacccgccacaccgaguucgaggagcgcgaguacgucguccucauccgcaucaacgacggcggccgccccccccucgagggcaucgucucccuccccgucaccuucugcuccugcgucgagggcuccugcuuccgccccgccggccaccagaccggcauccccaccgucggcauggccgucggcauccuccucaccacccuccucgucaucggcaucauccucgccgucgucuucauccgcaucaagaaggacaagggcaaggacaacgucgaguccgcccaggccuccgaggucaagccccuccgcuccuga

SEQ ID NO: 41074 - RNA, 1725 nt, Artificial Sequence
  derived and/or modified sequence opt2 from CDH18__Homo_sapiens__NP_001161139
augaagaucaccuccaccuccugcaucugccccguccucgucugccucugcuucguccagcgcugcuacggcaccgcccaccacuccuccaucaaggucaugcgcaaccagaccaagcacaucgagggcgagaccgagguccaccaccgccccaagcgcggcugggucuggaaccaguucuucguccucgaggagcacaugggccccgacccccaguacgucggcaagcuccacuccaacuccgacaagggcgacggcuccgucaaguacauccucaccggcgagggcgccggcaccaucuucaucaucgacgacaccaccggcgacauccacuccaccaagucccucgaccgcgagcagaagacccacuacguccuccacgcccaggccaucgaccgccgcaccaacaagccccucgagcccgaguccgaguucaucaucaagguccaggacaucaacgacaacgcccccaaguucaccgacggccccuacaucgucaccguccccgagauguccgacaugggcaccuccguccuccaggucaccgccaccgacgccgacgaccccaccuacggcaacuccgcccgcgucgucuacuccauccuccagggccagcccuacuucuccgucgaccccaagaccggcgucauccgcaccgcccuccacaacauggaccgcgaggcccgcgagcacuacuccgucgucauccaggccaaggacauggccggccaggucggcggccucuccggcuccaccaccgucaacaucacccucaccgacgucaacgacaaccccccccgcuucccccagaagcacuaccagcucuacguccccgaguccgcccaggucggcuccgccgucggcaagaucaaggccaacgacgccgacaccggcuccaacgccgacaugaccuacuccaucaucaacggcgacggcaugggcaucuucuccaucuccaccgacaaggagacccgcgagggcauccucucccucaagaagccccucaacuacgagaagaagaaguccuacacccucaacaucgagggcgccaacacccaccucgacuuccgcuucucccaccucggccccuucaaggacgccaccaugcucaagaucaucgucggcgacgucgacgagcccccccucuucuccaugcccuccuaccucauggaggucuacgagaacgccaagaucggcaccgucgucggcaccguccucgcccaggaccccgacuccaccaacucccucguccgcuacuucaucaacuacaacgucgaggacgaccgcuucuucaacaucgacgccaacaccggcaccauccgcaccaccaagguccucgaccgcgaggagacccccugguacaacaucaccgucaccgccuccgagaucgacaaccccgaccuccucucccacgucaccgucggcauccgcguccucgacgucaacgacaacccccccgagcucgcccgcgaguacgacaucaucgucugcgagaacuccaagcccggccaggucauccacaccaucuccgccaccgacaaggacgacuucgccaacggcccccgcuucaacuucuuccucgacgagcgccuccccgucaaccccaacuucacccucaaggacaacgaggccgccgcccccucccccuccggcuucguccacgcccgcgagaugggcgucugcggccccgccaugcagaagcccuccugcccccgccucgucuga

SEQ ID NO: 41075 - RNA, 1473 nt, Artificial Sequence
  derived and/or modified sequence opt2 from CDH19__Homo_sapiens__NP_001257957
augaacugcuaccuccuccuccgcuucaugcucggcaucccccuccucuggcccugccucggcgccaccgagaacucccagaccaagaaggucaagcagcccguccgcucccaccuccgcgucaagcgcggcugggucuggaaccaguucuucguccccgaggagaugaacaccaccucccaccacaucggccagcuccgcuccgaccucgacaacggcaacaacuccuuccaguacaagcuccucggcgccggcgccggcuccaccuucaucaucgacgagcgcaccggcgacaucuacgccauccagaagcucgaccgcgaggagcgcucccucuacauccuccgcgcccaggucaucgacaucgccaccggccgcgccgucgagcccgaguccgaguucgucaucaaggucuccgacaucaacgacaacgagcccaaguuccucgacgagcccuacgaggccaucguccccgagaugucccccgagggcacccucgucauccaggucaccgccuccgacgccgacgaccccuccuccggcaacaacgcccgccuccucuacucccuccuccagggccagcccuacuucuccgucgagcccaccaccggcgucauccgcaucuccuccaagauggaccgcgagcuccaggacgaguacugggucaucauccaggccaaggacaugaucggccagcccggcgcccucuccggcaccaccuccguccucaucaagcucuccgacgucaacgacaacaagcccaucuucaaggagucccucuaccgccucaccgucuccgaguccgcccccaccggcaccuccaucggcaccaucauggccuacgacaacgacaucggcgagaacgccgagauggacuacuccaucgaggaggacgacucccagaccuucgacaucaucaccaaccacgagacccaggagggcaucgucauccucaagaagaaggucgacuucgagcaccagaaccacuacggcauccgcgccaaggucaagaaccaccacguccccgagcagcucaugaaguaccacaccgaggccuccaccaccuucaucaagauccaggucgaggacgucgacgagcccccccucuuccuccuccccuacuacgucuucgaggucuucgaggagaccccccagggcuccuucgucggcgucgucuccgccaccgaccccgacaaccgcaagucccccauccgcuacuccaucacccgcuccaaggucuucaacaucaacgacaacggcaccaucaccaccuccaacucccucgaccgcgagaucuccgccugguacaaccucuccaucaccgccaccgagaaguacaacaucgagcagaucuccuccaucccccucuacguccagguccucaacaucaacgaccacgcccccgaguucucccaguacuacgagaccuacgucugcgagaacgccggcuccggccagggccucuucuucuga

SEQ ID NO: 41076 - RNA, 2649 nt, Artificial Sequence
  derived and/or modified sequence opt2 from CDH1__Homo_sapiens__NP_004351
augggccccuggucccgcucccucuccgcccuccuccuccuccuccaggucuccuccuggcucugccaggagcccgagcccugccaccccggcuucgacgccgaguccuacaccuucaccgucccccgccgccaccucgagcgcggccgcguccucggccgcgucaacuucgaggacugcaccggccgccagcgcaccgccuacuucucccucgacacccgcuucaaggucggcaccgacggcgucaucaccgucaagcgcccccuccgcuuccacaacccccagauccacuuccucgucuacgccugggacuccaccuaccgcaaguucuccaccaaggucacccucaacaccgucggccaccaccaccgcccccccccccaccaggccuccgucuccggcauccaggccgagcuccucaccuuccccaacuccucccccggccuccgccgccagaagcgcgacugggucaucccccccaucuccugccccgagaacgagaagggccccuuccccaagaaccucguccagaucaaguccaacaaggacaaggagggcaaggucuucuacuccaucaccggccagggcgccgacaccccccccgucggcgucuucaucaucgagcgcgagaccggcuggcucaaggucaccgagccccucgaccgcgagcgcaucgccaccuacacccucuucucccacgccgucuccuccaacggcaacgccgucgaggaccccauggagauccucaucaccgucaccgaccagaacgacaacaagcccgaguucacccaggaggucuucaagggcuccgucauggagggcgcccuccccggcaccuccgucauggaggucaccgccaccgacgccgacgacgacgucaacaccuacaacgccgccaucgccuacaccauccucucccaggaccccgagcuccccgacaagaacauguucaccaucaaccgcaacaccggcgucaucuccgucgucaccaccggccucgaccgcgaguccuuccccaccuacacccucgucguccaggccgccgaccuccagggcgagggccucuccaccaccgccaccgccgucaucaccgucaccgacaccaacgacaacccccccaucuucaaccccaccaccuacaagggccagguccccgagaacgaggccaacgucgucaucaccacccucaaggucaccgacgccgacgcccccaacacccccgccugggaggccgucuacaccauccucaacgacgacggcggccaguucgucgucaccaccaaccccgucaacaacgacggcauccucaagaccgccaagggccucgacuucgaggccaagcagcaguacauccuccacgucgccgucaccaacgucguccccuucgaggucucccucaccaccuccaccgccaccgucaccgucgacguccucgacgucaacgaggcccccaucuucgucccccccgagaagcgcgucgaggucuccgaggacuucggcgucggccaggagaucaccuccuacaccgcccaggagcccgacaccuucauggagcagaagaucaccuaccgcaucuggcgcgacaccgccaacuggcucgagaucaaccccgacaccggcgccaucuccacccgcgccgagcucgaccgcgaggacuucgagcacgucaagaacuccaccuacaccgcccucaucaucgccaccgacaacggcucccccgucgccaccggcaccggcacccuccuccucauccucuccgacgucaacgacaacgcccccauccccgagccccgcaccaucuucuucugcgagcgcaaccccaagccccaggucaucaacaucaucgacgccgaccucccccccaacaccucccccuucaccgccgagcucacccacggcgccuccgccaacuggaccauccaguacaacgaccccacccaggaguccaucauccucaagcccaagauggcccucgaggucggcgacuacaagaucaaccucaagcucauggacaaccagaacaaggaccaggucaccacccucgaggucuccgucugcgacugcgagggcgccgccggcgucugccgcaaggcccagcccgucgaggccggccuccagauccccgccauccucggcauccucggcggcauccucgcccuccucauccucauccuccuccuccuccucuuccuccgccgccgcgccgucgucaaggagccccuccucccccccgaggacgacacccgcgacaacgucuacuacuacgacgaggagggcggcggcgaggaggaccaggacuucgaccucucccagcuccaccgcggccucgacgcccgccccgaggucacccgcaacgacgucgcccccacccucauguccgucccccgcuaccucccccgccccgccaaccccgacgagaucggcaacuucaucgacgagaaccucaaggccgccgacaccgaccccaccgccccccccuacgacucccuccucgucuucgacuacgagggcuccggcuccgaggccgccucccucuccucccucaacuccuccgaguccgacaaggaccaggacuacgacuaccucaacgaguggggcaaccgcuucaagaagcucgccgacauguacggcggcggcgaggacgacuga

SEQ ID NO: 41077 - RNA, 2406 nt, Artificial Sequence
  derived and/or modified sequence opt2 from CDH20__Homo_sapiens__XP_005266739
auguggaccuccggccgcauguccaacgccaagaacuggcucggccucggcaugucccucuacuucuggggccucauggaccucaccaccaccguccucuccgacacccccaccccccagggcgagcucgaggcccuccucuccgacaagccccagucccaccagcgcaccaagcgcuccugggucuggaaccaguucuucguccucgaggaguacaccggcaccgacccccucuacgucggcaagcuccacuccgacauggaccgcggcgacggcuccaucaaguacauccucuccggcgagggcgccggcaucgucuucaccaucgacgacaccaccggcgacauccacgccauccagcgccucgaccgcgaggagcgcgcccaguacacccuccgcgcccaggcccucgaccgccgcaccggccgccccauggagcccgaguccgaguucaucaucaagauccaggacaucaacgacaacgagcccaaguuccucgacggccccuacgucgccaccguccccgagaugucccccgucggcaccuccgucauccaggucaccgccaccgacgccgacgaccccaccuacggcaacuccgcccgcgucgucuacuccauccuccagggccagcccuacuucuccgucgacuccaagaccggcgucauccgcaccgcccucaugaacauggaccgcgaggccaaggaguacuacgaggucaucauccaggccaaggacaugggcggccagcucggcggccucgccggcaccaccaccgucaacaucacccucuccgacgucaacgacaaccccccccgcuucccccagaagcacuaccagauguccguccucgaguccgcccccaucuccuccaccgucggccgcgucuucgccaaggaccucgacgagggcaucaacgccgagaugaaguacaccaucgucgacggcgacggcgccgacgccuucgacaucuccaccgaccccaacuuccaggucggcaucaucaccgucaagaagccccucuccuucgaguccaagaaguccuacacccucaaggucgagggcgccaacccccaccucgagaugcgcuuccucaaccucggccccuuccaggacaccaccaccguccacaucuccgucgaggacgucgacgagccccccgucuucgagcccggcuucuacuucgucgagguccccgaggacgucgccaucggcaccaccauccagaucaucuccgccaaggaccccgacgucaccaacaacuccauccgcuacuccaucgaccgcuccuccgaccccggccgcuucuucuacgucgacaucaccaccggcgcccucaugaccgcccgcccccucgaccgcgaggaguucuccuggcacaacaucaccguccucgccauggagaugaacaaccccucccaggucggcuccguccccgucaccaucaagguccucgacgucaacgacaacgcccccgaguucccccgcuucuacgaggccuucgucugcgagaacgccaaggccggccagcucauccagaccgucuccgccgucgaccaggacgacccccgcaacggccagcacuucuacuacucccucgcccccgaggccgccaacaaccccaacuucaccauccgcgacaaccaggacaacaccgcccgcauccucacccgccgcuccggcuuccgccagcaggagcaguccgucuuccaccuccccauccucaucgccgacuccggccagcccguccucuccuccaccggcacccucaccauccaggucugcuccugcgacgacgacggccacgucauguccugcucccccgaggccuacaugcuccccgucucccucucccgcggcgcccucaucgccauccucgccugcaucuucguccuccucguccucguccuccucauccucuccaugcgccgccaccgcaagcagcccuacaucaucgacgacgaggagaacauccacgagaacaucguccgcuacgacgacgagggcggcggcgaggaggacaccgaggccuucgacaucgccgccauguggaacccccgcgaggcccaggccggcgccgcccccaagacccgccaggacaugcuccccgagaucgagucccucucccgcuacgucccccagaccugcgccgucaacuccaccguccacuccuacguccucgccaagcucuacgaggccgacauggaccucugggccccccccuucgacucccuccagaccuacauguucgagggcgacggcuccgucgccggcucccucuccucccuccaguccgccaccuccgacuccgagcaguccuucgacuuccucaccgacuggggcccccgcuuccgcaagcucgccgagcucuacggcgccuccgagggccccgccccccucugguga

SEQ ID NO: 41078 - RNA, 2487 nt, Artificial Sequence
  derived and/or modified sequence opt2 from CDH22__Homo_sapiens__XP_011527296
augcgcccccgccccgagggccgcggccuccgcgccggcgucgcccucucccccgcccuccuccuccuccuccuccucccccccccccccacccuccucggccgccucugggccgccggcacccccucccccuccgcccccggcgcccgccaggacggcgcccucggcgccggccgcgucaagcgcggcugggucuggaaccaguucuucgucgucgaggaguacaccggcaccgagccccucuacgucggcaagauccacuccgacuccgacgagggcgacggcgccaucaaguacaccaucuccggcgagggcgccggcaccaucuuccucaucgacgagcucaccggcgacauccacgccauggagcgccucgaccgcgagcagaagaccuucuacacccuccgcgcccaggcccgcgaccgcgccaccaaccgccuccucgagcccgaguccgaguucaucaucaagguccaggacaucaacgacuccgagccccgcuuccuccacggccccuacaucggcuccgucgccgagcucucccccaccggcaccuccgucaugcaggucauggccuccgacgccgacgaccccaccuacggcuccuccgcccgccucgucuacuccguccucgacggcgagcaccacuucaccgucgaccccaagaccggcgucauccgcaccgccguccccgaccucgaccgcgagucccaggagcgcuacgaggucgucauccaggccaccgacauggccggccagcucggcggccucuccggcuccaccaccgucaccaucgucgucaccgacgucaacgacaaccccccccgcuucccccagaagauguaccaguucuccauccaggaguccgcccccaucggcaccgccgucggccgcgucaaggccgaggacuccgacgucggcgagaacaccgacaugaccuaccaccucaaggacgaguccuccuccggcggcgacgucuucaaggucaccaccgacuccgacacccaggaggccaucaucgucguccagaagcgccucgacuucgagucccagcccguccacaccgucauccucgaggcccucaacaaguucgucgacccccgcuucgccgaccucggcaccuuccgcgaccaggccaucguccgcgucgccgucaccgacgucgacgagccccccgaguuccgcccccccuccggccuccucgagguccaggaggacgcccaggucggcucccucgucggcgucgucaccgcccgcgaccccgacgccgccaaccgccccguccgcuacgccaucgaccgcgaguccgaccucgaccagaucuucgacaucgacgccgacaccggcgccaucgucaccggcaagggccucgaccgcgagaccgccggcuggcacaacaucaccguccucgccauggaggccgacaaccacgcccagcucucccgcgccucccuccgcauccgcauccucgacgucaacgacaacccccccgagcucgccacccccuacgaggccgccgucugcgaggacgccaagcccggccagcucauccagaccaucuccgucgucgaccgcgacgagccccagggcggccaccgcuucuacuuccgccucguccccgaggcccccuccaacccccacuucucccuccucgacauccaggacaacaccgccgccguccacacccagcacgucggcuucaaccgccaggagcaggacgucuucuuccuccccauccucgucgucgacuccggcccccccacccucuccuccaccggcacccucaccauccgcaucugcggcugcgacuccuccggcaccauccaguccugcaacaccaccgccuucgucauggccgccucccucucccccggcgcccucaucgcccuccucgucugcguccucauccucgucguccucguccuccucauccucacccuccgccgccaccacaagucccaccucuccuccgacgaggacgaggacaugcgcgacaacgucaucaaguacaacgacgagggcggcggcgagcaggacaccgaggccuacgacauguccgcccuccgcucccucuacgacuucggcgagcucaagggcggcgacggcggcggcuccgccggcggcggcgccggcggcggcuccggcggcggcgccggcucccccccccaggcccaccuccccuccgagcgccacucccucccccagggcccccccucccccgagcccgacuucuccgucuuccgcgacuucaucucccgcaaggucgcccucgccgacggcgaccucuccgucccccccuacgacgccuuccagaccuacgccuucgagggcgccgacucccccgccgccucccucuccucccuccacuccggcuccuccggcuccgagcaggacuucgccuaccucuccuccuggggcccccgcuuccgcccccucgccgcccucuacgccggccaccgcggcgacgacgaggcccaggccuccuga

SEQ ID NO: 41079 - RNA, 4146 nt, Artificial Sequence
  derived and/or modified sequence opt2 from CDH23__Homo_sapiens__NP_001165401
augggccgccacgucgccaccuccugccacgucgccuggcuccucguccucaucuccggcugcuggggccaggucaaccgccuccccuucuucaccaaccacuucuucgacaccuaccuccucaucuccgaggacacccccgucggcuccuccgucacccagcuccucgcccaggacauggacaacgacccccucgucuucggcgucuccggcgaggaggccucccgcuucuucgccgucgagcccgacaccggcgucgucuggcuccgccagccccucgaccgcgagaccaaguccgaguucaccgucgaguucuccgucuccgaccaccagggcgucaucacccgcaaggucaacauccaggucggcgacgucaacgacaacgcccccaccuuccacaaccagcccuacuccguccgcauccccgagaacacccccgucggcacccccaucuucaucgucaacgccaccgaccccgaccucggcgccggcggcuccguccucuacuccuuccagccccccucccaguucuucgccaucgacuccgcccgcggcaucgucaccgucauccgcgagcucgacuacgagaccacccaggccuaccagcucaccgucaacgccaccgaccaggacaagacccgcccccucuccacccucgccaaccucgccaucaucaucaccgacguccaggacauggaccccaucuucaucaaccuccccuacuccaccaacaucuacgagcacuccccccccggcaccaccguccgcaucaucaccgccaucgaccaggacaagggccgcccccgcggcaucggcuacaccaucgucuccggcaacaccaacuccaucuucgcccucgacuacaucuccggcguccucacccucaacggccuccucgaccgcgagaacccccucuacucccacggcuucauccucaccgucaagggcaccgagcucaacgacgaccgcacccccuccgacgccaccgucaccaccaccuucaacauccucgucaucgacaucaacgacaacgcccccgaguucaacuccuccgaguacuccgucgccaucaccgagcucgcccaggucggcuucgcccucccccucuucauccaggucgucgacaaggacgagaaccucggccucaacuccauguucgaggucuaccucgucggcaacaacucccaccacuucaucaucucccccaccuccguccagggcaaggccgacauccgcauccgcgucgccaucccccucgacuacgagaccgucgaccgcuacgacuucgaccucuucgccaacgaguccguccccgaccacgucggcuacgccaaggucaagaucacccucaucaacgagaacgacaaccgccccaucuucucccagccccucuacaacaucucccucuacgagaacgucaccgucggcaccuccguccucaccguccucgccaccgacaacgacgccggcaccuucggcgaggucuccuacuucuucuccgacgaccccgaccgcuucucccucgacaaggacaccggccucaucaugcucaucgcccgccucgacuacgagcucauccagcgcuucacccucaccaucaucgcccgcgacggcggcggcgaggagaccaccggccgcguccgcaucaacguccucgacgucaacgacaacguccccaccuuccagaaggacgccuacgucggcgcccuccgcgagaacgagcccuccgucacccagcucguccgccuccgcgccaccgacgaggacuccccccccaacaaccagaucaccuacuccaucgucuccgccuccgccuucggcuccuacuucgacaucucccucuacgagggcuacggcgucaucuccgucucccgcccccucgacuacgagcagaucuccaacggccucaucuaccucaccgucauggccauggacgccggcaaccccccccucaacuccaccguccccgucaccaucgaggucuucgacgagaacgacaacccccccaccuucuccaagcccgccuacuucgucuccgucgucgagaacaucauggccggcgccaccguccucuuccucaacgccaccgaccucgaccgcucccgcgaguacggccaggaguccaucaucuacucccucgagggcuccacccaguuccgcaucaacgcccgcuccggcgagaucaccaccaccucccuccucgaccgcgagaccaaguccgaguacauccucaucguccgcgccgucgacggcggcgucggccacaaccagaagaccggcaucgccaccgucaacaucacccuccucgacaucaacgacaaccaccccaccuggaaggacgcccccuacuacaucaaccucgucgagaugaccccccccgacuccgacgucaccaccgucgucgccgucgaccccgaccucggcgagaacggcacccucgucuacuccauccagccccccaacaaguucuacucccucaacuccaccaccggcaagauccgcaccacccacgccaugcucgaccgcgagaaccccgacccccacgaggccgagcucaugcgcaagaucgucgucuccgucaccgacugcggccgccccccccucaaggccaccuccuccgccaccgucuucgucaaccuccucgaccucaacgacaacgaccccaccuuccagaaccuccccuucgucgccgagguccucgagggcauccccgccggcgucuccaucuaccaggucgucgccaucgaccucgacgagggccucaacggccucgucuccuaccgcaugcccgucggcaugccccgcauggacuuccucaucaacuccuccuccggcgucgucgucaccaccaccgagcucgaccgcgagcgcaucgccgaguaccagcuccgcgucgucgccuccgacgccggcacccccaccaaguccuccaccuccacccucaccauccacguccucgacgucaacgacgagacccccaccuucuuccccgccgucuacaacgucuccgucuccgaggacgucccccgcgaguuccgcgucgucuggcucaacugcaccgacaacgacgucggccucaacgccgagcucuccuacuucaucaccggcggcaacgucgacggcaaguucuccgucggcuaccgcgacgccgucguccgcaccgucgucggccucgaccgcgagaccaccgccgccuacaugcucauccucgaggccaucgacaacggccccgucggcaagcgccacaccggcaccgccaccgucuucgucaccguccucgacgucaacgacaaccgccccaucuuccuccaguccuccuacgaggccuccguccccgaggacauccccgagggccacuccauccuccagcucaaggccaccgacgccgacgagggcgaguucggccgcgucugguaccgcauccuccacggcaaccacggcaacaacuuccgcauccacgucuccaacggccuccucaugcgcggcccccgcccccucgaccgcgagcgcaacuccucccacguccucaucgucgaggccuacaaccacgaccucggccccaugcgcuccuccguccgcgucaucgucuacgucgaggacaucaacgacgaggcccccgucuucacccagcagcaguacucccgccucggccuccgcgagaccgccggcaucggcaccuccgucaucgucguccaggccaccgaccgcgacuccggcgacggcggccucgucaacuaccgcauccucuccggcgccgagggcaaguucgagaucgacgaguccaccggccucaucaucaccgucaacuaccucgacuacgagaccaagaccuccuacaugaugaacgucuccgccaccgaccaggccccccccuucaaccagggcuucugcuccgucuacaucacccuccucaacgagcucgacgaggccguccaguucuccaacgccuccuacgaggccgccauccucgagaaccucgcccucggcaccgagaucguccgcguccaggccuacuccaucgacaaccucaaccagaucaccuaccgcuucaacgccuacaccuccacccaggccaaggcccucuucaagaucgacgccaucaccguccgcggcuggggccagggcgcccccuuccuccccaucuga

SEQ ID NO: 41080 - RNA, 498 nt, Artificial Sequence
  derived and/or modified sequence opt2 from CDH26__Homo_sapiens__NP_068582
augaagccccucaucuggaccugguccgacgucgagggccagcgccccgcccuccucaucugcaccgccgccgccggccccacccagggcgucaaggaccucgaggaggucccccccuccgccgccucccaguccgcccaggcccgcugcgcccucggcuccuggggcuacggcaagcccuucgagccccgcuccgucaagaacauccacuccacccccgccuaccccgacgccaccaugcaccgccagcuccucgcccccgucgagggccgcauggccgagacccucaaccagaagcuccacgucgccaacguccucgaggacgaccccggcuaccucccccacgucuacuccgaggagggcgagugcggcggcgcccccucccucuccucccucgccucccucgagcaggagcuccagcccgaccuccucgacucccucggcuccaaggccacccccuucgaggagaucuacuccgaguccggcguccccuccuga

SEQ ID NO: 41081 - RNA, 2721 nt, Artificial Sequence
  derived and/or modified sequence opt2 from CDH2__Homo_sapiens__NP_001783
augugccgcaucgccggcgcccuccgcacccuccucccccuccucgccgcccuccuccaggccuccgucgaggccuccggcgagaucgcccucugcaagaccggcuuccccgaggacgucuacuccgccguccucuccaaggacguccacgagggccagccccuccucaacgucaaguucuccaacugcaacggcaagcgcaagguccaguacgaguccuccgagcccgccgacuucaaggucgacgaggacggcauggucuacgccguccgcuccuucccccucuccuccgagcacgccaaguuccucaucuacgcccaggacaaggagacccaggagaaguggcaggucgccgucaagcucucccucaagcccacccucaccgaggaguccgucaaggaguccgccgaggucgaggagaucgucuucccccgccaguucuccaagcacuccggccaccuccagcgccagaagcgcgacugggucaucccccccaucaaccuccccgagaacucccgcggccccuucccccaggagcucguccgcauccgcuccgaccgcgacaagaaccucucccuccgcuacuccgucaccggccccggcgccgaccagccccccaccggcaucuucaucaucaaccccaucuccggccagcucuccgucaccaagccccucgaccgcgagcagaucgcccgcuuccaccuccgcgcccacgccgucgacaucaacggcaaccaggucgagaaccccaucgacaucgucaucaacgucaucgacaugaacgacaaccgccccgaguuccuccaccaggucuggaacggcaccguccccgagggcuccaagcccggcaccuacgucaugaccgucaccgccaucgacgccgacgaccccaacgcccucaacggcaugcuccgcuaccgcaucgucucccaggcccccuccacccccucccccaacauguucaccaucaacaacgagaccggcgacaucaucaccgucgccgccggccucgaccgcgagaagguccagcaguacacccucaucauccaggccaccgacauggagggcaaccccaccuacggccucuccaacaccgccaccgccgucaucaccgucaccgacgucaacgacaacccccccgaguucaccgccaugaccuucuacggcgagguccccgagaaccgcgucgacaucaucgucgccaaccucaccgucaccgacaaggaccagccccacacccccgccuggaacgccgucuaccgcaucuccggcggcgaccccaccggccgcuucgccauccagaccgaccccaacuccaacgacggccucgucaccgucgucaagcccaucgacuucgagaccaaccgcauguucguccucaccgucgccgccgagaaccaggucccccucgccaagggcauccagcaccccccccaguccaccgccaccgucuccgucaccgucaucgacgucaacgagaaccccuacuucgcccccaaccccaagaucauccgccaggaggagggccuccacgccggcaccaugcucaccaccuucaccgcccaggaccccgaccgcuacaugcagcagaacauccgcuacaccaagcucuccgaccccgccaacuggcucaagaucgaccccgucaacggccagaucaccaccaucgccguccucgaccgcgagucccccaacgucaagaacaacaucuacaacgccaccuuccucgccuccgacaacggcaucccccccauguccggcaccggcacccuccagaucuaccuccucgacaucaacgacaacgccccccagguccucccccaggaggccgagaccugcgagacccccgaccccaacuccaucaacaucaccgcccucgacuacgacaucgaccccaacgccggccccuucgccuucgaccucccccucucccccgucaccaucaagcgcaacuggaccaucacccgccucaacggcgacuucgcccagcucaaccucaagaucaaguuccucgaggccggcaucuacgagguccccaucaucaucaccgacuccggcaacccccccaaguccaacaucuccauccuccgcgucaaggucugccagugcgacuccaacggcgacugcaccgacgucgaccgcaucgucggcgccggccucggcaccggcgccaucaucgccauccuccucugcaucaucauccuccucauccucguccucauguucgucgucuggaugaagcgccgcgacaaggagcgccaggccaagcagcuccucaucgaccccgaggacgacguccgcgacaacauccucaaguacgacgaggagggcggcggcgaggaggaccaggacuacgaccucucccagcuccagcagcccgacaccgucgagcccgacgccaucaagcccgucggcauccgccgcauggacgagcgccccauccacgccgagccccaguaccccguccgcuccgccgccccccaccccggcgacaucggcgacuucaucaacgagggccucaaggccgccgacaacgaccccaccgccccccccuacgacucccuccucgucuucgacuacgagggcuccggcuccaccgccggcucccucuccucccucaacuccuccuccuccggcggcgagcaggacuacgacuaccucaacgacuggggcccccgcuucaagaagcucgccgacauguacggcggcggcgacgacuga

SEQ ID NO: 41082 - RNA, 2490 nt, Artificial Sequence
  derived and/or modified sequence opt2 from CDH3__Homo_sapiens__NP_001784
augggccucccccgcggcccccucgccucccuccuccuccuccaggucugcuggcuccagugcgccgccuccgagcccugccgcgccgucuuccgcgaggccgaggucacccucgaggccggcggcgccgagcaggagcccggccaggcccucggcaaggucuucaugggcugccccggccaggagcccgcccucuucuccaccgacaacgacgacuucaccguccgcaacggcgagaccguccaggagcgccgcucccucaaggagcgcaacccccucaagaucuuccccuccaagcgcauccuccgccgccacaagcgcgacugggucgucgcccccaucuccguccccgagaacggcaagggccccuucccccagcgccucaaccagcucaaguccaacaaggaccgcgacaccaagaucuucuacuccaucaccggccccggcgccgacuccccccccgagggcgucuucgccgucgagaaggagaccggcuggcuccuccucaacaagccccucgaccgcgaggagaucgccaaguacgagcucuucggccacgccgucuccgagaacggcgccuccgucgaggaccccaugaacaucuccaucaucgucaccgaccagaacgaccacaagcccaaguucacccaggacaccuuccgcggcuccguccucgagggcguccuccccggcaccuccgucaugcaggucaccgccaccgacgaggacgacgccaucuacaccuacaacggcgucgucgccuacuccauccacucccaggagcccaaggacccccacgaccucauguucaccauccaccgcuccaccggcaccaucuccgucaucuccuccggccucgaccgcgagaagguccccgaguacacccucaccauccaggccaccgacauggacggcgacggcuccaccaccaccgccgucgccgucgucgagauccucgacgccaacgacaacgcccccauguucgacccccagaaguacgaggcccacguccccgagaacgccgucggccacgagguccagcgccucaccgucaccgaccucgacgcccccaacucccccgccuggcgcgccaccuaccucaucaugggcggcgacgacggcgaccacuucaccaucaccacccaccccgaguccaaccagggcauccucaccacccgcaagggccucgacuucgaggccaagaaccagcacacccucuacgucgaggucaccaacgaggcccccuucguccucaagcuccccaccuccaccgccaccaucgucguccacgucgaggacgucaacgaggcccccgucuucgucccccccuccaaggucgucgagguccaggagggcauccccaccggcgagcccgucugcgucuacaccgccgaggaccccgacaaggagaaccagaagaucuccuaccgcauccuccgcgaccccgccggcuggcucgccauggaccccgacuccggccaggucaccgccgucggcacccucgaccgcgaggacgagcaguucguccgcaacaacaucuacgaggucaugguccucgccauggacaacggcuccccccccaccaccggcaccggcacccuccuccucacccucaucgacgucaacgaccacggccccguccccgagccccgccagaucaccaucugcaaccagucccccguccgccagguccucaacaucaccgacaaggaccucuccccccacaccucccccuuccaggcccagcucaccgacgacuccgacaucuacuggaccgccgaggucaacgaggagggcgacaccgucguccucucccucaagaaguuccucaagcaggacaccuacgacguccaccucucccucuccgaccacggcaacaaggagcagcucaccgucauccgcgccaccgucugcgacugccacggccacgucgagaccugccccggccccuggaagggcggcuucauccuccccguccucggcgccguccucgcccuccucuuccuccuccucguccuccuccuccucguccgcaagaagcgcaagaucaaggagccccuccuccuccccgaggacgacacccgcgacaacgucuucuacuacggcgaggagggcggcggcgaggaggaccaggacuacgacaucacccagcuccaccgcggccucgaggcccgccccgaggucguccuccgcaacgacgucgcccccaccaucauccccacccccauguaccgcccccgccccgccaaccccgacgagaucggcaacuucaucaucgagaaccucaaggccgccaacaccgaccccaccgccccccccuacgacacccuccucgucuucgacuacgagggcuccggcuccgacgccgccucccucuccucccucaccuccuccgccuccgaccaggaccaggacuacgacuaccucaacgaguggggcucccgcuucaagaagcucgccgacauguacggcggcggcgaggacgacuga

SEQ ID NO: 41083 - RNA, 2640 nt, Artificial Sequence
  derived and/or modified sequence opt2 from CDH4__Homo_sapiens__NP_001239267
augaacggcuccugcgacuucauccucuccgccuccuuccuccccugcuucaaggaggucaaguucuccuccugcgucggcaccaagggcacccaguacgagaccaacuccauggacuucaaggucggcgccgacggcaccgucuucgccacccgcgagcuccagguccccuccgagcaggucgccuucaccgucaccgccugggacucccagaccgccgagaagugggacgccgucguccgccuccucgucgcccagaccuccuccccccacuccggccacaagccccagaagggcaagaaggucgucgcccucgaccccucccccccccccaaggacacccuccuccccuggccccagcaccagaacgccaacggccuccgccgccgcaagcgcgacugggucaucccccccaucaacguccccgagaacucccgcggccccuucccccagcagcucguccgcauccgcuccgacaaggacaacgacauccccauccgcuacuccaucaccggcgucggcgccgaccagccccccauggaggucuucuccaucgacuccauguccggccgcauguacgucacccgccccauggaccgcgaggagcacgccuccuaccaccuccgcgcccacgccgucgacaugaacggcaacaaggucgagaaccccaucgaccucuacaucuacgucaucgacaugaacgacaaccgccccgaguucaucaaccaggucuacaacggcuccgucgacgagggcuccaagcccggcaccuacgucaugaccgucaccgccaacgacgccgacgacuccaccaccgccaacggcaugguccgcuaccgcaucgucacccagaccccccagucccccucccagaacauguucaccaucaacuccgagaccggcgacaucgucaccgucgccgccggccucgaccgcgagaagguccagcaguacaccgucaucguccaggccaccgacauggagggcaaccucaacuacggccucuccaacaccgccaccgccaucaucaccgucaccgacgucaacgacaacccccccgaguucaccgccuccaccuucgccggcgagguccccgagaaccgcgucgagaccgucgucgccaaccucaccgucauggaccgcgaccagccccacucccccaacuggaacgccgucuaccgcaucaucuccggcgaccccuccggccacuucuccguccgcaccgaccccgucaccaacgagggcauggucaccgucgucaaggccgucgacuacgagcucaaccgcgccuucaugcucaccgucauggucuccaaccaggccccccucgccuccggcauccagauguccuuccaguccaccgccggcgucaccaucuccaucauggacaucaacgaggcccccuacuuccccuccaaccacaagcucauccgccucgaggagggcgucccccccggcaccguccucaccaccuucuccgccgucgaccccgaccgcuucaugcagcaggccguccgcuacuccaagcucuccgaccccgccuccuggcuccacaucaacgccaccaacggccagaucaccaccgccgccguccucgaccgcgagucccucuacaccaagaacaacgucuacgaggccaccuuccucgccgccgacaacggcaucccccccgccuccggcaccggcacccuccagaucuaccucaucgacaucaacgacaacgcccccgagcuccuccccaaggaggcccagaucugcgagaagcccaaccucaacgccaucaacaucaccgccgccgacgccgacgucgaccccaacaucggccccuacgucuucgagcuccccuucguccccgccgccguccgcaagaacuggaccaucacccgccucaacggcgacuacgcccagcucucccuccgcauccucuaccucgaggccggcauguacgacguccccaucaucgucaccgacuccggcaaccccccccucuccaacaccuccaucaucaaggucaaggucugccccugcgacgacaacggcgacugcaccaccaucggcgccgucgccgccgccggccucggcaccggcgccaucgucgccauccucaucugcauccucauccuccucaccaugguccuccucuucgucauguggaugaagcgccgcgagaaggagcgccacaccaagcagcuccucaucgaccccgaggacgacguccgcgacaacauccucaaguacgacgaggagggcggcggcgaggaggaccaggacuacgaccucucccagcuccagcagcccgaggccaugggccacguccccuccaaggcccccggcguccgccgcgucgacgagcgccccgucggcgccgagccccaguaccccauccgccccauggucccccaccccggcgacaucggcgacuucaucaacgagggccuccgcgccgccgacaacgaccccaccgccccccccuacgacucccuccucgucuucgacuacgagggcuccggcuccaccgccggcuccgucuccucccucaacuccuccuccuccggcgaccaggacuacgacuaccucaacgacuggggcccccgcuucaagaagcucgccgacauguacggcggcggcgaggaggacuga

SEQ ID NO: 41084 - RNA, 2355 nt, Artificial Sequence
  derived and/or modified sequence opt2 from CDH5__Homo_sapiens__NP_001786
augcagcgccucaugaugcuccucgccaccuccggcgccugccucggccuccucgccgucgccgccgucgccgccgccggcgccaaccccgcccagcgcgacacccacucccuccuccccacccaccgccgccagaagcgcgacuggaucuggaaccagaugcacaucgacgaggagaagaacaccucccucccccaccacgucggcaagaucaaguccuccgucucccgcaagaacgccaaguaccuccucaagggcgaguacgucggcaaggucuuccgcgucgacgccgagaccggcgacgucuucgccaucgagcgccucgaccgcgagaacaucuccgaguaccaccucaccgccgucaucgucgacaaggacaccggcgagaaccucgagacccccuccuccuucaccaucaagguccacgacgucaacgacaacuggcccgucuucacccaccgccucuucaacgccuccguccccgaguccuccgccgucggcaccuccgucaucuccgucaccgccgucgacgccgacgaccccaccgucggcgaccacgccuccgucauguaccagauccucaagggcaaggaguacuucgccaucgacaacuccggccgcaucaucaccaucaccaagucccucgaccgcgagaagcaggcccgcuacgagaucgucgucgaggcccgcgacgcccagggccuccgcggcgacuccggcaccgccaccguccucgucacccuccaggacaucaacgacaacuuccccuucuucacccagaccaaguacaccuucgucguccccgaggacacccgcgucggcaccuccgucggcucccucuucgucgaggaccccgacgagccccagaaccgcaugaccaaguacuccauccuccgcggcgacuaccaggacgccuucaccaucgagaccaaccccgcccacaacgagggcaucaucaagcccaugaagccccucgacuacgaguacauccagcaguacuccuucaucgucgaggccaccgaccccaccaucgaccuccgcuacauguccccccccgccggcaaccgcgcccaggucaucaucaacaucaccgacgucgacgagccccccaucuuccagcagcccuucuaccacuuccagcucaaggagaaccagaagaagccccucaucggcaccguccucgccauggaccccgacgccgcccgccacuccaucggcuacuccauccgccgcaccuccgacaagggccaguucuuccgcgucaccaagaagggcgacaucuacaacgagaaggagcucgaccgcgaggucuaccccugguacaaccucaccgucgaggccaaggagcucgacuccaccggcacccccaccggcaaggaguccaucguccagguccacaucgagguccucgacgagaacgacaacgcccccgaguucgccaagcccuaccagcccaaggucugcgagaacgccguccacggccagcucguccuccagaucuccgccaucgacaaggacaucaccccccgcaacgucaaguucaaguucauccucaacaccgagaacaacuucacccucaccgacaaccacgacaacaccgccaacaucaccgucaaguacggccaguucgaccgcgagcacaccaagguccacuuccuccccgucgucaucuccgacaacggcaugcccucccgcaccggcaccuccacccucaccgucgccgucugcaagugcaacgagcagggcgaguucaccuucugcgaggacauggccgcccaggucggcgucuccauccaggccgucgucgccauccuccucugcauccucaccaucaccgucaucacccuccucaucuuccuccgccgccgccuccgcaagcaggcccgcgcccacggcaaguccguccccgagauccacgagcagcucgucaccuacgacgaggagggcggcggcgagauggacaccaccuccuacgacgucuccguccucaacuccguccgccgcggcggcgccaagcccccccgccccgcccucgacgcccgccccucccucuacgcccagguccagaagcccccccgccacgcccccggcgcccacggcggccccggcgagauggccgccaugaucgaggucaagaaggacgaggccgaccacgacggcgacggcccccccuacgacacccuccacaucuacggcuacgagggcuccgaguccaucgccgagucccucuccucccucggcaccgacuccuccgacuccgacgucgacuacgacuuccucaacgacuggggcccccgcuucaagaugcucgccgagcucuacggcuccgacccccgcgaggagcuccucuacuga

SEQ ID NO: 41085 - RNA, 2373 nt, Artificial Sequence
  derived and/or modified sequence opt2 from CDH6__Homo_sapiens__XP_011512223
augcgcaccuaccgcuacuuccuccuccucuucugggucggccagcccuaccccacccucuccaccccccucuccaagcgcaccuccggcuuccccgccaagaagcgcgcccucgagcucuccggcaacuccaagaacgagcucaaccgcuccaagcgcuccuggauguggaaccaguucuuccuccucgaggaguacaccggcuccgacuaccaguacgucggcaagcuccacuccgaccaggaccgcggcgacggcucccucaaguacauccucuccggcgacggcgccggcgaccucuucaucaucaacgagaacaccggcgacauccaggccaccaagcgccucgaccgcgaggagaagcccgucuacauccuccgcgcccaggccaucaaccgccgcaccggccgccccgucgagcccgaguccgaguucaucaucaagauccacgacaucaacgacaacgagcccaucuucaccaaggaggucuacaccgccaccguccccgagauguccgacgucggcaccuucgucguccaggucaccgccaccgacgccgacgaccccaccuacggcaacuccgccaaggucgucuacuccauccuccagggccagcccuacuucuccgucgaguccgagaccggcaucaucaagaccgcccuccucaacauggaccgcgagaaccgcgagcaguaccaggucgucauccaggccaaggacaugggcggccagaugggcggccucuccggcaccaccaccgucaacaucacccucaccgacgucaacgacaaccccccccgcuucccccaguccaccuaccaguucaagacccccgaguccuccccccccggcacccccaucggccgcaucaaggccuccgacgccgacgucggcgagaacgccgagaucgaguacuccaucaccgacggcgagggccucgacauguucgacgucaucaccgaccaggagacccaggagggcaucaucaccgucaagaagcuccucgacuucgagaagaagaaggucuacacccucaaggucgaggccuccaaccccuacgucgagccccgcuuccucuaccucggccccuucaaggacuccgccaccguccgcaucgucgucgaggacgucgacgagccccccgucuucuccaagcucgccuacauccuccagauccgcgaggacgcccagaucaacaccaccaucggcuccgucaccgcccaggaccccgacgccgcccgcaaccccgucaaguacuccgucgaccgccacaccgacauggaccgcaucuucaacaucgacuccggcaacggcuccaucuucaccuccaagcuccucgaccgcgagacccuccucuggcacaacaucaccgucaucgccaccgagaucaacaaccccaagcaguccucccgcgucccccucuacaucaagguccucgacgucaacgacaacgcccccgaguucgccgaguucuacgagaccuucgucugcgagaaggccaaggccgaccagcucauccagacccuccacgccgucgacaaggacgaccccuacuccggccaccaguucuccuucucccucgcccccgaggccgccuccggcuccaacuucaccauccaggacaacaaggacaacaccgccggcauccucacccgcaagaacggcuacaaccgccacgagauguccaccuaccuccuccccgucgucaucuccgacaacgacuaccccguccaguccuccaccggcaccgucaccguccgcgucugcgccugcgaccaccacggcaacaugcaguccugccacgccgaggcccucauccaccccaccggccucuccaccggcgcccucgucgccauccuccucugcaucgucauccuccucgucaccgucguccucuucgccgcccuccgccgccagcgcaagaaggagccccucaucaucuccaaggaggacauccgcgacaacaucgucuccuacaacgacgagggcggcggcgaggaggacacccaggccuucgacaucggcacccuccgcaaccccgaggccaucgaggacaacaagcuccgccgcgacaucguccccgaggcccucuuccucccccgccgcacccccaccgcccgcgacaacaccgacguccgcgacuucaucaaccagcgccucaaggagaacgacaccgaccccaccgccccccccuacgacucccucgccaccuacgccuacgagggcaccggcuccgucgccgacucccucuccucccucgaguccgucaccaccgacgccgaccaggacuacgacuaccucuccgacuggggcccccgcuucaagaagcucgccgacauguacggcggcgucgacuccgacaaggacuccuga

SEQ ID NO: 41086 - RNA, 2358 nt, Artificial Sequence
  derived and/or modified sequence opt2 from CDH7__Homo_sapiens__NP_387450
augaagcucggcaaggucgaguucugccacuuccuccagcucaucgcccucuuccucugcuucuccggcaugucccaggccgagcucucccgcucccgcuccaagcccuacuuccaguccggccgcucccgcaccaagcgcuccugggucuggaaccaguucuucguccucgaggaguacaugggcuccgacccccucuacgucggcaagcuccacuccgacgucgacaagggcgacggcuccaucaaguacauccucuccggcgagggcgccuccuccaucuucaucaucgacgagaacaccggcgacauccacgccaccaagcgccucgaccgcgaggagcaggccuacuacacccuccgcgcccaggcccucgaccgccucaccaacaagcccgucgagcccgaguccgaguucgucaucaagauccaggacaucaacgacaacgagcccaaguuccucgacggccccuacaccgccggcguccccgagaugucccccgucggcaccuccgucguccaggucaccgccaccgacgccgacgaccccaccuacggcaacuccgcccgcgucgucuacuccauccuccagggccagcccuacuucuccgucgagcccaagaccggcgucaucaagaccgcccuccccaacauggaccgcgaggccaaggaccaguaccuccucgucauccaggccaaggacauggucggccagaacggcggccucuccggcaccaccuccgucaccgucacccucaccgacgucaacgacaaccccccccgcuucccccgccgcuccuaccaguacaacguccccgagucccuccccgucgccuccgucgucgcccgcaucaaggccgccgacgccgacaucggcgccaacgccgagauggaguacaagaucgucgacggcgacggccucggcaucuucaagaucuccgucgacaaggagacccaggagggcaucaucaccauccagaaggagcucgacuucgaggccaagaccuccuacacccuccgcaucgaggccgccaacaaggacgccgacccccgcuuccucucccucggccccuucuccgacaccaccaccgucaagaucaucgucgaggacgucgacgagccccccgucuucuccuccccccucuaccccauggaggucuccgaggccacccaggucggcaacaucaucggcaccgucgccgcccacgaccccgacuccuccaacucccccguccgcuacuccaucgaccgcaacaccgaccucgagcgcuacuucaacaucgacgccaacuccggcgucaucaccaccgccaagucccucgaccgcgagaccaacgccauccacaacaucaccguccucgccauggagucccagaaccccucccaggucggccgcggcuacgucgccaucaccauccucgacaucaacgacaacgcccccgaguucgccauggacuacgagaccaccgucugcgagaacgcccagcccggccaggucauccagaagaucuccgccgucgacaaggacgagcccuccaacggccaccaguucuacuucucccucaccaccgacgccaccaacaaccacaacuucucccucaaggacaacaaggacaacaccgccuccauccucacccgccgcaacggcuuccgccgccaggagcaguccgucuacuaccuccccaucuucaucgucgacuccggcucccccucccucuccuccaccaacacccucaccauccgcgucugcgacugcgacgccgacggcgucgcccagaccugcaacgccgaggccuacguccuccccgccggccucuccaccggcgcccucaucgccauccucgccugcguccucacccuccucguccucauccuccucaucgucaccaugcgccgccgcaagaaggagccccucaucuucgacgaggagcgcgacauccgcgagaacaucguccgcuacgacgacgagggcggcggcgaggaggacaccgaggccuucgacauggccgcccuccgcaaccucaacgucauccgcgacaccaagacccgccgcgacgucacccccgagauccaguuccucucccgccccgccuucaaguccauccccgacaacgucaucuuccgcgaguucaucugggagcgccucaaggaggccgacgucgaccccggcgccccccccuacgacucccuccagaccuacgccuucgagggcaacggcuccgucgccgagucccucuccucccucgacuccaucuccuccaacuccgaccagaacuacgacuaccucuccgacuggggcccccgcuucaagcgccucgccgacauguacggcaccggccaggagucccucuacuccuga

SEQ ID NO: 41087 - RNA, 2400 nt, Artificial Sequence
  derived and/or modified sequence opt2 from CDH8__Homo_sapiens__NP_001787
augcccgagcgccucgccgagaugcuccucgaccucuggaccccccucaucauccucuggaucacccucccccccugcaucuacauggcccccaugaaccagucccagguccucauguccggcuccccccucgagcucaacucccucggcgaggagcagcgcauccucaaccgcuccaagcgcggcugggucuggaaccagauguucguccucgaggaguucuccggccccgagcccauccucgucggccgccuccacaccgaccucgaccccggcuccaagaagaucaaguacauccucuccggcgacggcgccggcaccaucuuccagaucaacgacgucaccggcgacauccacgccaucaagcgccucgaccgcgaggagaaggccgaguacacccucaccgcccaggccgucgacugggagaccuccaagccccucgagccccccuccgaguucaucaucaagguccaggacaucaacgacaacgcccccgaguuccucaacggccccuaccacgccaccguccccgagauguccauccucggcaccuccgucaccaacgucaccgccaccgacgccgacgaccccgucuacggcaacuccgccaagcucgucuacuccauccucgagggccagcccuacuucuccaucgagcccgagaccgccaucaucaagaccgcccuccccaacauggaccgcgaggccaaggaggaguaccucgucgucauccaggccaaggacaugggcggccacuccggcggccucuccggcaccaccacccucaccgucacccucaccgacgucaacgacaacccccccaaguucgcccagucccucuaccacuucuccguccccgaggacgucguccucggcaccgccaucggccgcgucaaggccaacgaccaggacaucggcgagaacgcccaguccuccuacgacaucaucgacggcgacggcaccgcccucuucgagaucaccuccgacgcccaggcccaggacggcaucauccgccuccgcaagccccucgacuucgagaccaagaaguccuacacccucaaggucgaggccgccaacguccacaucgacccccgcuucuccggccgcggccccuucaaggacaccgccaccgucaagaucgucgucgaggacgccgacgagccccccgucuucuccucccccaccuaccuccucgagguccacgagaacgccgcccucaacuccgucaucggccaggucaccgcccgcgaccccgacaucaccuccucccccauccgcuucuccaucgaccgccacaccgaccucgagcgccaguucaacaucaacgccgacgacggcaagaucacccucgccaccccccucgaccgcgagcucuccgucuggcacaacaucaccaucaucgccaccgagauccgcaaccacucccagaucucccgcguccccgucgccaucaagguccucgacgucaacgacaacgcccccgaguucgccuccgaguacgaggccuuccucugcgagaacggcaagcccggccaggucauccagaccgucuccgccauggacaaggacgaccccaagaacggccacuacuuccucuacucccuccuccccgagauggucaacaaccccaacuucaccaucaagaagaacgaggacaacucccucuccauccucgccaagcacaacggcuucaaccgccagaagcaggaggucuaccuccuccccaucaucaucuccgacuccggcaaccccccccucuccuccaccuccacccucaccauccgcgucugcggcugcuccaacgacggcgucguccaguccugcaacgucgaggccuacguccuccccaucggccucuccaugggcgcccucaucgccauccucgccugcaucauccuccuccucgucaucgucguccucuucgucacccuccgccgccacaagaacgagccccucaucaucaaggacgacgaggacguccgcgagaacaucauccgcuacgacgacgagggcggcggcgaggaggacaccgaggccuucgacaucgccacccuccagaaccccgacggcaucaacggcuuccucccccgcaaggacaucaagcccgaccuccaguucaugccccgccagggccucgcccccguccccaacggcgucgacgucgacgaguucaucaacguccgccuccacgaggccgacaacgaccccaccgccccccccuacgacuccauccagaucuacggcuacgagggccgcggcuccgucgccggcucccucuccucccucgaguccaccaccuccgacuccgaccagaacuucgacuaccucuccgacuggggcccccgcuucaagcgccucggcgagcucuacuccgucggcgaguccgacaaggagaccuga

SEQ ID NO: 41088 - RNA, 2370 nt, Artificial Sequence
  derived and/or modified sequence opt2 from CDH9__Homo_sapiens__XP_011512224
augcgcaccuaccacuacaucccccucuucaucuggaccuacauguuccacaccgucgacaccauccuccuccaggagaagcccaacuccuaccucuccuccaagaagaucgccggccucaccaaggacgacggcaagaugcuccgccgcaccaagcgcggcuggauguggaaccaguucuuccuccucgaggaguacaccggcaccgacacccaguacgucggcaagcuccacaccgaccaggacaagggcgacggcaaccucaaguacauccucaccggcgacggcgccggcucccucuucgucaucgacgagaacaccggcgacauccacgccgccaagaagcucgaccgcgaggagaagucccucuacauccuccgcgccaaggccaucgaccgcaagaccggccgccaggucgagcccgaguccgaguucaucaucaagauccacgacaucaacgacaacgagcccaaguucaccaaggaccucuacaccgccuccguccccgagauguccggcgucggcaccuccgucauccaggucaccgccaccgacgccgacgacgccaacuacggcaacuccgccaaggucgucuacuccauccuccagggccagcccuacuucuccgucgaccccgaguccggcaucaucaagaccgcccuccccgacaugucccgcgagaaccgcgagcaguaccaggucgucauccaggccaaggacaugggcggccagaugggcggccucuccggcaccaccaccgucaacaucacccucaccgacgucaacaacaaccccccccgcuucccccaguccaccuaccaguucaacucccccgaguccgucccccucggcacccaccucggccgcaucaaggccaacgaccccgacgucggcgagaacgccgagauggaguacuccaucgccgagggcgacggcgccgacauguucgacgucaucaccgacaaggacacccaggagggcaucaucaccgucaagcagaaccucgacuucgagaaccagaugcucuacacccuccgcgucgacgccuccaacacccaccccgacccccgcuuccuccaccucggccccuucaaggacaccgccgucgucaagaucuccgucgaggacaucgacgagccccccgucuucaccaaggucuccuaccucaucgaggucgacgaggacgucaaggagggcuccaucaucggccaggucaccgccuacgaccccgacgcccgcaacaaccucaucaaguacuccgucgaccgccacaccgacauggaccgcaucuucggcauccacuccgagaacggcuccaucuucacccucaaggcccucgaccgcgaguccucccccuggcacaacaucaccgucaccgccaccgagaucaacaaccccaagcaguccucccacauccccgucuucauccgcauccucgacaucaacgaccacgcccccgaguucgccauguacuacgagaccuucgucugcgagaacgccaagcccggccagcucauccagaccgucuccgucauggacaaggacgaccccccccgcggccacaaguucuucuucgagcccguccccgaguucacccucaaccccaacuucaccaucgucgacaacaaggacaacaccgccggcaucaugacccgcaaggacggcuacucccgcaacaagauguccaccuaccuccuccccauccucaucuucgacaacgacuaccccauccaguccuccaccggcacccucaccauccgcgucugcgccugcgacaaccagggcaacaugcaguccugcaccgccgaggcccucauccucuccgccggccucuccaccggcgcccucgucgccauccuccucugcguccucauccuccucauccucgucguccucuucgccgcccucaagcgccagcgcaagaaggagccccucaucaucuccaaggacgacguccgcgacaacaucgucaccuacaacgacgagggcggcggcgaggaggacacccaggccuucgacaucggcacccuccgcaaccccgaggcccgcgaggacuccaagcuccgccgcgacgucaugcccgagaccaucuuccagauccgccgcaccgucccccucugggagaacaucgacguccaggacuucauccaccgccgccucaaggagaacgacgccgaccccuccgccccccccuacgacucccucgccaccuacgccuacgagggcaacgacuccaucgccgacucccucuccucccucgagucccucaccgccgacugcaaccaggacuacgacuaccucuccgacuggggcccccgcuucaagaagcucgccgacauguacggcggcgacgacuccgaccgcgacuga

SEQ ID NO: 41089 - RNA, 2238 nt, Artificial Sequence
  derived and/or modified sequence opt2 from CDHR1__Homo_sapiens__NP_001165442
augcgccgcugccgcugggccgcccucgcccucggccuccuccgccucugccucgcccaggccaacuucgccccccacuucuucgacaacggcgucggcuccaccaacggcaacauggcccucuucucccuccccgaggacacccccgucggcucccacgucuacacccucaacggcaccgaccccgagggcgaccccaucuccuaccacaucuccuucgaccccuccacccgcuccgucuucuccgucgaccccaccuucggcaacaucacccucgucgaggagcucgaccgcgagcgcgaggacgagaucgaggccaucaucuccaucuccgacggccucaaccucgucgccgagaaggucgucauccucgucaccgacgccaacgacgaggccccccgcuucauccaggagcccuacgucgcccucguccccgaggacauccccgccggcuccaucaucuucaagguccacgccgucgaccgcgacaccggcuccggcggcuccgucaccuacuuccuccagaaccuccacucccccuucgccgucgaccgccacuccggcguccuccgccuccaggccggcgccacccucgacuacgagcgcucccgcacccacuacaucaccgucgucgccaaggacggcggcggccgccuccacggcgccgacgucgucuucuccgccaccaccaccgucaccgucaacgucgaggacguccaggacauggcccccgucuucgucggcacccccuacuacggcuacgucuacgaggacacccuccccggcuccgagguccucaaggucgucgccauggacggcgaccgcggcaagcccaaccgcauccucuacucccucgucaacggcaacgacggcgccuucgagaucaacgagaccuccggcgccaucuccaucacccagucccccgcccagcuccagcgcgaggucuacgagcuccacguccaggucaccgagaugucccccgccggcucccccgccgcccaggccaccguccccgucaccauccgcaucgucgaccucaacaaccacccccccaccuucuacggcgaguccggcccccagaaccgcuucgagcucuccaugaacgagcaccccccccagggcgagauccuccgcggccucaagaucaccgucaacgacuccgaccagggcgccaacgccaaguucaaccuccagcucgucggcccccgcggcaucuuccgcgucgucccccagaccguccucaacgaggcccaggucaccaucaucgucgagaacuccgccgccaucgacuucgagaaguccaagguccucaccuucaagcuccucgccgucgaggucaacacccccgagaaguucuccuccaccgccgacgucgucauccagcuccucgacaccaacgacaacguccccaaguucgacucccucuacuacgucgcccgcauccccgagaacgcccccggcggcuccuccgucgucgccgucaccgccgucgaccccgacaccggccccuggggcgaggucaaguacuccaccuacggcaccggcgccgaccucuuccucauccaccccuccaccggccucaucuacacccagcccugggccucccucgacgccgaggccaccgcccgcuacaacuucuacgucaaggccgaggacauggagggcaaguacuccgucgccgaggucuucaucacccuccucgacgucaacgaccaccccccccaguucggcaaguccguccagaagaagaccaugguccucggcacccccgucaagaucgaggccaucgacgaggacgccgaggagcccaacaaccucgucgacuacuccaucacccacgccgagcccgccaacgucuucgacaucaacucccacaccggcgagaucuggcucaagaacuccauccgcucccucgacgcccuccacaacaucacccccggccgcgacugccucuggucccucgagguccaggccaaggaccgcggcucccccuccuucuccaccaccgcccuccucaagaucgacaucaccgacgccgagguccgccgccuccgcuacaugaagaacuccaacuuccccggcaccaccaaguccguccgcaagcccaaguucaagcccaagaagccccacuccucccagggccucuuccuccacccccacugcgagaucgcccucuucaaccucuccaacgucaaccucuacucccgcgucuuccagggcgccgcccaggccuccuga

SEQ ID NO: 41090 - RNA, 3933 nt, Artificial Sequence
  derived and/or modified sequence opt2 from CDHR2__Homo_sapiens__NP_001165447
auggcccagcucuggcucuccugcuuccuccuccccgcccucgucgucuccgucgccgccaacgucgcccccaaguuccucgccaacaugaccuccgucauccuccccgaggaccuccccgucggcgcccaggccuucuggcucgucgccgaggaccaggacaacgacccccucaccuacggcauguccggccccaacgccuacuucuucgccgucacccccaagaccggcgaggucaagcucgccuccgcccucgacuacgagacccucuacaccuucaaggucaccaucuccgucuccgaccccuacauccagguccagcgcgagaugcucgucaucgucgaggaccgcaacgacaacgcccccgucuuccagaacaccgccuucuccaccuccaucaacgagacccuccccgucggcuccgucgucuucuccguccucgccgucgacaaggacaugggcuccgccggcauggucgucuacuccaucgagaaggucauccccuccaccggcgacuccgagcaccucuuccgcauccucgccaacggcuccaucguccucaacggcucccucuccuacaacaacaaguccgccuucuaccagcucgagcucaaggccugcgaccucggcggcauguaccacaacaccuucaccauccagugcucccuccccgucuuccucuccaucuccgucgucgaccagcccgaccucgacccccaguucguccgcgaguucuacuccgccuccgucgccgaggacgccgccaagggcaccuccguccucaccgucgaggccgucgacggcgacaagggcaucaacgaccccgucaucuacuccaucuccuacuccacccgccccggcugguucgacaucggcgccgacggcgucauccgcgucaacggcucccucgaccgcgagcagcuccucgaggccgacgaggagguccagcuccaggucaccgccaccgagacccaccucaacaucuacggccaggaggccaaggucuccaucugggucaccguccgcgucauggacgucaacgaccacaagcccgaguucuacaacugcucccuccccgccugcaccuucacccccgaggaggcccaggucaacuucaccggcuacgucgacgagcacgccuccccccgcauccccaucgacgaccucaccauggucgucuacgaccccgacaagggcuccaacggcaccuuccuccucucccucggcggccccgacgccgaggccuucuccgucucccccgagcgcgccgucggcuccgccuccguccagguccucguccgcgucuccgcccucgucgacuacgagcgccagaccgccauggccguccaggucgucgccaccgacuccgucucccagaacuucuccgucgccauggucaccauccaccuccgcgacaucaacgaccaccgccccaccuucccccagucccucuacguccucaccguccccgagcacuccgccaccggcuccgucgucaccgacuccauccacgccaccgaccccgacaccggcgccuggggccagaucaccuacucccuccuccccggcaacggcgccgaccucuuccaggucgaccccgucuccggcaccgucaccguccgcaacggcgagcuccucgaccgcgagucccaggccgucuacuaccucacccuccaggccaccgacggcggcaaccucuccuccuccaccacccuccagauccaccuccucgacaucaacgacaacgcccccgucgucuccggcuccuacaacaucuucguccaggaggaggagggcaacgucuccgucaccauccaggcccacgacaacgacgagcccggcaccaacaacucccgccuccucuucaaccuccuccccggccccuacucccacaacuucucccucgaccccgacaccggccuccuccgcaaccucggcccccucgaccgcgaggccaucgaccccgcccucgagggccgcaucguccucaccguccucgucuccgacugcggcgagcccguccucggcaccaaggucaacgucaccaucaccgucgaggacaucaacgacaaccuccccaucuucaaccaguccuccuacaacuucaccgucaaggaggaggaccccggcguccucgucggcgucgucaaggccugggacgccgaccagaccgaggccaacaaccgcaucuccuucucccucuccggcuccggcgccaacuacuucaugauccgcggccucguccucggcgccggcugggccgagggcuaccuccgccucccccccgacgucucccucgacuacgagacccagcccgucuucaaccucaccgucuccgccgagaaccccgacccccagggcggcgagaccaucgucgacgucugcgucaacgucaaggacgucaacgacaacccccccacccucgacgucgccucccuccgcggcauccgcgucgccgagaacggcucccagcacggccaggucgccgucgucgucgccuccgacgucgacaccuccgcccagcucgagauccagcucgucaacauccucugcaccaaggccggcgucgacgucggcucccucugcuggggcugguucuccgucgccgccaacggcuccgucuacaucaaccaguccaaggccaucgacuacgaggccugcgaccucgucacccucgucguccgcgccugcgaccucgccaccgaccccggcuuccaggccuacuccaacaacggcucccuccucaucaccaucgaggacgucaacgacaacgcccccuacuuccuccccgagaacaagaccuucgucaucauccccgagcucguccuccccaaccgcgaggucgccuccguccgcgcccgcgacgacgacuccggcaacaacggcgucauccucuucuccauccuccgcgucgacuucaucuccaaggacggcgccaccauccccuuccagggcgucuucuccaucuucaccuccuccgaggccgacgucuucgccggcuccauccagcccgucaccucccucgacuccacccuccagggcaccuaccaggucaccguccaggcccgcgaccgccccucccucggccccuuccucgaggccaccaccacccucaaccucuucaccgucgaccaguccuaccgcucccgccuccaguucuccacccccaaggaggaggucggcgccaaccgccaggccaucaacgccgcccucacccaggccacccgcaccaccgucuacaucgucgacauccaggacaucgacuccgccgcccgcgcccgcccccacuccuaccucgacgccuacuucgucuuccccaacggcuccgcccucacccucgacgagcucuccgucaugauccgcaacgaccaggacucccucacccagcuccuccagcucggccucgucguccucggcucccaggagucccaggaguccgaccucuccaagcagcucaucuccgucaucaucggccucggcgucgcccuccuccucguccucgucaucaugaccauggccuucgucugcguccgcaaguccuacaaccgcaagcuccaggccaugaaggccgccaaggaggcccgcaagaccgccgccggcgucaugcccuccgcccccgccauccccggcaccaacauguacaacaccgagcgcgccaaccccaugcucaaccuccccaacaaggaccucggccucgaguaccucucccccuccaacgaccucgacuccgucuccgucaacucccucgacgacaacuccgucgacgucgacaagaacucccaggagaucaaggagcaccgccccccccacaccccccccgagcccgaccccgagccccucuccgucguccuccucggccgccaggccggcgccuccggccagcucgagggccccuccuacaccaacgccggccucgacaccaccgaccucuga

SEQ ID NO: 41091 - RNA, 2658 nt, Artificial Sequence
  derived and/or modified sequence opt2 from CDHR3__Homo_sapiens__NP_689963
augcaggaggccaucauccuccucgcccuccucggcgccauguccggcggcgaggcccuccaccucauccuccuccccgccaccggcaacgucgccgagaacuccccccccggcaccuccguccacaaguucuccgucaagcucuccgccucccucucccccgucauccccggcuucccccagaucgucaacuccaacccccucaccgaggccuuccgcgucaacuggcucuccggcaccuacuucgaggucgucaccaccggcauggagcagcucgacuucgagaccggccccaacaucuucgaccuccagaucuacgucaaggacgaggucggcgucaccgaccuccagguccucaccguccaggucaccgacgucaacgagcccccccaguuccagggcaaccucgccgagggccuccaccucuacaucgucgagcgcgccaaccccggcuucaucuaccaggucgaggccuucgaccccgaggacaccucccgcaacaucccccucuccuacuuccucaucuccccccccaaguccuuccgcauguccgccaacggcacccucuucuccaccaccgagcucgacuucgaggccggccaccgcuccuuccaccucaucgucgagguccgcgacuccggcggccucaaggccuccaccgagcuccaggucaacaucgucaaccucaacgacgaggucccccgcuucaccucccccacccgcgucuacaccguccucgaggagcucucccccggcaccaucgucgccaacaucaccgccgaggaccccgacgacgagggcuuccccucccaccuccucuacuccaucaccaccgucuccaaguacuucaugaucaaccagcucaccggcaccauccaggucgcccagcgcaucgaccgcgacgccggcgagcuccgccagaaccccaccaucucccucgagguccucgucaaggaccgccccuacggcggccaggagaaccgcauccagaucaccuucaucgucgaggacgucaacgacaaccccgccaccugccagaaguucaccuucuccaucaugguccccgagcgcaccgccaagggcacccuccuccucgaccucaacaaguucugcuucgacgacgacuccgaggcccccaacaaccgcuucaacuucaccaugcccuccggcgucggcuccggcucccgcuuccuccaggaccccgccggcuccggcaagaucguccucaucggcgaccucgacuacgagaaccccuccaaccucgccgccggcaacaaguacaccgucaucauccagguccaggacgucgccccccccuacuacaagaacaacgucuacgucuacauccucaccucccccgagaacgaguucccccucaucuucgaccgccccuccuacgucuucgacgucuccgagcgccgccccgcccgcacccgcgucggccagguccgcgccaccgacaaggaccucccccaguccucccuccucuacuccaucuccaccggcggcgccucccuccaguaccccaacgucuucuggaucaaccccaagaccggcgagcuccagcucgucaccaaggucgacugcgagaccacccccaucuacauccuccgcauccaggccaccaacaacgaggacaccuccuccgucaccgucaccgucaacauccucgaggagaacgacgagaagcccaucugcacccccaacuccuacuuccucgcccuccccgucgaccucaaggucggcaccaacauccagaacuucaagcucaccugcaccgaccucgacuccuccccccgcuccuuccgcuacuccaucggccccggcaacgucaacaaccacuucaccuucucccccaacgccggcuccaacgucacccgccuccuccucaccucccgcuucgacuacgccggcggcuucgacaagaucugggacuacaagcuccucgucuacgucaccgacgacaaccucauguccgaccgcaagaaggccgaggcccucgucgagaccggcaccgucacccucuccaucaaggucaucccccaccccaccaccaucaucaccaccaccccccgcccccgcgucaccuaccagguccuccgcaagaacgucuacucccccuccgccugguacguccccuucgucaucacccucggcuccauccuccuccucggccuccucgucuaccucgucguccuccucgccaaggccauccaccgccacugccccugcaagaccggcaagaacaaggagccccucaccaagaagggcgagaccaagaccgccgagcgcgacgucgucgucgagaccauccagaugaacaccaucuucgacggcgaggccaucgaccccgucaccggcgagaccuacgaguucaacuccaagaccggcgcccgcaaguggaaggacccccucacccagaugcccaaguggaaggaguccucccaccagggcgccgccccccgccgcgucaccgccggcgagggcaugggcucccuccgcuccgccaacugggaggaggacgagcucuccggcaaggccugggccgaggacgccggccucggcucccgcaacgagggcggcaagcucggcaaccccaagaaccgcaaccccgccuucaugaaccgcgccuaccccaagccccaccccggcaaguga

SEQ ID NO: 41092 - RNA, 2520 nt, Artificial Sequence
  derived and/or modified sequence opt2 from CDHR5__Homo_sapiens__NP_001165439
augggcuccugggcccuccucuggcccccccuccucuucaccggccuccucguccgcccccccggcaccauggcccaggcccaguacugcuccgucaacaaggacaucuucgaggucgaggagaacaccaacgucaccgagccccucgucgacauccacguccccgagggccaggaggucacccucggcgcccucuccacccccuucgccuuccgcauccagggcaaccagcucuuccucaacgucacccccgacuacgaggagaagucccuccucgaggcccagcuccucugccaguccggcggcacccucgucacccagcuccgcgucuucgucuccguccucgacgucaacgacaacgcccccgaguuccccuucaagaccaaggagauccgcgucgaggaggacaccaaggucaacuccaccgucauccccgagacccagcuccaggccgaggaccgcgacaaggacgacauccucuucuacacccuccaggagaugaccgccggcgccuccgacuacuucucccucgucuccgucaaccgccccgcccuccgccucgaccgcccccucgacuucuacgagcgccccaacaugaccuucuggcuccucguccgcgacacccccggcgagaacgucgagcccucccacaccgccaccgccacccucguccucaacgucguccccgccgaccuccgcccccccugguuccuccccugcaccuucuccgacggcuacgucugcauccaggcccaguaccacggcgccguccccaccggccacauccuccccuccccccucguccuccgccccggccccaucuacgccgaggacggcgaccgcggcaucaaccagcccaucaucuacuccaucuuccgcggcaacgucaacggcaccuucaucauccaccccgacuccggcaaccucaccgucgcccgcuccguccccucccccaugaccuuccuccuccucgucaagggccagcaggccgaccucgcccgcuacuccgucacccaggucaccgucgaggccgucgccgccgccggcucccccccccgcuucccccagcgccucuaccgcggcaccgucgcccgcggcgccggcgccggcgucgucgucaaggacgccgccgcccccucccagccccuccgcauccaggcccaggaccccgaguucuccgaccucaacuccgccaucaccuaccgcaucaccaaccacucccacuuccgcauggagggcgaggucguccucaccaccaccacccucgcccaggccggcgccuucuacgccgaggucgaggcccacaacaccgucaccuccggcaccgccaccaccgucaucgagauccaggucuccgagcaggagccccccuccaccgaggccggcggcaccaccggccccuggaccuccaccaccuccgaggucccccgcccccccgagcccucccagggccccuccaccaccuccuccggcggcggcaccggcccccacccccccuccggcaccacccuccgcccccccaccuccuccacccccggcggcccccccggcgccgagaacuccaccucccaccagcccgccacccccggcggcgacaccgcccagacccccaagcccggcaccucccagcccaugccccccggcgucggcaccuccaccucccaccagcccgccacccccuccggcggcaccgcccagacccccgagcccggcaccucccagcccaugccccccuccaugggcaccuccaccucccaccagcccgccacccccggcggcggcaccgcccagacccccgaggccggcaccucccagcccaugccccccggcaugggcaccuccaccucccaccagcccaccacccccggcggcggcaccgcccagacccccgagcccggcaccucccagcccaugccccucuccaaguccacccccuccuccggcggcggccccuccgaggacaagcgcuucuccgucgucgacauggccgcccucggcggcguccucggcgcccuccuccuccucgcccuccucggccucgccguccucguccacaagcacuacggcccccgccucaagugcugcuccggcaaggcccccgagccccagccccagggcuucgacaaccaggccuuccuccccgaccacaaggccaacugggcccccguccccucccccacccacgaccccaagcccgccgaggcccccaugcccgccgagcccgccccccccggccccgccucccccggcggcgcccccgagccccccgccgccgcccgcgccggcggcucccccaccgccguccgcuccauccucaccaaggagcgccgccccgagggcggcuacaaggccgucugguucggcgaggacaucggcaccgaggccgacgucgucguccucaacgcccccacccucgacgucgacggcgccuccgacuccggcuccggcgacgagggcgagggcgccggccgcggcggcggccccuacgacgcccccggcggcgacgacuccuacaucuga

SEQ ID NO: 41093 - RNA, 642 nt, Artificial Sequence
  derived and/or modified sequence opt2 from CDIPT__Homo_sapiens__NP_006310
augcccgacgagaacaucuuccucuucguccccaaccucaucggcuacgcccgcaucgucuucgccaucaucuccuucuacuucaugcccugcugcccccucaccgccuccuccuucuaccuccucuccggccuccucgacgccuucgacggccacgccgcccgcgcccucaaccagggcacccgcuucggcgccaugcucgacaugcucaccgaccgcugcuccaccaugugccuccucgucaaccucgcccuccucuaccccggcgccacccucuucuuccagaucuccaugucccucgacgucgccucccacuggcuccaccuccacuccuccgucguccgcggcuccgagucccacaagaugaucgaccucuccggcaaccccguccuccgcaucuacuacaccucccgccccgcccucuucacccucugcgccggcaacgagcucuucuacugccuccucuaccucuuccacuucuccgagggcccccucgucggcuccgucggccucuuccgcaugggccucugggucaccgcccccaucgcccuccucaagucccucaucuccgucauccaccucaucaccgccgcccgcaacauggccgcccucgacgccgccgaccgcgccaagaagaaguga

SEQ ID NO: 41094 - RNA, 819 nt, Artificial Sequence
  derived and/or modified sequence opt2 from CDK10__Homo_sapiens__NP_443713
auggacaaggagaaggacggcauccccaucuccucccuccgcgagaucacccuccuccuccgccuccgccaccccaacaucgucgagcucaaggaggucgucgucggcaaccaccucgaguccaucuuccucgucaugggcuacugcgagcaggaccucgccucccuccucgagaacaugcccacccccuucuccgaggcccaggucaagugcaucguccuccagguccuccgcggccuccaguaccuccaccgcaacuucaucauccaccgcgaccucaaggucuccaaccuccucaugaccgacaagggcugcgucaagaccgccgacuucggccucgcccgcgccuacggcguccccgucaagcccaugacccccaaggucgucacccucugguaccgcgcccccgagcuccuccucggcaccaccacccagaccaccuccaucgacaugugggccgucggcugcauccucgccgagcuccucgcccaccgcccccuccuccccggcaccuccgagauccaccagaucgaccucaucguccagcuccucggcacccccuccgagaacaucuggcccggcuucuccaagcucccccucgucggccaguacucccuccgcaagcagcccuacaacaaccucaagcacaaguuccccuggcucuccgaggccggccuccgccuccuccacuuccucuucauguacgaccccaagaagcgcgccaccgccggcgacugccucgaguccuccuacuucaaggagaagccccuccgccuccccaucuccggcgucugcgagggcugccgcgagcccggcuga

SEQ ID NO: 41095 - RNA, 2388 nt, Artificial Sequence
  derived and/or modified sequence opt2 from CDK11B__Homo_sapiens__NP_001778
augggcgacgagaaggacuccuggaaggucaagacccucgacgagauccuccaggagaagaagcgccgcaaggagcaggaggagaaggccgagaucaagcgccucaagaacuccgacgaccgcgacuccaagcgcgacucccucgaggagggcgagcuccgcgaccaccgcauggagaucaccauccgcaacucccccuaccgccgcgaggacuccauggaggaccgcggcgaggaggacgacucccucgccaucaagcccccccagcagaugucccgcaaggagaaggcccaccaccgcaaggacgagaagcgcaaggagaagcgccgccaccgcucccacuccgccgagggcggcaagcacgcccgcgucaaggagaaggagcgcgagcacgagcgccgcaagcgccaccgcgaggagcaggacaaggcccgccgcgagugggagcgccagaagcgccgcgagauggcccgcgagcacucccgccgcgagcgcgaccgccucgagcagcucgagcgcaagcgcgagcgcgagcgcaagaugcgcgagcagcagaaggagcagcgcgagcagaaggagcgcgagcgccgcgccgaggagcgccgcaaggagcgcgaggcccgccgcgaggucuccgcccaccaccgcaccaugcgcgaggacuacuccgacaaggucaaggccucccacuggucccgcucccccccccgccccccccgcgagcgcuucgagcucggcgacggccgcaagcccggcgaggcccgccccgcccccgcccagaagcccgcccagcucaaggaggagaagauggaggagcgcgaccuccucuccgaccuccaggacaucuccgacuccgagcgcaagaccuccuccgccgaguccuccuccgccgaguccggcuccggcuccgaggaggaggaggaggaggaggaggaggaggaggaggagggcuccaccuccgaggaguccgaggaggaggaggaggaggaggaggaggaggaggaggagaccggcuccaacuccgaggaggccuccgagcaguccgccgaggaggucuccgaggaggagauguccgaggacgaggagcgcgagaacgagaaccaccuccucgucguccccgagucccgcuucgaccgcgacuccggcgaguccgaggaggccgaggaggaggucggcgagggcaccccccaguccuccgcccucaccgagggcgacuacguccccgacucccccgcccucucccccaucgagcucaagcaggagcuccccaaguaccuccccgcccuccagggcugccgcuccgucgaggaguuccagugccucaaccgcaucgaggagggcaccuacggcgucgucuaccgcgccaaggacaagaagaccgacgagaucgucgcccucaagcgccucaagauggagaaggagaaggagggcuuccccaucaccucccuccgcgagaucaacaccauccucaaggcccagcaccccaacaucgucaccguccgcgagaucgucgucggcuccaacauggacaagaucuacaucgucaugaacuacgucgagcacgaccucaagucccucauggagaccaugaagcagcccuuccuccccggcgaggucaagacccucaugauccagcuccuccgcggcgucaagcaccuccacgacaacuggauccuccaccgcgaccucaagaccuccaaccuccuccucucccacgccggcauccucaaggucggcgacuucggccucgcccgcgaguacggcuccccccucaaggccuacacccccgucgucgucacccucugguaccgcgcccccgagcuccuccucggcgccaaggaguacuccaccgccgucgacaugugguccgucggcugcaucuucggcgagcuccucacccagaagccccucuuccccggcaaguccgagaucgaccagaucaacaaggucuucaaggaccucggcacccccuccgagaagaucuggcccggcuacuccgagcuccccgccgucaagaagaugaccuucuccgagcaccccuacaacaaccuccgcaagcgcuucggcgcccuccucuccgaccagggcuucgaccucaugaacaaguuccucaccuacuuccccggccgccgcaucuccgccgaggacggccucaagcacgaguacuuccgcgagaccccccuccccaucgaccccuccauguuccccaccuggcccgccaaguccgagcagcagcgcgucaagcgcggcaccuccccccgcccccccgagggcggccucggcuacucccagcucggcgacgacgaccucaaggagaccggcuuccaccucaccaccaccaaccagggcgccuccgccgccggccccggcuucucccucaaguucuga

SEQ ID NO: 41096 - RNA, 4446 nt, Artificial Sequence
  derived and/or modified sequence opt2 from CDK12__Homo_sapiens__NP_055898
augcccaacuccgagcgccacggcggcaagaaggacggcuccggcggcgccuccggcacccuccagcccuccuccggcggcggcuccuccaacucccgcgagcgccaccgccucgucuccaagcacaagcgccacaaguccaagcacuccaaggacaugggccucgucacccccgaggccgccucccucggcaccgucaucaagccccucgucgaguacgacgacaucuccuccgacuccgacaccuucuccgacgacauggccuucaagcucgaccgccgcgagaacgacgagcgccgcggcuccgaccgcuccgaccgccuccacaagcaccgccaccaccagcaccgccgcucccgcgaccuccucaaggccaagcagaccgagaaggagaagucccaggaggucuccuccaaguccggcuccaugaaggaccgcaucuccggcuccuccaagcgcuccaacgaggagaccgacgacuacggcaaggcccaggucgccaaguccuccuccaaggagucccgcuccuccaagcuccacaaggagaagacccgcaaggagcgcgagcucaaguccggccacaaggaccgcuccaagucccaccgcaagcgcgagacccccaaguccuacaagaccgucgacucccccaagcgccgcucccgcuccccccaccgcaagugguccgacuccuccaagcaggacgacucccccuccggcgccuccuacggccaggacuacgaccucucccccucccgcucccacaccuccuccaacuacgacuccuacaagaagucccccggcuccaccucccgccgccaguccgucuccccccccuacaaggagcccuccgccuaccaguccuccacccgcucccccucccccuacucccgccgccagcgcuccgucucccccuacucccgccgccgcuccuccuccuacgagcgcuccggcuccuacuccggccgcucccccucccccuacggccgccgccgcuccuccucccccuuccucuccaagcgcucccucucccgcuccccccuccccucccgcaaguccaugaagucccgcucccgcucccccgccuacucccgccacuccuccucccacuccaagaagaagcgcuccuccucccgcucccgccacuccuccaucucccccguccgccucccccucaacuccucccucggcgccgagcucucccgcaagaagaaggagcgcgccgccgccgccgccgccgccaagauggacggcaaggaguccaagggcucccccgucuuccucccccgcaaggagaacuccuccgucgaggccaaggacuccggccucgaguccaagaagcucccccgcuccgucaagcucgagaaguccgcccccgacaccgagcucgucaacgucacccaccucaacaccgaggucaagaacuccuccgacaccggcaaggucaagcucgacgagaacuccgagaagcaccucgucaaggaccucaaggcccagggcacccgcgacuccaagcccaucgcccucaaggaggagaucgucacccccaaggagaccgagaccuccgagaaggagaccccccccccccuccccaccaucgccucccccccccccccccuccccaccaccaccccccccccccagacccccccccuccccccccucccccccauccccgcccucccccagcagcccccccucccccccucccagcccgccuucucccagguccccgccuccuccaccuccacccucccccccuccacccacuccaagaccuccgccgucuccucccaggccaacucccagccccccguccaggucuccgucaagacccaggucuccgucaccgccgccaucccccaccucaagaccuccacccuccccccccucccccuccccccccuccuccccggcgacgacgacauggacucccccaaggagacccuccccuccaagcccgucaagaaggagaaggagcagcgcacccgccaccuccucaccgaccucccccucccccccgagcuccccggcggcgaccucuccccccccgacucccccgagcccaaggccaucacccccccccagcagcccuacaagaagcgccccaagaucugcugcccccgcuacggcgagcgccgccagaccgaguccgacuggggcaagcgcugcgucgacaaguucgacaucaucggcaucaucggcgagggcaccuacggccaggucuacaaggccaaggacaaggacaccggcgagcucgucgcccucaagaagguccgccucgacaacgagaaggagggcuuccccaucaccgccauccgcgagaucaagauccuccgccagcucauccaccgcuccgucgucaacaugaaggagaucgucaccgacaagcaggacgcccucgacuucaagaaggacaagggcgccuucuaccucgucuucgaguacauggaccacgaccucaugggccuccucgaguccggccucguccacuucuccgaggaccacaucaaguccuucaugaagcagcucauggagggccucgaguacugccacaagaagaacuuccuccaccgcgacaucaagugcuccaacauccuccucaacaacuccggccagaucaagcucgccgacuucggccucgcccgccucuacaacuccgaggagucccgccccuacaccaacaaggucaucacccucugguaccgcccccccgagcuccuccucggcgaggagcgcuacacccccgccaucgacgucugguccugcggcugcauccucggcgagcucuucaccaagaagcccaucuuccaggccaaccucgagcucgcccagcucgagcucaucucccgccucugcggcucccccugccccgccgucuggcccgacgucaucaagcuccccuacuucaacaccaugaagcccaagaagcaguaccgccgccgccuccgcgaggaguucuccuucauccccuccgccgcccucgaccuccucgaccacaugcucacccucgaccccuccaagcgcugcaccgccgagcagacccuccaguccgacuuccucaaggacgucgagcucuccaagauggccccccccgaccucccccacuggcaggacugccacgagcucugguccaagaagcgccgccgccagcgccaguccggcgucgucgucgaggagcccccccccuccaagaccucccgcaaggagaccaccuccggcaccuccaccgagcccgucaagaacuccucccccgcccccccccagcccgcccccggcaaggucgaguccggcgccggcgacgccaucggccucgccgacaucacccagcagcucaaccaguccgagcucgccguccuccucaaccuccuccagucccagaccgaccucuccaucccccagauggcccagcuccucaacauccacuccaaccccgagaugcagcagcagcucgaggcccucaaccaguccaucuccgcccucaccgaggccaccucccagcagcaggacuccgagaccauggcccccgaggagucccucaaggaggcccccuccgcccccgucauccuccccuccgccgagcagaccacccucgaggccuccuccacccccgccgacaugcagaacauccucgccguccuccucucccagcucaugaagacccaggagcccgccggcucccucgaggagaacaacuccgacaagaacuccggcccccagggcccccgccgcacccccaccaugccccaggaggaggccgccgagaagcgcccccccgagccccccggcccccccccccccccccccccccccccccucgucgagggcgaccucuccuccgccccccaggagcucaaccccgccgucaccgccgcccuccuccagcuccucucccagcccgaggccgagccccccggccaccucccccacgagcaccaggcccuccgccccauggaguacuccacccgcccccgccccaaccgcaccuacggcaacaccgacggccccgagaccggcuucuccgccaucgacaccgacgagcgcaacuccggccccgcccucaccgagucccucguccagacccucgucaagaaccgcaccuucuccggcucccucucccaccucggcgaguccuccuccuaccagggcaccggcuccguccaguuccccggcgaccaggaccuccgcuucgcccgcgucccccucgcccuccaccccgucgucggccagcccuuccucaaggccgagggcuccuccaacuccgucguccacgccgagaccaagcuccagaacuacggcgagcucggccccggcaccaccggcgccuccuccuccggcgccggccuccacuggggcggccccacccaguccuccgccuacggcaagcucuaccgcggccccacccgcguccccccccgcggcggccgcggccgcggcguccccuacuga

SEQ ID NO: 41097 - RNA, 4539 nt, Artificial Sequence
  derived and/or modified sequence opt2 from CDK13__Homo_sapiens__NP_003709
augcccuccuccuccgacaccgcccucggcggcggcggcggccucuccugggccgagaagaagcucgaggagcgccgcaagcgccgccgcuuccucuccccccagcagcccccccuccuccucccccuccuccagccccagcuccuccagccccccccccccccccccccccuccucuuccucgccgcccccggcaccgccgccgccgccgccgccgccgccgccgccuccuccuccugcuucucccccggccccccccucgaggucaagcgccucgcccgcggcaagcgccgcgccggcggccgccagaagcgccgccgcggcccccgcgccggccaggaggccgagaagcgccgcgucuucucccucccccagccccagcaggacggcggcggcggcgccuccuccggcggcggcgucaccccccucgucgaguacgaggacgucuccucccaguccgagcagggccuccuccucggcggcgccuccgccgccaccgccgccaccgccgccggcggcaccggcggcuccggcggcucccccgccuccuccuccggcacccagcgccgcggcgagggcuccgagcgccgcccccgccgcgaccgccgcuccuccuccggccgcuccaaggagcgccaccgcgagcaccgccgccgcgacggccagcgcggcggcuccgaggccuccaagucccgcucccgccacucccacuccggcgaggagcgcgccgaggucgccaaguccggcuccuccuccuccuccggcggccgccgcaaguccgccuccgccaccuccuccuccuccuccucccgcaaggaccgcgacuccaaggcccaccgcucccgcaccaaguccuccaaggagccccccuccgccuacaaggagccccccaaggccuaccgcgaggacaagaccgagcccaaggccuaccgccgccgccgcucccucuccccccucggcggccgcgacgacucccccgucucccaccgcgccucccagucccuccgcucccgcaagucccccucccccgccggcggcggcuccucccccuacucccgccgccucccccgcucccccucccccuacucccgccgccgcucccccuccuacucccgccacuccuccuacgagcgcggcggcgacgucucccccucccccuacuccuccuccuccuggcgccgcucccgcucccccuacucccccguccuccgccgcuccggcaagucccgcucccgcucccccuacuccucccgccacucccgcucccgcucccgccaccgccucucccgcucccgcucccgccacuccuccaucucccccuccacccucacccucaaguccucccucgccgccgagcucaacaagaacaagaaggcccgcgccgccgaggccgcccgcgccgccgaggccgccaaggccgccgaggccaccaaggccgccgaggccgccgccaaggccgccaaggccuccaacaccuccacccccaccaagggcaacaccgagaccuccgccuccgccucccagaccaaccacgucaaggacgucaagaagaucaagaucgagcacgcccccucccccuccuccggcggcacccucaagaacgacaaggccaagaccaagcccccccuccaggucaccaaggucgagaacaaccucaucgucgacaaggccaccaagaaggccgucaucgucggcaaggaguccaaguccgccgccaccaaggaggaguccgucucccucaaggagaagaccaagccccucacccccuccaucggcgccaaggagaaggagcagcacgucgcccucgucaccuccacccuccccccccucccccucccccccaugcuccccgaggacaaggaggccgacucccuccgcggcaacaucuccgucaaggccgucaagaaggaggucgagaagaagcuccgcugccuccucgccgaccucccccucccccccgagcuccccggcggcgacgaccucuccaagucccccgaggagaagaagaccgccacccagcuccacuccaagcgccgccccaagaucugcggcccccgcuacggcgagaccaaggagaaggacaucgacuggggcaagcgcugcgucgacaaguucgacaucaucggcaucaucggcgagggcaccuacggccaggucuacaaggcccgcgacaaggacaccggcgagauggucgcccucaagaagguccgccucgacaacgagaaggagggcuuccccaucaccgccauccgcgagaucaagauccuccgccagcucacccaccaguccaucaucaacaugaaggagaucgucaccgacaaggaggacgcccucgacuucaagaaggacaagggcgccuucuaccucgucuucgaguacauggaccacgaccucaugggccuccucgaguccggccucguccacuucaacgagaaccacaucaaguccuucaugcgccagcucauggagggccucgacuacugccacaagaagaacuuccuccaccgcgacaucaagugcuccaacauccuccucaacaaccgcggccagaucaagcucgccgacuucggccucgcccgccucuacuccuccgaggagucccgccccuacaccaacaaggucaucacccucugguaccgcccccccgagcuccuccucggcgaggagcgcuacacccccgccaucgacgucugguccugcggcugcauccucggcgagcucuucaccaagaagcccaucuuccaggccaaccaggagcucgcccagcucgagcucaucucccgcaucugcggcucccccugccccgccgucuggcccgacgucaucaagcuccccuacuucaacaccaugaagcccaagaagcaguaccgccgcaagcuccgcgaggaguucgucuucauccccgccgccgcccucgaccucuucgacuacaugcucgcccucgaccccuccaagcgcugcaccgccgagcaggcccuccagugcgaguuccuccgcgacgucgagcccuccaagaugcccccccccgaccucccccucuggcaggacugccacgagcucugguccaagaagcgccgccgccagaagcagaugggcaugaccgacgacgucuccaccaucaaggccccccgcaaggaccucucccucggccucgacgacucccgcaccaacaccccccagggcguccuccccuccucccagcucaagucccagggcuccuccaacgucgcccccgucaagaccggccccggccagcaccucaaccacuccgagcucgccauccuccucaaccuccuccaguccaagaccuccgucaacauggccgacuucguccagguccucaacaucaaggucaacuccgagacccagcagcagcucaacaagaucaaccuccccgccggcauccucgccaccggcgagaagcagaccgaccccuccaccccccagcaggaguccuccaagccccucggcggcauccagcccuccucccagaccauccagcccaaggucgagaccgacgccgcccaggccgccguccaguccgccuucgccguccuccucacccagcucaucaaggcccagcaguccaagcagaaggacguccuccucgaggagcgcgagaacggcuccggccacgaggccucccuccagcuccgccccccccccgagcccuccacccccgucuccggccaggacgaccucauccagcaccaggacaugcgcauccucgagcucacccccgagcccgaccgcccccgcauccucccccccgaccagcgcccccccgagccccccgagcccccccccgucaccgaggaggaccucgacuaccgcaccgagaaccagcacguccccaccaccuccuccucccucaccgacccccacgccggcgucaaggccgcccuccuccagcuccucgcccagcaccagccccaggacgaccccaagcgcgagggcggcaucgacuaccaggccggcgacaccuacgucuccaccuccgacuacaaggacaacuucggcuccuccuccuucuccuccgcccccuacgucuccaacgacggccucggcuccuccuccgcccccccccucgagcgccgcuccuucaucggcaacuccgacauccagucccucgacaacuacuccaccgccuccucccacuccggcggccccccccagcccuccgccuucuccgaguccuuccccuccuccgucgccggcuacggcgacaucuaccucaacgccggccccaugcucuucuccggcgacaaggaccaccgcuucgaguacucccacggccccaucgccguccucgccaacuccuccgaccccuccaccggccccgaguccacccacccccuccccgccaagaugcacaacuacaacuacggcggcaaccuccaggagaaccccuccggccccucccucaugcacggccagaccuggaccucccccgcccagggccccggcuacucccagggcuaccgcggccacaucuccaccuccaccggccgcggccgcggccgcggccuccccuacuga

SEQ ID NO: 41098 - RNA, 1410 nt, Artificial Sequence
  derived and/or modified sequence opt2 from CDK14__Homo_sapiens__NP_001274064
augugcgaccucaucgagccccagcccgccgagaagaucggcaagaugaagaagcuccgccgcacccucuccgaguccuucucccgcaucgcccucaagaaggacgacaccaccuucgacgagaucugcgucaccaagauguccacccgcaacugccagggcauggacuccgucaucaagccccucgacaccauccccgaggacaagaagguccgcguccagcgcacccaguccaccuucgaccccuucgagaagcccgccaaccaggucaagcgcguccacuccgagaacaacgccugcaucaacuucaagaccuccuccaccggcaaggagucccccaagguccgccgccacuccucccccuccucccccaccucccccaaguucggcaaggccgacuccuacgagaagcucgagaagcucggcgagggcuccuacgccaccgucuacaagggcaaguccaaggucaacggcaagcucgucgcccucaaggucauccgccuccaggaggaggagggcacccccuucaccgccauccgcgaggccucccuccucaagggccucaagcacgccaacaucguccuccuccacgacaucauccacaccaaggagacccucacccucgucuucgaguacguccacaccgaccucugccaguacauggacaagcaccccggcggccuccaccccgacaacgucaagcucuuccucuuccagcuccuccgcggccucuccuacauccaccagcgcuacauccuccaccgcgaccucaagccccagaaccuccucaucuccgacaccggcgagcucaagcucgccgacuucggccucgcccgcgccaaguccguccccucccacaccuacuccaacgaggucgucacccucugguaccgcccccccgacguccuccucggcuccaccgaguacuccaccugccucgacauguggggcgucggcugcaucuucgucgagaugauccagggcgucgccgccuuccccggcaugaaggacauccaggaccagcucgagcgcaucuuccucguccucggcacccccaacgaggacaccuggcccggcguccacucccucccccacuucaagcccgagcgcuucacccucuacuccuccaagaaccuccgccaggccuggaacaagcucuccuacgucaaccacgccgaggaccucgccuccaagcuccuccagugcucccccaagaaccgccucuccgcccaggccgcccucucccacgaguacuucuccgaccuccccccccgccucugggagcucaccgacauguccuccaucuucaccguccccaacguccgccuccagcccgaggccggcgaguccaugcgcgccuucggcaagaacaacuccuacggcaagucccucuccaacuccaagcacuga

SEQ ID NO: 41099 - RNA, 1290 nt, Artificial Sequence
  derived and/or modified sequence opt2 from CDK15__Homo_sapiens__NP_001248364
augggccaggagcucugcgccaagaccguccagcccggcugcuccugcuaccacugcuccgagggcggcgaggcccacuccugccgccgcucccagcccgagaccaccgaggccgccuucaagcucaccgaccucaaggaggccuccugcuccaugaccuccuuccacccccgcggccuccaggccgcccgcgcccagaaguucaaguccaagcgcccccgcuccaacuccgacugcuuccaggaggaggaccuccgccagggcuuccaguggcgcaagucccuccccuucggcgccgccuccuccuaccucaaccucgagaagcucggcgagggcuccuacgccaccgucuacaagggcaucucccgcaucaacggccagcucgucgcccucaaggucaucuccaugaacgccgaggagggcguccccuucaccgccauccgcgaggccucccuccucaagggccucaagcacgccaacaucguccuccuccacgacaucauccacaccaaggagacccucaccuucgucuucgaguacaugcacaccgaccucgcccaguacaugucccagcaccccggcggccuccacccccacaacguccgccucuucauguuccagcuccuccgcggccucgccuacauccaccaccagcacguccuccaccgcgaccucaagccccagaaccuccucaucucccaccucggcgagcucaagcucgccgacuucggccucgcccgcgccaaguccauccccucccagaccuacuccuccgaggucgucacccucugguaccgcccccccgacgcccuccucggcgccaccgaguacuccuccgagcucgacaucuggggcgccggcugcaucuucaucgagauguuccagggccagccccucuuccccggcgucuccaacauccucgagcagcucgagaagaucugggagguccucggcguccccaccgaggacaccuggcccggcgucuccaagcuccccaacuacaaccccgagugguucccccuccccaccccccgcucccuccacgucgucuggaaccgccucggccgcguccccgaggccgaggaccucgccucccagaugcucaagggcuucccccgcgaccgcgucuccgcccaggaggcccucguccacgacuacuucuccgcccuccccucccagcucuaccagcuccccgacgucuccggcguccgccucaagcccgagaugugcgaccuccucgccuccuaccagaagggccaccaccccgcccaguucuccaagugcugguga

SEQ ID NO: 41100 - RNA, 1713 nt, Artificial Sequence
  derived and/or modified sequence opt2 from CDK16__Homo_sapiens__NP_001163931
augccccucuacggccgcgcccgcgaccacgucacccaccccuccauccucggcacccgccccggccgccccauggccggccccaucaccgccgccguccccgagaagaucugcaacggcgccuucugcuccugcuccggcgccuucccccucgaccccaacaaccccucccucggcccccuccccuccaucucccaccucaaccuccgcacccagaucgccauggaccgcaugaagaagaucaagcgccagcucuccaugacccuccgcggcggccgcggcaucgacaagaccaacggcgcccccgagcagaucggccucgacgaguccggcggcggcggcggcuccgaccccggcgaggcccccacccgcgccgcccccggcgagcuccgcuccgcccgcggcccccucuccuccgcccccgagaucguccacgaggaccucaagaugggcuccgacggcgaguccgaccaggccuccgccaccuccuccgacgagguccagucccccguccgcguccgcaugcgcaaccaccccccccgcaagaucuccaccgaggacaucaacaagcgccucucccuccccgccgacauccgccuccccgagggcuaccucgagaagcucacccucaacucccccaucuucgacaagccccucucccgccgccuccgccgcgucucccucuccgagaucggcuucggcaagcucgagaccuacaucaagcucgacaagcucggcgagggcaccuacgccaccgucuacaagggcaaguccaagcucaccgacaaccucgucgcccucaaggagauccgccucgagcacgaggagggcgcccccugcaccgccauccgcgaggucucccuccucaaggaccucaagcacgccaacaucgucacccuccacgacaucauccacaccgagaagucccucacccucgucuucgaguaccucgacaaggaccucaagcaguaccucgacgacugcggcaacaucaucaacaugcacaacgucaagcucuuccucuuccagcuccuccgcggccucgccuacugccaccgccagaagguccuccaccgcgaccucaagccccagaaccuccucaucaacgagcgcggcgagcucaagcucgccgacuucggccucgcccgcgccaaguccauccccaccaagaccuacuccaacgaggucgucacccucugguaccgcccccccgacauccuccucggcuccaccgacuacuccacccagaucgacauguggggcgucggcugcaucuucuacgagauggccaccggccgcccccucuuccccggcuccaccgucgaggagcagcuccacuucaucuuccgcauccucggcacccccaccgaggagaccuggcccggcauccucuccaacgaggaguucaagaccuacaacuaccccaaguaccgcgccgaggcccuccucucccacgccccccgccucgacuccgacggcgccgaccuccucaccaagcuccuccaguucgagggccgcaaccgcaucuccgccgaggacgccaugaagcaccccuucuuccucucccucggcgagcgcauccacaagcuccccgacaccaccuccaucuucgcccucaaggagauccagcuccagaaggaggccucccuccgcuccuccuccaugcccgacuccggccgccccgccuuccgcgucgucgacaccgaguucuga

SEQ ID NO: 41101 - RNA, 1572 nt, Artificial Sequence
  derived and/or modified sequence opt2 from CDK17__Homo_sapiens__NP_002586
augaagaaguucaagcgccgccucucccucacccuccgcggcucccagaccaucgacgagucccucuccgagcucgccgagcagaugaccaucgaggagaacuccuccaaggacaacgagcccaucgucaagaacggccgcccccccaccucccacuccaugcacuccuuccuccaccaguacaccggcuccuucaagaagcccccccuccgccgcccccacuccgucaucggcggcucccucggcuccuucauggccaugccccgcaacggcucccgccucgacaucguccacgagaaccucaagaugggcuccgacggcgaguccgaccaggccuccggcaccuccuccgacgagguccagucccccaccggcgucugccuccgcaaccgcauccaccgccgcaucuccauggaggaccucaacaagcgccucucccuccccgccgacauccgcauccccgacggcuaccucgagaagcuccagaucaacuccccccccuucgaccagcccaugucccgccgcucccgccgcgccucccucuccgagaucggcuucggcaagauggagaccuacaucaagcucgagaagcucggcgagggcaccuacgccaccgucuacaagggccgcuccaagcucaccgagaaccucgucgcccucaaggagauccgccucgagcacgaggagggcgcccccugcaccgccauccgcgaggucucccuccucaaggaccucaagcacgccaacaucgucacccuccacgacaucguccacaccgacaagucccucacccucgucuucgaguaccucgacaaggaccucaagcaguacauggacgacugcggcaacaucauguccaugcacaacgucaagcucuuccucuaccagauccuccgcggccucgccuacugccaccgccgcaagguccuccaccgcgaccucaagccccagaaccuccucaucaacgagaagggcgagcucaagcucgccgacuucggccucgcccgcgccaaguccguccccaccaagaccuacuccaacgaggucgucacccucugguaccgcccccccgacguccuccucggcuccuccgaguacuccacccagaucgacauguggggcgucggcugcaucuucuucgagauggccuccggccgcccccucuuccccggcuccaccgucgaggacgagcuccaccucaucuuccgccuccucggcacccccucccaggagaccuggcccggcaucuccuccaacgaggaguucaagaacuacaacuuccccaaguacaagccccagccccucaucaaccacgccccccgccucgacuccgagggcaucgagcucaucaccaaguuccuccaguacgaguccaagaagcgcgucuccgccgaggaggccaugaagcacgucuacuuccgcucccucggcccccgcauccacgcccuccccgaguccgucuccaucuucucccucaaggagauccagcuccagaaggaccccggcuuccgcaacuccuccuaccccgagaccggccacggcaagaaccgccgccaguccaugcucuucuga

SEQ ID NO: 41102 - RNA, 1425 nt, Artificial Sequence
  derived and/or modified sequence opt2 from CDK18__Homo_sapiens__NP_002587
augaucaugaacaagaugaagaacuucaagcgccgcuucucccucuccgucccccgcaccgagaccaucgaggagucccucgccgaguucaccgagcaguucaaccagcuccacaaccgccgcaacgagaaccuccagcucggcccccucggccgcgaccccccccaggagugcuccaccuucucccccaccgacuccggcgaggagcccggccagcucucccccggcguccaguuccagcgccgccagaaccagcgccgcuucuccauggaggacgucuccaagcgccucucccuccccauggacauccgccucccccaggaguuccuccagaagcuccagauggagucccccgaccuccccaagccccucucccgcaugucccgccgcgccucccucuccgacaucggcuucggcaagcucgagaccuacgucaagcucgacaagcucggcgagggcaccuacgccaccgucuucaagggccgcuccaagcucaccgagaaccucgucgcccucaaggagauccgccucgagcacgaggagggcgcccccugcaccgccauccgcgaggucucccuccucaagaaccucaagcacgccaacaucgucacccuccacgaccucauccacaccgaccgcucccucacccucgucuucgaguaccucgacuccgaccucaagcaguaccucgaccacugcggcaaccucauguccaugcacaacgucaagaucuucauguuccagcuccuccgcggccucgccuacugccaccaccgcaagauccuccaccgcgaccucaagccccagaaccuccucaucaacgagcgcggcgagcucaagcucgccgacuucggccucgcccgcgccaaguccguccccaccaagaccuacuccaacgaggucgucacccucugguaccgcccccccgacguccuccucggcuccaccgaguacuccacccccaucgacauguggggcgucggcugcauccacuacgagauggccaccggccgcccccucuuccccggcuccaccgucaaggaggagcuccaccucaucuuccgccuccucggcacccccaccgaggagaccuggcccggcgucaccgccuucuccgaguuccgcaccuacuccuuccccugcuaccucccccagccccucaucaaccacgccccccgccucgacaccgacggcauccaccuccucuccucccuccuccucuacgaguccaagucccgcauguccgccgaggccgcccucucccacuccuacuuccgcucccucggcgagcgcguccaccagcucgaggacaccgccuccaucuucucccucaaggagauccagcuccagaaggaccccggcuaccgcggccucgccuuccagcagcccggccgcggcaagaaccgccgccaguccaucuucuga

SEQ ID NO: 41103 - RNA, 1329 nt, Artificial Sequence
  derived and/or modified sequence opt2 from CDK19__Homo_sapiens__NP_001287892
auguccgccugccgcgagaucgcccuccuccgcgagcucaagcaccccaacgucaucgcccuccagaaggucuuccucucccacuccgaccgcaaggucuggcuccucuucgacuacgccgagcacgaccucuggcacaucaucaaguuccaccgcgccuccaaggccaacaagaagcccaugcagcucccccgcuccauggucaagucccuccucuaccagauccucgacggcauccacuaccuccacgccaacuggguccuccaccgcgaccucaagcccgccaacauccucgucaugggcgagggccccgagcgcggccgcgucaagaucgccgacaugggcuucgcccgccucuucaacuccccccucaagccccucgccgaccucgaccccgucgucgucaccuucugguaccgcgcccccgagcuccuccucggcgcccgccacuacaccaaggccaucgacaucugggccaucggcugcaucuucgccgagcuccucaccuccgagcccaucuuccacugccgccaggaggacaucaagaccuccaaccccuuccaccacgaccagcucgaccgcaucuucuccgucaugggcuuccccgccgacaaggacugggaggacauccgcaagaugcccgaguaccccacccuccagaaggacuuccgccgcaccaccuacgccaacuccucccucaucaaguacauggagaagcacaaggucaagcccgacuccaaggucuuccuccuccuccagaagcuccucaccauggaccccaccaagcgcaucaccuccgagcaggcccuccaggaccccuacuuccaggaggacccccuccccacccucgacgucuucgccggcugccagauccccuaccccaagcgcgaguuccucaacgaggacgaccccgaggagaagggcgacaagaaccagcagcagcagcagaaccagcaccagcagcccaccgcccccccccagcaggccgccgcccccccccaggccccccccccccagcagaacuccacccagaccaacggcaccgccggcggcgccggcgccggcgucggcggcaccggcgccggccuccagcacucccaggacuccucccucaaccaggucccccccaacaagaagccccgccucggccccuccggcgccaacuccggcggccccgucaugcccuccgacuaccagcacuccuccucccgccucaacuaccaguccuccguccagggcuccucccagucccaguccacccucggcuacuccuccuccucccagcaguccucccaguaccaccccucccaccaggcccaccgcuacuga

SEQ ID NO: 41104 - RNA, 723 nt, Artificial Sequence
  derived and/or modified sequence opt2 from CDK1__Homo_sapiens__NP_203698
auggaggacuacaccaagaucgagaagaucggcgagggcaccuacggcgucgucuacaagggccgccacaagaccaccggccaggucgucgccaugaagaagauccgccucgaguccgaggaggagggcguccccuccaccgccauccgcgagaucucccuccucaaggagcuccgccaccccaacaucgucucccuccaggacguccucaugcaggacucccgccucuaccucaucuucgaguuccucuccauggaccucaagaaguaccucgacuccaucccccccggccaguacauggacuccucccucgucaaggucgucacccucugguaccgcucccccgagguccuccucggcuccgcccgcuacuccacccccgucgacaucugguccaucggcaccaucuucgccgagcucgccaccaagaagccccucuuccacggcgacuccgagaucgaccagcucuuccgcaucuuccgcgcccucggcacccccaacaacgaggucuggcccgaggucgagucccuccaggacuacaagaacaccuuccccaaguggaagcccggcucccucgccucccacgucaagaaccucgacgagaacggccucgaccuccucuccaagaugcucaucuacgaccccgccaagcgcaucuccggcaagauggcccucaaccaccccuacuucaacgaccucgacaaccagaucaagaagauguga

SEQ ID NO: 41105 - RNA, 1041 nt, Artificial Sequence
  derived and/or modified sequence opt2 from CDK20__Homo_sapiens__NP_001034892
auggaccaguacugcauccucggccgcaucggcgagggcgcccacggcaucgucuucaaggccaagcacgucgagaccggcgagaucgucgcccucaagaaggucgcccuccgccgccucgaggacggcuuccccaaccaggcccuccgcgagaucaaggcccuccaggagauggaggacaaccaguacgucguccagcucaaggccgucuucccccacggcggcggcuucguccucgccuucgaguucaugcucuccgaccucgccgaggucguccgccacgcccagcgcccccucgcccaggcccaggucaaguccuaccuccagaugcuccucaagggcgucgccuucugccacgccaacaacaucguccaccgcgaccucaagcccgccaaccuccucaucuccgccuccggccagcucaagaucgccgacuucggccucgcccgcgucuucucccccgacggcucccgccucuacacccaccaggucgccacccgcugguaccgcgcccccgagcuccucuacggcgcccgccaguacgaccagggcgucgaccucugguccgucggcugcaucaugggcgagcuccucaacggcuccccccucuuccccggcaagaacgacaucgagcagcucugcuacguccuccgcauccucggcacccccaacccccaggucuggcccgagcucaccgagcuccccgacuacaacaagaucuccuucaaggagcagguccccaugccccucgaggagguccuccccgacgucuccccccaggcccucgaccuccucggccaguuccuccucuaccccccccaccagcgcaucgccgccuccaaggcccuccuccaccaguacuucuucaccgccccccuccccgcccaccccuccgagcuccccaucccccagcgccucggcggccccgcccccaaggcccaccccggccccccccacauccacgacuuccacgucgaccgcccccucgaggagucccuccucaaccccgagcucauccgccccuucauccucgagggcuga

SEQ ID NO: 41106 - RNA, 348 nt, Artificial Sequence
  derived and/or modified sequence opt2 from CDK2AP1__Homo_sapiens__NP_004633
auguccuacaagcccaaccucgccgcccacaugcccgccgccgcccucaacgccgccggcuccguccacucccccuccaccuccauggccaccuccucccaguaccgccagcuccucuccgacuacggcccccccucccucggcuacacccagggcaccggcaacucccaggucccccaguccaaguacgccgagcuccucgccaucaucgaggagcucggcaaggagauccgccccaccuacgccggcuccaaguccgccauggagcgccucaagcgcggcaucauccacgcccgcggccucguccgcgagugccucgccgagaccgagcgcaacgcccgcuccuga

SEQ ID NO: 41107 - RNA, 381 nt, Artificial Sequence
  derived and/or modified sequence opt2 from CDK2AP2__Homo_sapiens__NP_005842
auguccuacaagcccaucgcccccgcccccuccuccacccccggcuccuccacccccggccccggcacccccguccccaccggcuccguccccucccccuccggcuccguccccggcgccggcgcccccuuccgcccccucuucaacgacuucggcccccccuccaugggcuacguccaggccaugaagccccccggcgcccagggcucccaguccaccuacaccgaccuccucuccgucaucgaggagaugggcaaggagauccgccccaccuacgccggcuccaaguccgccauggagcgccucaagcgcggcaucauccacgcccgcgcccucguccgcgagugccucgccgagaccgagcgcaacgcccgcaccuga

SEQ ID NO: 41108 - RNA, 897 nt, Artificial Sequence
  derived and/or modified sequence opt2 from CDK2__Homo_sapiens__NP_001789
auggagaacuuccagaaggucgagaagaucggcgagggcaccuacggcgucgucuacaaggcccgcaacaagcucaccggcgaggucgucgcccucaagaagauccgccucgacaccgagaccgagggcguccccuccaccgccauccgcgagaucucccuccucaaggagcucaaccaccccaacaucgucaagcuccucgacgucauccacaccgagaacaagcucuaccucgucuucgaguuccuccaccaggaccucaagaaguucauggacgccuccgcccucaccggcaucccccucccccucaucaaguccuaccucuuccagcuccuccagggccucgccuucugccacucccaccgcguccuccaccgcgaccucaagccccagaaccuccucaucaacaccgagggcgccaucaagcucgccgacuucggccucgcccgcgccuucggcguccccguccgcaccuacacccacgaggucgucacccucugguaccgcgcccccgagauccuccucggcugcaaguacuacuccaccgccgucgacaucuggucccucggcugcaucuucgccgagauggucacccgccgcgcccucuuccccggcgacuccgagaucgaccagcucuuccgcaucuuccgcacccucggcacccccgacgaggucgucuggcccggcgucaccuccaugcccgacuacaagcccuccuuccccaagugggcccgccaggacuucuccaaggucguccccccccucgacgaggacggccgcucccuccucucccagaugcuccacuacgaccccaacaagcgcaucuccgccaaggccgcccucgcccaccccuucuuccaggacgucaccaagcccgucccccaccuccgccucuga

SEQ ID NO: 41109 - RNA, 918 nt, Artificial Sequence
  derived and/or modified sequence opt2 from CDK3__Homo_sapiens__NP_001249
auggacauguuccagaaggucgagaagaucggcgagggcaccuacggcgucgucuacaaggccaagaaccgcgagaccggccagcucgucgcccucaagaagauccgccucgaccucgagauggagggcguccccuccaccgccauccgcgagaucucccuccucaaggagcucaagcaccccaacaucguccgccuccucgacgucguccacaacgagcgcaagcucuaccucgucuucgaguuccucucccaggaccucaagaaguacauggacuccacccccggcuccgagcucccccuccaccucaucaaguccuaccucuuccagcuccuccagggcgucuccuucugccacucccaccgcgucauccaccgcgaccucaagccccagaaccuccucaucaacgagcucggcgccaucaagcucgccgacuucggccucgcccgcgccuucggcgucccccuccgcaccuacacccacgaggucgucacccucugguaccgcgcccccgagauccuccucggcuccaaguucuacaccaccgccgucgacaucugguccaucggcugcaucuucgccgagauggucacccgcaaggcccucuuccccggcgacuccgagaucgaccagcucuuccgcaucuuccgcaugcucggcacccccuccgaggacaccuggcccggcgucacccagcuccccgacuacaagggcuccuuccccaaguggacccgcaagggccucgaggagaucguccccaaccucgagcccgagggccgcgaccuccucaugcagcuccuccaguacgaccccucccagcgcaucaccgccaagaccgcccucgcccaccccuacuucuccucccccgagcccucccccgccgcccgccaguacguccuccagcgcuuccgccacuga

SEQ ID NO: 41110 - RNA, 912 nt, Artificial Sequence
  derived and/or modified sequence opt2 from CDK4__Homo_sapiens__NP_000066
auggccaccucccgcuacgagcccgucgccgagaucggcgucggcgccuacggcaccgucuacaaggcccgcgacccccacuccggccacuucgucgcccucaaguccguccgcguccccaacggcggcggcggcggcggcggccuccccaucuccaccguccgcgaggucgcccuccuccgccgccucgaggccuucgagcaccccaacgucguccgccucauggacgucugcgccaccucccgcaccgaccgcgagaucaaggucacccucgucuucgagcacgucgaccaggaccuccgcaccuaccucgacaaggcccccccccccggccuccccgccgagaccaucaaggaccucaugcgccaguuccuccgcggccucgacuuccuccacgccaacugcaucguccaccgcgaccucaagcccgagaacauccucgucaccuccggcggcaccgucaagcucgccgacuucggccucgcccgcaucuacuccuaccagauggcccucacccccgucgucgucacccucugguaccgcgcccccgagguccuccuccaguccaccuacgccacccccgucgacaugugguccgucggcugcaucuucgccgagauguuccgccgcaagccccucuucugcggcaacuccgaggccgaccagcucggcaagaucuucgaccucaucggccucccccccgaggacgacuggccccgcgacgucucccucccccgcggcgccuuccccccccgcggcccccgccccguccaguccgucguccccgagauggaggaguccggcgcccagcuccuccucgagaugcucaccuucaacccccacaagcgcaucuccgccuuccgcgcccuccagcacuccuaccuccacaaggacgagggcaaccccgaguga

SEQ ID NO: 41111 - RNA, 783 nt, Artificial Sequence
  derived and/or modified sequence opt2 from CDK5__Homo_sapiens__NP_001157882
augcagaaguacgagaagcucgagaagaucggcgagggcaccuacggcaccgucuucaaggccaagaaccgcgagacccacgagaucgucgcccucaagcgcguccgccucgacgacgacgacgagggcguccccuccuccgcccuccgcgagaucugccuccucaaggagcucaagcacaagaacaucguccgccuccacgacguccuccacuccgacaagaagcucacccucgucuucgaguucugcgaccaggaccucaagaaguacuucgacuccugcaacggcgaccucgaccccgagaucgucaagaacggcgagcucaagcucgccgacuucggccucgcccgcgccuucggcauccccguccgcugcuacuccgccgaggucgucacccucugguaccgcccccccgacguccucuucggcgccaagcucuacuccaccuccaucgacaugugguccgccggcugcaucuucgccgagcucgccaacgccggccgcccccucuuccccggcaacgacgucgacgaccagcucaagcgcaucuuccgccuccucggcacccccaccgaggagcaguggcccuccaugaccaagcuccccgacuacaagcccuaccccauguaccccgccaccaccucccucgucaacgucguccccaagcucaacgccaccggccgcgaccuccuccagaaccuccucaagugcaaccccguccagcgcaucuccgccgaggaggcccuccagcaccccuacuucuccgacuucugcccccccuga

SEQ ID NO: 41112 - RNA, 924 nt, Artificial Sequence
  derived and/or modified sequence opt2 from CDK5R1__Homo_sapiens__XP_011523740
augggcaccguccucucccucucccccuccuaccgcaaggccacccucuucgaggacggcgccgccaccgucggccacuacaccgccguccagaacuccaagaacgccaaggacaagaaccucaagcgccacuccaucaucuccguccuccccuggaagcgcaucgucgccgucuccgccaagaagaagaacuccaagaagguccagcccaacuccuccuaccagaacaacaucacccaccucaacaacgagaaccucaagaagucccucuccugcgccaaccucuccaccuucgcccagcccccccccgcccagccccccgccccccccgccucccagcucuccggcucccagaccggcggcuccuccuccgucaagaaggccccccaccccgccgucaccuccgccggcacccccaagcgcgucaucguccaggccuccaccuccgagcuccuccgcugccucggcgaguuccucugccgccgcugcuaccgccucaagcaccucucccccaccgaccccguccucuggcuccgcuccgucgaccgcucccuccuccuccagggcuggcaggaccagggcuucaucacccccgccaacgucgucuuccucuacaugcucugccgcgacgucaucuccuccgaggucggcuccgaccacgagcuccaggccguccuccucaccugccucuaccucuccuacuccuacaugggcaacgagaucuccuacccccucaagcccuuccucgucgaguccugcaaggaggccuucugggaccgcugccucuccgucaucaaccucauguccuccaagaugcuccagaucaacgccgacccccacuacuucacccaggucuucuccgaccucaagaacgaguccggccaggaggacaagaagcgccuccuccucggccucgaccgcuga

SEQ ID NO: 41113 - RNA, 1104 nt, Artificial Sequence
  derived and/or modified sequence opt2 from CDK5R2__Homo_sapiens__NP_003927
augggcaccguccucucccucucccccgccuccuccgccaagggccgccgccccggcggccuccccgaggagaagaagaaggccccccccgccggcgacgaggcccucggcggcuacggcgccccccccgucggcaagggcggcaagggcgagucccgccucaagcgccccuccguccucaucuccgcccucaccuggaagcgccucgucgccgccuccgccaagaagaagaagggcuccaagaaggucacccccaagcccgccuccaccggccccgacccccucguccagcagcgcaaccgcgagaaccuccuccgcaagggccgcgacccccccgacggcggcggcaccgccaagccccucgccguccccguccccaccguccccgccgccgccgccaccugcgagccccccuccggcggcuccgccgccgcccagccccccggcuccggcggcggcaagcccccccccccccccccccccgccccccaggucgccccccccguccccggcggcuccccccgccgcgucaucguccaggccuccaccggcgagcuccuccgcugccucggcgacuucgucugccgccgcugcuaccgccucaaggagcucucccccggcgagcucgucggcugguuccgcggcgucgaccgcucccuccuccuccagggcuggcaggaccaggccuucaucacccccgccaaccucgucuucgucuaccuccucugccgcgagucccuccgcggcgacgagcucgccuccgccgccgagcuccaggccgccuuccucaccugccucuaccucgccuacuccuacaugggcaacgagaucuccuacccccucaagcccuuccucgucgagcccgacaaggagcgcuucuggcagcgcugccuccgccucauccagcgccucuccccccagaugcuccgccucaacgccgacccccacuucuucacccaggucuuccaggaccucaagaacgagggcgaggccgccgccuccggcggcggcccccccuccggcggcgcccccgccgccuccuccgccgcccgcgacuccugcgccgccggcaccaagcacuggaccaugaaccucgaccgcuga

SEQ ID NO: 41114 - RNA, 1761 nt, Artificial Sequence
  derived and/or modified sequence opt2 from CDK5RAP1__Homo_sapiens__NP_001265096
augcacccccuccagugcguccuccagguccagcgcucccucggcuggggcccccucgccuccgucuccuggcucucccuccgcaugugccgcgcccacuccucccucuccuccaccaugugccccucccccgagcgccaggaggacggcgcccgcaaggacuucuccucccgccucgccgccggccccaccuuccagcacuuccucaaguccgccuccgccccccaggagaagcucuccuccgaggucgaggaccccccccccuaccucaugauggacgagcuccucggccgccagcgcaaggucuaccucgagaccuacggcugccagaugaacgucaacgacaccgagaucgccugguccauccuccagaaguccggcuaccuccgcaccuccaaccuccaggaggccgacgucauccuccucgucaccugcuccauccgcgagaaggccgagcagaccaucuggaaccgccuccaccagcucaaggcccucaagacccgccgcccccgcucccgcgucccccuccgcaucggcauccucggcugcauggccgagcgccucaaggaggagauccucaaccgcgagaagauggucgacauccucgccggccccgacgccuaccgcgaccucccccgccuccucgccgucgccgaguccggccagcaggccgccaacguccuccucucccucgacgagaccuacgccgacgucaugcccguccagaccuccgccuccgccaccuccgccuucgucuccaucaugcgcggcugcgacaacaugugcuccuacugcaucguccccuucacccgcggccgcgagcgcucccgccccaucgccuccauccucgaggaggucaagaagcucuccgagcagggccucaaggaggucacccuccucggccagaacgucaacuccuuccgcgacaacuccgagguccaguucaacuccgccguccccaccaaccucucccgcggcuucaccaccaacuacaagaccaagcagggcggccuccgcuucgcccaccuccucgaccaggucucccgcgucgaccccgagaugcgcauccgcuucaccuccccccaccccaaggacuuccccgacgagguccuccagcucauccacgagcgcgacaacaucugcaagcagauccaccuccccgcccaguccggcuccucccgcguccucgaggccaugcgccgcggcuacucccgcgaggccuacgucgagcucguccaccacauccgcgaguccauccccggcgucucccucuccuccgacuucaucgccggcuucugcggcgagaccgaggaggaccacguccagaccgucucccuccuccgcgagguccaguacaacaugggcuuccucuucgccuacuccaugcgccagacccgcgccuaccaccgccucaaggacgacguccccgaggaggucaagcuccgccgccucgaggagcucaucaccaucuuccgcgaggaggccaccaaggccaaccagaccuccgucggcugcacccagcucguccucgucgagggccucuccaagcgcuccgccaccgaccucugcggccgcaacgacggcaaccucaaggucaucuuccccgacgccgagauggaggacgucaacaaccccggccuccgcguccgcgcccagcccggcgacuacguccucgucaagaucaccuccgccuccucccagacccuccgcggccacguccucugccgcaccacccuccgcgacuccuccgccuacugcuga

SEQ ID NO: 41115 - RNA, 5445 nt, Artificial Sequence
  derived and/or modified sequence opt2 from CDK5RAP2__Homo_sapiens__NP_001011649
augauggaccucguccucgaggaggacgucaccguccccggcacccucuccggcugcuccggccucguccccuccguccccgacgaccucgacggcaucaaccccaacgccggccucggcaacggccuccuccccaacgucuccgaggagaccgucucccccacccgcgcccgcaacaugaaggacuucgagaaccagaucaccgagcucaagaaggagaacuucaaccucaagcuccgcaucuacuuccucgaggagcgcaugcagcaggaguuccacggccccaccgagcacaucuacaagaccaacaucgagcucaaggucgaggucgagucccucaagcgcgagcuccaggagcgcgagcagcuccucaucaaggccuccaaggccgucgagucccucgccgaggccggcggcuccgagauccagcgcgucaaggaggacgcccgcaagaagguccagcaggucgaggaccuccucaccaagcgcauccuccuccucgagaaggacgucaccgccgcccaggccgagcucgagaaggccuucgccggcaccgagaccgagaaggcccuccgccuccgccucgaguccaagcucuccgagaugaagaagaugcacgagggcgaccucgccauggcccucguccucgacgagaaggaccgccucaucgaggagcucaagcucucccucaaguccaaggaggcccucauccagugccucaaggaggagaagucccagauggccugccccgacgagaacgucuccuccggcgagcuccgcggccucugcgccgccccccgcgaggagaaggagcgcgagaccgaggccgcccagauggagcaccagaaggagcgcaacuccuucgaggagcgcauccaggcccucgaggaggaccuccgcgagaaggagcgcgagaucgccaccgagaagaagaacucccucaagcgcgacaaggccauccagggccucaccauggcccucaaguccaaggagaagaaggucgaggagcucaacuccgagaucgagaagcucuccgccgccuucgccaaggcccgcgaggcccuccagaaggcccagacccaggaguuccagggcuccgaggacuacgagaccgcccucuccggcaaggaggcccucuccgccgcccuccgcucccagaaccucaccaaguccaccgagaaccaccgccuccgccgcuccaucaagaagaucacccaggagcucuccgaccuccagcaggagcgcgagcgccucgagaaggaccucgaggaggcccaccgcgagaaguccaagggcgacugcaccauccgcgaccuccgcaacgaggucgagaagcuccgcaacgaggucaacgagcgcgagaaggccauggagaaccgcuacaagucccuccucuccgaguccaacaagaagcuccacaaccaggagcaggucaucaagcaccucaccgaguccaccaaccagaaggacguccuccuccagaaguucaacgagaaggaccucgaggucauccagcagaacugcuaccucauggccgccgaggaccucgagcuccgcuccgagggccucaucaccgagaagugcuccucccagcagccccccggcuccaagaccaucuucuccaaggagaagaagcaguccuccgacuacgaggagcucauccagguccucaagaaggagcaggacaucuacacccaccucgucaagucccuccaggaguccgacuccaucaacaaccuccaggccgagcucaacaagaucuucgcccuccgcaagcagcucgagcaggacguccucuccuaccagaaccuccgcaagacccucgaggagcagaucuccgagauccgccgccgcgaggaggaguccuucucccucuacuccgaccagaccuccuaccucuccaucugccucgaggagaacaaccgcuuccaggucgagcacuucucccaggaggagcucaagaagaaggucuccgaccucauccagcucgucaaggagcucuacaccgacaaccagcaccucaagaagaccaucuucgaccucuccugcaugggcuuccagggcaacggcuuccccgaccgccucgccuccaccgagcagaccgagcuccucgccuccaaggaggacgaggacaccaucaagaucggcgaggacgacgagaucaacuuccucuccgaccagcaccuccagcaguccaacgagaucaugaaggaccucuccaagggcggcugcaagaacggcuaccuccgccacaccgaguccaagaucuccgacugcgacggcgcccacgcccccggcugccucgaggagggcgccuucaucaaccuccucgccccccucuucaacgagaaggccacccuccuccucgagucccgccccgaccuccucaaggucguccgcgagcuccuccucggccagcucuuccucaccgagcaggaggucuccggcgagcaccucgacggcaagaccgagaagacccccaagcagaagggcgagcucguccacuucguccagaccaacuccuucuccaagccccacgacgagcucaagcucuccugcgaggcccagcucgucaaggccggcgagguccccaaggucggccucaaggacgccuccguccagaccgucgccaccgagggcgaccuccuccgcuucaagcacgaggccacccgcgaggccugggaggagaagcccaucaacaccgcccucuccgccgagcaccgccccgagaaccuccacggcguccccggcuggcaggccgcccuccucucccuccccggcaucaccaaccgcgaggccaagaagucccgccuccccauccucaucaagcccucccgcucccucggcaacauguaccgccuccccgccacccaggaggucgucacccagcuccagucccagauccucgagcuccagggcgagcucaaggaguucaagaccugcaacaagcagcuccaccagaagcucauccucgccgaggccgucauggagggccgccccacccccgacaagacccuccucaacgcccagccccccgucggcgccgccuaccaggacucccccggcgagcagaagggcaucaagaccaccuccuccgucuggcgcgacaaggagauggacuccgaccagcagcgcuccuacgagaucgacuccgagaucugcccccccgacgaccucgccucccuccccuccugcaaggagaaccccgaggacguccucucccccaccuccgucgccaccuaccucuccuccaagucccagcccuccgccaaggucuccgucaugggcaccgaccaguccgaguccaucaacaccuccaacgagaccgaguaccucaagcagaagauccacgaccucgagaccgagcucgagggcuaccagaacuucaucuuccagcuccagaagcacucccagugcuccgaggccaucaucaccguccucugcggcaccgagggcgcccaggacggccucuccaagcccaagaacggcuccgacggcgaggagaugaccuucuccucccuccaccagguccgcuacgucaagcacgucaagauccucggcccccucgcccccgagaugaucgacucccgcguccucgagaaccucaagcagcagcucgaggagcaggaguacaagcuccagaaggagcagaaccucaacaugcagcucuucuccgagauccacaaccuccagaacaaguuccgcgaccucucccccccccgcuacgacucccucguccagucccaggcccgcgagcucucccuccagcgccagcagaucaaggacggccacggcaucugcgucaucucccgccagcacaugaacaccaugaucaaggccuucgaggagcuccuccaggccuccgacgucgacuacugcgucgccgagggcuuccaggagcagcucaaccagugcgccgagcuccucgagaagcucgagaagcucuuccucaacggcaaguccgucggcgucgagaugaacacccagaacgagcucauggagcgcaucgaggaggacaaccucaccuaccagcaccuccuccccgagucccccgagcccuccgccucccacgcccucuccgacuacgagaccuccgagaaguccuucuucucccgcgaccagaagcaggacaacgagaccgagaagaccuccgucauggucaacuccuucucccaggaccuccucauggagcacauccaggagauccgcacccuccgcaagcgccucgaggaguccaucaagaccaacgagaagcuccgcaagcagcucgagcgccagggcuccgaguucguccagggcuccaccuccaucuucgccuccggcuccgagcuccacuccucccucaccuccgagauccacuuccuccgcaagcagaaccaggcccucaacgccaugcucaucaagggcucccgcgacaagcagaaggagaacgacaagcuccgcgagucccucucccgcaagaccgucucccucgagcaccuccagcgcgaguacgccuccgucaaggaggagaacgagcgccuccagaaggagggcuccgagaaggagcgccacaaccagcagcucauccaggagguccgcugcuccggccaggagcucucccgcguccaggaggaggucaagcuccgccagcagcuccucucccagaacgacaagcuccuccagucccuccgcgucgagcucaaggccuacgagaagcucgacgaggagcaccgccgccuccgcgacggcgacaaguaccccauggaguccgacaacuccuucgaccucuucgacuccucccaggccgucacccccaaguccgucuccgagacccccccccucuccggcaacgacaccgacucccucuccugcgacuccggcuccuccgccaccuccacccccugcgucucccgccucgucaccggccaccaccucugggccuccaagaacggccgccacguccucggccucaucgaggacuacgaggcccuccucaagcagaucucccagggccagcgccuccucgccgagauggacauccagacccaggaggcccccuccuccaccucccaggagcucggcaccaagggcccccaccccgccccccucuccaaguucgucuccuccgucuccaccgccaagcucacccucgaggaggccuaccgccgccucaagcuccucuggcgcgucucccuccccgaggacggccagugcccccuccacugcgagcagaucggcgagaugaaggccgaggucaccaagcuccacaagaagcucuucgagcaggagaagaagcuccagaacaccaugaagcuccuccagcucuccaagcgccaggagaaggucaucuucgaccagcucgucgucacccacaagauccuccgcaaggcccgcggcaaccucgagcuccgccccggcggcgcccaccccggcaccugcucccccucccgccccggcuccuga

SEQ ID NO: 41116 - RNA, 1521 nt, Artificial Sequence
  derived and/or modified sequence opt2 from CDK5RAP3__Homo_sapiens__NP_788276
auggaggaccaccagcacguccccaucgacauccagaccuccaagcuccucgacuggcucgucgaccgccgccacugcucccucaaguggcagucccucguccucaccauccgcgagaagaucaacgccgccauccaggacaugcccgaguccgaggagaucgcccagcuccucuccggcuccuacauccacuacuuccacugccuccgcauccucgaccuccucaagggcaccgaggccuccaccaagaacaucuucggccgcuacuccucccagcgcaugaaggacuggcaggagaucaucgcccucuacgagaaggacaacaccuaccucgucgagcucuccucccuccucguccgcaacgucaacuacgagauccccucccucaagaagcagaucgccaagugccagcagcuccagcaggaguacucccgcaaggaggaggagugccaggccggcgccgccgagaugcgcgagcaguucuaccacuccugcaagcaguacggcaucaccggcgagaacguccgcggcgagcuccucgcccucgucaaggaccuccccucccagcucgccgagaucggcgccgccgcccagcagucccucggcgaggccaucgacgucuaccaggccuccgucggcuucgucugcgagucccccaccgagcagguccuccccaugcuccgcuucguccagaagcgcggcaacuccaccgucuacgaguggcgcaccggcaccgagcccuccgucgucgagcgcccccaccucgaggagcuccccgagcaggucgccgaggacgccaucgacuggggcgacuucggcgucgaggccgucuccgagggcaccgacuccggcaucuccgccgaggccgccggcaucgacuggggcaucuuccccgaguccgacuccaaggaccccggcggcgacggcaucgacuggggcgacgacgccgucgcccuccagaucaccguccucgaggccggcacccaggcccccgagggcgucgcccgcggccccgacgcccucacccuccucgaguacaccgagacccgcaaccaguuccucgacgagcucauggagcucgagaucuuccucgcccagcgcgccgucgagcucuccgaggaggccgacguccucuccgucucccaguuccagcucgcccccgccauccuccagggccagaccaaggagaagauggucaccauggucuccguccucgaggaccucaucggcaagcucaccucccuccagcuccagcaccucuucaugauccucgccuccccccgcuacgucgaccgcgucaccgaguuccuccagcagaagcucaagcagucccagcuccucgcccucaagaaggagcucaugguccagaagcagcaggaggcccucgaggagcaggccgcccucgagcccaagcucgaccuccuccucgagaagaccaaggagcuccagaagcucaucgaggccgacaucuccaagcgcuacuccggccgccccgucaaccucaugggcaccucccucuga

SEQ ID NO: 41117 - RNA, 981 nt, Artificial Sequence
  derived and/or modified sequence opt2 from CDK6__Homo_sapiens__XP_006715898
auggagaaggacggccucugccgcgccgaccagcaguacgagugcgucgccgagaucggcgagggcgccuacggcaaggucuucaaggcccgcgaccucaagaacggcggccgcuucgucgcccucaagcgcguccgcguccagaccggcgaggagggcaugccccucuccaccauccgcgaggucgccguccuccgccaccucgagaccuucgagcaccccaacgucguccgccucuucgacgucugcaccgucucccgcaccgaccgcgagaccaagcucacccucgucuucgagcacgucgaccaggaccucaccaccuaccucgacaagguccccgagcccggcguccccaccgagaccaucaaggacaugauguuccagcuccuccgcggccucgacuuccuccacucccaccgcgucguccaccgcgaccucaagccccagaacauccucgucaccuccuccggccagaucaagcucgccgacuucggccucgcccgcaucuacuccuuccagauggcccucaccuccgucgucgucacccucugguaccgcgcccccgagguccuccuccaguccuccuacgccacccccgucgaccucugguccgucggcugcaucuucgccgagauguuccgccgcaagccccucuuccgcggcuccuccgacgucgaccagcucggcaagauccucgacgucaucggccuccccggcgaggaggacuggccccgcgacgucgcccucccccgccaggccuuccacuccaaguccgcccagcccaucgagaaguucgucaccgacaucgacgagcucggcaaggaccuccuccucaagugccucaccuucaaccccgccaagcgcaucuccgccuacuccgcccucucccaccccuacuuccaggaccucgagcgcugcaaggagaaccucgacucccaccucccccccucccagaacaccuccgagcucaacaccgccuga

SEQ ID NO: 41118 - RNA, 1041 nt, Artificial Sequence
  derived and/or modified sequence opt2 from CDK7__Homo_sapiens__NP_001790
auggcccucgacgucaagucccgcgccaagcgcuacgagaagcucgacuuccucggcgagggccaguucgccaccgucuacaaggcccgcgacaagaacaccaaccagaucgucgccaucaagaagaucaagcucggccaccgcuccgaggccaaggacggcaucaaccgcaccgcccuccgcgagaucaagcuccuccaggagcucucccaccccaacaucaucggccuccucgacgccuucggccacaaguccaacaucucccucgucuucgacuucauggagaccgaccucgaggucaucaucaaggacaacucccucguccucacccccucccacaucaaggccuacaugcucaugacccuccagggccucgaguaccuccaccagcacuggauccuccaccgcgaccucaagcccaacaaccuccuccucgacgagaacggcguccucaagcucgccgacuucggccucgccaaguccuucggcucccccaaccgcgccuacacccaccaggucgucacccgcugguaccgcgcccccgagcuccucuucggcgcccgcauguacggcgucggcgucgacaugugggccgucggcugcauccucgccgagcuccuccuccgcguccccuuccuccccggcgacuccgaccucgaccagcucacccgcaucuucgagacccucggcacccccaccgaggagcaguggcccgacaugugcucccuccccgacuacgucaccuucaaguccuuccccggcaucccccuccaccacaucuucuccgccgccggcgacgaccuccucgaccucauccagggccucuuccucuucaaccccugcgcccgcaucaccgccacccaggcccucaagaugaaguacuucuccaaccgccccggccccacccccggcugccagcucccccgccccaacugccccgucgagacccucaaggagcaguccaaccccgcccucgccaucaagcgcaagcgcaccgaggcccucgagcagggcggccuccccaagaagcucaucuucuga

SEQ ID NO: 41119 - RNA, 1395 nt, Artificial Sequence
  derived and/or modified sequence opt2 from CDK8__Homo_sapiens__NP_001251
auggacuacgacuucaaggucaagcucuccuccgagcgcgagcgcgucgaggaccucuucgaguacgagggcugcaaggucggccgcggcaccuacggccacgucuacaaggccaagcgcaaggacggcaaggacgacaaggacuacgcccucaagcagaucgagggcaccggcaucuccauguccgccugccgcgagaucgcccuccuccgcgagcucaagcaccccaacgucaucucccuccagaaggucuuccucucccacgccgaccgcaaggucuggcuccucuucgacuacgccgagcacgaccucuggcacaucaucaaguuccaccgcgccuccaaggccaacaagaagcccguccagcucccccgcggcauggucaagucccuccucuaccagauccucgacggcauccacuaccuccacgccaacuggguccuccaccgcgaccucaagcccgccaacauccucgucaugggcgagggccccgagcgcggccgcgucaagaucgccgacaugggcuucgcccgccucuucaacuccccccucaagccccucgccgaccucgaccccgucgucgucaccuucugguaccgcgcccccgagcuccuccucggcgcccgccacuacaccaaggccaucgacaucugggccaucggcugcaucuucgccgagcuccucaccuccgagcccaucuuccacugccgccaggaggacaucaagaccuccaaccccuaccaccacgaccagcucgaccgcaucuucaacgucaugggcuuccccgccgacaaggacugggaggacaucaagaagaugcccgagcacuccacccucaugaaggacuuccgccgcaacaccuacaccaacugcucccucaucaaguacauggagaagcacaaggucaagcccgacuccaaggccuuccaccuccuccagaagcuccucaccauggaccccaucaagcgcaucaccuccgagcaggccaugcaggaccccuacuuccucgaggacccccuccccaccuccgacgucuucgccggcugccagauccccuaccccaagcgcgaguuccucaccgaggaggagcccgacgacaagggcgacaagaagaaccagcagcagcagcagggcaacaaccacaccaacggcaccggccaccccggcaaccaggacuccucccacacccagggccccccccucaagaagguccgcgucgucccccccaccaccaccuccggcggccucaucaugaccuccgacuaccagcgcuccaacccccacgccgccuaccccaaccccggccccuccaccucccagccccaguccuccaugggcuacuccgccaccucccagcagcccccccaguacucccaccagacccaccgcuacuga

SEQ ID NO: 41120 - RNA, 1119 nt, Artificial Sequence
  derived and/or modified sequence opt2 from CDK9__Homo_sapiens__NP_001252
auggccaagcaguacgacuccgucgagugccccuucugcgacgaggucuccaaguacgagaagcucgccaagaucggccagggcaccuucggcgaggucuucaaggcccgccaccgcaagaccggccagaaggucgcccucaagaagguccucauggagaacgagaaggagggcuuccccaucaccgcccuccgcgagaucaagauccuccagcuccucaagcacgagaacgucgucaaccucaucgagaucugccgcaccaaggccucccccuacaaccgcugcaagggcuccaucuaccucgucuucgacuucugcgagcacgaccucgccggccuccucuccaacguccucgucaaguucacccucuccgagaucaagcgcgucaugcagaugcuccucaacggccucuacuacauccaccgcaacaagauccuccaccgcgacaugaaggccgccaacguccucaucacccgcgacggcguccucaagcucgccgacuucggccucgcccgcgccuucucccucgccaagaacucccagcccaaccgcuacaccaaccgcgucgucacccucugguaccgcccccccgagcuccuccucggcgagcgcgacuacggcccccccaucgaccucuggggcgccggcugcaucauggccgagauguggacccgcucccccaucaugcagggcaacaccgagcagcaccagcucgcccucaucucccagcucugcggcuccaucacccccgaggucuggcccaacgucgacaacuacgagcucuacgagaagcucgagcucgucaagggccagaagcgcaaggucaaggaccgccucaaggccuacguccgcgaccccuacgcccucgaccucaucgacaagcuccucguccucgaccccgcccagcgcaucgacuccgacgacgcccucaaccacgacuucuucugguccgaccccaugcccuccgaccucaagggcaugcucuccacccaccucaccuccauguucgaguaccucgcccccccccgccgcaagggcucccagaucacccagcaguccaccaaccagucccgcaaccccgccaccaccaaccagaccgaguucgagcgcgucuucuga

SEQ ID NO: 41121 - RNA, 1740 nt, Artificial Sequence
  derived and/or modified sequence opt2 from CDKAL1__Homo_sapiens__NP_060244
augcccuccgccuccugcgacacccuccucgacgacaucgaggacaucgucucccaggaggacuccaagccccaggaccgccacuucguccgcaaggacgucguccccaagguccgccgccgcaacacccagaaguaccuccaggaggaggagaacuccccccccuccgacuccaccauccccggcauccagaagaucuggauccgcaccuggggcugcucccacaacaacuccgacggcgaguacauggccggccagcucgccgccuacggcuacaagaucaccgagaacgccuccgacgccgaccucuggcuccucaacuccugcaccgucaagaaccccgccgaggaccacuuccgcaacuccaucaagaaggcccaggaggagaacaagaagaucguccucgccggcugcgucccccaggcccagccccgccaggacuaccucaagggccucuccaucaucggcguccagcagaucgaccgcgucgucgaggucgucgaggagaccaucaagggccacuccguccgccuccucggccagaagaaggacaacggccgccgccucggcggcgcccgccucgaccuccccaagauccgcaagaacccccucaucgagaucaucuccaucaacaccggcugccucaacgccugcaccuacugcaagaccaagcacgcccgcggcaaccucgccuccuaccccaucgacgagcucgucgaccgcgccaagcaguccuuccaggagggcgucugcgagaucuggcucaccuccgaggacaccggcgccuacggccgcgacaucggcaccaaccuccccacccuccucuggaagcucgucgaggucauccccgagggcgccaugcuccgccucggcaugaccaacccccccuacauccucgagcaccucgaggagauggccaagauccucaaccacccccgcgucuacgccuuccuccacauccccguccaguccgccuccgacuccguccucauggagaugaagcgcgaguacugcgucgccgacuucaagcgcgucgucgacuuccucaaggagaagguccccggcaucaccaucgccaccgacaucaucugcggcuuccccggcgagaccgaccaggacuuccaggagaccgucaagcucgucgaggaguacaaguuccccucccucuucaucaaccaguucuacccccgccccggcacccccgccgccaagauggagcagguccccgcccaggucaagaagcagcgcaccaaggaccucucccgcgucuuccacuccuacucccccuacgaccacaagaucggcgagcgccagcagguccucgucaccgaggaguccuucgacuccaaguucuacgucgcccacaaccaguucuacgagcagguccucguccccaagaaccccgccuucaugggcaagauggucgaggucgacaucuacgaguccggcaagcacuucaugaagggccagcccgucuccgacgccaaggucuacacccccuccaucuccaagccccucgccaagggcgaggucuccggccucaccaaggacuuccgcaacggccucggcaaccagcucuccuccggcucccacaccuccgccgccucccagugcgacuccgccuccucccgcaugguccuccccaugccccgccuccaccaggacugcgcccuccgcauguccgucggccucgcccuccucggccuccucuucgccuucuucgucaaggucuacaacuga

SEQ ID NO: 41122 - RNA, 1077 nt, Artificial Sequence
  derived and/or modified sequence opt2 from CDKL1__Homo_sapiens__NP_004187
augauggagaaguacgagaagaucggcaagaucggcgagggcuccuacggcgucgucuucaagugccgcaaccgcgacaccggccagaucgucgccaucaagaaguuccucgaguccgaggacgaccccgucaucaagaagaucgcccuccgcgagauccgcaugcucaagcagcucaagcaccccaaccucgucaaccuccucgaggucuuccgccgcaagcgccgccuccaccucgucuucgaguacugcgaccacaccguccuccacgagcucgaccgcuaccagcgcggcguccccgagcaccucgucaaguccaucaccuggcagacccuccaggccgucaacuucugccacaagcacaacugcauccaccgcgacgucaagcccgagaacauccucaucaccaagcacuccgucaucaagcucugcgacuucggcuucgcccgccuccucaccggccccuccgacuacuacaccgacuacgucgccacccgcugguaccgcucccccgagcuccucgucggcgacacccaguacggcccccccgucgacgucugggccaucggcugcgucuucgccgagcuccucuccggcgucccccucuggcccggcaaguccgacgucgaccagcucuaccucauccgcaagacccucggcgaccucaucccccgccaccagcaggucuucuccaccaaccaguacuucuccggcgucaagauccccgaccccgaggacauggagccccucgagcucaaguuccccaacaucuccuaccccgcccucggccuccucaagggcugccuccacauggaccccacccagcgccucaccugcgagcagcuccuccaccaccccuacuucgagaacauccgcgagaucgaggaccucgccaaggagcacaacaagcccacccgcaagacccuccgcaagucccgcaagcaccacugcuucaccgagaccuccaagcuccaguaccucccccagcucaccggcuccuccauccuccccgcccucgacaacaagaaguacuacugcgacaccaagaagcucaacuaccgcuuccccaacaucuga

SEQ ID NO: 41123 - RNA, 1482 nt, Artificial Sequence
  derived and/or modified sequence opt2 from CDKL2__Homo_sapiens__NP_003939
auggagaaguacgagaaccucggccucgucggcgagggcuccuacggcauggucaugaagugccgcaacaaggacaccggccgcaucgucgccaucaagaaguuccucgaguccgacgacgacaagauggucaagaagaucgccaugcgcgagaucaagcuccucaagcagcuccgccacgagaaccucgucaaccuccucgaggucugcaagaagaagaagcgcugguaccucgucuucgaguucgucgaccacaccauccucgacgaccucgagcucuuccccaacggccucgacuaccaggucguccagaaguaccucuuccagaucaucaacggcaucggcuucugccacucccacaacaucauccaccgcgacaucaagcccgagaacauccucgucucccaguccggcgucgucaagcucugcgacuucggcuucgcccgcacccucgccgcccccggcgaggucuacaccgacuacgucgccacccgcugguaccgcgcccccgagcuccucgucggcgacgucaaguacggcaaggccgucgacgucugggccaucggcugccucgucaccgagauguucaugggcgagccccucuuccccggcgacuccgacaucgaccagcucuaccacaucaugaugugccucggcaaccucaucccccgccaccaggagcucuucaacaagaaccccgucuucgccggcguccgccuccccgagaucaaggagcgcgagccccucgagcgccgcuaccccaagcucuccgaggucgucaucgaccucgccaagaagugccuccacaucgaccccgacaagcgccccuucugcgccgagcuccuccaccacgacuucuuccagauggacggcuucgccgagcgcuucucccaggagcuccagcucaagguccagaaggacgcccgcaacgucucccucuccaagaagucccagaaccgcaagaaggagaaggagaaggacgacucccucgucgaggagcgcaagacccucgucguccaggacaccaacgccgaccccaagaucaaggacuacaagcucuucaagaucaagggcuccaagaucgacggcgagaaggccgagaagggcaaccgcgccuccaacgccuccugccuccacgacucccgcaccucccacaacaagaucguccccuccaccucccucaaggacugcuccaacgucuccgucgaccacacccgcaaccccuccgucgccauccccccccucacccacaaccucuccgccgucgcccccuccaucaacuccggcaugggcaccgagaccauccccauccagggcuaccgcgucgacgagaagaccaagaagugcuccauccccuucgucaagcccaaccgccacucccccuccggcaucuacaacaucaacgucaccacccucgucuccggccccccccucuccgacgacuccggcgccgaccucccccagauggagcaccagcacuga

SEQ ID NO: 41124 - RNA, 1779 nt, Artificial Sequence
  derived and/or modified sequence opt2 from CDKL3__Homo_sapiens__NP_001107047
auggagauguacgagacccucggcaaggucggcgagggcuccuacggcaccgucaugaagugcaagcacaagaacaccggccagaucgucgccaucaagaucuucuacgagcgccccgagcaguccgucaacaagaucgccaugcgcgagaucaaguuccucaagcaguuccaccacgagaaccucgucaaccucaucgaggucuuccgccagaagaagaagauccaccucgucuucgaguucaucgaccacaccguccucgacgagcuccagcacuacugccacggccucgaguccaagcgccuccgcaaguaccucuuccagauccuccgcgccaucgacuaccuccacuccaacaacaucauccaccgcgacaucaagcccgagaacauccucgucucccaguccggcaucaccaagcucugcgacuucggcuucgcccgcacccucgccgcccccggcgacaucuacaccgacuacgucgccacccgcugguaccgcgcccccgagcucguccucaaggacaccuccuacggcaagcccgucgacaucugggcccucggcugcaugaucaucgagauggccaccggcaaccccuaccuccccuccuccuccgaccucgaccuccuccacaagaucguccucaaggucggcaaccucuccccccaccuccagaacaucuucuccaagucccccaucuucgccggcgucguccucccccagguccagcaccccaagaacgcccgcaagaaguaccccaagcucaacggccuccucgccgacaucguccacgccugccuccagaucgaccccgccgaccgcaucuccuccuccgaccuccuccaccacgaguacuucacccgcgacggcuucaucgagaaguucaugcccgagcucaaggccaagcuccuccaggaggccaaggucaacucccucaucaagcccaaggaguccuccaaggagaacgagcuccgcaaggacgagcgcaagaccgucuacaccaacacccuccucuccuccuccguccucggcaaggagaucgagaaggagaagaagcccaaggagaucaagguccgcgucaucaaggucaagggcggccgcggcgacaucuccgagcccaagaagaaggaguacgagggcggccucggccagcaggacgccaacgagaacguccaccccaugucccccgacaccaagcucgucaccaucgagccccccaaccccaucaaccccuccaccaacugcaacggccucaaggagaacccccacugcggcggcuccgucaccaugccccccaucaaccucaccaacuccaaccucauggccgccaaccucuccuccaaccucuuccaccccuccguccgccucaccgagcgcgccaagaagcgccgcaccuccucccaguccaucggccaggucaugcccaacucccgccaggaggaccccggccccauccagucccagauggagaagggcaucuucaacgagcgcaccggccacuccgaccagauggccaacgagaacaagcgcaagcucaacuucucccgcuccgaccgcaaggaguuccacuuccccgagcuccccgucaccauccaguccaaggacaccaagggcauggaggucaagcagaucaagaugcucaagcgcgaguccaagaagaccgaguccuccaagauccccacccuccucaacgucgaccagaaccaggagaagcaggagggcggcgacggccacugcgagggcaagaaccucaagcgcaaccgcuucuucuucugguga

SEQ ID NO: 41125 - RNA, 948 nt, Artificial Sequence
  derived and/or modified sequence opt2 from CDKL4__Homo_sapiens__NP_001009565
auggagaaguacgagaagcucgccaagaccggcgagggcuccuacggcgucgucuucaagugccgcaacaagaccuccggccaggucgucgccgucaagaaguucgucgaguccgaggacgaccccgucgucaagaagaucgcccuccgcgagauccgcaugcucaagcagcucaagcaccccaaccucgucaaccucaucgaggucuuccgccgcaagcgcaagaugcaccucgucuucgaguacugcgaccacacccuccucaacgagcucgagcgcaaccccaacggcgucgccgacggcgucaucaaguccguccucuggcagacccuccaggcccucaacuucugccacauccacaacugcauccaccgcgacaucaagcccgagaacauccucaucaccaagcagggcaucaucaagaucugcgacuucggcuucgcccagauccucauccccggcgacgccuacaccgacuacgucgccacccgcugguaccgcgcccccgagcuccucgucggcgacacccaguacggcuccuccgucgacaucugggccaucggcugcgucuucgccgagcuccucaccggccagccccucuggcccggcaaguccgacgucgaccagcucuaccucaucauccgcacccucggcaagcucaucccccgccaccaguccaucuucaaguccaacggcuucuuccacggcaucuccauccccgagcccgaggacauggagacccucgaggagaaguucuccgacguccaccccgucgcccucaacuucaugaagggcugccucaagaugaaccccgacgaccgccucaccugcucccagcuccucgaguccuccuacuucgacuccuuccaggaggcccagaucaagcgcaaggcccgcaacgagggccgcaaccgccgccgccagcagguccucccccucaaguccuga

SEQ ID NO: 41126 - RNA, 3093 nt, Artificial Sequence
  derived and/or modified sequence opt2 from CDKL5__Homo_sapiens__NP_001032420
augaagauccccaacaucggcaacgucaugaacaaguucgagauccucggcgucgucggcgagggcgccuacggcgucguccucaagugccgccacaaggagacccacgagaucgucgccaucaagaaguucaaggacuccgaggagaacgaggaggucaaggagaccacccuccgcgagcucaagaugcuccgcacccucaagcaggagaacaucgucgagcucaaggaggccuuccgccgccgcggcaagcucuaccucgucuucgaguacgucgagaagaacaugcucgagcuccucgaggagaugcccaacggcgucccccccgagaaggucaaguccuacaucuaccagcucaucaaggccauccacuggugccacaagaacgacaucguccaccgcgacaucaagcccgagaaccuccucaucucccacaacgacguccucaagcucugcgacuucggcuucgcccgcaaccucuccgagggcaacaacgccaacuacaccgaguacgucgccacccgcugguaccgcucccccgagcuccuccucggcgcccccuacggcaaguccgucgacaugugguccgucggcugcauccucggcgagcucuccgacggccagccccucuuccccggcgaguccgagaucgaccagcucuucaccauccagaagguccucggcccccuccccuccgagcagaugaagcucuucuacuccaacccccgcuuccacggccuccgcuuccccgccgucaaccacccccagucccucgagcgccgcuaccucggcauccucaacuccguccuccucgaccucaugaagaaccuccucaagcucgaccccgccgaccgcuaccucaccgagcagugccucaaccaccccaccuuccagacccagcgccuccucgaccgcucccccucccgcuccgccaagcgcaagcccuaccacgucgaguccuccacccucuccaaccgcaaccaggccggcaaguccaccgcccuccagucccaccaccgcuccaacuccaaggacauccagaaccucuccgucggccucccccgcgccgacgagggccuccccgccaacgaguccuuccucaacggcaaccucgccggcgccucccucuccccccuccacaccaagaccuaccaggccuccucccagcccggcuccaccuccaaggaccucaccaacaacaacaucccccaccuccucucccccaaggaggccaaguccaagaccgaguucgacuucaacaucgaccccaagcccuccgagggccccggcaccaaguaccucaaguccaacucccgcucccagcagaaccgccacuccuucauggaguccucccaguccaaggccggcacccuccagcccaacgagaagcagucccgccacuccuacaucgacaccaucccccaguccucccgcucccccuccuaccgcaccaaggccaagucccacggcgcccucuccgacuccaaguccgucuccaaccucuccgaggcccgcgcccagaucgccgagcccuccaccucccgcuacuuccccuccuccugccucgaccucaacucccccaccucccccacccccacccgccacuccgacacccgcacccuccucucccccuccggccgcaacaaccgcaacgagggcacccucgacucccgccgcaccaccacccgccacuccaagaccauggaggagcucaagcuccccgagcacauggacuccucccacucccacucccucuccgccccccacgaguccuucuccuacggccucggcuacaccucccccuucuccucccagcagcgcccccaccgccacuccauguacgucacccgcgacaagguccgcgccaagggccucgacggcucccucuccaucggccagggcauggccgcccgcgccaacucccuccagcuccucuccccccagcccggcgagcagcucccccccgagaugaccgucgcccgcuccuccgucaaggagaccucccgcgagggcaccuccuccuuccacacccgccagaaguccgagggcggcgucuaccacgacccccacuccgacgacggcaccgcccccaaggagaaccgccaccucuacaacgaccccgucccccgccgcgucggcuccuucuaccgcguccccuccccccgccccgacaacuccuuccacgagaacaacgucuccacccgcgucuccucccuccccuccgaguccuccuccggcaccaaccacuccaagcgccagcccgccuucgaccccuggaagucccccgagaacaucucccacuccgagcagcucaaggagaaggagaagcagggcuucuuccgcuccaugaagaagaagaagaagaagucccagaccguccccaacuccgacucccccgaccuccucacccuccagaaguccauccacuccgccuccacccccuccucccgccccaaggaguggcgccccgagaagaucuccgaccuccagacccagucccagccccucaagucccuccgcaagcuccuccaccucuccuccgccuccaaccaccccgccuccuccgacccccgcuuccagccccucaccgcccagcagaccaagaacuccuucuccgagauccgcauccacccccucucccaggccuccggcggcuccuccaacauccgccaggagcccgcccccaagggccgccccgcccuccagcuccccgacggcggcugcgacggccgccgccagcgccaccacuccggcccccaggaccgccgcuucaugcuccgcaccaccgagcagcagggcgaguacuucugcugcggcgaccccaagaagccccacacccccugcguccccaaccgcgcccuccaccgccccaucuccucccccgcccccuaccccguccuccagguccgcggcaccuccaugugccccacccuccagguccgcggcaccgacgccuucuccugccccacccagcaguccggcuucuccuucuucguccgccacgucaugcgcgaggcccucauccaccgcgcccaggucaaccaggccgcccuccucaccuaccacgagaacgccgcccucaccggcaaguga

SEQ ID NO: 41127 - RNA, 495 nt, Artificial Sequence
  derived and/or modified sequence opt2 from CDKN1A__Homo_sapiens__NP_000380
auguccgagcccgccggcgacguccgccagaaccccugcggcuccaaggccugccgccgccucuucggccccgucgacuccgagcagcucucccgcgacugcgacgcccucauggccggcugcauccaggaggcccgcgagcgcuggaacuucgacuucgucaccgagaccccccucgagggcgacuucgccugggagcgcguccgcggccucggccuccccaagcucuaccuccccaccggcccccgccgcggccgcgacgagcucggcggcggccgccgccccggcaccucccccgcccuccuccagggcaccgccgaggaggaccacgucgaccucucccucuccugcacccucgucccccgcuccggcgagcaggccgagggcucccccggcggccccggcgacucccagggccgcaagcgccgccagaccuccaugaccgacuucuaccacuccaagcgccgccucaucuucuccaagcgcaagcccuga

SEQ ID NO: 41128 - RNA, 597 nt, Artificial Sequence
  derived and/or modified sequence opt2 from CDKN1B__Homo_sapiens__NP_004055
auguccaacguccgcgucuccaacggcucccccucccucgagcgcauggacgcccgccaggccgagcaccccaagcccuccgccugccgcaaccucuucggccccgucgaccacgaggagcucacccgcgaccucgagaagcacugccgcgacauggaggaggccucccagcgcaaguggaacuucgacuuccagaaccacaagccccucgagggcaaguacgaguggcaggaggucgagaagggcucccuccccgaguucuacuaccgccccccccgcccccccaagggcgccugcaagguccccgcccaggagucccaggacgucuccggcucccgccccgccgccccccucaucggcgcccccgccaacuccgaggacacccaccucgucgaccccaagaccgaccccuccgacucccagaccggccucgccgagcagugcgccggcauccgcaagcgccccgccaccgacgacuccuccacccagaacaagcgcgccaaccgcaccgaggagaacgucuccgacggcucccccaacgccggcuccgucgagcagacccccaagaagcccggccuccgccgccgccagaccuga

SEQ ID NO: 41129 - RNA, 951 nt, Artificial Sequence
  derived and/or modified sequence opt2 from CDKN1C__Homo_sapiens__NP_000067
auguccgacgccucccuccgcuccaccuccaccauggagcgccucgucgcccgcggcaccuuccccguccucguccgcaccuccgccugccgcucccucuucggccccgucgaccacgaggagcucucccgcgagcuccaggcccgccucgccgagcucaacgccgaggaccagaaccgcugggacuacgacuuccagcaggacaugccccuccgcggccccggccgccuccaguggaccgaggucgacuccgacuccguccccgccuucuaccgcgagaccguccaggucggccgcugccgccuccuccucgccccccgccccgucgccgucgccgucgccgucucccccccccucgagcccgccgccgagucccucgacggccucgaggaggcccccgagcagcuccccuccguccccguccccgcccccgccuccacccccccccccguccccguccucgcccccgcccccgcccccgcccccgcccccgucgccgcccccgucgccgcccccgucgccgucgccguccucgcccccgcccccgcccccgcccccgcccccgcccccgcccccgcccccgucgccgcccccgcccccgcccccgcccccgcccccgcccccgcccccgcccccgcccccgcccccgacgccgccccccaggaguccgccgagcagggcgccaaccagggccagcgcggccaggagccccucgccgaccagcuccacuccggcaucuccggccgccccgccgccggcaccgccgccgccuccgccaacggcgccgccaucaagaagcucuccggcccccucaucuccgacuucuucgccaagcgcaagcgcuccgcccccgagaaguccuccggcgacguccccgcccccugccccucccccuccgccgcccccggcgucggcuccgucgagcagaccccccgcaagcgccuccgcuga

SEQ ID NO: 41130 - RNA, 471 nt, Artificial Sequence
  derived and/or modified sequence opt2 from CDKN2A__Homo_sapiens__NP_000068
auggagcccgccgccggcuccuccauggagcccuccgccgacuggcucgccaccgccgccgcccgcggccgcgucgaggagguccgcgcccuccucgaggccggcgcccuccccaacgcccccaacuccuacggccgccgccccauccaggucaugaugaugggcuccgcccgcgucgccgagcuccuccuccuccacggcgccgagcccaacugcgccgaccccgccacccucacccgccccguccacgacgccgcccgcgagggcuuccucgacacccucgucguccuccaccgcgccggcgcccgccucgacguccgcgacgccuggggccgccuccccgucgaccucgccgaggagcucggccaccgcgacgucgcccgcuaccuccgcgccgccgccggcggcacccgcggcuccaaccacgcccgcaucgacgccgccgagggccccuccgacauccccgacuga

SEQ ID NO: 41131 - RNA, 1743 nt, Artificial Sequence
  derived and/or modified sequence opt2 from CDKN2AIP__Homo_sapiens__NP_060102
auggcccaggaggucuccgaguaccucucccagaacccccgcgucgccgccugggucgaggcccuccgcugcgacggcgagaccgacaagcacuggcgccaccgccgcgacuuccuccuccgcaacgccggcgaccucgcccccgccggcggcgccgccuccgccuccaccgacgaggccgccgacgccgaguccggcacccgcaaccgccagcuccagcagcucaucuccuucuccauggccugggccaaccacgucuuccucggcugccgcuacccccagaaggucauggacaagauccucuccauggccgagggcaucaaggucaccgacgcccccaccuacaccacccgcgacgagcucgucgccaaggucaagaagcgcggcaucuccuccuccaacgagggcgucgaggagcccuccaagaagcgcgucaucgagggcaagaacuccuccgccgucgagcaggaccacgccaagaccuccgccaagaccgagcgcgccuccgcccagcaggagaacuccuccaccugcaucggcuccgccaucaaguccgaguccggcaacuccgcccgcuccuccggcaucuccucccagaacuccuccaccuccgacggcgaccgcuccgucuccucccaguccuccuccuccgucuccucccaggucaccaccgccggcuccggcaaggccuccgaggccgaggcccccgacaagcacggcuccgccuccuucgucucccuccucaaguccuccgucaacucccacaugacccaguccaccgacucccgccagcaguccggcucccccaagaaguccgcccucgagggcuccuccgccuccgccucccaguccuccuccgagaucgaggucccccuccucggcuccuccggcuccuccgaggucgagcucccccuccucuccuccaagcccuccuccgagaccgccuccuccggccucaccuccaagaccuccuccgaggccuccgucuccuccuccgucgccaagaacuccuccuccuccggcaccucccuccucacccccaaguccuccuccuccaccaacaccucccuccucaccuccaaguccaccucccaggucgccgccucccuccucgccuccaaguccuccucccagaccuccggcucccucgucuccaaguccaccucccucgccuccgucucccagcucgccuccaaguccuccucccagaccuccaccucccagcuccccuccaaguccaccucccaguccuccgaguccuccgucaaguucuccugcaagcucaccaacgaggacgucaagcagaagcagcccuucuucaaccgccucuacaagaccgucgccuggaagcucgucgccgucggcggcuucucccccaacgucaaccacggcgagcuccucaacgccgccaucgaggcccucaaggccacccucgacgucuucuucgucccccucaaggagcucgccgaccucccccagaacaaguccucccaggaguccaucgucugcgagcuccgcugcaaguccgucuaccucggcaccggcugcggcaaguccaaggagaacgccaaggccgucgccucccgcgaggcccucaagcucuuccucaagaagaaggucgucgucaagaucugcaagcgcaaguaccgcggcuccgagaucgaggaccucguccuccucgacgaggagucccgccccgucaaccucccccccgcccucaagcacccccaggagcuccucuga

SEQ ID NO: 41132 - RNA, 417 nt, Artificial Sequence
  derived and/or modified sequence opt2 from CDKN2B__Homo_sapiens__NP_004927
augcgcgaggagaacaagggcaugcccuccggcggcggcuccgacgagggccucgccuccgccgccgcccgcggccucgucgagaagguccgccagcuccucgaggccggcgccgaccccaacggcgucaaccgcuucggccgccgcgccauccaggucaugaugaugggcuccgcccgcgucgccgagcuccuccuccuccacggcgccgagcccaacugcgccgaccccgccacccucacccgccccguccacgacgccgcccgcgagggcuuccucgacacccucgucguccuccaccgcgccggcgcccgccucgacguccgcgacgccuggggccgccuccccgucgaccucgccgaggagcgcggccaccgcgacgucgccggcuaccuccgcaccgccaccggcgacuga

SEQ ID NO: 41133 - RNA, 507 nt, Artificial Sequence
  derived and/or modified sequence opt2 from CDKN2C__Homo_sapiens__NP_001253
auggccgagcccuggggcaacgagcucgccuccgccgccgcccgcggcgaccucgagcagcucaccucccuccuccagaacaacgucaacgucaacgcccagaacggcuucggccgcaccgcccuccaggucaugaagcucggcaaccccgagaucgcccgccgccuccuccuccgcggcgccaaccccgaccucaaggaccgcaccggcuucgccgucauccacgacgccgcccgcgccggcuuccucgacacccuccagacccuccucgaguuccaggccgacgucaacaucgaggacaacgagggcaaccucccccuccaccucgccgccaaggagggccaccuccgcgucgucgaguuccucgucaagcacaccgccuccaacgucggccaccgcaaccacaagggcgacaccgccugcgaccucgcccgccucuacggccgcaacgaggucgucucccucaugcaggccaacggcgccggcggcgccaccaaccuccaguga

SEQ ID NO: 41134 - RNA, 501 nt, Artificial Sequence
  derived and/or modified sequence opt2 from CDKN2D__Homo_sapiens__NP_001791
augcuccucgaggagguccgcgccggcgaccgccucuccggcgccgccgcccgcggcgacguccaggagguccgccgccuccuccaccgcgagcucguccaccccgacgcccucaaccgcuucggcaagaccgcccuccaggucaugauguucggcuccaccgccaucgcccucgagcuccucaagcagggcgccucccccaacguccaggacaccuccggcaccucccccguccacgacgccgcccgcaccggcuuccucgacacccucaagguccucgucgagcacggcgccgacgucaacguccccgacggcaccggcgcccuccccauccaccucgccguccaggagggccacaccgccgucgucuccuuccucgccgccgaguccgaccuccaccgccgcgacgcccgcggccucaccccccucgagcucgcccuccagcgcggcgcccaggaccucgucgacauccuccagggccacauggucgccccccucuga

SEQ ID NO: 41135 - RNA, 519 nt, Artificial Sequence
  derived and/or modified sequence opt2 from CDKN3__Homo_sapiens__NP_001124323
augaagccccccuccuccauccagaccuccugcaaguucaaggacguccgccgcaacguccagaaggacaccgaggagcucaaguccugcggcauccaggacaucuucgucuucugcacccgcggcgagcucuccaaguaccgcguccccaaccuccucgaccucuaccagcagugcggcaucaucacccaccaccaccccaucgccgacggcggcacccccgacaucgccuccugcugcgagaucauggaggagcucaccaccugccucaagaacuaccgcaagacccucauccacugcuacggcggccucggccgcuccugccucgucgccgccugccuccuccucuaccucuccgacaccaucucccccgagcaggccaucgacucccuccgcgaccuccgcggcuccggcgccauccagaccaucaagcaguacaacuaccuccacgaguuccgcgacaagcucgccgcccaccucuccucccgcgacucccagucccgcuccgucucccgcuga

SEQ ID NO: 41136 - RNA, 564 nt, Artificial Sequence
  derived and/or modified sequence opt2 from CDNF__Homo_sapiens__NP_001025125
auguggugcgccucccccgucgccgucgucgccuucugcgccggccuccucgucucccaccccguccucacccagggccaggaggccggcggccgccccggcgccgacugcgaggucugcaaggaguuccucaaccgcuucuacaagucccucaucgaccgcggcgucaacuucucccucgacaccaucgagaaggagcucaucuccuucugccucgacaccaagggcaaggagaaccgccucugcuacuaccucggcgccaccaaggacgccgccaccaagauccucuccgaggucacccgccccauguccguccacaugcccgccaugaagaucugcgagaagcucaagaagcucgacucccagaucugcgagcucaaguacgagaagacccucgaccucgccuccgucgaccuccgcaagaugcgcgucgccgagcucaagcagauccuccacuccuggggcgaggagugccgcgccugcgccgagaagaccgacuacgucaaccucauccaggagcucgcccccaaguacgccgccacccaccccaagaccgagcucuga

SEQ ID NO: 41137 - RNA, 603 nt, Artificial Sequence
  derived and/or modified sequence opt2 from CDO1__Homo_sapiens__NP_001792
auggagcagaccgagguccucaagccccgcacccucgccgaccucauccgcauccuccaccagcucuucgccggcgacgaggucaacgucgaggagguccaggccaucauggaggccuacgaguccgaccccaccgagugggccauguacgccaaguucgaccaguaccgcuacacccgcaaccucgucgaccagggcaacggcaaguucaaccucaugauccucugcuggggcgagggccacggcuccuccauccacgaccacaccaacucccacugcuuccucaagaugcuccagggcaaccucaaggagacccucuucgccuggcccgacaagaaguccaacgagauggucaagaaguccgagcgcguccuccgcgagaaccagugcgccuacaucaacgacuccaucggccuccaccgcgucgagaacaucucccacaccgagcccgccgucucccuccaccucuacuccccccccuucgacaccugccacgccuucgaccagcgcaccggccacaagaacaaggucaccaugaccuuccacuccaaguucggcauccgcacccccaacgccaccuccggcucccucgagaacaacuga

SEQ ID NO: 41138 - RNA, 3864 nt, Artificial Sequence
  derived and/or modified sequence opt2 from CDON__Homo_sapiens__XP_011541167
augcaccccgaccucggcccccucugcacccuccucuacgucacccucaccauccucugcuccuccgucuccuccgaccucgcccccuacuucaccuccgagccccucuccgccguccagaagcucggcggccccgucguccuccacugcuccgcccagcccgucaccacccgcaucuccuggcuccacaacggcaagacccucgacggcaaccucgagcacgucaagauccaccagggcacccucaccauccucucccucaacuccucccuccucggcuacuaccagugccucgccaacaacuccaucggcgccaucgucuccggccccgccaccgucuccgucgccguccucggcgacuucggcuccuccaccaagcacgucaucaccgccgaggagaaguccgccggcuucaucggcugccgcguccccgaguccaaccccaaggccgagguccgcuacaagauccgcggcaaguggcucgagcacuccaccgagaacuaccucauccuccccuccggcaaccuccagauccucaacgucucccucgaggacaagggcuccuacaagugcgccgccuacaaccccgucacccaccagcucaaggucgagcccaucggccgcaagcuccucgucucccgccccuccuccgacgacguccacauccuccaccccacccacucccaggcccucgccguccucucccgcucccccgucacccucgagugcgucgucuccggcguccccgccccccaggucuacuggcucaaggacggccaggacaucgcccccggcuccaacuggcgccgccucuacucccaccucgccaccgacuccgucgaccccgccgacuccggcaacuacuccugcauggccggcaacaaguccggcgacgucaaguacgucaccuacauggucaacguccucgagcacgccuccaucuccaagggccuccaggaccagaucgucucccucggcgccaccguccacuucaccugcgacguccacggcaaccccgcccccaacugcaccugguuccacaacgcccagcccauccaccccuccgcccgccaccucaccgccggcaacggccucaagaucuccggcgucaccgucgaggacgucggcauguaccagugcgucgccgacaacggcaucggcuucaugcacuccaccggccgccucgagaucgagaacgacggcggcuucaagcccgucaucaucaccgcccccgucuccgccaaggucgccgacggcgacuucgucacccucuccugcaacgccuccggccuccccguccccgucauccgcugguacgacucccacggccucaucaccucccaccccucccagguccuccgcuccaagucccgcaagucccagcucucccgccccgagggccucaaccucgagcccgucuacuucguccucucccaggccggcgccuccucccuccacauccaggccgucacccaggagcacgccggcaaguacaucugcgaggccgccaacgagcacggcaccacccaggccgaggccucccucauggucguccccuucgagaccaacaccaaggccgagaccgucacccuccccgacgccgcccagaacgacgaccgcuccaagcgcgacggcuccgagaccggccuccucuccuccuuccccgucaagguccaccccuccgccgucgaguccgcccccgagaagaacgccuccggcaucuccguccccgacgcccccaucauccucucccccccccagacccacacccccgacaccuacaaccucgucuggcgcgccggcaaggacggcggccuccccaucaacgccuacuucgucaaguaccgcaagcucgacgacggcgucggcaugcucggcuccuggcacaccguccgcguccccggcuccgagaacgagcuccaccucgccgagcucgagcccuccucccucuacgagguccucauggucgcccgcuccgccgccggcgagggccagcccgccaugcucaccuuccgcaccuccaaggagaagaccgccuccuccaagaacacccaggccuccuccccccccgucggcauccccaaguaccccgucgucuccgaggccgccaacaacaacuucggcgucguccucaccgacuccucccgccacuccggcguccccgaggcccccgaccgccccaccaucuccaccgccuccgagaccuccgucuacgucaccuggaucccccgcgccaacggcggcucccccaucaccgccuucaaggucgaguacaagcgcaugcgcaccuccaacuggcucgucgccgccgaggacaucccccccuccaagcucuccgucgagguccgcucccucgagcccggcuccaccuacaaguuccgcgucaucgccaucaaccacuacggcgaguccuuccgcuccuccgccucccgccccuaccaggucgucggcuuccccaaccgcuucuccucccgccccaucaccggcccccacaucgccuacaccgaggccgucuccgacacccagaucaugcucaaguggaccuacauccccuccuccaacaacaacacccccauccagggcuucuacaucuacuaccgccccaccgacuccgacaacgacuccgacuacaagcgcgacgucgucgagggcuccaagcaguggcacaugaucggccaccuccagcccgagaccuccuacgacaucaagaugcagugcuucaacgagggcggcgaguccgaguucuccaacgucaugaucugcgagaccaaggucaagcgcguccccggcgccuccgaguaccccgucaaggaccucuccaccccccccaacucccucggcuccggcggcaacgucggccccgccaccucccccgcccgcuccuccgacaugcucuaccucaucgucggcugcguccucggcgucaugguccucauccucauggucuucaucgccaugugccucuggaagaaccgccagcagaacaccauccagaaguacgacccccccggcuaccucuaccagggcuccgacaugaacggccagauggucgacuacaccacccucuccggcgccucccagaucaacggcaacguccacggcggcuuccucaccaacggcggccucuccuccggcuacucccaccuccaccacaagguccccaacgccgucaacggcaucgucaacggcucccucaacggcggccucuacuccggccacuccaacucccucacccgcacccacgucgacuucgagcacccccaccaccucgucaacggcggcggcauguacaccgccgucccccagaucgacccccucgagugcgucaacugccgcaacugccgcaacaacaaccgcugcuucaccaagaccaacuccaccuucuccuccucccccccccccgucguccccgucgucgcccccuacccccaggacggccucgagaugaagccccucucccacgucaagguccccgucugccucaccuccgccguccccgacugcggccagcuccccgaggaguccgucaaggacaacgucgagcccguccccacccagcgcaccugcugccaggacaucgucaacgacgucuccuccgacggcuccgaggaccccgccgaguucucccgcggccaggagggcaugaucaaccuccgcauccccgaccaccuccagcucgccaaguccugcgucugggagggcgacuccugcgcccacuccgagaccgagaucaacaucgucuccuggaacgcccucauccucccccccguccccgagggcugcgccgagaagaccaugugguccccccccggcaucccccucgacucccccaccgagguccuccagcagccccgcgagaccuga

SEQ ID NO: 41139 - RNA, 789 nt, Artificial Sequence
  derived and/or modified sequence opt2 from CDR1__Homo_sapiens__NP_004056
auggccuggcucgaggacgucgacuuccucgaggacgucccccuccucgaggacaucccccuccucgaggacgucccccuccucgaggacgucccccuccucgaggacaccucccgccucgaggacaucaaccucauggaggacauggcccuccucgaggacgucgaccuccucgaggacaccgacuuccucgaggaccucgacuucuccgaggccauggaccuccgcgaggacaaggacuuccucgaggacauggacucccucgaggacauggcccuccucgaggacgucgaccuccucgaggacaccgacuuccucgaggaccccgacuuccucgaggccaucgaccuccgcgaggacaaggacuuccucgaggacauggacucccucgaggaccucgaggccaucggccgcugcggcuucuccggccgccacggcuucuucggccgccgccgcuucuccggccgccccaagcucuccggccgccucggccuccucggccgccgcggcuucuccggccgccucggcggcuacuggaagaccuggaucuucuggaagaccuggaucuucuggaagaccuggaucuuccgcaagaccuacaucggcuggaagaccuggaucuucuccggccgcugcggccucaccggccgccccggcuucggcggccgccgccgcuucuucuggaagacccucaccgacuggaagaccuggaucuccuucuggaagacccucaucgacuggaagaccuggaucuccuucuggaagacccucaucgacuggaagaucuga

SEQ ID NO: 41140 - RNA, 1365 nt, Artificial Sequence
  derived and/or modified sequence opt2 from CDR2__Homo_sapiens__NP_001793
augcucgccgagaaccucgucgaggaguucgagaugaaggaggacgagcccugguacgaccaccaggaccuccagcaggaccuccagcucgccgccgagcucggcaagacccuccucgaccgcaacaccgagcucgaggacuccguccagcagauguacaccaccaaccaggagcagcuccaggagaucgaguaccucaccaagcaggucgagcuccuccgccagaugaacgagcagcacgccaaggucuacgagcagcucgacgucaccgcccgcgagcucgaggagaccaaccagaagcucgucgccgacuccaaggccucccagcagaagauccucucccucaccgagaccaucgagugccuccagaccaacaucgaccaccuccagucccaggucgaggagcucaaguccuccggccagggccgccgcucccccggcaagugcgaccaggagaagcccgcccccuccuucgccugccucaaggagcucuacgaccuccgccagcacuucgucuacgaccacgucuucgccgagaagaucaccucccuccagggccagcccucccccgacgaggaggagaacgagcaccucaagaagaccgucaccaugcuccaggcccagcucucccucgagcgccagaagcgcgucaccauggaggaggaguacggccucguccucaaggagaacuccgagcucgagcagcagcucggcgccaccggcgccuaccgcgcccgcgcccucgagcucgaggccgaggucgccgagaugcgccagaugcuccaguccgagcaccccuucgucaacggcgucgagaagcucguccccgacucccucuacguccccuucaaggagcccucccagucccuccucgaggagauguuccucaccguccccgagucccaccgcaagccccucaagcgcuccuccuccgagaccauccucuccucccucgccggcuccgacaucgucaagggccacgaggagaccugcauccgccgcgccaaggccgucaagcagcgcggcaucucccuccuccacgaggucgacacccaguacuccgcccucaaggucaaguacgaggagcuccucaagaagugccaggaggagcaggacucccucucccacaaggccguccagaccucccgcgccgccgccaaggaccucaccggcgucaacgcccaguccgagcccgucgccuccggcugggagcucgccuccgucaaccccgagcccgucuccucccccaccaccccccccgaguacaaggcccucuucaaggagaucuucuccugcaucaagaagaccaagcaggagaucgacgagcagcgcaccaaguaccgcucccucuccucccacuccuga

SEQ ID NO: 41141 - RNA, 1338 nt, Artificial Sequence
  derived and/or modified sequence opt2 from CDS2__Homo_sapiens__NP_003809
augaccgagcuccgccagcgcgucgcccacgagcccgucgccccccccgaggacaaggaguccgaguccgaggccaaggucgacggcgagaccgccuccgacuccgagucccgcgccgaguccgccccccuccccgucuccgccgacgacacccccgagguccucaaccgcgcccucuccaaccucuccucccgcuggaagaacugguggguccgcggcauccucacccucgccaugaucgccuucuucuucaucaucaucuaccucggccccaugguccucaugaucaucgucaugugcguccagaucaagugcuuccacgagaucaucaccaucggcuacaacgucuaccacuccuacgaccuccccugguuccgcacccucuccugguacuuccuccucugcgucaacuacuucuucuacggcgagaccgucaccgacuacuucuucacccucguccagcgcgaggagccccuccgcauccucuccaaguaccaccgcuucaucuccuucacccucuaccucaucggcuucugcauguucguccucucccucgucaagaagcacuaccgccuccaguucuacauguucggcuggacccacgucacccuccucaucgucgucacccagucccaccucgucauccacaaccucuucgagggcaugaucugguucaucguccccaucuccugcgucaucugcaacgacaucauggccuacauguucggcuucuucuucggccgcaccccccucaucaagcucucccccaagaagaccugggagggcuucaucggcggcuucuucgccaccgucgucuucggccuccuccucuccuacgucauguccggcuaccgcugcuucgucugccccgucgaguacaacaacgacaccaacuccuucaccgucgacugcgagcccuccgaccucuuccgccuccaggaguacaacauccccggcgucauccaguccgucaucggcuggaagaccguccgcauguaccccuuccagauccacuccaucgcccucuccaccuucgccucccucaucggccccuucggcggcuucuucgccuccggcuucaagcgcgccuucaagaucaaggacuucgccaacaccauccccggccacggcggcaucauggaccgcuucgacugccaguaccucauggccaccuucgucaacgucuacaucgccuccuucauccgcggccccaaccccuccaagcucauccagcaguuccucacccuccgccccgaccagcagcuccacaucuucaacacccuccgcucccaccucaucgacaagggcaugcucaccuccaccaccgaggacgaguga

SEQ ID NO: 41142 - RNA, 1641 nt, Artificial Sequence
  derived and/or modified sequence opt2 from CDT1__Homo_sapiens__NP_112190
auggagcagcgccgcgucaccgacuucuucgcccgccgccgccccggccccccccgcaucgccccccccaagcucgccugccgcacccccucccccgcccgccccgcccuccgcgcccccgccuccgccaccuccggcucccgcaagcgcgcccgcccccccgccgcccccggccgcgaccaggcccgcccccccgcccgccgccgccuccgccucuccgucgacgaggucuccucccccuccacccccgaggcccccgacauccccgccugccccucccccggccagaagaucaagaaguccacccccgccgccggccagcccccccaccucaccuccgcccaggaccaggacaccaucuccgagcucgccuccugccuccagcgcgcccgcgagcucggcgcccgcguccgcgcccucaaggccuccgcccaggacgccggcgaguccugcacccccgaggccgagggccgccccgaggagcccugcggcgagaaggcccccgccuaccagcgcuuccacgcccucgcccagcccggccuccccggccucguccuccccuacaaguaccagguccucgccgagauguuccgcuccauggacaccaucgucggcaugcuccacaaccgcuccgagacccccaccuucgccaagguccagcgcggcguccaggacaugaugcgccgccgcuucgaggagugcaacgucggccagaucaagaccgucuaccccgccuccuaccgcuuccgccaggagcgcuccguccccaccuucaaggacggcacccgccgcuccgacuaccagcucaccaucgagccccuccucgagcaggaggccgacggcgccgccccccagcucaccgccucccgccuccuccagcgccgccagaucuucucccagaagcucgucgagcacgucaaggagcaccacaaggccuuccucgccucccucucccccgccauggucguccccgaggaccagcucacccgcuggcacccccgcuucaacgucgacgagguccccgacaucgagcccgccgcccucccccagccccccgccaccgagaagcucaccaccgcccaggagguccucgcccgcgcccgcaaccucaucuccccccgcauggagaaggcccucucccagcucgcccuccgcuccgccgcccccuccucccccggcuccccccgccccgcccuccccgccaccccccccgccaccccccccgccgccucccccuccgcccucaagggcgucucccaggaccuccucgagcgcauccgcgccaaggaggcccagaagcagcucgcccagaugacccgcugccccgagcaggagcagcgccuccagcgccucgagcgccuccccgagcucgcccgcguccuccgcuccgucuucgucuccgagcgcaagcccgcccucuccauggaggucgccugcgcccgcauggucggcuccugcugcaccaucaugucccccggcgagauggagaagcaccuccuccuccucuccgagcuccuccccgacuggcucucccuccaccgcauccgcaccgacaccuacgucaagcucgacaaggccgccgaccucgcccacaucaccgcccgccucgcccaccagacccgcgccgaggagggccucuga

SEQ ID NO: 41143 - RNA, 642 nt, Artificial Sequence
  derived and/or modified sequence opt2 from CDV3__Homo_sapiens__NP_001127894
auggccgagaccgaggagcgcucccucgacaacuucuucgccaagcgcgacaagaagaagaagaaggagcgcuccaaccgcgccgccuccgccgccggcgccgccggcuccgccggcggcuccuccggcgccgccggcgccgccggcggcggcgccggcgccggcacccgccccggcgacggcggcaccgccuccgccggcgccgccggccccggcgccgccaccaaggccgucaccaaggacgaggacgaguggaaggagcucgagcagaaggaggucgacuacuccggccuccgcguccaggccaugcagaucuccuccgagaaggaggaggacgacaacgagaagcgccaggaccccggcgacaacugggaggagggcggcggcggcggcggcggcauggagaaguccuccggccccuggaacaagaccgcccccguccaggccccccccgcccccgucaucgucaccgagacccccgagcccgccaugaccuccggcgucuaccgcccccccggcgcccgccucaccaccacccgcaagaccccccagggcccccccgagaucuacuccgacacccaguuccccucccuccaguccaccgccaagcacgucgagucccgcaaccgcuaccucaaguga

SEQ ID NO: 41144 - RNA, 798 nt, Artificial Sequence
  derived and/or modified sequence opt2 from CDX1__Homo_sapiens__NP_001795
auguacgucggcuacguccucgacaaggacucccccgucuaccccggccccgcccgccccgccucccucggccucggcccccaggccuacggcccccccgcccccccccccgcccccccccaguaccccgacuucuccuccuacucccacgucgagcccgcccccgccccccccaccgccuggggcgcccccuuccccgcccccaaggacgacugggccgccgccuacggccccggccccgccgcccccgccgccucccccgccucccucgccuucggccccccccccgacuucucccccguccccgccccccccggccccggccccggccuccucgcccagccccucggcggccccggcacccccuccucccccggcgcccagcgccccacccccuacgaguggaugcgccgcuccgucgccgccggcggcggcggcggcuccggcaagacccgcaccaaggacaaguaccgcgucgucuacaccgaccaccagcgccucgagcucgagaaggaguuccacuacucccgcuacaucaccauccgccgcaaguccgagcucgccgccaaccucggccucaccgagcgccaggucaagaucugguuccagaaccgccgcgccaaggagcgcaaggucaacaagaagaagcagcagcagcagcagcccccccagccccccauggcccacgacaucaccgccacccccgccggccccucccucggcggccucugccccuccaacaccucccuccucgccaccuccucccccaugcccgucaaggaggaguuccuccccuga

SEQ ID NO: 41145 - RNA, 942 nt, Artificial Sequence
  derived and/or modified sequence opt2 from CDX2__Homo_sapiens__NP_001256
auguacgucuccuaccuccucgacaaggacgucuccauguaccccuccuccguccgccacuccggcggccucaaccucgccccccagaacuucgucucccccccccaguaccccgacuacggcggcuaccacgucgccgccgccgccgccgccgccgccaaccucgacuccgcccagucccccggccccuccuggcccgccgccuacggcgccccccuccgcgaggacuggaacggcuacgcccccggcggcgccgccgccgccgccaacgccgucgcccacggccucaacggcggcucccccgccgccgccaugggcuacuccucccccgccgacuaccacccccaccaccacccccaccaccacccccaccaccccgccgccgcccccuccugcgccuccggccuccuccagacccucaaccccggcccccccggccccgccgccaccgccgccgccgagcagcucucccccggcggccagcgccgcaaccucugcgaguggaugcgcaagcccgcccagcagucccucggcucccaggucaagacccgcaccaaggacaaguaccgcgucgucuacaccgaccaccagcgccucgagcucgagaaggaguuccacuacucccgcuacaucaccauccgccgcaaggccgagcucgccgccacccucggccucuccgagcgccaggucaagaucugguuccagaaccgccgcgccaaggagcgcaagaucaacaagaagaagcuccagcagcagcagcagcagcagcccccccagcccccccccccccccccccagcccccccagccccagcccggcccccuccgcuccguccccgagccccucucccccgucuccucccuccaggccuccgucuccggcuccguccccggcguccucggccccaccggcggcguccucaaccccaccgucacccaguga

SEQ ID NO: 41146 - RNA, 855 nt, Artificial Sequence
  derived and/or modified sequence opt2 from CDX4__Homo_sapiens__NP_005184
auguacggcuccugccuccucgagaaggaggccggcauguaccccggcacccucaugucccccggcggcgacggcaccgccggcaccggcggcaccggcggcggcggcucccccaugcccgccuccaacuucgccgccgcccccgccuucucccacuacaugggcuacccccacaugcccuccauggacccccacuggcccucccucggcgucuggggcucccccuacucccccccccgcgaggacugguccgucuaccccggccccuccuccaccaugggcaccguccccgucaacgacgucaccuccucccccgccgccuucugcuccaccgacuacuccaaccucggccccgucggcggcggcaccuccggcuccucccuccccggccaggccggcggcucccucguccccaccgacgccggcgccgccaaggccuccucccccucccgcucccgccacucccccuacgccuggaugcgcaagaccguccaggucaccggcaagacccgcaccaaggagaaguaccgcgucgucuacaccgaccaccagcgccucgagcucgagaaggaguuccacugcaaccgcuacaucaccauccagcgcaaguccgagcucgccgucaaccucggccucuccgagcgccaggucaagaucugguuccagaaccgccgcgccaaggagcgcaagaugaucaagaagaagaucucccaguucgagaacuccggcggcuccguccaguccgacuccgacuccaucucccccggcgagcuccccaacaccuucuucaccacccccuccgccguccgcggcuuccagcccaucgagauccagcaggucaucgucuccgaguga

SEQ ID NO: 41147 - RNA, 1623 nt, Artificial Sequence
  derived and/or modified sequence opt2 from CDY1B__Homo_sapiens__NP_001003894
auggccucccaggaguucgaggucgaggccaucgucgacaagcgccaggacaagaacggcaacacccaguaccucguccgcuggaagggcuacgacaagcaggacgacaccugggagcccgagcagcaccucaugaacugcgagaagugcguccacgacuucaaccgccgccagaccgagaagcagaagaagcucaccuggaccaccaccucccgcaucuucuccaacaacgcccgccgccgcaccucccgcuccaccaaggccaacuacuccaagaacucccccaagacccccgucaccgacaagcaccaccgcuccaagaaccgcaagcucuucgccgccuccaagaacguccgccgcaaggccgccuccauccucuccgacaccaagaacauggagaucaucaacuccaccaucgagacccucgcccccgacucccccuucgaccacaagaccgucuccggcuuccagaagcucgagaagcucgaccccaucgccgccgaccagcaggacaccgucgucuucaaggucaccgagggcaagcuccuccgcgacccccucucccgccccggcgccgagcagaccggcauccagaacaagacccagauccacccccucaugucccagauguccggcuccgucaccgccuccauggccaccggcuccgccacccgcaagggcaucgucguccucaucgacccccucgccgccaacggcaccaccgacaugcacaccuccgucccccgcgucaagggcggccagcgcaacaucaccgacgacucccgcgaccagcccuucaucaagaagaugcacuucaccauccgccucaccgaguccgccuccaccuaccgcgacaucgucgucaagaaggaggacggcuucacccagaucguccucuccacccgcuccaccgagaagaacgcccucaacaccgaggucaucaaggagaucgucaacgcccucaacuccgccgccgccgacgacuccaagcucguccucuucuccgccgccggcuccgucuucugcugcggccucgacuucggcuacuucgucaagcaccuccgcaacaaccgcaacaccgccucccucgagauggucgacaccaucaagaacuucgucaacaccuucauccaguucaagaagcccaucgucgucuccgucaacggccccgccaucggccucggcgccuccauccucccccucugcgaccucgucugggccaacgagaaggccugguuccagacccccuacaccaccuucggccagucccccgacggcugcuccuccaucaccuuccccaagaugaugggcaaggccuccgccaacgagaugcucaucgccggccgcaagcucaccgcccgcgaggccugcgccaagggccucgucucccaggucuuccucaccggcaccuucacccaggaggucaugauccagaucaaggagcucgccuccuacaaccccaucguccucgaggagugcaaggcccucguccgcugcaacaucaagcucgagcucgagcaggccaacgagcgcgagugcgagguccuccgcaagaucugguccuccgcccagggcaucgaguccaugcucaaguacgucgagaacaagaucgacgaguucuga

SEQ ID NO: 41148 - RNA, 1626 nt, Artificial Sequence
  derived and/or modified sequence opt2 from CDY2B__Homo_sapiens__NP_001001722
auggccucccaggaguucgaggucgaggccaucgucgacaagcgccaggacaagaacggcaacacccaguaccucguccgcuggaagggcuacgacaagcaggacgacaccugggagcccgagcagcaccucaugaacugcgagaagugcguccacgacuucaaccgccgccagaccgagaagcagaagaagcucaccuggaccaccaccucccgcaucuucuccaacaacgcccgccgccgcaccucccgcuccaccaaggccaacuacuccaagaacucccccaagacccccgucaccgacaagcaccaccgcuccaagaacugcaagcucuucgccgccuccaagaacguccgccgcaaggccgccuccacccucuccgacaccaagaacauggagaucaucaacuccaccaucgagacccucgcccccgacucccccuucgaccacaagaagaccgucuccggcuuccagaagcucgagaagcucgaccccaucgccgccgaccagcaggacaccgucgucuucaaggucaccgagggcaagcuccuccgcgacccccucucccaccccggcgccgagcagaccggcauccagaacaagacccagaugcacccccucaugucccagauguccggcuccgucaccgccuccauggccaccggcuccgccacccgcaagggcaucgucguccucaucgacccccucgccgccaacggcaccaccgacaugcacaccuccgucccccgcgucaagggcggccagcgcaacaucaccgacgacucccgcggccagcccuucaucaagaagaugcacuucaccauccgccucaccgaguccgccaucaccuaccgcgacaucgucgucaagaaggaggacggcuucacccagaucguccucuccacccgcuccaccgagaagaacgcccucaacaccgaggucaucaaggagauggucaacgcccucaacuccgccgccgccgacgacuccaagcucguccucuucuccgccgccggcuccgucuucugcugcggccucgacuucggcuacuucguccgccaccuccgcaacgaccgcaacaccgccucccucgagauggucgacaccaucaagaacuucgucaacaccuucauccaguucaagaagcccaucgucgucuccgucaacggccccgccaucggccucggcgccuccauccucccccucugcgaccucgucugggccaacgagaaggccugguuccagacccccuacaccaccuucggccagucccccgacggcugcuccuccaucaccuuccccaagaugaugggcaaggccuccgccaacgagaugcucaucgccggccgcaagcucaccgcccgcgaggccugcgccaagggccucgucucccaggucuuccucaccggcaccuucacccaggaggucaugauccagaucaaggagcucgccuccuacaacgccaucguccucgaggagugcaaggcccucguccgcugcaacaucaagcucgagcucgagcaggccaacgagcgcgagugcgagguccuccgcaagaucugguccuccgcccagggcaucgaguccaugcucaaguacgucgagaacaagaucgacgaguucuga

SEQ ID NO: 41149 - RNA, 1521 nt, Artificial Sequence
  derived and/or modified sequence opt2 from CDYL2__Homo_sapiens__NP_689555
auggccuccggcgaccucuacgaggucgagcgcaucgucgacaagcgcaagaacaagaagggcaagugggaguaccucauccgcuggaagggcuacggcuccaccgaggacaccugggagcccgagcaccaccuccuccacugcgaggaguucaucgacgaguucaacggccuccacauguccaaggacaagcgcaucaaguccggcaagcaguccuccaccuccaagcuccuccgcgacucccgcggccccuccgucgagaagcucucccaccgccccuccgaccccggcaaguccaagggcaccucccacaagcgcaagcgcaucaaccccccccucgccaagcccaagaagggcuacuccggcaagcccuccuccggcggcgaccgcgccaccaagaccgucuccuaccgcaccacccccuccggccuccagaucaugccccucaagaagucccagaacggcauggagaacggcgacgccggcuccgagaaggacgagcgccacuucggcaacggcucccaccagcccggccucgaccucaacgaccacgucggcgagcaggacaugggcgagugcgacgucaaccacgccacccucgccgagaacggccucggcuccgcccucaccaacggcggccucaaccuccacucccccgucaagcgcaagcucgaggccgagaaggacuacgucuucgacaagcgccuccgcuacuccguccgccagaacgaguccaacugccgcuuccgcgacaucgucguccgcaaggaggagggcuucacccacauccuccucuccucccagaccuccgacaacaacgcccucacccccgagaucaugaaggagguccgccgcgcccucugcaacgccgccaccgacgacuccaagcuccuccuccucuccgccgucggcuccgucuucugcuccggccucgacuacuccuaccucaucggccgccucuccuccgaccgccgcaaggaguccacccgcaucgccgaggccauccgcgacuucgucaaggccuucauccaguucaagaagcccaucgucgucgccaucaacggccccgcccucggccucggcgccuccauccucccccucugcgacaucgucugggccuccgagaaggccugguuccagacccccuacgccaccauccgccucacccccgccggcugcuccuccuacaccuucccccagauccucggcgucgcccucgccaacgagaugcucuucugcggccgcaagcucaccgcccaggaggccugcucccgcggccucgucucccaggucuucuggcccaccaccuucucccaggaggucaugcuccgcgucaaggagauggccuccugcuccgccgucguccucgaggaguccaagugccucguccgcuccuuccucaaguccguccucgaggacgucaacgagaaggagugccucaugcucaagcagcucugguccuccuccaagggccucgacucccucuucuccuaccuccaggacaagaucuacgaggucuga

SEQ ID NO: 41150 - RNA, 1239 nt, Artificial Sequence
  derived and/or modified sequence opt2 from CDYL__Homo_sapiens__NP_001137442
auggaccucgccaaguccggcaucaagauccucguccccaagucccccgucaagucccgcaccgccgucgacggcuuccaguccgagucccccgagaagcucgaccccgucgagcagggccaggaggacaccgucgcccccgaggucgccgccgagaagcccgucggcgcccuccucggccccggcgccgagcgcgcccgcaugggcucccgcccccgcauccacccccucgucccccagguccccggccccgucaccgccgccauggccaccggccucgccgucaacggcaagggcaccucccccuucauggacgcccucaccgccaacggcaccaccaacauccagaccuccgucaccggcgucaccgccuccaagcgcaaguucaucgacgaccgccgcgaccagcccuucgacaagcgccuccgcuucuccguccgccagaccgaguccgccuaccgcuaccgcgacaucgucguccgcaagcaggacggcuucacccacauccuccucuccaccaaguccuccgagaacaacucccucaaccccgaggucaugcgcgagguccaguccgcccucuccaccgccgccgccgacgacuccaagcucguccuccucuccgccgucggcuccgucuucugcugcggccucgacuucaucuacuucauccgccgccucaccgacgaccgcaagcgcgaguccaccaagauggccgaggccauccgcaacuucgucaacaccuucauccaguucaagaagcccaucaucgucgccgucaacggccccgccaucggccucggcgccuccauccucccccucugcgacgucgucugggccaacgagaaggccugguuccagacccccuacaccaccuucggccagucccccgacggcugcuccaccgucauguuccccaagaucaugggcggcgccuccgccaacgagaugcuccucuccggccgcaagcucaccgcccaggaggccugcggcaagggccucgucucccaggucuucuggcccggcaccuucacccaggaggucaugguccgcaucaaggagcucgccuccugcaaccccgucguccucgaggaguccaaggcccucguccgcugcaacaugaagauggagcucgagcaggccaacgagcgcgagugcgagguccucaagaagaucuggggcuccgcccagggcauggacuccaugcucaaguaccuccagcgcaagaucgacgaguucuga

SEQ ID NO: 41151 - RNA, 1278 nt, Artificial Sequence
  derived and/or modified sequence opt2 from CEACAM16__Homo_sapiens__NP_001034302
auggcccucaccggcuacuccuggcuccuccucuccgccaccuuccucaacgucggcgccgagaucuccaucacccucgagcccgcccagcccuccgagggcgacaacgucacccucgucguccacggccucuccggcgagcuccucgccuacuccugguacgccggccccacccucuccgucuccuaccucgucgccuccuacaucgucuccaccggcgacgagacccccggccccgcccacaccggccgcgaggccguccgccccgacggcucccucgacauccagggcauccucccccgccacuccggcaccuacauccuccagaccuucaaccgccagcuccagaccgaggucggcuacggccacguccagguccacgagauccucgcccagcccaccguccucgccaacuccaccgcccucgucgagcgccgcgacacccuccgccucaugugcuccucccccucccccaccgccgagguccgcugguucuucaacggcggcgcccuccccgucgcccuccgccucggccucucccccgacggccgcguccucgcccgccacggcauccgccgcgaggaggccggcgccuaccagugcgaggucuggaaccccgucuccgucucccgcuccgagcccaucaaccucaccgucuacuucggccccgagcgcgucgccauccuccaggacuccaccacccgcaccggcugcaccaucaaggucgacuucaacaccucccucacccucuggugcgucucccgcuccugccccgagcccgaguacgucuggaccuucaacggccaggcccucaagaacggccaggaccaccucaacaucuccuccaugaccgccgcccaggagggcaccuacaccugcaucgccaagaacaccaagacccuccucuccggcuccgccuccgucgucgucaagcucuccgccgccgccgucgccaccaugaucguccccguccccaccaagcccaccgagggccaggacgucacccucaccguccagggcuaccccaaggaccuccucgucuacgccugguaccgcggccccgccuccgagcccaaccgccuccucucccagcuccccuccggcaccuggaucgccggccccgcccacaccggccgcgaggucggcuuccccaacugcucccuccucguccagaagcucaaccucaccgacaccggccgcuacacccucaagaccgucaccguccagggcaagaccgagacccucgaggucgagcuccaggucgccccccucggcuga

SEQ ID NO: 41152 - RNA, 900 nt, Artificial Sequence
  derived and/or modified sequence opt2 from CEACAM19__Homo_sapiens__NP_001121365
auggagauccccaugggcacccagggcugcuucuccaagucccuccuccucuccgccuccauccucguccucuggaugcuccagggcucccaggccgcccucuacauccagaagauccccgagcagccccagaagaaccaggaccuccuccucuccguccagggcguccccgacaccuuccaggacuucaacugguaccucggcgaggagaccuacggcggcacccgccucuucaccuacauccccggcauccagcgcccccagcgcgacggcuccgccaugggccagcgcgacaucgucggcuuccccaacggcuccaugcuccuccgccgcgcccagcccaccgacuccggcaccuaccaggucgccaucaccaucaacuccgaguggaccaugaaggccaagaccgagguccaggucgccgagaagaacaaggagcuccccuccacccaccuccccaccaacgccggcauccucgccgccaccaucaucggcucccucgccgccggcgcccuccucaucuccugcaucgccuaccuccucgucacccgcaacuggcgcggccagucccaccgccuccccgccccccgcggccagggcucccucuccauccucugcuccgccgucucccccguccccuccgucacccccuccaccuggauggccaccaccgagaagcccgagcucggccccgcccacgacgccggcgacaacaacaucuacgaggucaugcccucccccguccuccucgucucccccaucuccgacacccgcuccaucaaccccgcccgcccccuccccacccccccccaccuccaggccgagcccgagaaccaccaguaccaggaccuccucaaccccgaccccgcccccuacugccagcucguccccaccuccuga

SEQ ID NO: 41153 - RNA, 1395 nt, Artificial Sequence
  derived and/or modified sequence opt2 from CEACAM1__Homo_sapiens__NP_001020083
augggccaccucuccgccccccuccaccgcguccgcguccccuggcagggccuccuccucaccgccucccuccucaccuucuggaacccccccaccaccgcccagcucaccaccgaguccaugcccuucaacgucgccgagggcaaggagguccuccuccucguccacaaccucccccagcagcucuucggcuacuccugguacaagggcgagcgcgucgacggcaaccgccagaucgucggcuacgccaucggcacccagcaggccacccccggccccgccaacuccggccgcgagaccaucuaccccaacgccucccuccucauccagaacgucacccagaacgacaccggcuucuacacccuccaggucaucaaguccgaccucgucaacgaggaggccaccggccaguuccacgucuaccccgagcuccccaagcccuccaucuccuccaacaacuccaaccccgucgaggacaaggacgccgucgccuucaccugcgagcccgagacccaggacaccaccuaccucugguggaucaacaaccagucccuccccgucuccccccgccuccagcucuccaacggcaaccgcacccucacccuccucuccgucacccgcaacgacaccggccccuacgagugcgagauccagaaccccgucuccgccaaccgcuccgaccccgucacccucaacgucaccuacggccccgacacccccaccaucucccccuccgacaccuacuaccgccccggcgccaaccucucccucuccugcuacgccgccuccaacccccccgcccaguacuccuggcucaucaacggcaccuuccagcaguccacccaggagcucuucauccccaacaucaccgucaacaacuccggcuccuacaccugccacgccaacaacuccgucaccggcugcaaccgcaccaccgucaagaccaucaucgucaccgagcucucccccgucgucgccaagccccagaucaaggccuccaagaccaccgucaccggcgacaaggacuccgucaaccucaccugcuccaccaacgacaccggcaucuccauccgcugguucuucaagaaccagucccuccccuccuccgagcgcaugaagcucucccagggcaacaccacccucuccaucaaccccgucaagcgcgaggacgccggcaccuacuggugcgaggucuucaaccccaucuccaagaaccaguccgaccccaucaugcucaacgucaacuacaacgcccucccccaggagaacggccucucccccggcgccaucgccggcaucgucaucggcgucgucgcccucgucgcccucaucgccgucgcccucgccugcuuccuccacuucggcaagaccggcuccuccggcccccuccaguga

SEQ ID NO: 41154 - RNA, 882 nt, Artificial Sequence
  derived and/or modified sequence opt2 from CEACAM21__Homo_sapiens__XP_006725457
augggcccccccuccgccugcccccaccgcgagugcauccccuggcagggccuccuccucaccgccucccuccucaccuucuggaacgcccccaccaccgccuggcucuucaucgccuccgcccccuucgaggucgccgagggcgagaacguccaccucuccgucgucuaccuccccgagaaccucuacuccuacggcugguacaagggcaagaccgucgagcccaaccagcucaucgccgccuacgucaucgacacccacguccgcacccccggccccgccuacuccggccgcgagaccaucucccccuccggcgaccuccacuuccagaacgucacccucgaggacaccggcuacuacaaccuccaggucaccuaccgcaacucccagaucgagcaggccucccaccaccuccgcgucuacgaguccgucgcccagcccuccauccaggccuccuccaccaccgucaccgagaagggcuccgucguccucaccugccacaccaacaacaccggcaccuccuuccaguggaucuucaacaaccagcgccuccaggucaccaagcgcaugaagcucuccugguucaaccacguccucaccaucgaccccauccgccaggaggacgccggcgaguaccagugcgaggucuccaaccccgucuccuccaaccgcuccgacccccucaagcucaccgucaaguccgacgacaacacccucggcauccucaucggcguccucgucggcucccuccucgucgccgcccucgucugcuuccuccuccuccgcaagaccggccgcgccuccgaccaguccgacuuccgcgagcagcagccccccgccuccacccccggccacggccccuccgacuccuccaucuccuga

SEQ ID NO: 41155 - RNA, 639 nt, Artificial Sequence
  derived and/or modified sequence opt2 from CEACAM3__Homo_sapiens__NP_001264092
augggcccccccuccgccuccccccaccgcgagugcauccccuggcagggccuccuccucaccgccucccuccucaacuucuggaacccccccaccaccgccaagcucaccaucgaguccaugccccucuccgucgccgagggcaaggagguccuccuccucguccacaaccucccccagcaccucuucggcuacuccugguacaagggcgagcgcgucgacggcaacucccucaucgucggcuacgucaucggcacccagcaggccacccccggcgccgccuacuccggccgcgagaccaucuacaccaacgccucccuccucauccagaacgucacccagaacgacaucggcuucuacacccuccaggucaucaaguccgaccucgucaacgaggaggccaccggccaguuccacgucuaccaggagaacgcccccggccuccccgucggcgccgucgccggcaucgucaccggcguccucgucggcgucgcccucgucgccgcccucgucugcuuccuccuccucgccaagaccggccgccccuggucccucccccagcucugccuccucgacguccccucccuccacugccccggcccccccacccagccccaggacuccuccuuccaccucuga

SEQ ID NO: 41156 - RNA, 735 nt, Artificial Sequence
  derived and/or modified sequence opt2 from CEACAM4__Homo_sapiens__NP_001808
augggcccccccuccgccgccccccgcggcggccaccgccccuggcagggccuccucaucaccgccucccuccucaccuucuggcacccccccaccaccguccaguucaccaucgaggcccuccccuccuccgccgccgagggcaaggacguccuccuccucgccugcaacaucuccgagaccauccaggccuacuacuggcacaagggcaagaccgccgagggcuccccccucaucgccggcuacaucaccgacauccaggccaacauccccggcgccgccuacuccggccgcgagaccgucuaccccaacggcucccuccucuuccagaacaucacccucgaggacgccggcuccuacacccuccgcaccaucaacgccuccuacgacuccgaccaggccaccggccagcuccacguccaccagaacaacguccccggccuccccgucggcgccgucgccggcaucgucaccggcguccucgucggcgucgcccucgucgccgcccucgucugcuuccuccuccucucccgcaccggccgcgccuccauccagcgcgaccuccgcgagcagcccccccccgccuccacccccggccacggccccucccaccgcuccaccuucuccgccccccuccccuccccccgcaccgccacccccaucuacgaggagcuccucuacuccgacgccaacaucuacugccagaucgaccacaaggccgacgucgucuccuga

SEQ ID NO: 41157 - RNA, 2109 nt, Artificial Sequence
  derived and/or modified sequence opt2 from CEACAM5__Homo_sapiens__NP_001278413
auggagucccccuccgcccccccccaccgcuggugcauccccuggcagcgccuccuccucaccgccucccuccucaccuucuggaacccccccaccaccgccaagcucaccaucgaguccacccccuucaacgucgccgagggcaaggagguccuccuccucguccacaaccucccccagcaccucuucggcuacuccugguacaagggcgagcgcgucgacggcaaccgccagaucaucggcuacgucaucggcacccagcaggccacccccggccccgccuacuccggccgcgagaucaucuaccccaacgccucccuccucauccagaacaucauccagaacgacaccggcuucuacacccuccacgucaucaaguccgaccucgucaacgaggaggccaccggccaguuccgcgucuaccccgagcuccccaagcccuccaucuccuccaacaacuccaagcccgucgaggacaaggacgccgucgccuucaccugcgagcccgagacccaggacgccaccuaccucuggugggucaacaaccagucccuccccgucuccccccgccuccagcucuccaacggcaaccgcacccucacccucuucaacgucacccgcaacgacaccgccuccuacaagugcgagacccagaaccccgucuccgcccgccgcuccgacuccgucauccucaacguccucuacggccccgacgcccccaccaucuccccccucaacaccuccuaccgcuccggcgagaaccucaaccucuccugccacgccgccuccaacccccccgcccaguacuccugguucgucaacggcaccuuccagcaguccacccaggagcucuucauccccaacaucaccgucaacaacuccggcuccuacaccugccaggcccacaacuccgacaccggccucaaccgcaccaccgucaccaccaucaccgucuacgccgagccccccaagcccuucaucaccuccaacaacuccaaccccgucgaggacgaggacgccgucgcccucaccugcgagcccgagauccagaacaccaccuaccucuggugggucaacaaccagucccuccccgucuccccccgccuccagcucuccaacgacaaccgcacccucacccuccucuccgucacccgcaacgacgucggccccuacgagugcggcauccagaacgagcucuccgucgaccacuccgaccccgucauccucaacguccucuacggccccgacgaccccaccaucucccccuccuacaccuacuaccgccccggcgucaaccucucccucuccugccacgccgccuccaacccccccgcccaguacuccuggcucaucgacggcaacauccagcagcacacccaggagcucuucaucuccaacaucaccgagaagaacuccggccucuacaccugccaggccaacaacuccgccuccggccacucccgcaccaccgucaagaccaucaccgucuccgccgagcuccccaagcccuccaucuccuccaacaacuccaagcccgucgaggacaaggacgccgucgccuucaccugcgagcccgaggcccagaacaccaccuaccucuggugggucaacggccagucccuccccgucuccccccgccuccagcucuccaacggcaaccgcacccucacccucuucaacgucacccgcaacgacgcccgcgccuacgucugcggcauccagaacuccgucuccgccaaccgcuccgaccccgucacccucgacguccucuacggccccgacacccccaucaucuccccccccgacuccuccuaccucuccggcgccaaccucaaccucuccugccacuccgccuccaaccccuccccccaguacuccuggcgcaucaacggcaucccccagcagcacacccagguccucuucaucgccaagaucacccccaacaacaacggcaccuacgccugcuucgucuccaaccucgccaccggccgcaacaacuccaucgucaaguccaucaccgucuccgccuccggcaccucccccggccucuccgccggcgccaccgucggcaucaugaucggcguccucgucggcgucgcccucaucuga

SEQ ID NO: 41158 - RNA, 1035 nt, Artificial Sequence
  derived and/or modified sequence opt2 from CEACAM6__Homo_sapiens__NP_002474
augggcccccccuccgccccccccugccgccuccacguccccuggaaggagguccuccucaccgccucccuccucaccuucuggaacccccccaccaccgccaagcucaccaucgaguccacccccuucaacgucgccgagggcaaggagguccuccuccucgcccacaaccucccccagaaccgcaucggcuacuccugguacaagggcgagcgcgucgacggcaacucccucaucgucggcuacgucaucggcacccagcaggccacccccggccccgccuacuccggccgcgagaccaucuaccccaacgccucccuccucauccagaacgucacccagaacgacaccggcuucuacacccuccaggucaucaaguccgaccucgucaacgaggaggccaccggccaguuccacgucuaccccgagcuccccaagcccuccaucuccuccaacaacuccaaccccgucgaggacaaggacgccgucgccuucaccugcgagcccgagguccagaacaccaccuaccucuggugggucaacggccagucccuccccgucuccccccgccuccagcucuccaacggcaacaugacccucacccuccucuccgucaagcgcaacgacgccggcuccuacgagugcgagauccagaaccccgccuccgccaaccgcuccgaccccgucacccucaacguccucuacggccccgacguccccaccaucucccccuccaaggccaacuaccgccccggcgagaaccucaaccucuccugccacgccgccuccaacccccccgcccaguacuccugguucaucaacggcaccuuccagcaguccacccaggagcucuucauccccaacaucaccgucaacaacuccggcuccuacaugugccaggcccacaacuccgccaccggccucaaccgcaccaccgucaccaugaucaccgucuccggcuccgcccccguccucuccgccgucgccaccgucggcaucaccaucggcguccucgcccgcgucgcccucaucuga

SEQ ID NO: 41159 - RNA, 798 nt, Artificial Sequence
  derived and/or modified sequence opt2 from CEACAM7__Homo_sapiens__NP_001278414
augggcucccccuccgccugccccuaccgcgucugcauccccuggcagggccuccuccucaccgccucccuccucaccuucuggaaccuccccaacuccgcccagaccaacaucgacgucguccccuucaacgucgccgagggcaaggagguccuccucgucguccacaacgagucccagaaccucuacggcuacaacugguacaagggcgagcgcguccacgccaacuaccgcaucaucggcuacgucaagaacaucucccaggagaacgcccccggccccgcccacaacggccgcgagaccaucuaccccaacggcacccuccucauccagaacgucacccacaacgacgccggcaucuacacccuccacgucaucaaggagaaccucgucaacgaggaggucacccgccaguucuacgucuucuccgagccccccaagcccuccaucaccuccaacaacuucaaccccgucgagaacaaggacaucgucguccucaccugccagcccgagacccagaacaccaccuaccucuggugggucaacaaccagucccuccucgucuccccccgccuccuccucuccaccgacaaccgcacccucguccuccucuccgccaccaagaacgacaucggccccuacgagugcgagauccagaaccccgucggcgccucccgcuccgaccccgucacccucaacguccgcuacgaguccguccaggccuccucccccgaccucuccgccggcaccgccgucuccaucaugaucggcguccucgccggcauggcccucaucuga

SEQ ID NO: 41160 - RNA, 1050 nt, Artificial Sequence
  derived and/or modified sequence opt2 from CEACAM8__Homo_sapiens__NP_001807
augggccccaucuccgcccccuccugccgcuggcgcauccccuggcagggccuccuccucaccgccucccucuucaccuucuggaacccccccaccaccgcccagcucaccaucgaggccguccccuccaacgccgccgagggcaaggagguccuccuccucguccacaaccucccccaggacccccgcggcuacaacugguacaagggcgagaccgucgacgccaaccgccgcaucaucggcuacgucaucuccaaccagcagaucacccccggccccgccuacuccaaccgcgagaccaucuaccccaacgccucccuccucaugcgcaacgucacccgcaacgacaccggcuccuacacccuccaggucaucaagcucaaccucauguccgaggaggucaccggccaguucuccguccaccccgagacccccaagcccuccaucuccuccaacaacuccaaccccgucgaggacaaggacgccgucgccuucaccugcgagcccgagacccagaacaccaccuaccucuggugggucaacggccagucccuccccgucuccccccgccuccagcucuccaacggcaaccgcacccucacccuccucuccgucacccgcaacgacgucggccccuacgagugcgagauccagaaccccgccuccgccaacuucuccgaccccgucacccucaacguccucuacggccccgacgcccccaccaucucccccuccgacaccuacuaccacgccggcgucaaccucaaccucuccugccacgccgccuccaacccccccucccaguacuccugguccgucaacggcaccuuccagcaguacacccagaagcucuucauccccaacaucaccaccaagaacuccggcuccuacgccugccacaccaccaacuccgccaccggccgcaaccgcaccaccguccgcaugaucaccgucuccgacgcccucguccagggcuccucccccggccucuccgcccgcgccaccgucuccaucaugaucggcguccucgcccgcgucgcccucaucuga

SEQ ID NO: 41161 - RNA, 1182 nt, Artificial Sequence
  derived and/or modified sequence opt2 from CEBPA__Homo_sapiens__NP_001274353
augcgcggccgcggccgcgccggcucccccggcggccgccgccgccgccccgcccaggccggcggccgccgcggcucccccugccgcgagaacuccaacucccccauggaguccgccgacuucuacgaggccgagccccgcccccccauguccucccaccuccagucccccccccacgcccccuccuccgccgccuucggcuucccccgcggcgccggccccgcccagccccccgccccccccgccgcccccgagccccucggcggcaucugcgagcacgagaccuccaucgacaucuccgccuacaucgaccccgccgccuucaacgacgaguuccucgccgaccucuuccagcacucccgccagcaggagaaggccaaggccgccgucggccccaccggcggcggcggcggcggcgacuucgacuaccccggcgcccccgccggccccggcggcgccgucaugcccggcggcgcccacggccccccccccggcuacggcugcgccgccgccggcuaccucgacggccgccucgagccccucuacgagcgcgucggcgcccccgcccuccgcccccucgucaucaagcaggagccccgcgaggaggacgaggccaagcagcucgcccucgccggccucuuccccuaccagcccccccccccccccccccccucccacccccacccccaccccccccccgcccaccucgccgccccccaccuccaguuccagaucgcccacugcggccagaccaccaugcaccuccagcccggccaccccacccccccccccacccccguccccuccccccaccccgcccccgcccucggcgccgccggccuccccggccccggcuccgcccucaagggccucggcgccgcccaccccgaccuccgcgccuccggcggcuccggcgccggcaaggccaagaaguccgucgacaagaacuccaacgaguaccgcguccgccgcgagcgcaacaacaucgccguccgcaagucccgcgacaaggccaagcagcgcaacgucgagacccagcagaagguccucgagcucaccuccgacaacgaccgccuccgcaagcgcgucgagcagcucucccgcgagcucgacacccuccgcggcaucuuccgccagcuccccgaguccucccucgucaaggccaugggcaacugcgccuga

SEQ ID NO: 41162 - RNA, 1038 nt, Artificial Sequence
  derived and/or modified sequence opt2 from CEBPB__Homo_sapiens__NP_005185
augcagcgccucgucgccugggaccccgccugccucccccuccccccccccccccccgccuucaaguccauggaggucgccaacuucuacuacgaggccgacugccucgccgccgccuacggcggcaaggccgcccccgccgccccccccgccgcccgccccggcccccgcccccccgccggcgagcucggcuccaucggcgaccacgagcgcgccaucgacuucucccccuaccucgagccccucggcgccccccaggcccccgcccccgccaccgccaccgacaccuucgaggccgccccccccgcccccgcccccgcccccgccuccuccggccagcaccacgacuuccucuccgaccucuucuccgacgacuacggcggcaagaacugcaagaagcccgccgaguacggcuacgucucccucggccgccucggcgccgccaagggcgcccuccaccccggcugcuucgccccccuccaccccccccccccccccccccccccccccgccgagcucaaggccgagcccggcuucgagcccgccgacugcaagcgcaaggaggaggccggcgcccccggcggcggcgccggcauggccgccggcuuccccuacgcccuccgcgccuaccucggcuaccaggccguccccuccggcuccuccggcucccucuccaccuccuccuccuccuccccccccggcacccccucccccgccgacgccaaggccccccccaccgccugcuacgccggcgccgcccccgcccccucccaggucaaguccaaggccaagaagaccgucgacaagcacuccgacgaguacaagauccgccgcgagcgcaacaacaucgccguccgcaagucccgcgacaaggccaagaugcgcaaccucgagacccagcacaagguccucgagcucaccgccgagaacgagcgccuccagaagaaggucgagcagcucucccgcgagcucuccacccuccgcaaccucuucaagcagcuccccgagccccuccucgccuccuccggccacugcuga

SEQ ID NO: 41163 - RNA, 810 nt, Artificial Sequence
  derived and/or modified sequence opt2 from CEBPD__Homo_sapiens__NP_005186
auguccgccgcccucuucucccucgacggccccgcccgcggcgcccccuggcccgccgagcccgcccccuucuacgagcccggccgcgccggcaagcccggccgcggcgccgagcccggcgcccucggcgagcccggcgccgccgcccccgccauguacgacgacgaguccgccaucgacuucuccgccuacaucgacuccauggccgccguccccacccucgagcucugccacgacgagcucuucgccgaccucuucaacuccaaccacaaggccggcggcgccggcccccucgagcuccuccccggcggccccgcccgcccccucggccccggccccgccgccccccgccuccucaagcgcgagcccgacuggggcgacggcgacgcccccggcucccuccuccccgcccaggucgccgccugcgcccagaccgucgucucccucgccgccgccggccagcccaccccccccaccucccccgagcccccccgcuccuccccccgccagacccccgcccccggccccgcccgcgagaaguccgccggcaagcgcggccccgaccgcggcucccccgaguaccgccagcgccgcgagcgcaacaacaucgccguccgcaagucccgcgacaaggccaagcgccgcaaccaggagaugcagcagaagcucgucgagcucuccgccgagaacgagaagcuccaccagcgcgucgagcagcucacccgcgaccucgccggccuccgccaguucuucaagcagcuccccuccccccccuuccuccccgccgccggcaccgccgacugccgcuga

SEQ ID NO: 41164 - RNA, 846 nt, Artificial Sequence
  derived and/or modified sequence opt2 from CEBPE__Homo_sapiens__NP_001796
augucccacggcaccuacuacgagugcgagccccgcggcggccagcagccccucgaguucuccggcggccgcgccggccccggcgagcucggcgacaugugcgagcacgaggccuccaucgaccucuccgccuacaucgaguccggcgaggagcagcuccucuccgaccucuucgccgucaagcccgcccccgaggcccgcggccucaagggccccggcacccccgccuucccccacuaccucccccccgacccccgccccuucgccuaccccccccacaccuucggccccgaccgcaaggcccucggccccggcaucuacuccucccccggcuccuacgacccccgcgccgucgccgucaaggaggagccccgcggccccgagggcucccgcgccgccucccgcggcuccuacaacccccuccaguaccaggucgcccacugcggccagaccgccaugcaccucccccccacccucgccgcccccggccagccccuccgcguccucaaggccccccucgccaccgccgccccccccugcuccccccuccucaaggcccccucccccgccggcccccuccacaagggcaagaaggccgucaacaaggacucccucgaguaccgccuccgccgcgagcgcaacaacaucgccguccgcaagucccgcgacaaggccaagcgccgcauccucgagacccagcagaagguccucgaguacauggccgagaacgagcgccuccgcucccgcgucgagcagcucacccaggagcucgacacccuccgcaaccucuuccgccagauccccgaggccgccaaccucaucaagggcgucggcggcugcuccuga

SEQ ID NO: 41165 - RNA, 453 nt, Artificial Sequence
  derived and/or modified sequence opt2 from CEBPG__Homo_sapiens__NP_001239225
auguccaagaucucccagcagaacuccacccccggcgucaacggcaucuccgucauccacacccaggcccacgccuccggccuccagcaggucccccagcucguccccgccggccccggcggcggcggcaaggccgucgcccccuccaagcaguccaagaaguccucccccauggaccgcaacuccgacgaguaccgccagcgccgcgagcgcaacaacauggccgucaagaagucccgccucaaguccaagcagaaggcccaggacacccuccagcgcgucaaccagcucaaggaggagaacgagcgccucgaggccaagaucaagcuccucaccaaggagcucuccguccucaaggaccucuuccucgagcacgcccacaaccucgccgacaacguccaguccaucuccaccgagaacaccaccgccgacggcgacaacgccggccaguga

SEQ ID NO: 41166 - RNA, 3165 nt, Artificial Sequence
  derived and/or modified sequence opt2 from CEBPZ__Homo_sapiens__NP_005751
auggccgccgucaaggagccccucgaguuccacgccaagcgccccuggcgccccgaggaggccgucgaggaccccgacgaggaggacgaggacaacaccuccgaggccgagaacggcuucucccucgaggagguccuccgccucggcggcaccaagcaggacuaccucaugcucgccacccucgacgagaacgaggaggucaucgacggcggcaagaagggcgccaucgacgaccuccagcagggcgagcucgaggccuucauccagaaccucaaccucgccaaguacaccaaggccucccucgucgaggaggacgagcccgccgagaaggagaacuccuccaagaaggaggucaagauccccaagaucaacaacaagaacaccgccgagucccagcgcaccuccgucaacaaggucaagaacaagaaccgccccgagccccacuccgacgagaacggcuccaccacccccaaggucaagaaggacaagcagaacaucuucgaguucuucgagcgccagacccuccuccuccgccccggcggcaagugguacgaccucgaguacuccaacgaguacucccucaagccccagccccaggacgucgucuccaaguacaagacccucgcccagaagcucuaccagcacgagaucaaccucuucaaguccaagaccaacucccagaagggcgccuccuccaccuggaugaaggccaucgucuccuccggcacccucggcgaccgcauggccgccaugauccuccucauccaggacgacgccguccacacccuccaguucgucgagacccucgucaaccucgucaagaagaagggcuccaagcagcagugccucauggcccucgacaccuucaaggagcuccucaucaccgaccuccuccccgacaaccgcaagcuccgcaucuucucccagcgccccuucgacaagcucgagcagcucuccuccggcaacaaggacucccgcgaccgccgccucauccucugguacuucgagcaccagcucaagcaccucgucgccgaguucguccagguccucgagacccucucccacgacacccucgucaccaccaagacccgcgcccucaccgucgcccacgagcuccucugcaacaagcccgaggaggagaaggcccuccucguccaggucgucaacaagcucggcgacccccagaaccgcaucgccaccaaggccucccaccuccucgagacccuccucugcaagcaccccaacaugaagggcgucgucuccggcgaggucgagcgccuccucuuccgcuccaacaucuccuccaaggcccaguacuacgccaucugcuuccucaaccagauggcccucucccacgaggaguccgagcucgccaacaagcucaucaccgucuacuucugcuucuuccgcaccugcgucaagaagaaggacgucgaguccaagaugcucuccgcccuccucaccggcgucaaccgcgccuaccccuacucccagaccggcgacgacaagguccgcgagcagaucgacacccucuucaagguccuccacaucgucaacuucaacaccuccguccaggcccucaugcuccucuuccaggucaugaacucccagcagaccaucuccgaccgcuacuacaccgcccucuaccgcaagaugcucgaccccggccucaugaccugcuccaagcaggccauguuccucaaccucgucuacaagucccucaaggccgacaucguccuccgccgcgucaaggccuucgucaagcgccuccuccaggucaccugccagcagaugccccccuucaucugcggcgcccucuaccucgucuccgagauccucaaggccaagcccggccuccgcucccagcucgacgaccaccccgaguccgacgacgaggagaacuucaucgacgccaacgacgacgaggacauggagaaguucaccgacgccgacaaggagaccgagaucgucaagaagcucgagaccgaggagaccguccccgagaccgacgucgagaccaagaagcccgaggucgccuccuggguccacuucgacaaccucaagggcggcaagcagcucaacaaguacgaccccuucucccgcaacccccucuucugcggcgccgagaacaccucccucugggagcucaagaagcucuccguccacuuccaccccuccgucgcccucuucgccaagaccauccuccagggcaacuacauccaguacuccggcgacccccuccaggacuucacccucaugcgcuuccucgaccgcuucgucuaccgcaaccccaagccccacaagggcaaggagaacaccgacuccgucgucaugcagcccaagcgcaagcacuucaucaaggacauccgccaccuccccgucaacuccaaggaguuccucgccaaggaggagucccagauccccgucgacgaggucuucuuccaccgcuacuacaagaaggucgccgucaaggagaagcagaagcgcgacgccgacgaggaguccaucgaggacgucgacgacgaggaguucgaggagcucaucgacaccuucgaggacgacaacugcuucuccuccggcaaggacgacauggacuucgccggcaacgucaagaagcgcaccaagggcgccaaggacaacacccucgacgaggacuccgagggcuccgacgacgagcucggcaaccucgacgacgacgaggucucccucggcuccauggacgacgaggaguucgccgaggucgacgaggacggcggcaccuucauggacguccucgacgacgaguccgaguccguccccgagcucgagguccacuccaaggucuccaccaagaaguccaagcgcaagggcaccgacgacuucgacuucgccggcuccuuccagggcccccgcaagaagaagcgcaaccucaacgacuccucccucuucgucuccgccgaggaguucggccaccuccucgacgagaacaugggcuccaaguucgacaacaucggcaugaacgccauggccaacaaggacaacgccucccucaagcagcuccgcugggaggccgagcgcgacgacuggcuccacaaccgcgacgccaaguccaucaucaagaagaagaagcacuucaagaagaagcgcaucaagaccacccagaagaccaagaagcagcgcaaguga

SEQ ID NO: 41167 - RNA, 813 nt, Artificial Sequence
  derived and/or modified sequence opt2 from CECR1__Homo_sapiens__NP_803124
auggacucccucgaguggaacugggcccucgucuacgagcucuccggcgagcaccacgacgaggagugguccgucaagaccuaccaggaggucgcccagaaguucgucgagacccaccccgaguucaucggcaucaagaucaucuacuccgaccaccgcuccaaggacgucgccgucaucgccgaguccauccgcauggccaugggccuccgcaucaaguuccccaccgucgucgccggcuucgaccucgucggccacgaggacaccggccacucccuccacgacuacaaggaggcccucaugauccccgccaaggacggcgucaagcuccccuacuucuuccacgccggcgagaccgacuggcagggcaccuccaucgaccgcaacauccucgacgcccucaugcucaacaccacccgcaucggccacggcuucgcccucuccaagcaccccgccguccgcaccuacuccuggaagaaggacauccccaucgaggucugccccaucuccaaccagguccucaagcucgucuccgaccuccgcaaccaccccgucgccacccucauggccaccggccaccccauggucaucuccuccgacgaccccgccauguucggcgccaagggccucuccuacgacuucuacgaggucuucaugggcaucggcggcaugaaggccgaccuccgcacccucaagcagcucgccaugaacuccaucaaguacuccacccuccucgaguccgagaagaacaccuucauggagaucuggaagaagcgcugggacaaguucaucgccgacgucgccaccaaguga

SEQ ID NO: 41168 - RNA, 4395 nt, Artificial Sequence
  derived and/or modified sequence opt2 from CECR2__Homo_sapiens__NP_001276976
augugccccgaggagggcggcgccgccggccucggcgagcuccgcuccuggugggagguccccgccaucgcccacuucugcucccucuuccgcaccgccuuccgccuccccgacuucgagaucgaggagcucgaggccgcccuccaccgcgacgacgucgaguucaucuccgaccucaucgccugccuccuccagggcugcuaccagcgccgcgacaucaccccccagaccuuccacuccuaccucgaggacaucaucaacuaccgcugggagcucgaggagggcaagcccaacccccuccgcgaggccuccuuccaggaccucccccuccgcacccgcgucgagauccuccaccgccucugcgacuaccgccucgacgccgacgacgucuucgaccuccucaagggccucgacgccgacucccuccgcgucgagccccucggcgaggacaacuccggcgcccucuacugguacuucuacggcacccgcauguacaaggaggaccccguccagggcaaguccaacggcgagcucucccucucccgcgaguccgagggccagaagaacgucuccuccauccccggcaagaccggcaagcgccgcggccgcccccccaagcgcaagaagcuccaggaggagauccuccucuccgagaagcaggaggagaacucccucgccuccgagccccagacccgccacggcucccagggccccggccagggcaccugguggcuccucugccagaccgaggaggaguggcgccaggucaccgaguccuuccgcgagcgcaccucccuccgcgagcgccagcucuacaagcuccucuccgaggacuuccuccccgagaucugcaacaugaucgcccagaagggcaagcgcccccagcgcaccaaggccgagcuccacccccgcuggauguccgaccaccucuccaucaagcccgucaagcaggaggagacccccguccucacccgcaucgagaagcagaagcgcaaggaggaggaggaggagcgccagauccuccucgccguccagaagaaggagcaggagcagaugcucaaggaggagcgcaagcgcgagcucgaggagaaggucaaggccgucgaggaccgcgccaagcgccgcaagcuccgcgaggagcgcgccuggcuccucgcccagggcaaggagcucccccccgagcucucccaccucgaccccaacucccccaugcgcgaggagaagaagaccaaggaccucuucgagcucgacgacgacuucaccgccauguacaagguccucgacgucgucaaggcccacaaggacuccuggcccuuccucgagcccgucgacgaguccuacgcccccaacuacuaccagaucaucaaggcccccauggacaucuccuccauggagaagaagcucaacggcggccucuacugcaccaaggaggaguucgucaacgacaugaagaccauguuccgcaacugccgcaaguacaacggcgaguccuccgaguacaccaagauguccgacaaccucgagcgcugcuuccaccgcgccaugaugaagcacuuccccggcgaggacggcgacaccgacgaggaguucuggauccgcgaggacgagaagcgcgagaagcgccgcucccgcgccggccgcuccggcggcucccacgucuggacccgcucccgcgaccccgagggcuccucccgcaagcagcagcccauggagaacggcggcaagucccucccccccacccgccgcgcccccuccuccggcgacgaccaguccuccuccuccacccagcccccccgcgaggucggcaccuccaacggccgcggcuucucccacccccuccacugcggcggcacccccucccaggcccccuuccucaaccagaugcgccccgccguccccggcaccuucggcccccuccgcggcuccgaccccgccacccucuacggcuccuccggcguccccgagccccaccccggcgagcccguccagcagcgccagcccuucaccaugcagccccccgucggcaucaacucccuccgcggcccccgccucggcacccccgaggagaagcagaugugcggcggccucacccaccucuccaacaugggcccccaccccggcucccuccagcucggccagaucuccggccccucccaggacggcuccauguacgcccccgcccaguuccagcccggcuucauccccccccgccacggcggcgcccccgcccgcccccccgacuuccccgaguccuccgagaucccccccucccacauguaccgcuccuacaaguaccucaaccgcguccacuccgccgucuggaacggcaaccacggcgccaccaaccagggcccccucggccccgacgagaagccccaccucggccccggccccucccaccagccccgcacccucggccacgucauggacucccgcgucaugcgcccccccgucccccccaaccaguggaccgagcaguccggcuuccucccccacggcguccccuccuccggcuacaugcgcccccccugcaaguccgccggccaccgccuccagcccccccccguccccgcccccuccucccucuucggcgcccccgcccaggcccuccgcggcguccagggcggcgacuccaugauggacucccccgagaugaucgccaugcagcagcucuccucccgcgucugcccccccggcguccccuaccacccccaccagcccgcccacccccgccuccccggccccuucccccaggucgcccaccccauguccgucaccgucuccgcccccaagcccgcccucggcaaccccggccgcgcccccgagaacuccgaggcccaggagcccgagaacgaccaggccgagccccuccccggccucgaggagaagccccccggcgucggcaccuccgagggcgucuaccucacccagcucccccaccccacccccccccuccagaccgacugcacccgccaguccuccccccaggagcgcgagaccgucggccccgagcucaaguccuccuccuccgaguccgccgacaacugcaaggccaugaagggcaagaaccccuggcccuccgacuccuccuaccccggccccgccgcccagggcugcguccgcgaccucuccaccgucgccgaccgcggcgcccucuccgagaacggcgucaucggcgaggccucccccugcggcuccgagggcaagggccucggcuccuccggcuccgagaagcuccucugcccccgcggccgcacccuccaggagaccaugcccugcaccggccagaacgccgccaccccccccuccaccgaccccggccucaccggcggcaccgucucccaguuccccccccucuacaugcccggccucgaguaccccaacuccgccgcccacuaccacaucucccccggccuccagggcgucggccccgucaugggcggcaagucccccgccucccacccccagcacuuccccccccgcggcuuccaguccaaccacccccacuccggcggcuucccccgcuaccgccccccccagggcaugcgcuacuccuaccacccccccccccagcccuccuaccaccacuaccagcgcacccccuacuacgccugcccccaguccuucuccgacuggcagcgcccccuccacccccagggcucccccuccggcccccccgccucccagcccccccccccccgcucccucuucuccgacaagaacgccauggccucccuccagggcugcgagacccucaacgccgcccucaccucccccacccgcauggacgccgucgccgccaagguccccaacgacggccagaaccccggccccgaggaggagaagcucgacgaguccauggagcgccccgagucccccaaggaguuccucgaccucgacaaccacaacgccgccaccaagcgccaguccucccucuccgccuccgaguaccucuacggcaccccccccccccucuccuccggcaugggcuucggcuccuccgccuuccccccccacuccgucaugcuccagaccggcccccccuacaccccccagcgccccgccucccacuuccagccccgcgccuacuccucccccgucgccgcccuccccccccaccaccccggcgccacccagcccaacggccucucccaggagggccccaucuaccgcugccaggaggagggccucggccacuuccaggccgucaugauggagcagaucggcacccgcuccggcauccgcggccccuuccaggagauguaccgccccuccggcaugcagaugcaccccguccagucccaggccuccuuccccaagacccccaccgccgccaccucccaggaggagguccccccccacaagccccccacccucccccucgaccaguccuga

SEQ ID NO: 41169 - RNA, 777 nt, Artificial Sequence
  derived and/or modified sequence opt2 from CELA1__Homo_sapiens__NP_001962
augcucguccucuacggccacuccacccaggaccuccccgagaccaacgcccgcgucgucggcggcaccgaggccggccgcaacuccuggcccucccagaucucccuccaguaccgcuccggcggcucccgcuaccacaccugcggcggcacccucauccgccagaacugggucaugaccgccgcccacugcgucgacuaccagaagaccuuccgcgucgucgccggcgaccacaaccucucccagaacgacggcaccgagcaguacgucuccguccagaagaucgucguccaccccuacuggaacuccgacaacgucgccgccggcuacgacaucgcccuccuccgccucgcccaguccgucacccucaacuccuacguccagcucggcguccucccccaggagggcgccauccucgccaacaacucccccugcuacaucaccggcuggggcaagaccaagaccaacggccagcucgcccagacccuccagcaggccuaccuccccuccgucgacuacgccaucugcuccuccuccuccuacuggggcuccaccgucaagaacaccauggucugcgccggcggcgacggcguccgcuccggcugccagggcgacuccggcggcccccuccacugccucgucaacggcaaguacuccguccacggcgucaccuccuucgucuccucccgcggcugcaacgucucccgcaagcccaccgucuucacccaggucuccgccuacaucuccuggaucaacaacgucaucgccuccaacuga

SEQ ID NO: 41170 - RNA, 882 nt, Artificial Sequence
  derived and/or modified sequence opt2 from CELA3B__Homo_sapiens__XP_011539434
augaugcuccgccuccucuccucccuccuccucgucgccgucgccuccggcuacggcccccccuccucccgccccuccucccgcgucgucaacggcgaggacgccguccccuacuccuggcccuggcaggucucccuccaguacgagaaguccggcuccuucuaccacaccugcggcggcucccucaucgcccccgacugggucgucaccgccggccacugcaucuccuccucccgcaccuaccaggucguccucggcgaguacgaccgcgccgucaaggagggccccgagcaggucauccccaucaacuccggcgaccucuucguccacccccucuggaaccgcuccugcgucgccugcggcaacgacaucgcccucaucaagcucucccgcuccgcccagcucggcgacgccguccagcucgccucccucccccccgccggcgacauccuccccaacgagacccccugcuacaucaccggcuggggccgccucuacaccaacggcccccuccccgacaagcuccaggaggcccuccuccccgucgucgacuacgagcacugcucccgcuggaacugguggggcuccuccgucaagaagaccauggucugcgccggcggcgacauccgcuccggcugcaacggcgacuccggcggcccccucaacugccccaccgaggacggcggcuggcagguccacggcgucaccuccuucgucuccgccuucggcugcaacacccgccgcaagcccaccgucuucacccgcgucuccgccuucaucgacuggaucgaggagggccucugccgcauggagaccacccucgccugccuccccggcucccagaagcuccagggcaacaaggcccccgagucccgcaccuga

SEQ ID NO: 41171 - RNA, 1539 nt, Artificial Sequence
  derived and/or modified sequence opt2 from CELF1__Homo_sapiens__NP_001166110
auggccgccuucaagcucgacuuccuccccgagaugauggucgaccacugcucccucaacuccucccccgucuccaagaagaugaacggcacccucgaccaccccgaccagcccgaccucgacgccaucaagauguucgucggccaggucccccgcaccugguccgagaaggaccuccgcgagcucuucgagcaguacggcgccgucuacgagaucaacguccuccgcgaccgcucccagaaccccccccaguccaagggcugcugcuucgucaccuucuacacccgcaaggccgcccucgaggcccagaacgcccuccacaacaugaagguccuccccggcaugcaccaccccauccagaugaagcccgccgacuccgagaagaacaacgucgaggaccgcaagcucuucaucggcaugaucuccaagaagugcaccgagaacgacauccgcgucauguucuccuccuucggccagaucgaggagugccgcauccuccgcggccccgacggccucucccgcggcugcgccuucgucaccuucaccacccgcgccauggcccagaccgccaucaaggccaugcaccaggcccagaccauggagggcugcuccucccccauggucgucaaguucgccgacacccagaaggacaaggagcagaagcgcauggcccagcagcuccagcagcagaugcagcagaucuccgccgccuccgucuggggcaaccucgccggccucaacacccucggcccccaguaccucgcccucuaccuccagcuccuccagcagaccgccuccuccggcaaccucaacacccucuccucccuccaccccaugggcggccucaacgccaugcagcuccagaaccucgccgcccucgccgccgccgccuccgccgcccagaacacccccuccggcaccaacgcccucaccaccuccuccuccccccucuccguccucaccuccuccggcuccucccccuccuccuccuccuccaacuccgucaaccccaucgccucccucggcgcccuccagacccucgccggcgccaccgccggccucaacgucggcucccucgccggcauggccgcccucaacggcggccucggcuccuccggccucuccaacggcaccggcuccaccauggaggcccucacccaggccuacuccggcauccagcaguacgccgccgccgcccuccccacccucuacaaccagaaccuccucacccagcaguccaucggcgccgccggcucccagaaggagggccccgagggcgccaaccucuucaucuaccaccucccccaggaguucggcgaccaggaccuccuccagauguucaugcccuucggcaacgucgucuccgccaaggucuucaucgacaagcagaccaaccucuccaagugcuucggcuucgucuccuacgacaaccccgucuccgcccaggccgccauccaguccaugaacggcuuccagaucggcaugaagcgccucaagguccagcucaagcgcuccaagaacgacuccaagcccuacuga

SEQ ID NO: 41172 - RNA, 1473 nt, Artificial Sequence
  derived and/or modified sequence opt2 from CELF2__Homo_sapiens__NP_001020247
augaacggcgcccucgaccacuccgaccagcccgaccccgacgccaucaagauguucgucggccagaucccccgcuccugguccgagaaggagcucaaggagcucuucgagcccuacggcgccgucuaccagaucaacguccuccgcgaccgcucccagaaccccccccaguccaagggcugcugcuucgucaccuucuacacccgcaaggccgcccucgaggcccagaacgcccuccacaacaucaagacccuccccggcaugcaccaccccauccagaugaagcccgccgacuccgagaaguccaacgccgucgaggaccgcaagcucuucaucggcauggucuccaagaagugcaacgagaacgacauccgcgucauguucucccccuucggccagaucgaggagugccgcauccuccgcggccccgacggccucucccgcggcugcgccuucgucaccuucuccacccgcgccauggcccagaacgccaucaaggccaugcaccagucccagaccauggagggcugcuccucccccaucgucgucaaguucgccgacacccagaaggacaaggagcagcgccgccuccagcagcagcucgcccagcagaugcagcagcucaacaccgccaccuggggcaaccucaccggccucggcggccucaccccccaguaccucgcccuccuccagcaggccaccuccuccuccaaccucggcgccuucuccggcauccagcagauggccggcaugaacgcccuccagcuccagaaccucgccacccucgccgccgccgccgccgccgcccagaccuccgccaccuccaccaacgccaacccccucuccaccaccuccuccgcccucggcgcccucaccucccccgucgccgccuccacccccaacuccaccgccggcgccgccaugaacucccucaccucccucggcacccuccagggccucgccggcgccaccgucggccucaacaacaucaacgcccucgccgucgcccagaugcucuccggcauggccgcccucaacggcggccucggcgccaccggccucaccaacggcaccgccggcaccauggacgcccucacccaggccuacuccggcauccagcaguacgccgccgccgcccuccccacccucuacucccagucccuccuccagcagcaguccgccgccggcucccagaaggagggccccgagggcgccaaccucuucaucuaccaccucccccaggaguucggcgaccaggacauccuccagauguucaugcccuucggcaacgucaucuccgccaaggucuucaucgacaagcagaccaaccucuccaagugcuucggcuucgucuccuacgacaaccccgucuccgcccaggccgccauccaggccaugaacggcuuccagaucggcaugaagcgccucaagguccagcucaagcgcuccaagaacgacuccaagcccuacuga

SEQ ID NO: 41173 - RNA, 1458 nt, Artificial Sequence
  derived and/or modified sequence opt2 from CELF4__Homo_sapiens__NP_001020258
auguacaucaagauggccacccucgccaacggccaggccgacaacgccucccucuccaccaacggccucggcuccucccccggcuccgccggccacaugaacggccucucccacucccccggcaaccccuccaccauccccaugaaggaccacgacgccaucaagcucuucaucggccagaucccccgcaaccucgacgagaaggaccucaagccccucuucgaggaguucggcaagaucuacgagcucaccguccucaaggaccgcuucaccggcaugcacaagggcugcgccuuccucaccuacugcgagcgcgaguccgcccucaaggcccaguccgcccuccacgagcagaagacccuccccggcaugaaccgccccauccaggucaagcccgccgacuccgagucccgcggcggcuccuccugccuccgccagccccccucccaggaccgcaagcucuucgucggcaugcucaacaagcagcaguccgaggacgacguccgccgccucuucgaggccuucggcaacaucgaggagugcaccauccuccgcggccccgacggcaacuccaagggcugcgccuucgucaaguacuccucccacgccgaggcccaggccgccaucaacgcccuccacggcucccagaccaugcccggcgccuccuccucccucgucgucaaguucgccgacaccgacaaggagcgcaccaugcgccgcaugcagcagauggccggccagaugggcauguucaaccccauggccauccccuucggcgccuacggcgccuacgcccaggccaugcagcagcaggccgcccucauggccuccgucgcccagggcggcuaccucaaccccauggccgccuucgccgccgcccagaugcagcagauggccgcccucaacaugaacggccucgccgccgcccccaugacccccaccuccggcggcuccaccccccccggcaucaccgcccccgccguccccuccauccccucccccaucggcgucaacggcuucaccggccuccccccccaggccaacggccagcccgccgccgaggccgucuucgccaacggcauccaccccuaccccgcccagucccccaccgccgccgacccccuccagcaggccuacgccggcguccagcaguacgccggccccgccgccuaccccgccgccuacggccagaucucccaggccuucccccagcccccccccaugaucccccagcagcagcgcgagggccccgagggcugcaaccucuucaucuaccaccucccccaggaguucggcgacgccgagcucaugcagauguuccuccccuucggcuucgucuccuucgacaaccccgccuccgcccagaccgccauccaggccaugaacggcuuccagaucggcaugaagcgccucaagguccagcucaagcgccccaaggacgccaaccgccccuacuga

SEQ ID NO: 41174 - RNA, 1230 nt, Artificial Sequence
  derived and/or modified sequence opt2 from CELF5__Homo_sapiens__NP_001166144
auggcccgccucaccgaguccgaggcccgccgccagcagcagcagcuccuccagccccgccccucccccgucggcuccuccggccccgagccccccggcggccagcccgacggcaugaaggaccucgacgccaucaagcucuucgucggccagaucccccgccaccucgacgagaaggaccucaagccccucuucgagcaguucggccgcaucuacgagcucaccguccucaaggaccccuacaccggcaugcacaagggcugcgccuuccucaccuacugcgcccgcgacuccgccaucaaggcccagaccgcccuccacgagcagaagacccuccccggcauggcccgccccauccaggucaagcccgccgacuccgagucccgcggcggccgcgaccgcaagcucuucgucggcaugcucaacaagcagcaguccgaggaggacguccuccgccucuuccagcccuucggcgucaucgacgagugcaccguccuccgcggccccgacggcuccuccaagggcugcgccuucgucaaguucuccucccacaccgaggcccaggccgccauccacgcccuccacggcucccagaccaugcccggcgccuccuccucccucgucgucaaguucgccgacaccgacaaggagcgcacccuccgccgcaugcagcagauggucggccagcucggcauccucacccccucccucacccuccccuucucccccuacuccgccuacgcccaggcccucaugcagcagcagaccaccguccucuccaccuccggcuccuaccucucccccggcgucgccuucucccccugccacauccagcagaucggcgccgucucccucaacggccuccccgccacccccaucgcccccgccuccggcgucguccccuuccccggcggccaccccgcccucgagaccgucuacgccaacggccucguccccuaccccgcccagucccccaccgucgccgagacccuccaccccgccuucuccggcguccagcaguacaccgccauguaccccaccgccgccaucacccccaucgcccacuccgucccccagccccccccccuccuccagcagcagcagcgcgagggcgucuggcgccacggcgccgacgccgacguccccacccuccgccaguaccacuuccuccagggcgucuacggcuccuccuaccagcccgagcaggucuuccgccuccgcgagcucuga

SEQ ID NO: 41175 - RNA, 1365 nt, Artificial Sequence
  derived and/or modified sequence opt2 from CELF6__Homo_sapiens__NP_001166155
auggccgccgcccccggcggcuccgcccagcccgccggccccggcccccgccucggcuucuccaccgccgacuccggcgucggcauguccggccucaaccccggccccgccguccccaugaaggaccacgacgccaucaagcucuucgucggccagaucccccgcggccucgacgagcaggaccucaagccccucuucgaggaguucggccgcaucuacgagcucaccguccucaaggaccgccucaccggccuccacaagggcugcgccuuccucaccuacugcgcccgcgacuccgcccucaaggcccaguccgcccuccacgagcagaagacccuccccggcaugaaccgccccauccaggucaagcccgccgccuccgagggccgcggcgaggaccgcaagcucuucgucggcaugcucggcaagcagcagggcgaggaggacguccgccgccucuuccagcccuucggccacaucgaggagugcaccguccuccgcucccccgacggcaccuccaagggcugcgccuucgucaaguucggcucccagggcgaggcccaggccgccauccgcggccuccacggcucccgcaccauggccggcgccuccuccucccucgucgucaagcucgccgacaccgaccgcgagcgcgcccuccgccgcaugcagcagauggccggccaccucggcgccuuccaccccgccccccucccccucggcgccugcggcgccuacaccaccgccauccuccagcaccaggccgcccuccucgccgccgcccagggccccggccucggccccgucgccgccgucgccgcccagaugcagcacgucgccgccuucucccucgucgccgccccccuccuccccgccgccgccgccaacuccccccccggcuccggccccggcacccuccccggccuccccgcccccaucggcgucaacggcuucggcccccucaccccccagaccaacggccagcccggcuccgacacccucuacaacaacggccucucccccuaccccgcccagucccccggcgucgccgacccccuccagcaggccuacgccggcaugcaccacuacgccggccccgagggcugcaaccucuucaucuaccaccucccccaggaguucggcgacgccgagcucauccagaccuuccuccccuucggcgccgucgucuccgccaaggucuucgucgaccgcgccaccaaccaguccaagugcuucggcuucgucuccuucgacaaccccaccuccgcccagaccgccauccaggccaugaacggcuuccagaucggcaugaagcgccucaagguccagcucaagcgccccaaggacgccaaccgccccuacuga

SEQ ID NO: 41176 - RNA, 2271 nt, Artificial Sequence
  derived and/or modified sequence opt2 from CEL__Homo_sapiens__NP_001798
augcucaccaugggccgccuccagcucgucguccucggccucaccugcugcugggccgucgccuccgccgccaagcucggcgccgucuacaccgagggcggcuucgucgagggcgucaacaagaagcucggccuccucggcgacuccgucgacaucuucaagggcauccccuucgccgcccccaccaaggcccucgagaacccccagccccaccccggcuggcagggcacccucaaggccaagaacuucaagaagcgcugccuccaggccaccaucacccaggacuccaccuacggcgacgaggacugccucuaccucaacaucugggucccccagggccgcaagcaggucucccgcgaccuccccgucaugaucuggaucuacggcggcgccuuccucaugggcuccggccacggcgccaacuuccucaacaacuaccucuacgacggcgaggagaucgccacccgcggcaacgucaucgucgucaccuucaacuaccgcgucggcccccucggcuuccucuccaccggcgacgccaaccuccccggcaacuacggccuccgcgaccagcacauggccaucgccugggucaagcgcaacaucgccgccuucggcggcgaccccaacaacaucacccucuucggcgaguccgccggcggcgccuccgucucccuccagacccucucccccuacaacaagggccucauccgccgcgccaucucccaguccggcgucgcccucucccccugggucauccagaagaacccccucuucugggccaagaaggucgccgagaaggucggcugccccgucggcgacgccgcccgcauggcccagugccucaaggucaccgacccccgcgcccucacccucgccuacaaggucccccucgccggccucgaguaccccaugcuccacuacgucggcuucguccccgucaucgacggcgacuucauccccgccgaccccaucaaccucuacgccaacgccgccgacaucgacuacaucgccggcaccaacaacauggacggccacaucuucgccuccaucgacaugcccgccaucaacaagggcaacaagaaggucaccgaggaggacuucuacaagcucgucuccgaguucaccaucaccaagggccuccgcggcgccaagaccaccuucgacgucuacaccgaguccugggcccaggaccccucccaggagaacaagaagaagaccgucgucgacuucgagaccgacguccucuuccucguccccaccgagaucgcccucgcccagcaccgcgccaacgccaaguccgccaagaccuacgccuaccucuucucccaccccucccgcaugcccgucuaccccaagugggucggcgccgaccacgccgacgacauccaguacgucuucggcaagcccuucgccacccccaccggcuaccgcccccaggaccgcaccgucuccaaggccaugaucgccuacuggaccaacuucgccaagaccggcgaccccaacaugggcgacuccgccguccccacccacugggagcccuacaccaccgagaacuccggcuaccucgagaucaccaagaagaugggcuccuccuccaugaagcgcucccuccgcaccaacuuccuccgcuacuggacccucaccuaccucgcccuccccaccgucaccgaccaggaggccacccccgucccccccaccggcgacuccgaggccacccccgucccccccaccggcgacuccgagaccgcccccgucccccccaccggcgacuccggcgccccccccgucccccccaccggcgacuccggcgccccccccgucccccccaccggcgacuccggcgccccccccgucccccccaccggcgacuccggcgccccccccgucccccccaccggcgacuccggcgccccccccgucccccccaccggcgacuccggcgccccccccgucccccccaccggcgacuccggcgccccccccgucccccccaccggcgacuccggcgccccccccgucccccccaccggcgacgccggccccccccccgucccccccaccggcgacuccggcgccccccccgucccccccaccggcgacuccggcgccccccccgucacccccaccggcgacuccgagaccgcccccgucccccccaccggcgacuccggcgccccccccgucccccccaccggcgacuccgaggccgcccccgucccccccaccgacgacuccaaggaggcccagaugcccgccgucauccgcuucuga

SEQ ID NO: 41177 - RNA, 9045 nt, Artificial Sequence
  derived and/or modified sequence opt2 from CELSR1__Homo_sapiens__NP_055061
auggcccccccccccccccccguccuccccguccuccuccuccucgccgccgccgccgcccuccccgccaugggccuccgcgccgccgccugggagccccgcguccccggcggcacccgcgccuucgcccuccgccccggcugcaccuacgccgucggcgccgccugcaccccccgcgccccccgcgagcuccucgacgucggccgcgacggccgccucgccggccgccgccgcgucuccggcgccggccgcccccucccccuccagguccgccucgucgcccgcuccgcccccaccgcccucucccgccgccuccgcgcccgcacccaccuccccggcugcggcgcccgcgcccgccucugcggcaccggcgcccgccucugcggcgcccucugcuuccccguccccggcggcugcgccgccgcccagcacuccgcccucgccgcccccaccacccuccccgccugccgcugccccccccgcccccgcccccgcugccccggccgccccaucugccucccccccggcggcuccguccgccuccgccuccucugcgcccuccgccgcgccgccggcgccguccgcgucggccucgcccucgaggccgccaccgccggcacccccuccgccucccccucccccucccccccccucccccccaaccuccccgaggcccgcgccggccccgcccgccgcgcccgccgcggcaccuccggccgcggcucccucaaguuccccaugcccaacuaccaggucgcccucuucgagaacgagcccgccggcacccucauccuccagcuccacgcccacuacaccaucgagggcgaggaggagcgcgucuccuacuacauggagggccucuucgacgagcgcucccgcggcuacuuccgcaucgacuccgccaccggcgccgucuccaccgacuccguccucgaccgcgagaccaaggagacccacguccuccgcgucaaggccgucgacuacuccacccccccccgcuccgccaccaccuacaucaccguccucgucaaggacaccaacgaccacucccccgucuucgagcaguccgaguaccgcgagcgcguccgcgagaaccucgaggucggcuacgagguccucaccauccgcgccuccgaccgcgacucccccaucaacgccaaccuccgcuaccgcguccucggcggcgccugggacgucuuccagcucaacgaguccuccggcgucgucuccacccgcgccguccucgaccgcgaggaggccgccgaguaccagcuccucgucgaggccaacgaccagggccgcaaccccggcccccucuccgccaccgccaccgucuacaucgaggucgaggacgagaacgacaacuacccccaguucuccgagcagaacuacgucguccagguccccgaggacgucggccucaacaccgccguccuccgcguccaggccaccgaccgcgaccagggccagaacgccgccauccacuacuccauccucuccggcaacgucgccggccaguucuaccuccacucccucuccggcauccucgacgucaucaacccccucgacuucgaggacguccagaaguacucccucuccaucaaggcccaggacggcggccgccccccccucaucaacuccuccggcgucgucuccguccagguccucgacgucaacgacaacgagcccaucuucgucuccucccccuuccaggccaccguccucgagaacgucccccucggcuaccccgucguccacauccaggccgucgacgccgacuccggcgagaacgcccgccuccacuaccgccucgucgacaccgccuccaccuuccucggcggcggcuccgccggccccaagaaccccgcccccacccccgacuuccccuuccagauccacaacuccuccggcuggaucaccgucugcgccgagcucgaccgcgaggaggucgagcacuacuccuucggcgucgaggccgucgaccacggcuccccccccauguccuccuccaccuccgucuccaucaccguccucgacgucaacgacaacgaccccgucuucacccagcccaccuacgagcuccgccucaacgaggacgccgccgucggcuccuccguccucacccuccaggcccgcgaccgcgacgccaacuccgucaucaccuaccagcucaccggcggcaacacccgcaaccgcuucgcccucuccucccagcgcggcggcggccucaucacccucgcccucccccucgacuacaagcaggagcagcaguacguccucgccgucaccgccuccgacggcacccgcucccacaccgcccacguccucaucaacgucaccgacgccaacacccaccgccccgucuuccaguccucccacuacaccgucuccgucuccgaggaccgccccgucggcaccuccaucgccacccucuccgccaacgacgaggacaccggcgagaacgcccgcaucaccuacgucauccaggaccccgucccccaguuccgcaucgaccccgacuccggcaccauguacaccaugauggagcucgacuacgagaaccaggucgccuacacccucaccaucauggcccaggacaacggcaucccccagaaguccgacaccaccacccucgagauccucauccucgacgccaacgacaacgccccccaguuccucugggacuucuaccagggcuccaucuucgaggacgccccccccuccaccuccauccuccaggucuccgccaccgaccgcgacuccggccccaacggccgccuccucuacaccuuccagggcggcgacgacggcgacggcgacuucuacaucgagcccaccuccggcgucauccgcacccagcgccgccucgaccgcgagaacgucgccgucuacaaccucugggcccucgccgucgaccgcggcucccccaccccccucuccgccuccgucgagauccaggucaccauccucgacaucaacgacaacgcccccauguucgagaaggacgagcucgagcucuucgucgaggagaacaaccccgucggcuccgucgucgccaagauccgcgccaacgaccccgacgagggccccaacgcccagaucauguaccagaucgucgagggcgacaugcgccacuucuuccagcucgaccuccucaacggcgaccuccgcgccauggucgagcucgacuucgagguccgccgcgaguacguccucgucguccaggccaccuccgccccccucgucucccgcgccaccguccacauccuccucgucgaccagaacgacaacccccccguccuccccgacuuccagauccucuucaacaacuacgucaccaacaaguccaacuccuuccccaccggcgucaucggcugcauccccgcccacgaccccgacgucuccgacucccucaacuacaccuucguccagggcaacgagcuccgccuccuccuccucgaccccgccaccggcgagcuccagcucucccgcgaccucgacaacaaccgcccccucgaggcccucauggaggucuccgucuccgacggcauccacuccgucaccgccuucugcacccuccgcgucaccaucaucaccgacgacaugcucaccaacuccaucaccguccgccucgagaacaugucccaggagaaguuccucuccccccuccucgcccucuucgucgagggcgucgccgccguccucuccaccaccaaggacgacgucuucgucuucaacguccagaacgacaccgacgucuccuccaacauccucaacgucaccuucuccgcccuccuccccggcggcguccgcggccaguucuuccccuccgaggaccuccaggagcagaucuaccucaaccgcacccuccucaccaccaucuccacccagcgcguccuccccuucgacgacaacaucugccuccgcgagcccugcgagaacuacaugaagugcgucuccguccuccgcuucgacuccuccgcccccuuccucuccuccaccaccguccucuuccgccccauccaccccaucaacggccuccgcugccgcugcccccccggcuucaccggcgacuacugcgagaccgagaucgaccucugcuacuccgaccccugcggcgccaacggccgcugccgcucccgcgagggcggcuacaccugcgagugcuucgaggacuucaccggcgagcacugcgaggucgacgcccgcuccggccgcugcgccaacggcgucugcaagaacggcggcaccugcgucaaccuccucaucggcggcuuccacugcgucugcccccccggcgaguacgagcgccccuacugcgaggucaccacccgcuccuuccccccccaguccuucgucaccuuccgcggccuccgccagcgcuuccacuucaccaucucccucaccuucgccacccaggagcgcaacggccuccuccucuacaacggccgcuucaacgagaagcacgacuucaucgcccucgagaucgucgacgagcagguccagcucaccuucuccgccggcgagaccaccaccaccgucgcccccaagguccccuccggcgucuccgacggccgcuggcacuccguccagguccaguacuacaacaagcccaacaucggccaccucggccucccccacggccccuccggcgagaagauggccgucgucaccgucgacgacugcgacaccaccauggccguccgcuucggcaaggacaucggcaacuacuccugcgccgcccagggcacccagaccggcuccaagaagucccucgaccucaccggcccccuccuccucggcggcguccccaaccuccccgaggacuuccccguccacaaccgccaguucgucggcugcaugcgcaaccucuccgucgacggcaagaacgucgacauggccggcuucaucgccaacaacggcacccgcgagggcugcgccgcccgccgcaacuucugcgacggccgccgcugccagaacggcggcaccugcgucaaccgcuggaacauguaccucugcgagugcccccuccgcuucggcggcaagaacugcgagcaggccaugccccacccccagcucuucuccggcgaguccgucgucuccugguccgaccucaacaucaucaucuccguccccugguaccucggccucauguuccgcacccgcaaggaggacuccguccucauggaggccaccuccggcggccccaccuccuuccgccuccagauccucaacaacuaccuccaguucgaggucucccacggccccuccgacgucgaguccgucaugcucuccggccuccgcgucaccgacggcgaguggcaccaccuccucaucgagcucaagaacgucaaggaggacuccgagaugaagcaccucgucaccaugacccucgacuacggcauggaccagaacaaggccgacaucggcggcaugcuccccggccucaccguccgcuccgucgucgucggcggcgccuccgaggacaaggucuccguccgccgcggcuuccgcggcugcaugcagggcguccgcaugggcggcacccccaccaacgucgccacccucaacaugaacaacgcccucaagguccgcgucaaggacggcugcgacgucgacgaccccugcaccuccucccccugcccccccaacucccgcugccacgacgccugggaggacuacuccugcgucugcgacaagggcuaccucggcaucaacugcgucgacgccugccaccucaaccccugcgagaacaugggcgccugcguccgcucccccggcuccccccagggcuacgucugcgagugcggccccucccacuacggccccuacugcgagaacaagcucgaccuccccugcccccgcggcugguggggcaaccccgucugcggccccugccacugcgccgucuccaagggcuucgaccccgacugcaacaagaccaacggccagugccagugcaaggagaacuacuacaagcuccucgcccaggacaccugccuccccugcgacugcuucccccacggcucccacucccgcaccugcgacauggccaccggccagugcgccugcaagcccggcgucaucggccgccagugcaaccgcugcgacaaccccuucgccgaggucaccacccucggcugcgaggucaucuacaacggcugccccaaggccuucgaggccggcaucugguggccccagaccaaguucggccagcccgccgccguccccugccccaagggcuccgucggcaacgccguccgccacugcuccggcgagaagggcuggcucccccccgagcucuucaacugcaccaccaucuccuucgucgaccuccgcgccaugaacgagaagcucucccgcaacgagacccaggucgacggcgcccgcgcccuccagcucguccgcgcccuccgcuccgccacccagcacaccggcacccucuucggcaacgacguccgcaccgccuaccagcuccucggccacguccuccagcacgaguccuggcagcagggcuucgaccucgccgccacccaggacgccgacuuccacgaggacgucauccacuccggcuccgcccuccucgcccccgccacccgcgccgccugggagcagauccagcgcuccgagggcggcaccgcccagcuccuccgccgccucgagggcuacuucuccaacgucgcccgcaacguccgccgcaccuaccuccgccccuucgucaucgucaccgccaacaugauccucgccgucgacaucuucgacaaguucaacuucaccggcgcccgcgucccccgcuucgacaccauccacgaggaguucccccgcgagcucgaguccuccgucuccuuccccgccgacuucuuccgcccccccgaggagaaggagggcccccuccuccgccccgccggccgccgcaccaccccccagaccacccgccccggccccggcaccgagcgcgaggcccccaucucccgccgccgccgccaccccgacgacgccggccaguucgccgucgcccucgucaucaucuaccgcacccucggccagcuccuccccgagcgcuacgaccccgaccgccgcucccuccgccucccccaccgccccaucaucaacacccccauggucuccacccucgucuacuccgagggcgccccccucccccgcccccucgagcgccccguccucgucgaguucgcccuccucgaggucgaggagcgcaccaagcccgucugcgucuucuggaaccacucccucgccgucggcggcaccggcggcugguccgcccgcggcugcgagcuccucucccgcaaccgcacccacgucgccugccagugcucccacaccgccuccuucgccguccucauggacaucucccgccgcgagaacggcgagguccucccccucaagaucgucaccuacgccgccgucucccucucccucgccgcccuccucgucgccuucguccuccucucccucguccgcaugcuccgcuccaaccuccacuccauccacaagcaccucgccgucgcccucuuccucucccagcucgucuucgucaucggcaucaaccagaccgagaaccccuuccucugcaccgucgucgccauccuccuccacuacaucuacauguccaccuucgccuggacccucgucgagucccuccacgucuaccgcaugcucaccgagguccgcaacaucgacaccggccccaugcgcuucuacuacgucgucggcuggggcauccccgccaucgucaccggccucgccgucggccucgacccccagggcuacggcaaccccgacuucugcuggcucucccuccaggacacccucaucugguccuucgccggccccaucggcgccgucaucaucaucaacaccgucaccuccguccucuccgccaaggucuccugccagcgcaagcaccacuacuacggcaagaagggcaucgucucccuccuccgcaccgccuuccuccuccuccuccucaucuccgccaccuggcuccucggccuccucgccgucaaccgcgacgcccucuccuuccacuaccucuucgccaucuucuccggccuccagggccccuucguccuccucuuccacugcguccucaaccaggagguccgcaagcaccucaagggcguccucggcggccgcaagcuccaccucgaggacuccgccaccacccgcgccacccuccucacccgcucccucaacugcaacaccaccuucggcgacggccccgacaugcuccgcaccgaccucggcgaguccaccgccucccucgacuccaucguccgcgacgagggcauccagaagcucggcgucuccuccggccucguccgcggcucccacggcgagcccgacgccucccucaugccccgcuccugcaaggacccccccggccacgacuccgacuccgacuccgagcucucccucgacgagcaguccuccuccuacgccuccucccacuccuccgacuccgaggacgacggcgucggcgccgaggagaagugggaccccgcccgcggcgccguccacuccacccccaagggcgacgccgucgccaaccacguccccgccggcuggcccgaccagucccucgccgaguccgacuccgaggaccccuccggcaagccccgccucaaggucgagaccaaggucuccgucgagcuccaccgcgaggagcagggcucccaccgcggcgaguacccccccgaccaggaguccggcggcgccgcccgccucgccuccucccagccccccgagcagcgcaagggcauccucaagaacaaggucaccuacccccccccccucacccucaccgagcagacccucaagggccgccuccgcgagaagcucgccgacugcgagcagucccccaccuccucccgcaccuccucccucggcuccggcggccccgacugcgccaucaccgucaagucccccggccgcgagcccggccgcgaccaccucaacggcgucgccaugaacguccgcaccggcuccgcccaggccgacggcuccgacuccgagaagcccuga

SEQ ID NO: 41178 - RNA, 9939 nt, Artificial Sequence
  derived and/or modified sequence opt2 from CELSR3__Homo_sapiens__NP_001398
augauggcccgccgcccccccuggcgcggccucggcggccgcuccacccccauccuccuccuccuccuccucucccucuucccccucucccaggaggagcucggcggcggcggccaccagggcugggaccccggccucgccgccaccaccggcccccgcgcccacaucggcggcggcgcccucgcccucugccccgaguccuccggcguccgcgaggacggcggccccggccucggcguccgcgagcccaucuucgucggccuccgcggccgccgccaguccgcccgcaacucccgcggcccccccgagcagcccaacgaggagcucggcaucgagcacggcguccagccccucggcucccgcgagcgcgagaccggccagggccccggcuccguccucuacuggcgccccgaggucuccuccugcggccgcaccggcccccuccagcgcggcucccucucccccggcgcccucuccuccggcguccccggcuccggcaacuccuccccccuccccuccgacuuccucauccgccaccacggccccaagcccgucuccucccagcgcaacgccggcaccggcucccgcaagcgcgucggcaccgcccgcugcugcggcgagcucugggccaccggcuccaagggccagggcgagcgcgccaccaccuccggcgccgagcgcaccgccccccgccgcaacugccuccccggcgccuccggcuccggccccgagcucgacuccgccccccgcaccgcccgcaccgcccccgccuccggcuccgccccccgcgagucccgcaccgcccccgagcccgcccccaagcgcaugcgcucccgcggccucuuccgcugccgcuuccucccccagcgccccggcccccgcccccccggccuccccgcccgccccgaggcccgcaaggucaccuccgccaaccgcgcccgcuuccgccgcgccgccaaccgccacccccaguucccccaguacaacuaccagacccucguccccgagaacgaggccgccggcaccgccguccuccgcgucgucgcccaggaccccgacgccggcgaggccggccgccucgucuacucccucgccgcccucaugaacucccgcucccucgagcucuucuccaucgacccccaguccggccucauccgcaccgccgccgcccucgaccgcgaguccauggagcgccacuaccuccgcgucaccgcccaggaccacggcuccccccgccucuccgccaccaccauggucgccgucaccgucgccgaccgcaacgaccacucccccgucuucgagcaggcccaguaccgcgagacccuccgcgagaacgucgaggagggcuaccccauccuccagcuccgcgccaccgacggcgacgccccccccaacgccaaccuccgcuaccgcuucgucggcccccccgccgcccgcgccgccgccgccgccgccuucgagaucgacccccgcuccggccucaucuccaccuccggccgcgucgaccgcgagcacauggaguccuacgagcucgucgucgaggccuccgaccagggccaggagcccggcccccgcuccgccaccguccgcguccacaucaccguccucgacgagaacgacaacgccccccaguucuccgagaagcgcuacgucgcccagguccgcgaggacguccgcccccacaccgucguccuccgcgucaccgccaccgaccgcgacaaggacgccaacggccucguccacuacaacaucaucuccggcaacucccgcggccacuucgccaucgacucccucaccggcgagauccaggucgucgccccccucgacuucgaggccgagcgcgaguacgcccuccgcauccgcgcccaggacgccggccgccccccccucuccaacaacaccggccucgccuccauccaggucgucgacaucaacgaccacauccccaucuucgucuccacccccuuccaggucuccguccucgagaacgccccccucggccacuccgucauccacauccaggccgucgacgccgaccacggcgagaacgcccgccucgaguacucccucaccggcgucgcccccgacacccccuucgucaucaacuccgccaccggcugggucuccgucuccggcccccucgaccgcgaguccgucgagcacuacuucuucggcgucgaggcccgcgaccacggcucccccccccucuccgccuccgccuccgucaccgucaccguccucgacgucaacgacaaccgccccgaguucaccaugaaggaguaccaccuccgccucaacgaggacgccgccgucggcaccuccgucgucuccgucaccgccgucgaccgcgacgccaacuccgccaucuccuaccagaucaccggcggcaacacccgcaaccgcuucgccaucuccacccagggcggcgucggccucgucacccucgcccucccccucgacuacaagcaggagcgcuacuucaagcucguccucaccgccuccgaccgcgcccuccacgaccacugcuacguccacaucaacaucaccgacgccaacacccaccgccccgucuuccaguccgcccacuacuccgucuccgucaacgaggaccgccccaugggcuccaccaucgucgucaucuccgccuccgacgacgacgucggcgagaacgcccgcaucaccuaccuccucgaggacaaccucccccaguuccgcaucgacgccgacuccggcgccaucacccuccaggccccccucgacuacgaggaccaggucaccuacacccucgccaucaccgcccgcgacaacggcaucccccagaaggccgacaccaccuacgucgaggucauggucaacgacgucaacgacaacgccccccaguucgucgccucccacuacaccggccucgucuccgaggacgccccccccuucaccuccguccuccagaucuccgccaccgaccgcgacgcccacgccaacggccgcguccaguacaccuuccagaacggcgaggacggcgacggcgacuucaccaucgagcccaccuccggcaucguccgcaccguccgccgccucgaccgcgaggccgucuccgucuacgagcucaccgccuacgccgucgaccgcggcguccccccccuccgcacccccgucuccauccaggucaugguccaggacgucaacgacaacgcccccgucuuccccgccgaggaguucgagguccgcgucaaggagaacuccaucgucggcuccgucgucgcccagaucaccgccgucgaccccgacgagggccccaacgcccacaucauguaccagaucgucgagggcaacauccccgagcucuuccagauggacaucuucuccggcgagcucaccgcccucaucgaccucgacuacgaggcccgccaggaguacgucaucgucguccaggccaccuccgccccccucgucucccgcgccaccguccacguccgccucgucgaccagaacgacaacucccccguccucaacaacuuccagauccucuucaacaacuacgucuccaaccgcuccgacaccuuccccuccggcaucaucggccgcauccccgccuacgaccccgacgucuccgaccaccucuucuacuccuucgagcgcggcaacgagcuccagcuccucgucgucaaccagaccuccggcgagcuccgccucucccgcaagcucgacaacaaccgcccccucgucgccuccaugcucgucaccgucaccgacggccuccacuccgucaccgcccagugcguccuccgcgucgucaucaucaccgaggagcuccucgccaacucccucaccguccgccucgagaacauguggcaggagcgcuuccucuccccccuccucggccgcuuccucgagggcgucgccgccguccucgccacccccgccgaggacgucuucaucuucaacauccagaacgacaccgacgucggcggcaccguccucaacgucuccuucuccgcccucgccccccgcggcgccggcgccggcgccgccggccccugguucuccuccgaggagcuccaggagcagcucuacguccgccgcgccgcccucgccgcccgcucccuccucgacguccuccccuucgacgacaacgucugccuccgcgagcccugcgagaacuacaugaagugcgucuccguccuccgcuucgacuccuccgcccccuuccucgccuccgccuccacccucuuccgccccauccagcccaucgccggccuccgcugccgcugcccccccggcuucaccggcgacuucugcgagaccgagcucgaccucugcuacuccaaccccugccgcaacggcggcgccugcgcccgccgcgagggcggcuacaccugcgucugccgcccccgcuucaccggcgaggacugcgagcucgacaccgaggccggccgcugcguccccggcgucugccgcaacggcggcaccugcaccgacgcccccaacggcggcuuccgcugccagugccccgccggcggcgccuucgagggcccccgcugcgaggucgccgcccgcuccuucccccccuccuccuucgucauguuccgcggccuccgccagcgcuuccaccucacccucucccucuccuucgccaccguccagcaguccggccuccucuucuacaacggccgccucaacgagaagcacgacuuccucgcccucgagcucgucgccggccagguccgccucaccuacuccaccggcgaguccaacaccgucgucucccccaccguccccggcggccucuccgacggccaguggcacaccguccaccuccgcuacuacaacaagccccgcaccgacgcccucggcggcgcccagggccccuccaaggacaaggucgccguccucuccgucgacgacugcgacgucgccgucgcccuccaguucggcgccgagaucggcaacuacuccugcgccgccgccggcguccagaccuccuccaagaagucccucgaccucaccggcccccuccuccucggcggcguccccaaccuccccgagaacuuccccgucucccacaaggacuucaucggcugcaugcgcgaccuccacaucgacggccgccgcgucgacauggccgccuucgucgccaacaacggcaccauggccggcugccaggccaagcuccacuucugcgacuccggccccugcaagaacuccggcuucugcuccgagcgcuggggcuccuucuccugcgacugccccgucggcuucggcggcaaggacugccagcucaccauggcccacccccaccacuuccgcggcaacggcacccucuccuggaacuucggcuccgacauggccgucuccguccccugguaccucggccucgccuuccgcacccgcgccacccagggcguccucaugcagguccaggccggcccccacuccacccuccucugccagcucgaccgcggccuccucuccgucaccgucacccgcggcuccggccgcgccucccaccuccuccucgaccaggucaccgucuccgacggccgcuggcacgaccuccgccucgagcuccaggaggagcccggcggccgccgcggccaccacguccucauggucucccucgacuucucccucuuccaggacaccauggccgucggcuccgagcuccagggccucaaggucaagcagcuccacgucggcggccucccccccggcuccgccgaggaggccccccagggccucgucggcugcauccagggcgucuggcucggcuccacccccuccggcucccccgcccuccucccccccucccaccgcgucaacgccgagcccggcugcgucgucaccaacgccugcgccuccggccccugccccccccacgccgacugccgcgaccucuggcagaccuucuccugcaccugccagcccggcuacuacggccccggcugcgucgacgccugccuccucaaccccugccagaaccagggcuccugccgccaccuccccggcgccccccacggcuacaccugcgacugcgucggcggcuacuucggccaccacugcgagcaccgcauggaccagcagugcccccgcggcugguggggcucccccaccugcggccccugcaacugcgacguccacaagggcuucgaccccaacugcaacaagaccaacggccagugccacugcaaggaguuccacuaccgcccccgcggcuccgacuccugccuccccugcgacugcuaccccgucggcuccaccucccgcuccugcgccccccacuccggccagugccccugccgccccggcgcccucggccgccagugcaacuccugcgacucccccuucgccgaggucaccgccuccggcugccgcguccucuacgacgccugccccaagucccuccgcuccggcgucugguggccccagaccaaguucggcguccucgccaccguccccugcccccgcggcgcccucggcgccgccguccgccucugcgacgaggcccagggcuggcucgagcccgaccucuucaacugcaccucccccgccuuccgcgagcucucccuccuccucgacggccucgagcucaacaagaccgcccucgacaccauggaggccaagaagcucgcccagcgccuccgcgaggucaccggccacaccgaccacuacuucucccaggacguccgcgucaccgcccgccuccucgcccaccuccucgccuucgagucccaccagcagggcuucggccucaccgccacccaggacgcccacuucaacgagaaccuccucugggccggcuccgcccuccucgcccccgagaccggcgaccucugggccgcccucggccagcgcgcccccggcggcucccccggcuccgccggccucguccgccaccucgaggaguacgccgccacccucgcccgcaacauggagcucaccuaccucaaccccaugggccucgucacccccaacaucaugcucuccaucgaccgcauggagcaccccuccuccccccgcggcgcccgccgcuacccccgcuaccacuccaaccucuuccgcggccaggacgccugggacccccacacccacguccuccuccccucccaguccccccgccccucccccuccgagguccuccccaccuccuccuccaucgagaacuccaccaccuccuccgucguccccccccccgccccccccgagcccgagcccggcaucuccaucaucauccuccucgucuaccgcacccucggcggccuccuccccgcccaguuccaggccgagcgccgcggcgcccgccucccccagaaccccgucaugaacucccccgucgucuccgucgccgucuuccacggccgcaacuuccuccgcggcauccucgagucccccaucucccucgaguuccgccuccuccagaccgccaaccgcuccaaggccaucugcguccagugggacccccccggccucgccgagcagcacggcgucuggaccgcccgcgacugcgagcucguccaccgcaacggcucccacgcccgcugccgcugcucccgcaccggcaccuucggcguccucauggacgccuccccccgcgagcgccucgagggcgaccucgagcuccucgccgucuucacccacgucgucgucgccgucuccgucgccgcccucguccucaccgccgccauccuccucucccuccgcucccucaaguccaacguccgcggcauccacgccaacgucgccgccgcccucggcgucgccgagcuccucuuccuccucggcauccaccgcacccacaaccagcucgucugcaccgccgucgccauccuccuccacuacuucuuccucuccaccuucgccuggcucuucguccagggccuccaccucuaccgcaugcaggucgagccccgcaacgucgaccgcggcgccaugcgcuucuaccacgcccucggcuggggcguccccgccguccuccucggccucgccgucggccucgaccccgagggcuacggcaaccccgacuucugcuggaucuccguccacgagccccucaucugguccuucgccggccccgucguccucgucaucgucaugaacggcaccauguuccuccucgccgcccgcaccuccugcuccaccggccagcgcgaggccaagaagaccuccgcccucacccuccgcuccuccuuccuccuccuccuccucgucuccgccuccuggcucuucggccuccucgccgucaaccacuccauccucgccuuccacuaccuccacgccggccucugcggccuccagggccucgccguccuccuccucuucugcguccucaacgccgacgcccgcgccgccuggaugcccgccugccucggccgcaaggccgcccccgaggaggcccgccccgcccccggccucggccccggcgccuacaacaacaccgcccucuucgaggaguccggccucauccgcaucacccucggcgccuccaccgucuccuccgucuccuccgcccgcuccggccgcacccaggaccaggacucccagcgcggccgcuccuaccuccgcgacaacguccucguccgccacggcuccgccgccgaccacaccgaccacucccuccaggcccacgccggccccaccgaccucgacgucgccauguuccaccgcgacgccggcgccgacuccgacuccgacuccgaccucucccucgaggaggagcgcucccucuccauccccuccuccgaguccgaggacaacggccgcacccgcggccgcuuccagcgcccccucugccgcgccgcccaguccgagcgccuccucacccaccccaaggacgucgacggcaacgaccuccucuccuacuggcccgcccucggcgagugcgaggccgcccccugcgcccuccagaccuggggcuccgagcgccgccucggccucgacaccuccaaggacgccgccaacaacaaccagcccgaccccgcccucaccuccggcgacgagaccucccucggccgcgcccagcgccagcgcaagggcauccucaagaaccgccuccaguacccccucgucccccagacccgcggcgcccccgagcucuccuggugccgcgccgccacccucggccaccgcgccguccccgccgccuccuacggccgcaucuacgccggcggcggcaccggcucccucucccagcccgccucccgcuacuccucccgcgagcagcucgaccuccuccuccgccgccagcucucccgcgagcgccucgaggaggcccccgcccccguccuccgcccccucucccgccccggcucccaggagugcauggacgccgcccccggccgccucgagcccaaggaccgcggcuccacccucccccgccgccagcccccccgcgacuaccccggcgccauggccggccgcuucggcucccgcgacgcccucgaccucggcgccccccgcgaguggcucuccacccucccccccccccgccgcacccgcgaccucgacccccagccccccccccucccccucuccccccagcgccagcucucccgcgacccccuccuccccucccgcccccucgacucccucucccgcuccuccaacucccgcgagcagcucgaccagguccccucccgccaccccucccgcgaggcccucggcccccucccccagcuccuccgcgcccgcgaggacuccgucuccggccccucccacggccccuccaccgagcagcucgacauccucuccuccauccucgccuccuucaacuccuccgcccucuccuccguccaguccuccuccaccccccucggcccccacaccaccgccacccccuccgccaccgccuccguccucggccccuccaccccccgcuccgccaccucccacuccaucuccgagcucucccccgacuccgaggucccccgcuccgagggccacuccuga

SEQ ID NO: 41179 - RNA, 4086 nt, Artificial Sequence
  derived and/or modified sequence opt2 from CEMIP__Homo_sapiens__NP_001280227
augggcgccgccggccgccaggacuuccucuucaaggccaugcucaccaucuccuggcucacccucaccugcuuccccggcgccaccuccaccgucgccgccggcugccccgaccagucccccgagcuccagcccuggaaccccggccacgaccaggaccaccacguccacaucggccagggcaagacccuccuccucaccuccuccgccaccgucuacuccauccacaucuccgagggcggcaagcucgucaucaaggaccacgacgagcccaucguccuccgcacccgccacauccucaucgacaacggcggcgagcuccacgccggcuccgcccucugccccuuccagggcaacuucaccaucauccucuacggccgcgccgacgagggcauccagcccgaccccuacuacggccucaaguacaucggcgucggcaagggcggcgcccucgagcuccacggccagaagaagcucuccuggaccuuccucaacaagacccuccaccccggcggcauggccgagggcggcuacuucuucgagcgcuccuggggccaccgcggcgucaucguccacgucaucgaccccaaguccggcaccgucauccacuccgaccgcuucgacaccuaccgcuccaagaaggaguccgagcgccucguccaguaccucaacgccguccccgacggccgcauccucuccgucgccgucaacgacgagggcucccgcaaccucgacgacauggcccgcaaggccaugaccaagcucggcuccaagcacuuccuccaccucggcuuccgccaccccugguccuuccucaccgucaagggcaaccccuccuccuccgucgaggaccacaucgaguaccacggccaccgcggcuccgccgccgcccgcgucuucaagcucuuccagaccgagcacggcgaguacuucaacgucucccucuccuccgaguggguccaggacgucgaguggaccgagugguucgaccacgacaaggucucccagaccaagggcggcgagaagaucuccgaccucuggaaggcccaccccggcaagaucugcaaccgccccaucgacauccaggccaccaccauggacggcgucaaccucuccaccgaggucgucuacaagaagggccaggacuaccgcuucgccugcuacgaccgcggccgcgccugccgcuccuaccgcguccgcuuccucugcggcaagcccguccgccccaagcucaccgucaccaucgacaccaacgucaacuccaccauccucaaccucgaggacaacguccaguccuggaagcccggcgacacccucgucaucgccuccaccgacuacuccauguaccaggccgaggaguuccagguccuccccugccgcuccugcgcccccaaccaggucaaggucgccggcaagcccauguaccuccacaucggcgaggagaucgacggcgucgacaugcgcgccgaggucggccuccucucccgcaacaucaucgucaugggcgagauggaggacaagugcuaccccuaccgcaaccacaucugcaacuucuucgacuucgacaccuucggcggccacaucaaguucgcccucggcuucaaggccgcccaccucgagggcaccgagcucaagcacaugggccagcagcucgucggccaguaccccauccacuuccaccucgccggcgacgucgacgagcgcggcggcuacgacccccccaccuacauccgcgaccucuccauccaccacaccuucucccgcugcgucaccguccacggcuccaacggccuccucaucaaggacgucgucggcuacaacucccucggccacugcuucuucaccgaggacggccccgaggagcgcaacaccuucgaccacugccucggccuccucgucaaguccggcacccuccuccccuccgaccgcgacuccaagaugugcaagaugaucaccgaggacuccuaccccggcuacauccccaagccccgccaggacugcaacgccgucuccaccuucuggauggccaaccccaacaacaaccucaucaacugcgccgccgccggcuccgaggagaccggcuucugguucaucuuccaccacguccccaccggccccuccgucggcauguacucccccggcuacuccgagcacaucccccucggcaaguucuacaacaaccgcgcccacuccaacuaccgcgccggcaugaucaucgacaacggcgucaagaccaccgaggccuccgccaaggacaagcgccccuuccucuccaucaucuccgcccgcuacuccccccaccaggacgccgacccccucaagccccgcgagcccgccaucauccgccacuucaucgccuacaagaaccaggaccacggcgccuggcuccgcggcggcgacgucuggcucgacuccugccgcuucgccgacaacggcaucggccucacccucgccuccggcggcaccuuccccuacgacgacggcuccaagcaggagaucaagaacucccucuucgucggcgaguccggcaacgucggcaccgagaugauggacaaccgcaucuggggccccggcggccucgaccacuccggccgcacccuccccaucggccagaacuuccccauccgcggcauccagcucuacgacggccccaucaacauccagaacugcaccuuccgcaaguucgucgcccucgagggccgccacaccuccgcccucgccuuccgccucaacaacgccuggcaguccugcccccacaacaacgucaccggcaucgccuucgaggacguccccaucaccucccgcgucuucuucggcgagcccggccccugguucaaccagcucgacauggacggcgacaagaccuccgucuuccacgacgucgacggcuccgucuccgaguaccccggcuccuaccucaccaagaacgacaacuggcucguccgccaccccgacugcaucaacguccccgacuggcgcggcgccaucugcuccggcugcuacgcccagauguacauccaggccuacaagaccuccaaccuccgcaugaagaucaucaagaacgacuuccccucccacccccucuaccucgagggcgcccucacccgcuccacccacuaccagcaguaccagcccgucgucacccuccagaagggcuacaccauccacugggaccagaccgcccccgccgagcucgccaucuggcucaucaacuucaacaagggcgacuggauccgcgucggccucugcuacccccgcggcaccaccuucuccauccucuccgacguccacaaccgccuccucaagcagaccuccaagaccggcgucuucguccgcacccuccagauggacaaggucgagcaguccuaccccggccgcucccacuacuacugggacgaggacuccggccuccucuuccucaagcucaaggcccagaacgagcgcgagaaguucgccuucugcuccaugaagggcugcgagcgcaucaagaucaaggcccucauccccaagaacgccggcgucuccgacugcaccgccaccgccuaccccaaguucaccgagcgcgccgucgucgacguccccaugcccaagaagcucuucggcucccagcucaagaccaaggaccacuuccucgaggucaagauggaguccuccaagcagcacuucuuccaccucuggaacgacuucgccuacaucgaggucgacggcaagaaguaccccuccuccgaggacggcauccaggucgucgucaucgacggcaaccagggccgcgucgucucccacaccuccuuccgcaacuccauccuccagggcauccccuggcagcucuucaacuacgucgccaccauccccgacaacuccaucguccucauggccuccaagggccgcuacgucucccgcggccccuggacccgcguccucgagaagcucggcgccgaccgcggccucaagcucaaggagcagauggccuucgucggcuucaagggcuccuuccgccccaucugggucacccucgacaccgaggaccacaaggccaagaucuuccaggucguccccauccccgucgucaagaagaagaagcucuga

SEQ ID NO: 41180 - RNA, 744 nt, Artificial Sequence
  derived and/or modified sequence opt2 from CEMP1__Homo_sapiens__NP_001041677
augggcaccuccuccaccgacucccagcaggccggccaccgccgcugcuccaccuccaacaccuccgccgagaaccucaccugccucucccuccccggcucccccggcaagaccgccccccuccccggccccgcccaggccggcgccggccagccccuccccaagggcugcgccgccgucaaggccgaggucggcauccccgccccccacaccucccaggagguccgcauccacauccgccgccuccucuccugggccgcccccggcgccugcggccuccgcuccacccccugcgcccucccccaggcccucccccaggcccgccccugccccggccgcugguucuuccccggcugcucccuccccaccggcggcgcccagaccauccucucccucuggaccuggcgccacuuccucaacugggcccuccagcagcgcgaggagaacuccggccgcgcccgccgcgucccccccgucccccgcaccgcccccgucuccaagggcgagggcucccaccccccccagaacuccaacggcgagaaggucaagaccaucacccccgacgucggccuccaccagucccucaccuccgaccccaccgucgccguccuccgcgccaagcgcgcccccgaggcccaccccccccgcuccugcuccggcucccucaccgcccgcgucugccacaugggcgucugccagggccagggcgacaccgaggacggccgcaugacccucaugggcuga

SEQ ID NO: 41181 - RNA, 450 nt, Artificial Sequence
  derived and/or modified sequence opt2 from CEND1__Homo_sapiens__NP_057648
auggagucccgcggcaaguccgccuccucccccaagcccgacaccaaggucccccaggucaccaccgaggccaaggucccccccgccgccgacggcaaggccccccucaccaagcccuccaagaaggaggcccccgccgagaagcagcagccccccgccgcccccaccaccgcccccgccaagaagaccuccgccaaggccgaccccgcccuccucaacaaccacuccaaccucaagcccgcccccaccguccccuccucccccgacgccacccccgagcccaagggccccggcgacggcgccgaggaggacgaggccgccuccggcggccccggcggccgcggccccugguccugcgagaacuucaacccccuccucgucgccggcggcgucgccgucgccgccaucgcccucauccucggcgucgccuuccucguccgcaagaaguga

SEQ ID NO: 41182 - RNA, 345 nt, Artificial Sequence
  derived and/or modified sequence opt2 from CENPA__Homo_sapiens__NP_001035891
augggcccccgccgccgcucccgcaagcccgaggccccccgccgccgcucccccucccccacccccacccccggccccucccgccgcggccccucccucggcgccuccucccaccagcacucccgccgccgccagggcuggcucaaggagauccgcaagcuccagaaguccacccaccuccucauccgcaagcuccccuucucccgccucgccgccgaggccuuccucguccaccucuucgaggacgccuaccuccucacccuccacgccggccgcgucacccucuuccccaaggacguccagcucgcccgccgcauccgcggccucgaggagggccucggcuga

SEQ ID NO: 41183 - RNA, 1800 nt, Artificial Sequence
  derived and/or modified sequence opt2 from CENPB__Homo_sapiens__NP_001801
augggccccaagcgccgccagcucaccuuccgcgagaagucccgcaucauccaggaggucgaggagaaccccgaccuccgcaagggcgagaucgcccgccgcuucaacaucccccccuccacccucuccaccauccucaagaacaagcgcgccauccucgccuccgagcgcaaguacggcgucgccuccaccugccgcaagaccaacaagcucucccccuacgacaagcucgagggccuccucaucgccugguuccagcagauccgcgccgccggccuccccgucaagggcaucauccucaaggagaaggcccuccgcaucgccgaggagcucggcauggacgacuucaccgccuccaacggcuggcucgaccgcuuccgccgccgccacggcgucgucuccugcuccggcgucgcccgcgcccgcgcccgcaacgccgccccccgcacccccgccgcccccgccucccccgccgccguccccuccgagggcuccggcggcuccaccaccggcuggcgcgcccgcgaggagcagccccccuccgucgccgagggcuacgccucccaggacgucuucuccgccaccgagaccucccucugguacgacuuccuccccgaccaggccgccggccucugcggcggcgacggccgcccccgccaggccacccagcgccucuccguccuccucugcgccaacgccgacggcuccgagaagcuccccccccucgucgccggcaaguccgccaagccccgcgccggccaggccggccuccccugcgacuacaccgccaacuccaagggcggcgucaccacccaggcccucgccaaguaccucaaggcccucgacacccgcauggccgccgagucccgccgcguccuccuccucgccggccgccucgccgcccagucccucgacaccuccggccuccgccacguccagcucgccuucuucccccccggcaccguccacccccucgagcgcggcgucguccagcaggucaagggccacuaccgccaggccaugcuccucaaggccauggccgcccucgagggccaggaccccuccggccuccagcucggccucaccgaggcccuccacuucgucgccgccgccuggcaggccgucgagcccuccgacaucgccgccugcuuccgcgaggccggcuucggcggcggccccaacgccaccaucaccaccucccucaaguccgagggcgaggaggaggaggaggaggaggaggaggaggaggaggaggagggcgagggcgaggaggaggaggaggagggcgaggaggaggaggaggagggcggcgagggcgaggagcucggcgaggaggaggaggucgaggaggagggcgacgucgacuccgacgaggaggaggaggaggacgaggaguccuccuccgagggccucgaggccgaggacugggcccagggcgucgucgaggccggcggcuccuucggcgccuacggcgcccaggaggaggcccagugccccacccuccacuuccucgagggcggcgaggacuccgacuccgacuccgaggaggaggacgacgaggaggaggacgacgaggacgaggacgacgacgacgacgaggaggacggcgacgagguccccguccccuccuucggcgaggccauggccuacuucgccauggucaagcgcuaccucaccuccuuccccaucgacgaccgcguccagucccacauccuccaccucgagcacgaccucguccacgucacccgcaagaaccacgcccgccaggccggcguccgcggccucggccaccaguccuga

SEQ ID NO: 41184 - RNA, 2832 nt, Artificial Sequence
  derived and/or modified sequence opt2 from CENPC__Homo_sapiens__NP_001803
auggccgccuccggccucgaccaccucaagaacggcuaccgccgccgcuucugccgccccucccgcgcccgcgacaucaacaccgagcagggccagaacguccucgagauccuccaggacugcuucgaggagaagucccucgccaacgacuucuccaccaacuccaccaaguccguccccaacuccacccgcaagaucaaggacaccugcauccagucccccuccaaggagugccagaagucccaccccaaguccguccccgucuccuccaagaagaaggaggccucccuccaguucgucgucgagcccuccgaggccaccaaccgcuccguccaggcccacgagguccaccagaagauccucgccaccgacgucuccuccaagaacacccccgacuccaagaagaucuccucccgcaacaucaacgaccaccacuccgaggccgacgaggaguucuaccucuccgucggcucccccuccguccuccucgacgccaagaccuccgucucccagaacgucauccccuccuccgcccagaagcgcgagaccuacaccuucgagaacuccgucaacaugcuccccuccuccaccgaggucuccgucaagaccaagaagcgccucaacuucgacgacaaggucaugcucaagaagaucgagaucgacaacaaggucuccgacgaggaggacaagaccuccgagggccaggagcgcaagcccuccggcuccucccagaaccgcauccgcgacuccgaguacgagauccagcgccaggccaagaaguccuucuccacccucuuccucgagaccgucaagcgcaaguccgaguccucccccaucguccgccacgccgccaccgcccccccccacuccugcccccccgacgacaccaagcucaucgaggacgaguucaucaucgacgaguccgaccaguccuucgccucccgcuccuggaucaccaucccccgcaaggccggcucccucaagcagcgcaccaucucccccgccgaguccaccgcccuccuccagggccgcaagucccgcgagaagcaccacaacauccuccccaagacccucgccaacgacaagcacucccacaagccccaccccgucgagaccucccagcccuccgacaagaccguccucgacaccuccuacgcccucaucggcgagaccgucaacaacuaccgcuccaccaaguacgagauguacuccaagaacgccgagaagcccucccgcuccaagcgcaccaucaagcagaagcagcgccgcaaguucauggccaagcccgccgaggagcagcucgacgucggccaguccaaggacgagaacauccacaccucccacaucacccaggacgaguuccagcgcaacuccgaccgcaacauggaggagcacgaggagaugggcaacgacugcgucuccaagaagcagaugccccccgucggcuccaagaaguccuccacccgcaaggacaaggaggaguccaagaagaagcgcuucuccuccgaguccaagaacaagcucguccccgaggaggucaccuccaccgucaccaagucccgccgcaucucccgccgccccuccgacuggugggucgucaaguccgaggagucccccgucuacuccaacuccuccguccgcaacgagcuccccaugcaccacaacuccucccgcaaguccaccaagaagaccaaccaguccuccaagaacauccgcaagaagaccaucccccucaagcgccagaagaccgccaccaagggcaaccagcgcguccagaaguuccucaacgccgagggcuccggcggcaucgucggccacgacgagaucucccgcugcucccucuccgagccccucgaguccgacgaggccgaccucgccaagaagaagaaccucgacugcucccgcuccacccgcuccuccaagaacgaggacaacaucaugaccgcccagaacgucccccucaagccccagaccuccggcuacaccugcaacauccccaccgaguccaaccucgacuccggcgagcacaagaccuccguccucgaggaguccggccccucccgccucaacaacaacuaccucauguccggcaagaacgacgucgacgacgaggagguccacggcuccuccgacgacuccaagcaguccaaggucauccccaagaaccgcauccaccacaagcucguccuccccuccaacacccccaacguccgccgcaccaagcgcacccgccucaagccccucgaguacuggcgcggcgagcgcaucgacuaccagggccgccccuccggcggcuucgucaucuccggcguccucucccccgacaccaucuccuccaagcgcaaggccaaggagaacaucggcaaggucaacaagaaguccaacaagaagcgcaucugccucgacaacgacgagcgcaagaccaaccucauggucaaccucggcaucccccucggcgacccccuccagcccacccgcgucaaggaccccgagacccgcgagaucauccucauggaccucguccgcccccaggacaccuaccaguucuucgucaagcacggcgagcucaaggucuacaagacccucgacacccccuucuucuccaccggcaagcucauccucggcccccaggaggagaagggcaagcagcacgucggccaggacauccucgucuucuacgucaacuucggcgaccuccucugcacccuccacgagacccccuacauccucuccaccggcgacuccuucuacguccccuccggcaacuacuacaacaucaagaaccuccgcaacgaggaguccguccuccucuucacccagaucaagcgcuga

SEQ ID NO: 41185 - RNA, 7743 nt, Artificial Sequence
  derived and/or modified sequence opt2 from CENPE__Homo_sapiens__NP_001273663
auggccgaggagggcgccgucgccgucugcguccgcguccgcccccucaacucccgcgaggagucccucggcgagaccgcccaggucuacuggaagaccgacaacaacgucaucuaccaggucgacggcuccaaguccuucaacuucgaccgcgucuuccacggcaacgagaccaccaagaacgucuacgaggagaucgccgcccccaucaucgacuccgccauccagggcuacaacggcaccaucuucgccuacggccagaccgccuccggcaagaccuacaccaugaugggcuccgaggaccaccucggcgucaucccccgcgccauccacgacaucuuccagaagaucaagaaguuccccgaccgcgaguuccuccuccgcgucuccuacauggagaucuacaacgagaccaucaccgaccuccucugcggcacccagaagaugaagccccucaucauccgcgaggacgucaaccgcaacgucuacgucgccgaccucaccgaggaggucgucuacaccuccgagauggcccucaaguggaucaccaagggcgagaagucccgccacuacggcgagaccaagaugaaccagcgcuccucccgcucccacaccaucuuccgcaugauccucgagucccgcgagaagggcgagcccuccaacugcgagggcuccgucaaggucucccaccucaaccucgucgaccucgccggcuccgagcgcgccgcccagaccggcgccgccggcguccgccucaaggagggcugcaacaucaaccgcucccucuucauccucggccaggucaucaagaagcucuccgacggccaggucggcggcuucaucaacuaccgcgacuccaagcucacccgcauccuccagaacucccucggcggcaacgccaagacccgcaucaucugcaccaucacccccgucuccuucgacgagacccucaccgcccuccaguucgccuccaccgccaaguacaugaagaacacccccuacgucaacgaggucuccaccgacgaggcccuccucaagcgcuaccgcaaggagaucauggaccucaagaagcagcucgaggaggucucccucgagacccgcgcccaggccauggagaaggaccagcucgcccagcuccucgaggagaaggaccuccuccagaagguccagaacgagaagaucgagaaccucacccgcaugcucgucaccuccuccucccucacccuccagcaggagcucaaggccaagcgcaagcgccgcgucaccuggugccucggcaagaucaacaagaugaagaacuccaacuacgccgaccaguucaacauccccaccaacaucaccaccaagacccacaagcucuccaucaaccuccuccgcgagaucgacgaguccgucugcuccgaguccgacgucuucuccaacacccucgacacccucuccgagaucgaguggaaccccgccaccaagcuccucaaccaggagaacaucgaguccgagcucaacucccuccgcgccgacuacgacaaccucguccucgacuacgagcagcuccgcaccgagaaggaggagauggagcucaagcucaaggagaagaacgaccucgacgaguucgaggcccucgagcgcaagaccaagaaggaccaggagaacgagcucuccuccaaggucgagcuccuccgcgagaaggaggaccagaucaagaagcuccaggaguacaucgacucccagaagcucgagaacaucaagauggaccucuccuacucccucgaguccaucgaggaccccaagcagaugaagcagacccucuucgacgccgagaccgucgcccucgacgccaagcgcgaguccgccuuccuccgcuccgagaaccucgagcucaaggagaagaugaaggagcucgccaccaccuacaagcagauggagaacgacauccagcucuaccagucccagcucgaggccaagaagaagaugcaggucgaccucgagaaggagcuccaguccgccuucaacgagaucaccaagcucaccucccucaucgacggcaagguccccaaggaccuccucugcaaccucgagcucgagggcaagaucaccgaccuccagaaggagcucaacaaggaggucgaggagaacgaggcccuccgcgaggaggucauccuccucuccgagcucaagucccuccccuccgaggucgagcgccuccgcaaggagauccaggacaaguccgaggagcuccacaucaucaccuccgagaaggacaagcucuucuccgaggucguccacaaggagucccgcguccagggccuccucgaggagaucggcaagaccaaggacgaccucgccaccacccaguccaacuacaaguccaccgaccaggaguuccagaacuucaagacccuccacauggacuucgagcagaaguacaagaugguccucgaggagaacgagcgcaugaaccaggagaucgucaaccucuccaaggaggcccagaaguucgacuccucccucggcgcccucaagaccgagcucuccuacaagacccaggagcuccaggagaagacccgcgagguccaggagcgccucaacgagauggagcagcucaaggagcagcucgagaaccgcgacuccacccuccagaccgucgagcgcgagaagacccucaucaccgagaagcuccagcagacccucgaggaggucaagacccucacccaggagaaggacgaccucaagcagcuccaggagucccuccagaucgagcgcgaccagcucaaguccgacauccacgacaccgucaacaugaacaucgacacccaggagcagcuccgcaacgcccucgagucccucaagcagcaccaggagaccaucaacacccucaaguccaagaucuccgaggaggucucccgcaaccuccacauggaggagaacaccggcgagaccaaggacgaguuccagcagaagauggucggcaucgacaagaagcaggaccucgaggccaagaacacccagacccucaccgccgacgucaaggacaacgagaucaucgagcagcagcgcaagaucuucucccucauccaggagaagaacgagcuccagcagaugcucgaguccgucaucgccgagaaggagcagcucaagaccgaccucaaggagaacaucgagaugaccaucgagaaccaggaggagcuccgccuccucggcgacgagcucaagaagcagcaggagaucgucgcccaggagaagaaccacgccaucaagaaggagggcgagcucucccgcaccugcgaccgccucgccgaggucgaggagaagcucaaggagaagucccagcagcuccaggagaagcagcagcagcuccucaacguccaggaggagauguccgagaugcagaagaagaucaacgagaucgagaaccucaagaacgagcucaagaacaaggagcucacccucgagcacauggagaccgagcgccucgagcucgcccagaagcucaacgagaacuacgaggaggucaaguccaucaccaaggagcgcaagguccucaaggagcuccagaaguccuucgagaccgagcgcgaccaccuccgcggcuacauccgcgagaucgaggccaccggccuccagaccaaggaggagcucaagaucgcccacauccaccucaaggagcaccaggagaccaucgacgagcuccgccgcuccgucuccgagaagaccgcccagaucaucaacacccaggaccucgagaagucccacaccaagcuccaggaggagauccccguccuccacgaggagcaggagcuccuccccaacgucaaggaggucuccgagacccaggagaccaugaacgagcucgagcuccucaccgagcaguccaccaccaaggacuccaccacccucgcccgcaucgagauggagcgccuccgccucaacgagaaguuccaggagucccaggaggagaucaagucccucaccaaggagcgcgacaaccucaagaccaucaaggaggcccucgaggucaagcacgaccagcucaaggagcacauccgcgagacccucgccaagauccaggagucccaguccaagcaggagcagucccucaacaugaaggagaaggacaacgagaccaccaagaucgucuccgagauggagcaguucaagcccaaggacuccgcccuccuccgcaucgagaucgagaugcucggccucuccaagcgccuccaggagucccacgacgagaugaaguccgucgccaaggagaaggacgaccuccagcgccuccaggagguccuccaguccgaguccgaccagcucaaggagaacaucaaggagaucgucgccaagcaccucgagaccgaggaggagcucaaggucgcccacugcugccucaaggagcaggaggagaccaucaacgagcuccgcgucaaccucuccgagaaggagaccgagaucuccaccauccagaagcagcucgaggccaucaacgacaagcuccagaacaagauccaggagaucuacgagaaggaggagcaguucaacaucaagcagaucuccgagguccaggagaaggucaacgagcucaagcaguucaaggagcaccgcaaggccaaggacuccgcccuccaguccaucgaguccaagaugcucgagcucaccaaccgccuccaggagucccaggaggagauccagaucaugaucaaggagaaggaggagaugaagcgcguccaggaggcccuccagaucgagcgcgaccagcucaaggagaacaccaaggagaucgucgccaagaugaaggagucccaggagaaggaguaccaguuccucaagaugaccgccgucaacgagacccaggagaagaugugcgagaucgagcaccucaaggagcaguucgagacccagaagcucaaccucgagaacaucgagaccgagaacauccgccucacccagauccuccacgagaaccucgaggagaugcgcuccgucaccaaggagcgcgacgaccuccgcuccgucgaggagacccucaaggucgagcgcgaccagcucaaggagaaccuccgcgagaccaucacccgcgaccucgagaagcaggaggagcucaagaucguccacaugcaccucaaggagcaccaggagaccaucgacaagcuccgcggcaucgucuccgagaagaccaacgagaucuccaacaugcagaaggaccucgagcacuccaacgacgcccucaaggcccaggaccucaagauccaggaggagcuccgcaucgcccacaugcaccucaaggagcagcaggagaccaucgacaagcuccgcggcaucgucuccgagaagaccgacaagcucuccaacaugcagaaggaccucgagaacuccaacgccaagcuccaggagaagauccaggagcucaaggccaacgagcaccagcucaucacccucaagaaggacgucaacgagacccagaagaaggucuccgagauggagcagcucaagaagcagaucaaggaccagucccucacccucuccaagcucgagaucgagaaccucaaccucgcccagaagcuccacgagaaccucgaggagaugaaguccgucaugaaggagcgcgacaaccuccgccgcgucgaggagacccucaagcucgagcgcgaccagcucaaggagucccuccaggagaccaaggcccgcgaccucgagauccagcaggagcucaagaccgcccgcaugcucuccaaggagcacaaggagaccgucgacaagcuccgcgagaagaucuccgagaagaccauccagaucuccgacauccagaaggaccucgacaaguccaaggacgagcuccagaagaagcaggaccgccagaaccaccaggucaagcccgagaagcgccuccucuccgacggccagcagcaccucaccgagucccuccgcgagaagugcucccgcaucaaggagcuccucaagcgcuacuccgagauggacgaccacuacgagugccucaaccgccucucccucgaccucgagaaggagaucgaguuccagaaggagcucuccaugcgcgucaaggccaaccucucccuccccuaccuccagaccaagcacaucgagaagcucuucaccgccaaccagcgcugcuccauggaguuccaccgcaucaugaagaagcucaaguacguccucuccuacgucaccaagaucaaggaggagcagcacgaguccaucaacaaguucgagauggacuucaucgacgaggucgagaagcagaaggagcuccucaucaagauccagcaccuccagcaggacugcgacguccccucccgcgagcuccgcgaccucaagcucaaccagaacauggaccuccacaucgaggagauccucaaggacuucuccgaguccgaguuccccuccaucaagaccgaguuccagcagguccucuccaaccgcaaggagaugacccaguuccucgaggaguggcucaacacccgcuucgacaucgagaagcucaagaacggcauccagaaggagaacgaccgcaucugccaggucaacaacuucuucaacaaccgcaucaucgccaucaugaacgaguccaccgaguucgaggagcgcuccgccaccaucuccaaggagugggagcaggaccucaagucccucaaggagaagaacgagaagcucuucaagaacuaccagacccucaagaccucccucgccuccggcgcccaggucaaccccaccacccaggacaacaagaacccccacgucaccucccgcgccacccagcucaccaccgagaagauccgcgagcucgagaacucccuccacgaggccaaggaguccgccaugcacaaggaguccaagaucaucaagaugcagaaggagcucgaggucaccaacgacaucaucgccaagcuccaggccaagguccacgaguccaacaagugccucgagaagaccaaggagaccauccagguccuccaggacaaggucgcccucggcgccaagcccuacaaggaggagaucgaggaccucaagaugaagcucgucaagaucgaccucgagaagaugaagaacgccaaggaguucgagaaggagaucuccgccaccaaggccaccgucgaguaccagaaggaggucauccgccuccuccgcgagaaccuccgccgcucccagcaggcccaggacaccuccgucaucuccgagcacaccgacccccagcccuccaacaagccccucaccugcggcggcggcuccggcaucguccagaacaccaaggcccucauccucaaguccgagcacauccgccucgagaaggagaucuccaagcucaagcagcagaacgagcagcucaucaagcagaagaacgagcuccucuccaacaaccagcaccucuccaacgaggucaagaccuggaaggagcgcacccucaagcgcgaggcccacaagcaggucaccugcgagaacucccccaagucccccaaggucaccggcaccgccuccaagaagaagcagaucacccccucccagugcaaggagcgcaaccuccaggaccccguccccaaggagucccccaaguccugcuucuucgacucccgcuccaagucccuccccuccccccaccccguccgcuacuucgacaacuccucccucggccucugccccgagguccagaacgccggcgccgaguccgucgacucccagcccggccccuggcacgccuccuccggcaaggacguccccgagugcaagacccaguga

SEQ ID NO: 41186 - RNA, 9345 nt, Artificial Sequence
  derived and/or modified sequence opt2 from CENPF__Homo_sapiens__NP_057427
auguccugggcccucgaggaguggaaggagggccuccccacccgcgcccuccagaagauccaggagcucgagggccagcucgacaagcucaagaaggagaagcagcagcgccaguuccagcucgacucccucgaggccgcccuccagaagcagaagcagaaggucgagaacgagaagaccgagggcaccaaccucaagcgcgagaaccagcgccucauggagaucugcgagucccucgagaagaccaagcagaagaucucccacgagcuccaggucaaggagucccaggucaacuuccaggagggccagcucaacuccggcaagaagcagaucgagaagcucgagcaggagcucaagcgcugcaaguccgagcucgagcgcucccagcaggccgcccaguccgccgacgucucccucaaccccugcaacaccccccagaagaucuucaccaccccccucacccccucccaguacuacuccggcuccaaguacgaggaccucaaggagaaguacaacaaggaggucgaggagcgcaagcgccucgaggccgaggucaaggcccuccaggccaagaaggccucccagacccucccccaggccaccaugaaccaccgcgacaucgcccgccaccaggccuccuccuccgucuucuccuggcagcaggagaagacccccucccaccucuccuccaacucccagcgcacccccauccgccgcgacuucuccgccuccuacuucuccggcgagcaggaggucacccccucccgcuccacccuccagaucggcaagcgcgacgccaacuccuccuucuucgacaacuccuccuccccccaccuccucgaccagcucaaggcccagaaccaggagcuccgcaacaagaucaacgagcucgagcuccgccuccagggccacgagaaggagaugaagggccaggucaacaaguuccaggagcuccagcuccagcucgagaaggccaaggucgagcucaucgagaaggagaagguccucaacaagugccgcgacgagcucguccgcaccaccgcccaguacgaccaggccuccaccaaguacaccgcccucgagcagaagcucaagaagcucaccgaggaccucuccugccagcgccagaacgccgaguccgcccgcugcucccucgagcagaagaucaaggagaaggagaaggaguuccaggaggagcucucccgccagcagcgcuccuuccagacccucgaccaggagugcauccagaugaaggcccgccucacccaggagcuccagcaggccaagaacaugcacaacguccuccaggccgagcucgacaagcucaccuccgucaagcagcagcucgagaacaaccucgaggaguucaagcagaagcucugccgcgccgagcaggccuuccaggccucccagaucaaggagaacgagcuccgccgcuccauggaggagaugaagaaggagaacaaccuccucaagucccacuccgagcagaaggcccgcgaggucugccaccucgaggccgagcucaagaacaucaagcagugccucaaccagucccagaacuucgccgaggagaugaaggccaagaacaccucccaggagaccaugcuccgcgaccuccaggagaagaucaaccagcaggagaacucccucacccucgagaagcucaagcucgccgucgccgaccucgagaagcagcgcgacugcucccaggaccuccucaagaagcgcgagcaccacaucgagcagcucaacgacaagcucuccaagaccgagaaggaguccaaggcccuccucuccgcccucgagcucaagaagaaggaguacgaggagcucaaggaggagaagacccucuucuccugcuggaaguccgagaacgagaagcuccucacccagauggaguccgagaaggagaaccuccaguccaagaucaaccaccucgagaccugccucaagacccagcagaucaagucccacgaguacaacgagcgcguccgcacccucgagauggaccgcgagaaccucuccgucgagauccgcaaccuccacaacguccucgacuccaaguccgucgaggucgagacccagaagcucgccuacauggagcuccagcagaaggccgaguucuccgaccagaagcaccagaaggagaucgagaacaugugccucaagaccucccagcucaccggccaggucgaggaccucgagcacaagcuccagcuccucuccaacgagaucauggacaaggaccgcugcuaccaggaccuccacgccgaguacgagucccuccgcgaccuccucaaguccaaggacgccucccucgucaccaacgaggaccaccagcgcucccuccucgccuucgaccagcagcccgccaugcaccacuccuucgccaacaucaucggcgagcagggcuccaugcccuccgagcgcuccgagugccgccucgaggccgaccagucccccaagaacuccgccauccuccagaaccgcgucgacucccucgaguucucccucgagucccagaagcagaugaacuccgaccuccagaagcagugcgaggagcucguccagaucaagggcgagaucgaggagaaccucaugaaggccgagcagaugcaccaguccuucgucgccgagaccucccagcgcaucuccaagcuccaggaggacaccuccgcccaccagaacgucgucgccgagacccucuccgcccucgagaacaaggagaaggagcuccagcuccucaacgacaaggucgagaccgagcaggccgagauccaggagcucaagaaguccaaccaccuccucgaggacucccucaaggagcuccagcuccucuccgagacccucucccucgagaagaaggagauguccuccaucaucucccucaacaagcgcgagaucgaggagcucacccaggagaacggcacccucaaggagaucaacgccucccucaaccaggagaagaugaaccucauccagaaguccgaguccuucgccaacuacaucgacgagcgcgagaaguccaucuccgagcucuccgaccaguacaagcaggagaagcucauccuccuccagcgcugcgaggagaccggcaacgccuacgaggaccucucccagaaguacaaggccgcccaggagaagaacuccaagcucgagugccuccucaacgagugcaccucccucugcgagaaccgcaagaacgagcucgagcagcucaaggaggccuucgccaaggagcaccaggaguuccucaccaagcucgccuucgccgaggagcgcaaccagaaccucaugcucgagcucgagaccguccagcaggcccuccgcuccgagaugaccgacaaccagaacaacuccaaguccgaggccggcggccucaagcaggagaucaugacccucaaggaggagcagaacaagaugcagaaggaggucaacgaccuccuccaggagaacgagcagcucaugaaggucaugaagaccaagcacgagugccagaaccucgaguccgagcccauccgcaacuccgucaaggagcgcgaguccgagcgcaaccagugcaacuucaagccccagauggaccucgaggucaaggagaucucccucgacuccuacaacgcccagcucguccagcucgaggccaugcuccgcaacaaggagcucaagcuccaggaguccgagaaggagaaggagugccuccagcacgagcuccagaccauccgcggcgaccucgagaccuccaaccuccaggacaugcagucccaggagaucuccggccucaaggacugcgagaucgacgccgaggagaaguacaucuccggcccccacgagcucuccaccucccagaacgacaacgcccaccuccagugcucccuccagaccaccaugaacaagcucaacgagcucgagaagaucugcgagauccuccaggccgagaaguacgagcucgucaccgagcucaacgacucccgcuccgagugcaucaccgccacccgcaagauggccgaggaggucggcaagcuccucaacgaggucaagauccucaacgacgacuccggccuccuccacggcgagcucgucgaggacauccccggcggcgaguucggcgagcagcccaacgagcagcaccccgucucccucgccccccucgacgaguccaacuccuacgagcaccucacccucuccgacaaggagguccagaugcacuucgccgagcuccaggagaaguuccucucccuccaguccgagcacaagauccuccacgaccagcacugccagauguccuccaagauguccgagcuccagaccuacgucgacucccucaaggccgagaaccucguccucuccaccaaccuccgcaacuuccagggcgaccucgucaaggagaugcagcucggccucgaggagggccucguccccucccucuccuccuccugcguccccgacuccuccucccucuccucccucggcgacuccuccuucuaccgcgcccuccucgagcagaccggcgacaugucccuccucuccaaccucgagggcgccgucuccgccaaccagugcuccgucgacgaggucuucugcuccucccuccaggaggagaaccucacccgcaaggagacccccuccgcccccgccaagggcgucgaggagcucgagucccucugcgaggucuaccgccagucccucgagaagcucgaggagaagauggagucccagggcaucaugaagaacaaggagauccaggagcucgagcagcuccucuccuccgagcgccaggagcucgacugccuccgcaagcaguaccucuccgagaacgagcaguggcagcagaagcucaccuccgucacccucgagauggaguccaagcucgccgccgagaagaagcagaccgagcagcucucccucgagcucgaggucgcccgccuccagcuccagggccucgaccucuccucccgcucccuccucggcaucgacaccgaggacgccauccagggccgcaacgaguccugcgacaucuccaaggagcacaccuccgagaccaccgagcgcacccccaagcacgacguccaccagaucugcgacaaggacgcccagcaggaccucaaccucgacaucgagaagaucaccgagaccggcgccgucaagcccaccggcgagugcuccggcgagcagucccccgacaccaacuacgagccccccggcgaggacaagacccagggcuccuccgagugcaucuccgagcucuccuucuccggccccaacgcccucguccccauggacuuccucggcaaccaggaggacauccacaaccuccagcuccgcgucaaggagaccuccaacgagaaccuccgccuccuccacgucaucgaggaccgcgaccgcaaggucgagucccuccucaacgagaugaaggagcucgacuccaagcuccaccuccaggagguccagcucaugaccaagaucgaggccugcaucgagcucgagaagaucgucggcgagcucaagaaggagaacuccgaccucuccgagaagcucgaguacuucuccugcgaccaccaggagcuccuccagcgcgucgagaccuccgagggccucaacuccgaccucgagaugcacgccgacaaguccucccgcgaggacaucggcgacaacgucgccaaggucaacgacuccuggaaggagcgcuuccucgacgucgagaacgagcucucccgcauccgcuccgagaaggccuccaucgagcacgaggcccucuaccucgaggccgaccucgaggucguccagaccgagaagcucugccucgagaaggacaacgagaacaagcagaaggucaucgucugccucgaggaggagcucuccgucgucaccuccgagcgcaaccagcuccgcggcgagcucgacaccauguccaagaagaccaccgcccucgaccagcucuccgagaagaugaaggagaagacccaggagcucgagucccaccaguccgagugccuccacugcauccaggucgccgaggccgaggucaaggagaagaccgagcuccuccagacccucuccuccgacgucuccgagcuccucaaggacaagacccaccuccaggagaagcuccagucccucgagaaggacucccaggcccucucccucaccaagugcgagcucgagaaccagaucgcccagcucaacaaggagaaggagcuccucgucaaggaguccgagucccuccaggcccgccucuccgaguccgacuacgagaagcucaacgucuccaaggcccucgaggccgcccucgucgagaagggcgaguucgcccuccgccucuccuccacccaggaggagguccaccagcuccgccgcggcaucgagaagcuccgcguccgcaucgaggccgacgagaagaagcagcuccacaucgccgagaagcucaaggagcgcgagcgcgagaacgacucccucaaggacaaggucgagaaccucgagcgcgagcuccagauguccgaggagaaccaggagcucgucauccucgacgccgagaacuccaaggccgaggucgagacccucaagacccagaucgaggagauggcccgcucccucaaggucuucgagcucgaccucgucacccuccgcuccgagaaggagaaccucaccaagcagauccaggagaagcagggccagcucuccgagcucgacaagcuccucuccuccuucaagucccuccucgaggagaaggagcaggccgagauccagaucaaggaggaguccaagaccgccgucgagaugcuccagaaccagcucaaggagcucaacgaggccgucgccgcccucugcggcgaccaggagaucaugaaggccaccgagcagucccucgacccccccaucgaggaggagcaccagcuccgcaacuccaucgagaagcuccgcgcccgccucgaggccgacgagaagaagcagcucugcguccuccagcagcucaaggaguccgagcaccacgccgaccuccucaagggccgcgucgagaaccucgagcgcgagcucgagaucgcccgcaccaaccaggagcacgccgcccucgaggccgagaacuccaagggcgaggucgagacccucaaggccaagaucgagggcaugacccagucccuccgcggccucgagcucgacgucgucaccauccgcuccgagaaggagaaccucaccaacgagcuccagaaggagcaggagcgcaucuccgagcucgagaucaucaacuccuccuucgagaacauccuccaggagaaggagcaggagaagguccagaugaaggagaaguccuccaccgccauggagaugcuccagacccagcucaaggagcucaacgagcgcgucgccgcccuccacaacgaccaggaggccugcaaggccaaggagcagaaccucuccucccaggucgagugccucgagcucgagaaggcccagcuccuccagggccucgacgaggccaagaacaacuacaucguccuccaguccuccgucaacggccucauccaggaggucgaggacggcaagcagaagcucgagaagaaggacgaggagaucucccgccucaagaaccagauccaggaccaggagcagcucgucuccaagcucucccaggucgagggcgagcaccagcucuggaaggagcagaaccucgagcuccgcaaccucaccgucgagcucgagcagaagauccagguccuccaguccaagaacgccucccuccaggacacccucgagguccuccaguccuccuacaagaaccucgagaacgagcucgagcucaccaagauggacaagauguccuucgucgagaaggucaacaagaugaccgccaaggagaccgagcuccagcgcgagaugcacgagauggcccagaagaccgccgagcuccaggaggagcucuccggcgagaagaaccgccucgccggcgagcuccagcuccuccucgaggagaucaaguccuccaaggaccagcucaaggagcucacccucgagaacuccgagcucaagaagucccucgacugcaugcacaaggaccaggucgagaaggagggcaagguccgcgaggagaucgccgaguaccagcuccgccuccacgaggccgagaagaagcaccaggcccuccuccucgacaccaacaagcaguacgaggucgagauccagaccuaccgcgagaagcucaccuccaaggaggagugccucuccucccagaagcucgagaucgaccuccucaaguccuccaaggaggagcucaacaacucccucaaggccaccacccagauccucgaggagcucaagaagaccaagauggacaaccucaaguacgucaaccagcucaagaaggagaacgagcgcgcccagggcaagaugaagcuccucaucaaguccugcaagcagcucgaggaggagaaggagauccuccagaaggagcucucccagcuccaggccgcccaggagaagcagaagaccggcaccgucauggacaccaaggucgacgagcucaccaccgagaucaaggagcucaaggagacccucgaggagaagaccaaggaggccgacgaguaccucgacaaguacugcucccuccucaucucccacgagaagcucgagaaggccaaggagaugcucgagacccaggucgcccaccucugcucccagcaguccaagcaggacucccgcggcuccccccuccucggccccgucguccccggccccucccccauccccuccgucaccgagaagcgccucuccuccggccagaacaaggccuccggcaagcgccagcgcuccuccggcaucugggagaacggccgcggccccacccccgccacccccgaguccuucuccaagaaguccaagaaggccgucauguccggcauccaccccgccgaggacaccgagggcaccgaguucgagcccgagggccuccccgaggucgucaagaagggcuucgccgacauccccaccggcaagaccucccccuacauccuccgccgcaccaccauggccacccgcaccuccccccgccucgccgcccagaagcucgcccucuccccccucucccucggcaaggagaaccucgccgaguccuccaagcccaccgccggcggcucccgcucccagaaggucaaggucgcccagcgcucccccgucgacuccggcaccauccuccgcgagcccaccaccaaguccguccccgucaacaaccuccccgagcgcucccccaccgacuccccccgcgagggccuccgcgucaagcgcggccgccucguccccucccccaaggccggccucgaguccaacggcuccgagaacugcaagguccaguga

SEQ ID NO: 41187 - RNA, 744 nt, Artificial Sequence
  derived and/or modified sequence opt2 from CENPH__Homo_sapiens__NP_075060
auggaggagcagccccagaugcaggacgccgacgagcccgccgacuccggcggcgagggccgcgccggcggccccccccaggucgccggcgcccaggccgccugcuccgaggaccgcaugacccuccuccuccgccuccgcgcccagaccaagcagcagcuccucgaguacaaguccauggucgacgccuccgaggagaagacccccgagcagaucaugcaggagaagcagaucgaggccaagaucgaggaccucgagaacgagaucgaggaggucaaggucgccuucgagaucaagaagcucgcccucgaccgcaugcgccucuccaccgcccucaagaagaaccucgagaagaucucccgccaguccuccguccucauggacaacaugaagcaccuccucgagcucaacaagcucaucaugaagucccagcaggaguccugggaccucgaggagaagcuccucgacauccgcaagaagcgccuccagcucaagcaggccuccgaguccaagcuccucgagauccagaccgagaagaacaagcagaagaucgaccucgacuccauggagaacuccgagcgcaucaagaucauccgccagaaccuccagauggagaucaagaucaccaccgucauccagcacgucuuccagaaccucauccucggcuccaaggucaacugggccgaggaccccgcccucaaggagaucguccuccagcucgagaagaacgucgacaugauguga

SEQ ID NO: 41188 - RNA, 4017 nt, Artificial Sequence
  derived and/or modified sequence opt2 from CENPJ__Homo_sapiens__NP_060921
auguuccucaugcccaccuccuccgagcucaacuccggccagaacuuccucacccaguggaugaccaaccccucccgcgccggcgucauccucaaccgcggcuuccccauccucgaggccgacaaggagaagcgcgccgccgucgacaucuccaccuccuuccccaucaagggcacccacuucuccgacuccuucuccuucaucaacgaggaggacucccuccucgaggagcagaagcucgaguccaacaaccccuacaagccccaguccgacaaguccgagacccacaccgccuuccccugcaucaagaagggcccccaggucgccgccugccacuccgcccccggccaccaggaggagaacaagaacgacuucauccccgaccucgccuccgaguucaaggagggcgccuacaaggacccccucuucaagaagcucgagcagcucaaggagguccagcagaagaagcaggagcagcucaagcgccagcagcucgagcagcuccagcgccucauggaggagcaggagaagcuccucaccauggucuccggccagugcacccuccccggccucucccuccuccccgacgaccagucccagaagcaccgcucccccggcaacaccaccaccggcgagcgcgccaccugcugcuuccccuccuacgucuaccccgaccccacccaggaggagaccuaccccuccaacauccucucccacgagcaguccaacuucugccgcaccgcccacggcgacuucguccucaccuccaagcgcgccucccccaaccucuucuccgaggcccaguaccaggaggcccccgucgagaagaacaaccucaaggaggagaaccgcaaccaccccaccggcgaguccauccucugcugggagaaggucaccgagcagauccaggaggccaacgacaagaaccuccagaagcacgacgacuccuccgaggucgccaacaucgaggagcgccccaucaaggccgccaucggcgagcgcaagcagaccuucgaggacuaccucgaggagcagauccagcucgaggagcaggagcucaagcagaagcagcucaaggaggccgagggcccccuccccaucaaggccaagcccaagcagcccuuccucaagcgcggcgagggccucgcccgcuucaccaacgccaaguccaaguuccagaagggcaaggaguccaagcucgucaccaaccaguccaccuccgaggaccagccccucuucaagauggaccgccagcagcuccagcgcaagaccgcccucaagaacaaggagcucugcgccgacaaccccauccucaagaaggacuccaaggcccgcaccaaguccggcuccgucacccucucccagaagcccaagaugcucaagugcuccaaccgcaagucccucucccccuccggccucaagauccagaccggcaagaagugcgacggccaguuccgcgaccagaucaaguucgagaacaaggucaccuccaacaacaaggagaacgucaccgagugccccaagcccugcgacaccggcugcaccggcuggaacaagacccagggcaaggaccgccucccccucuccaccggccccgccucccgccucgccgccaagucccccauccgcgagaccaugaaggaguccgaguccucccucgacgucucccuccagaagaagcucgagaccugggagcgcgagaaggagaaggagaaccucgagcucgacgaguuccucuuccucgagcaggccgccgacgagaucuccuucuccuccaacuccuccuucguccucaagauccucgagcgcgaccagcagaucugcaagggccaccgcauguccuccacccccgucaaggccgucccccagaagaccaaccccgccgaccccaucucccacugcaaccgcuccgaggaccucgaccacaccgcccgcgagaaggaguccgagugcgaggucgcccccaagcagcuccacucccucuccuccgccgacgagcuccgcgagcagcccugcaagauccgcaaggccguccagaaguccaccuccgagaaccagaccgaguggaacgcccgcgacgacgagggcguccccaacuccgacuccuccaccgacuccgaggagcagcucgacgucaccaucaagcccuccaccgaggaccgcgagcgcggcaucuccucccgcgaggacuccccccaggucugcgacgacaagggccccuucaaggacacccgcacccaggaggacaagcgccgcgacgucgaccucgaccucuccgacaaggacuacuccuccgacgaguccaucauggaguccaucaagcacaaggucuccgagcccucccgcuccuccucccucucccucuccaagauggacuucgacgacgagcgcaccuggaccgaccucgaggagaaccucugcaaccacgacgucguccucggcaacgaguccaccuacggcaccccccagaccugcuaccccaacaacgagaucggcauccucgacaagaccaucaagcgcaagaucgcccccgucaagcgcggcgaggaccucuccaagucccgccgcucccgcuccccccccaccuccgagcucaugaugaaguucuuccccucccucaagcccaagcccaaguccgacucccaccucggcaacgagcucaagcucaacaucucccaggaccagccccccggcgacaacgcccgcucccagguccuccgcgagaagaucaucgagcucgagaccgagaucgagaaguucaaggccgagaacgccucccucgccaagcuccgcaucgagcgcgaguccgcccucgagaagcuccgcaaggagaucgccgacuucgagcagcagaaggccaaggagcucgcccgcaucgaggaguucaagaaggaggagaugcgcaagcuccagaaggagcgcaaggucuucgagaaguacaccaccgccgcccgcaccuuccccgacaagaaggagcgcgaggagauccagacccucaagcagcagaucgccgaccuccgcgaggaccucaagcgcaaggagaccaagugguccuccacccacucccgccuccgcucccagauccagaugcucguccgcgagaacaccgaccuccgcgaggagaucaaggucauggagcgcuuccgccucgacgccuggaagcgcgccgaggccaucgaguccucccucgaggucgagaagaaggacaagcucgccaacaccuccguccgcuuccagaacucccagaucuccuccggcacccaggucgagaaguacaagaagaacuaccuccccaugcagggcaaccccccccgccgcuccaaguccgcccccccccgcgaccucggcaaccucgacaagggccaggccgccuccccccgcgagccccucgagccccucaacuuccccgaccccgaguacaaggaggaggaggaggaccaggacauccagggcgagaucucccaccccgacggcaaggucgagaaggucuacaagaacggcugccgcgucauccucuuccccaacggcacccgcaaggaggucuccgccgacggcaagaccaucaccgucaccuucuucaacggcgacgucaagcaggucaugcccgaccagcgcgucaucuacuacuacgccgccgcccagaccacccacaccaccuaccccgagggccucgagguccuccacuucuccuccggccagaucgagaagcacuaccccgacggccgcaaggagaucaccuuccccgaccagaccgucaagaaccucuuccccgacggccaggaggaguccaucuuccccgacggcaccaucguccgcguccagcgcgacggcaacaagcucaucgaguucaacaacggccagcgcgagcuccacaccgcccaguucaagcgccgcgaguaccccgacggcaccgucaagaccgucuacgccaacggccaccaggagaccaaguaccgcuccggccgcauccgcgucaaggacaaggagggcaacguccucauggacaccgagcucuga

SEQ ID NO: 41189 - RNA, 810 nt, Artificial Sequence
  derived and/or modified sequence opt2 from CENPK__Homo_sapiens__NP_001253967
augaaccaggaggaccucgaccccgacuccaccaccgacgucggcgacgucaccaacaccgaggaggagcucauccgcgagugcgaggagauguggaaggacauggaggagugccagaacaagcucucccucaucggcaccgagacccucaccgacuccaacgcccagcucucccuccucaucaugcaggucaagugccucaccgccgagcucucccaguggcagaagaagacccccgagaccaucccccucaccgaggacguccucaucacccucggcaaggaggaguuccagaagcuccgccaggaccucgagaugguccucuccaccaaggaguccaagaacgagaagcucaaggaggaccucgagcgcgagcagcgcuggcucgacgagcagcagcagaucauggagucccucaacguccuccacuccgagcucaagaacaaggucgagaccuucuccgagucccgcaucuucaacgagcucaagaccaagaugcucaacaucaaggaguacaaggagaagcuccucuccacccucggcgaguuccucgaggaccacuucccccuccccgaccgcuccgucaagaagaagaagaagaacauccaggaguccuccgucaaccucaucacccuccacgagaugcucgagauccucaucaaccgccucuucgacgucccccacgaccccuacgucaagaucuccgacuccuucuggccccccuacgucgagcuccuccuccgcaacggcaucgcccuccgccaccccgaggaccccacccgcauccgccucgaggccuuccaccaguga

SEQ ID NO: 41190 - RNA, 1062 nt, Artificial Sequence
  derived and/or modified sequence opt2 from CENPN__Homo_sapiens__NP_001094095
auggacgagaccgucgccgaguucaucaagcgcaccauccucaagauccccaugaacgagcucaccaccauccucaaggccugggacuuccucuccgagaaccagcuccagaccgucaacuuccgccagcgcaaggaguccgucguccagcaccucauccaccucugcgaggagaagcgcgccuccaucuccgacgccgcccuccucgacaucaucuacaugcaguuccaccagcaccagaaggucugggaggucuuccagauguccaagggccccggcgaggacgucgaccucuucgacaugaagcaguucaagaacuccuucaagaagauccuccagcgcgcccucaagaacgucaccgucuccuuccgcgagaccgaggagaacgccgucuggauccgcaucgccuggggcacccaguacaccaagcccaaccaguacaagcccaccuacgucgucuacuacucccagacccccuacgccuucaccuccuccuccaugcuccgccgcaacaccccccuccucggccaggcccucaccaucgccuccaagcaccaccagaucgucaagauggaccuccgcucccgcuaccucgacucccucaaggccaucgucuucaagcaguacaaccagaccuucgagacccacaacuccaccaccccccuccaggagcgcucccucggccucgacaucaacauggacucccgcaucauccacgagaacaucgucgagaaggagcgcguccagcgcaucacccaggagaccuucggcgacuacccccagccccagcucgaguucgcccaguacaagcucgagaccaaguucaaguccggccucaacggcuccauccucgccgagcgcgaggagccccuccgcugccucaucaaguucuccuccccccaccuccucgaggcccucaagucccucgcccccgccgcccucgucugccgcauccagaagcuccucugcuacuccggcucccacucccagggcacccaggaccccuccuccuggcagaaggaccucuaccuccucuucgucccccucuacccccgcugcuga

SEQ ID NO: 41191 - RNA, 885 nt, Artificial Sequence
  derived and/or modified sequence opt2 from CENPO__Homo_sapiens__NP_001186732
auggccggcauccucgccuccggccucggcguccucgcccaccucgagcgccucgagacccaggucucccgcucccgcaagcaguccgaggagcuccaguccguccaggcccaggagggcgcccucggcaccaagauccacaagcuccgccgccuccgcgacgagcuccgcgccgucguccgccaccgccgcgccuccgucaaggccugcaucgccaacgucgagcccaaccagaccgucgagaucaacgagcaggaggcccucgaggagaagcucgagaacgucaaggccauccuccaggccuaccacuucaccggccucuccggcaagcucaccucccgcggcgucugcgucugcaucuccaccgccuucgagggcaaccuccucgacuccuacuucgucgaccucgucauccagaagccccuccgcauccaccaccacuccguccccgucuucaucccccucgaggagaucgccgccaaguaccuccagaccaacauccagcacuuccucuucucccucugcgaguaccucaacgccuacuccggccgcaaguaccaggccgaccgccuccaguccgacuucgccgcccuccucaccggcccccuccagcgcaacccccucugcaaccuccucuccuucaccuacaagcucgaccccggcggccaguccuuccccuucugcgcccgccuccucuacaaggaccucaccgccacccuccccaccgacgucaccgucaccugccagggcgucgagguccucuccaccuccugggaggagcagcgcgccucccacgagacccucuucugcaccaagccccuccaccaggucuucgccuccuucacccgcaagggcgagaagcucgacaugucccucgucuccuga

SEQ ID NO: 41192 - RNA, 807 nt, Artificial Sequence
  derived and/or modified sequence opt2 from CENPQ__Homo_sapiens__NP_060602
auguccggcaaggccaacgccuccaagaagaacgcccagcagcucaagcgcaaccccaagcgcaagaaggacaacgaggaggucguccucuccgagaacaagguccgcaacaccgucaagaagaacaagaaccaccucaaggaccucuccuccgagggccagaccaagcacaccaaccucaagcacggcaagaccgccgccuccaagcgcaagaccuggcagccccucuccaaguccacccgcgaccaccuccagaccaugauggaguccgucaucaugaccauccucuccaacuccaucaaggagaaggaggagauccaguaccaccucaacuuccucaagaagcgccuccuccagcagugcgagacccucaaggucccccccaagaagauggaggaccucaccaacgucuccucccuccucaacauggagcgcgcccgcgacaaggccaacgaggagggccucgcccuccuccaggaggagaucgacaagauggucgagaccaccgagcucaugaccggcaacauccagucccucaagaacaagauccagauccucgccuccgaggucgaggaggaggaggagcgcgucaagcagaugcaccagaucaacuccuccggcguccucucccuccccgagcucucccagaagacccucaaggcccccacccuccagaaggagauccucgcccucauccccaaccagaacgcccuccucaaggaccucgacauccuccacaacuccucccagaugaaguccauguccaccuucaucgaggaggccuacaagaagcucgacgccuccuga

SEQ ID NO: 41193 - RNA, 1257 nt, Artificial Sequence
  derived and/or modified sequence opt2 from CENPU__Homo_sapiens__NP_078905
auggccccccgcggccgccgccgcccccgcccccaccgcuccgagggcgcccgccgcuccaagaacacccucgagcgcacccacuccaugaaggacaaggccggccagaagugcaagcccaucgacgucuucgacuuccccgacaacuccgacgucuccuccaucggccgccucggcgagaacgagaaggacgaggagaccuacgagaccuucgaccccccccuccacuccaccgccaucuacgccgacgaggaggaguucuccaagcacugcggccucucccucuccuccaccccccccggcaaggaggccaagcgcuccuccgacaccuccggcaacgaggccuccgagaucgaguccgucaagaucuccgccaagaagcccggccgcaagcuccgccccaucuccgacgacuccgaguccaucgaggaguccgacacccgccgcaaggucaaguccgccgagaagaucuccacccagcgccacgaggucauccgcaccaccgccuccuccgagcucuccgagaagcccgccgaguccgucaccuccaagaagaccggcccccucuccgcccagcccuccgucgagaaggagaaccucgccaucgagucccaguccaagacccagaagaagggcaagaucucccacgacaagcgcaagaagucccgcuccaaggccaucggcuccgacaccuccgacaucguccacaucuggugccccgagggcaugaagaccuccgacaucaaggagcucaacaucguccuccccgaguucgagaagacccaccucgagcaccagcagcgcaucgaguccaaggucugcaaggccgccaucgccaccuucuacgucaacgucaaggagcaguucaucaagaugcucaaggagucccagaugcucaccaaccucaagcgcaagaacgccaagaugaucuccgacaucgagaagaagcgccagcgcaugaucgagguccaggacgagcuccuccgccucgagccccagcucaagcagcuccagaccaaguacgacgagcucaaggagcgcaaguccucccuccgcaacgccgccuacuuccucuccaaccucaagcagcucuaccaggacuacuccgacguccaggcccaggagcccaacgucaaggagaccuacgacuccuccucccuccccgcccuccucuucaaggcccgcacccuccucggcgccgagucccaccuccgcaacaucaaccaccagcucgagaagcuccucgaccagggcuga

SEQ ID NO: 41194 - RNA, 819 nt, Artificial Sequence
  derived and/or modified sequence opt2 from CENPV__Homo_sapiens__NP_859067
augcgccgcucccgcuccuccgccgccgccaagcuccgcggccagaagcgcuccggcgccuccgccgcccccgccgccuccgccgccgccgcccucgcccccuccgccacccgcacccgccgcuccgccucccaggccggcuccaagucccaggccgucgagaagccccccuccgagaagccccgccuccgccgcuccuccccccgcgcccaggaggagggccccggcgagccccccccccccgagcucgcccuccucccccccccccccccccccccccccacccccgccacccccaccuccuccgccuccaaccucgaccucggcgagcagcgcgagcgcugggagaccuuccagaagcgccagaagcucaccuccgagggcgccgccaagcuccuccucgacaccuucgaguaccagggccucgucaagcacaccggcggcugccacugcggcgccguccgcuucgaggucugggccuccgccgaccuccacaucuucgacugcaacugcuccaucugcaagaagaagcagaaccgccacuucaucguccccgccucccgcuucaagcuccucaagggcgccgagcacaucaccaccuacaccuucaacacccacaaggcccagcacaccuucugcaagcgcugcggcguccaguccuucuacaccccccgcuccaaccccggcggcuucggcaucgccccccacugccucgacgagggcaccguccgcuccauggucaccgaggaguucaacggcuccgacugggagaaggccaugaaggagcacaagaccaucaagaacauguccaaggaguga

SEQ ID NO: 41195 - RNA, 267 nt, Artificial Sequence
  derived and/or modified sequence opt2 from CENPW__Homo_sapiens__NP_001012525
auggcccucuccaccaucgucucccagcgcaagcagaucaagcgcaaggccccccgcggcuuccucaagcgcgucuucaagcgcaagaagccccagcuccgccucgagaaguccggcgaccuccucguccaccucaacugccuccucuucguccaccgccucgccgaggagucccgcaccaacgccugcgccuccaagugccgcgucaucaacaaggagcacguccucgccgccgccaaggucauccucaagaagucccgcggcuga

SEQ ID NO: 41196 - RNA, 636 nt, Artificial Sequence
  derived and/or modified sequence opt2 from CEP112__Homo_sapiens__NP_001032402
augugggccucccucucccucgaccaccccuccgccaaggagaaccaggcccuccgccucaucgagaugcgcgaggagaacggcaacguccccaagaccgagcaggccggcucccucaagccccuccgcgacaccggcaaguccaaccucaaggagaagaaggccaacuccaagcucaagcagaucgagaaggaguacacccagaagcucgccaaguccucccagaucaucgccgagcuccagaccaccaucuccucccucaaggaggagaacucccagcagcagcucgccgccgagcgccgccuccaggacguccgccagaaguucgaggacgagaagaagcagcucauccgcgacaacgaccaggccaucaagguccuccaggacgagcucgagaaccgcuccaaccagguccgcugcgccgagaagaagcuccagcacaaggagcucgagucccaggagcagaucaccuacauccgccaggaguacgagaccaagcucaagggccucaugcccgccucccuccgccaggagcucgaggacaccaucuccucccucaagucccaggucaacuuccuccagaagcgcgccuccauccuccaggaggagcucaccaccuaccagggccgccgcuga

SEQ ID NO: 41197 - RNA, 2883 nt, Artificial Sequence
  derived and/or modified sequence opt2 from CEP120__Homo_sapiens__NP_001159698
augcucgucgucgaggccaaguucgacggcgagcagcucgccaccgaccccgucgaccacaccgaccagcccgaguucgccaccgagcucgccugggagaucgaccgcaaggcccuccaccagcaccgccuccagcgcacccccaucaagcuccagugcuucgcccucgaccccgucaccuccgccaaggagaccaucggcuacaucguccucgaccuccgcaccgcccaggagaccaagcaggcccccaagugguaccagcuccucuccaacaaguacaccaaguucaaguccgagauccagaucuccaucgcccucgagaccgacaccaagccccccgucgacuccuucaaggccaagggcgcccccccccgcgacggcaagguccccgccauccucgccggccucgacccccgcgacaucgucgccguccucaacgaggagggcggcuaccaccagaucggccccgccgaguacugcaccgacuccuucaucauguccgucaccaucgccuucgccacccagcucgagcagcucauccccugcaccaugaagcuccccgagcgccagcccgaguucuucuucuacuacucccuccucggcaacgacgucaccaacgagcccuucaacgaccucaucaaccccaacuucgagcccgagcgcgccuccguccgcauccgcuccuccgucgagauccuccgcgucuaccucgcccuccaguccaagcuccagauccaccucugcugcggcgaccagucccucggcuccaccgagaucccccucaccggccuccucaagaagggcuccaccgagaucaaccagcaccccgucaccgucgagggcgccuucacccucgacccccccaaccgcgccaagcagaagcucgcccccauccccgucgagcucgcccccaccgucggcgucuccgucgcccuccagcgcgagggcaucgacucccagucccucaucgagcucaagacccagaacgagcacgagcccgagcacuccaagaagaagguccucacccccaucaaggagaagacccucaccggccccaagucccccaccgucucccccguccccucccacaaccaguccccccccaccaaggacgacgccaccgaguccgaggucgagucccuccaguacgacaaggacaccaagcccaaccccaaggccuccuccuccguccccgccucccucgcccagcucgucaccaccuccaacgccuccgaggucgccuccggccagaagaucgccguccccgccaccucccaccacuucugcuucuccaucgaccuccgcuccauccacgcccucgagaucggcuuccccaucaacugcauccuccgcuacuccuaccccuucuucggcuccgccgcccccaucaugaccaacccccccgucgagguccgcaagaacauggaggucuuccucccccaguccuacugcgccuucgacuucgccaccaugccccaccagcuccaggacaccuuccuccgcaucccccuccucgucgagcucuggcacaaggacaagauguccaaggaccuccuccucggcaucgcccgcauccagcucuccaacauccucuccuccgagaagacccgcuuccucggcuccaacggcgagcagugcuggcgccagaccuacuccgaguccguccccgucaucgccgcccagggcuccaacaaccgcaucgccgaccucuccuacaccgucacccucgaggacuacggccucgucaagaugcgcgagaucuucaucuccgacuccucccagggcgucuccgccguccagcagaagcccuccucccucccccccgcccccugccccuccgagauccagaccgagccccgcgagacccucgaguacaaggccgcccucgagcucgagauguggaaggagaugcaggaggacaucuucgagaaccagcucaagcagaaggagcucgcccacaugcaggcccucgccgaggaguggaagaagcgcgaccgcgagcgcgagucccucgucaagaagaaggucgccgaguacaccauccucgagggcaagcuccagaagacccucaucgaccucgagaagcgcgagcagcagcucgccuccgucgaguccgagcuccagcgcgagaagaaggagcuccaguccgagcgccagcgcaaccuccaggagcuccaggacuccauccgccgcgccaaggaggacugcauccaccaggucgagcucgagcgccucaagaucaagcagcucgaggaggacaagcaccgccuccagcagcagcucaacgacgccgagaacaaguacaagauccucgagaaggaguuccagcaguucaaggaccagcagaacaacaagcccgagauccgccuccaguccgagaucaaccuccucacccucgagaaggucgagcucgagcgcaagcucgaguccgccaccaaguccaagcuccacuacaagcagcaguggggccgcgcccucaaggagcucgcccgccucaagcagcgcgagcaggagucccagauggcccgccucaagaagcagcaggaggagcucgagcagaugcgccuccgcuaccucgccgccgaggagaaggacaccgucaagaccgagcgccaggagcuccucgacauccgcaacgagcucaaccgccuccgccagcaggagcagaagcaguaccaggacuccaccgagaucgccuccggcaagaaggacggcccccacggcuccguccucgaggagggccucgacgacuaccucacccgccucaucgaggagcgcgacacccucaugcgcaccggcgucuacaaccacgaggaccgcaucaucuccgagcucgaccgccagauccgcgagauccucgccaaguccaacgccuccaacuga

SEQ ID NO: 41198 - RNA, 3285 nt, Artificial Sequence
  derived and/or modified sequence opt2 from CEP128__Homo_sapiens__XP_006720119
auggccgaguccuccuccgaguccgaccacuuccgcugccgcgaccgccucucccccugggccgcccgcuccacccaccgcggcacccgcucccuccccaccgucgaggucaccgagaaggucaacaccaucaccuccacccuccaggacaccucccgcaaccuccgccaggucgaccagaugcucggccgcuaccgcgaguacuccaacggccaggccggcgccaucgagcaccucaaggagucccucgagcaguccaucgaccagcuccgcucccagcgccuccuccgcaacuccggcggccgcuccaucuccgucaccucccucuccgccuccgaccucgacggcggcaccggcuccgagcuccaccacuucccccccaccuccccccucaaggacuacggcgacccccagggcaucaagcgcaugcgcucccgcaccggcguccgcuucguccaggagaccgacgacaugacccagcuccacggcuuccaccagucccuccgcgaccucuccuccgagcagauccgccucggcgacgacuucaaccgcgagcucucccgccgcucccgcuccgacgccgagaccaagcgcgcccucgaggagcucaccgagaagcucaacgaggcccagaagcaggaggucgucuccgaccgcgucgagcgccgccuccaggagcucgagcgcgagaugcgcaccgagcgcgagcucgucgagcgccgccaggaccagcucggccucaugucccuccagcuccaggaggcccucaagaagcaggaggccaaggccgacgagcacgagggcgccaucaagaacaagcuccgccagaccgagaccgagaagaaccagcucgagcaggagcucgagcucucccgccgccuccucaaccaguccgagggcucccgcgagacccuccuccaccaggucgaggagcuccgcacccagcucaccaaggccgagggcgaccgcaagggccuccagcaccaggucucccagaucuccaagcagcaguccaacuaccaggacgagcagggcgaggacuggcgcuuccgccgcggcgucgagcgcgagaagcaggaccucgagaagcagauguccgaccuccgcguccagcucaacuucuccgccauggccuccgagcucgaggaggucaagcgcugcauggagcgcaaggacaaggagaaggcccaccucgccucccaggucgagaaccucacccgcgagcucgagaacggcgagaagcagcagcuccagaugcucgaccgccucaaggagauccagaaccacuucgacaccugcgaggccgagcgcaagcacgccgaccuccagaucuccgagcucacccgccacgccgaggacgccaccaagcaggccgagcgcuaccucuccgagcuccagcaguccgaggcccucaaggaggaggccgagaagcgccgcgaggaccucaagcucaaggcccaggaguccauccgccaguggaagcucaagcacaagaagcucgagcgcgcccucgagaagcaguccgagaccgucgacgagcucaccggcaagaacaaccagauccucaaggagaaggacgagcucaagacccagcucuacgccgcccuccagcagaucgagaaccuccgcaaggagcucaacgacguccucaccaagcgcgcccuccaggaggaggagcuccacuccaaggaggagaagcuccgcgacaucaagucccaccaggccgaccucgagcucgaggucaagaacucccucgacaccauccaccgccucgaguccgagcucaagaagcaguccaagauccagucccagaugaaggucgagaaggcccaccucgaggaggagaucgccgagcucaagaagucccaggcccaggacaaggccaagcuccucgagaugcaggaguccaucaaggaccucuccgccauccgcgccgaccucgccaacaagcucgccgaggaggagcgcgccaagaaggccguccucaaggaccucuccgaccucaccgcccaggccaagucccgcgacgaggagaccgccaccaucaucacccagcucaagcucgagcgcgacguccaccagcgcgagcucaaggaccucaccuccucccuccaguccgucaagaccaagcacgagcagaacauccaggagcucaugaagcacuucaagaaggagaaguccgaggccgagaaccacauccgcacccucaaggccgagucccucgaggagaagaacauggccaagauccaccgcggccagcucgagaagcucaagucccagugcgaccgccucaccgaggagcucacccagaacgagaacgagaacaagaagcucaagcucaaguaccagugccucaaggaccagcucgaggagcgcgagaagcacaucuccaucgaggaggagcaccuccgccgcauggaggaggcccgccuccagcucaaggaccagcuccucugccucgagaccgagcaggaguccauccucggcgucaucggcaaggagaucgacgccgccugcaagaccuucuccaaggacuccgucgagaagcucaaggucuucuccuccggccccgacauccacuacgacccccaccgcuggcucgccgaguccaagaccaagcuccaguggcucugcgaggagcucaaggagcgcgagaaccgcgagaagaaccuccgccaccagcucaugcucugccgccagcagcuccgcaaccucaccgagaacaaggaguccgagcuccagugccucuuccagcagaucgagcgccaggagcagcuccucgacgagauccaccgcgagaagcgcgaccuccucgaggagacccagcgcaaggacgaggagaugggcucccuccaggaccgcgucaucgcccucgagaccuccacccaggucgcccucgaccaccucgaguccguccccgagaagcucucccuccucgaggacuucaaggacuuccgcgacuccugcuccuccuccgagcgcaccgacggccgcuacuccaaguaccgcguccgccgcaacucccuccagcaccaccaggacgacaccaaguaccgcaccaaguccuucaagggcgaccgcaccuuccucgagggcucccacacccgcggccucgaccacuccuccuccuggcaggaccacucccgcuuccucuccuccccccgcuucuccuacgucaacuccuucaccaagcgcaccgucgcccccgacuccgccuccaacaaggaggacgccaccaugaacggcaccuccucccagcccaagaaggaggaguacggcuccuga

SEQ ID NO: 41199 - RNA, 3135 nt, Artificial Sequence
  derived and/or modified sequence opt2 from CEP131__Homo_sapiens__NP_001009811
augaagggcacccgcgccaucggcuccguccccgagcgcucccccgccggcgucgaccucucccucaccggccuccccccccccgucucccgccgccccggcuccgccgccaccaccaagcccaucguccgcuccgucuccgucgucaccggcuccgagcagaagcgcaagguccucgaggccaccggccccggcggcucccaggccaucaacaaccuccgccgcuccaacuccaccacccaggucucccagccccgcuccggcuccccccgccccaccgagcccaccgacuuccucaugcucuucgagggcucccccuccggcaagaagcgccccgccucccucuccaccgcccccuccgagaagggcgccaccuggaacguccucgacgaccagccccgcggcuucacccuccccuccaacgcccgcuccuccuccgcccucgacucccccgccggcccccgccgcaaggagugcaccgucgcccucgcccccaacuucaccgccaacaaccgcuccaacaagggcgccgucggcaacugcgucaccaccaugguccacaaccgcuacacccccuccgagcgcgcccccccccucaaguccuccaaccagaccgcccccucccucaacaacaucaucaaggccgccaccugcgagggcuccgaguccuccggcuucggcaagcuccccaagaacgucuccuccgccacccacuccgcccgcaacaacaccggcggcuccaccggccucccccgccgcaaggaggucaccgaggaggaggccgagcgcuucauccaccaggucaaccaggccaccgucaccauccagcgcugguaccgccaccagguccagcgccgcggcgccggcgccgcccgccucgagcaccuccuccaggccaagcgcgaggagcagcgccagcgcuccggcgagggcacccuccucgaccuccaccagcagaaggaggccgcccgccgcaaggcccgcgaggagaaggcccgccaggcccgccgcgccgccauccaggagcuccagcagaagcgcgcccuccgcgcccagaaggccuccaccgccgagcgcggcccccccgagaacccccgcgagacccgcguccccggcaugcgccagcccgcccaggagcucucccccacccccggcggcaccgcccaccaggcccucaaggccaacaacaccggcggcggccuccccgccgccggccccggcgaccgcugccuccccaccuccgacuccucccccgagccccagcagccccccgaggaccgcacccaggacguccucgcccaggacgccgccggcgacaaccucgagaugauggcccccucccgcggcuccgccaagucccgcggcccccucgaggagcuccuccacacccuccagcuccucgagaaggagcccgacguccucccccgcccccgcacccaccaccgcggccgcuacgccugggccuccgaggaggacgacgccuccucccucaccgccgacaaccucgagaaguucggcaagcucuccgccuuccccgagccccccgaggacggcacccuccucuccgaggccaagcuccaguccaucauguccuuccucgacgagauggagaaguccggccaggaccagcucgacucccagcaggagggcuggguccccgaggccggccccggcccccucgagcucggcuccgaggucuccaccuccgucaugcgccucaagcucgaggucgaggagaagaagcaggccaugcuccuccuccagcgcgcccucgcccagcagcgcgaccucaccgcccgccgcgucaaggagaccgagaaggcccucucccgccagcuccagcgccagcgcgagcacuacgaggccaccauccagcgccaccucgccuucaucgaccagcucaucgaggacaagaagguccucuccgagaagugcgaggccgucgucgccgagcucaagcaggaggaccagcgcugcaccgagcgcgucgcccaggcccaggcccagcacgagcucgagaucaagaagcucaaggagcucauguccgccaccgagaaggcccgccgcgagaaguggaucuccgagaagaccaagaagaucaaggaggucaccguccgcggccucgagcccgagauccagaagcucaucgcccgccacaagcaggagguccgccgccucaagucccuccacgaggccgagcuccuccaguccgacgagcgcgccucccagcgcugccuccgccaggccgaggagcuccgcgagcagcucgagcgcgagaaggaggcccucggccagcaggagcgcgagcgcgcccgccagcgccagcgcgccgagcucgaggagcuccgccagcagcucgaggaguccuccuccgcccucacccgcgcccuccgcgccgaguucgagaagggccgcgaggagcaggagcgccgccaccagauggagcucaacacccucaagcagcagcucgagcucgagcgccaggccugggaggccggccgcacccgcaaggaggaggccuggcuccucaaccgcgagcaggagcuccgcgaggagauccgcaagggccgcgacaaggagaucgagcucgucauccaccgccucgaggccgacauggcccucgccaaggaggaguccgagaaggccgccgagucccgcaucaagcgccuccgcgacaaguacgaggccgagcucuccgagcucgagcaguccgagcgcaagcuccaggagcgcugcuccgagcucaagggccagcucggcgaggccgagggcgagaaccuccgccuccagggccucguccgccagaaggagcgcgcccucgaggacgcccaggccgucaacgagcagcucuccuccgagcgcuccaaccucgcccaggucauccgccaggaguucgaggaccgccucgccgccuccgaggaggagacccgccaggccaaggccgagcucgccacccuccaggcccgccagcagcucgagcucgaggagguccaccgccgcgucaagaccgcccucgcccgcaaggaggaggccgucuccucccuccgcacccagcacgaggccgccgucaagcgcgccgaccaccucgaggagcuccucgagcagcaccgccgccccacccccuccaccaaguga

SEQ ID NO: 41200 - RNA, 3423 nt, Artificial Sequence
  derived and/or modified sequence opt2 from CEP135__Homo_sapiens__NP_079285
augaccaccgccgucgagcgcaaguacaucaacauccgcaagcgccucgaccagcucggcuaccgccagacccucaccgucgagugccucccccucgucgagaagcucuucuccgaccucguccacaccaccgagucccuccgccaguccaagcucuccgccgucaaggccgagaaggaguccgccaacuucgacuucguccucgagcccuacaagcucgagaacgcccgccucucccgcgagaacaacgagcucuaccucgagcucaugaagcuccgcgagcacuccgaccagcacgucaaggagcucaagaccucccucaagaagugcgcccgcgagaccgccgaccucaaguuccucaacaaccaguacgcccacaagcucaagcuccucgagaaggaguccaaggccaagaacgagcgcauccagcagcuccaggagaagaaccuccacgccgucguccagacccccggcggcaagaagcgcuccaucgccuuccgccgccagcgcaugcagaucgacgagcccgucccccccuccgaggucuccuccuaccccgucccccagcccgacgaccccuacaucgccgaccuccuccaggucgccgacaaccgcauccaggagcuccagcaggagguccaccagcuccaggagaagcucgccaugauggaguccggcguccgcgacuacuccaagcagaucgagcuccgcgagcgcgagaucgagcgccucuccgucgcccucgacggcggccgcucccccgacguccucucccucgagucccgcaacaagaccaacgagaagcucaucgcccaccucaacauccaggucgacuuccuccagcaggccaacaaggaccucgagaagcgcauccgcgagcucauggagaccaaggagaccgucaccuccgaggucgucaaccucuccaacaagaacgagaagcucugccaggagcucaccgagaucgaccagcucgcccagcagcucgagcgccacaaggaggagguccucgagaccgccgacaaggagcucggcgaggccaagaaggagaucaagcgcaagcucuccgagaugcaggaccucgaggagaccauggccaagcuccagcucgagcucaaccucugccagaaggagaaggagcgccucuccgacgagcuccucgucaaguccgaccucgagaccgucguccaccagcucgagcaggagaagcagcgccucuccaagaaggucgaguccuucgccgucaccgagcgccagcucacccucgaggucgagcgcaugcgccucgagcacggcaucaagcgccgcgaccgcucccccucccgccucgacaccuuccucaagggcaucgaggaggagcgcgacuacuacaagaaggagcucgagcgccuccagcacaucauccagcgccgcuccugcuccaccuccuacuccgcccgcgagaaguccuccaucuuccgcacccccgagaagggcgacuacaacuccgagauccaccagaucacccgcgagcgcgacgagcuccagcgcaugcucgagcgcuucgagaaguacauggaggacauccaguccaacgucaagcuccucaccgccgagcgcgacaagcucuccguccucuacaacgaggcccaggaggagcucuccgcccuccgcaaggaguccacccagaccaccgccccccacaacaucgucucccucauggagaaggagaaggagcucgcccucuccgaccuccgccgcaucauggccgagaaggaggcccuccgcgagaagcucgagcacaucgaggaggucucccucuucggcaaguccgagcucgagaagaccaucgagcaccucaccugcgucaaccaccagcucgaguccgagaaguacgagcucaaguccaagguccucaucaugaaggagaccaucgagucccucgagaacaagcucaagguccaggcccagaaguucucccacgucgccggcgacuccucccaccagaagaccgaggucaacucccuccgcaucgucaacgagcagcuccagcgcuccgucgacgacuaccagcaccgccucuccaucaagcgcggcgagcucgaguccgcccaggcccagaucaagauccucgaggagaagaucgacgagcucaaccucaagaugaccucccaggacgaggaggcccacgucaugaagaagaccaucggcgucaucgacaaggagaaggacuuccuccaggagaccgucgacgagaagaccgagaagaucgccaaccuccaggagaaccucgccaacaaggagaaggccgucgcccagaugaagaucaugaucuccgagugcgaguccuccgucaaccagcucaaggagacccucgucaaccgcgaccgcgagaucaacucccuccgccgccagcucgacgccgcccacaaggagcucgacgaggucggccgcucccgcgagaucgccuucaaggagaaccgccgccuccaggacgaccucgccaccauggcccgcgagaaccaggagaucucccucgagcucgaggccgccguccaggagaaggaggagaugaagucccgcguccacaaguacaucaccgaggucucccgcugggagucccucauggccgccaaggagaaggagaaccaggaccuccucgaccgcuuccagaugcuccacaaccgcgccgaggacugggaggucaaggcccaccaggccgagggcgaguccuccuccguccgccucgagcuccucuccaucgacaccgagcgccgccaccuccgcgagcgcgucgagcuccucgagaaggagauccaggagcacaucaacgcccaccacgccuacgagucccagaucuccuccauggccaaggccaugucccgccucgaggaggagcuccgccaccaggaggacgagaaggccaccguccucaacgaccucuccucccuccgcgagcucugcaucaagcucgacuccggcaaggacaucaugacccagcagcucaacuccaagaaccucgaguucgagcgcgucgucgucgagcucgagaacgucaaguccgaguccgaccuccucaagaagcagcucuccaacgagcgccacaccgucaagaaccucgagucccuccucgccaccaaccgcgacaaggaguuccacucccaccucaccucccacgagaaggacaccgagauccagcuccucaaggagaagcucacccucuccgaguccaagcucaccucccagucccgcgagaacaccaugcuccgcgccaaggucgcccagcuccagaccgacuacgacgcccucaagcgccagaucuccaccgagcgcuacgagcgcgagcgcgccauccaggagaugcgccgccacggccucgccacccccccccucuccuccacccuccgcucccccucccacucccccgagcaccgcaacgucuga

SEQ ID NO: 41201 - RNA, 4965 nt, Artificial Sequence
  derived and/or modified sequence opt2 from CEP152__Homo_sapiens__NP_055800
augucccucgacuucggcuccgucgcccuccccguccagaacgaggacgaggaguacgacgaggaggacuacgagcgcgagaaggagcuccagcagcuccucaccgaccucccccacgacaugcucgacgacgaccucuccucccccgagcuccaguacuccgacugcuccgaggacggcaccgacggccagccccaccaccccgagcagcucgagauguccuggaacgagcagaugcuccccaagucccaguccgucaacggcuacaacgagauccagucccucuacgccggcgagaagugcggcaacgucugggaggagaaccgcuccaagaccgaggaccgccaccccgucuaccaccccgaggagggcggcgacgagggcggcuccggcuacuccccccccuccaagugcgagcagaccgaccucuaccaccuccccgagaacuuccgccccuacaccaacggccagaagcaggaguucaacaaccaggccaccaacgucaucaaguucuccgacccccaguggaaccacuuccagggccccuccugccagggccucgagcccuacaacaaggucaccuacaagcccuaccaguccuccgcccagaacaacggcucccccgcccaggagaucaccggcuccgacaccuucgagggccuccagcagcaguuccucggcgccaacgagaacuccgccgagaacaugcagaucauccagcuccagguccucaacaaggccaaggagcgccagcucgagaaccucaucgagaagcucaacgaguccgagcgccagauccgcuaccucaaccaccagcucgucaucaucaaggacgagaaggacggccucacccucucccuccgcgagucccagaagcucuuccagaacggcaaggagcgcgagauccagcucgaggcccagaucaaggcccucgagacccagauccaggcccucaaggucaacgaggagcagaugaucaagaagucccgcaccaccgagauggcccucgagucccucaagcagcagcucgucgaccuccaccacuccgagucccuccagcgcgcccgcgagcagcacgaguccaucgucaugggccucaccaagaaguacgaggagcagguccucucccuccagaagaaccucgacgccaccgucaccgcccucaaggagcaggaggacaucugcucccgccucaaggaccacgucaagcagcucgagcgcaaccaggaggccaucaagcucgagaagaccgagaucaucaacaagcucacccgcucccucgaggagucccagaagcagugcgcccaccuccuccaguccggcuccguccaggaggucgcccagcuccaguuccagcuccagcaggcccagaaggcccacgccauguccgccaacaugaacaaggcccuccaggaggagcucaccgagcucaaggacgagaucucccucuacgaguccgccgccaagcucggcauccaccccuccgacuccgagggcgagcucaacaucgagcucaccgaguccuacgucgaccucggcaucaagaaggucaacuggaagaaguccaaggucaccuccaucguccaggaggaggaccccaacgaggagcucuccaaggacgaguucauccucaagcucaaggccgagguccagcgccuccucggcuccaacuccaugaagcgccaccucgucucccagcuccagaacgaccucaaggacugccacaagaagaucgaggaccuccaccaggucaagaaggacgagaaguccaucgaggucgagaccaagaccgacaccuccgagaagcccaagaaccagcucuggcccgaguccuccaccuccgacgucguccgcgacgacauccuccuccucaagaacgagauccagguccuccagcagcagaaccaggagcucaaggagaccgagggcaagcuccgcaacaccaaccaggaccucugcaaccagaugcgccagaugguccaggacuucgaccacgacaagcaggaggccgucgaccgcugcgagcgcaccuaccagcagcaccacgaggccaugaagacccagauccgcgagucccuccucgccaagcacgcccucgagaagcagcagcucuucgaggccuacgagcgcacccaccuccagcuccgcuccgagcucgacaagcucaacaaggaggucaccgccguccaggagugcuaccucgaggucugccgcgagaaggacaaccucgagcucacccuccgcaagaccaccgagaaggagcagcagacccaggagaagaucaaggagaagcucauccagcagcucgagaaggaguggcaguccaagcucgaccagaccaucaaggccaugaagaagaagacccucgacugcggcucccagaccgaccaggucaccaccuccgacgucaucuccaagaaggagauggccaucaugaucgaggagcagaagugcaccauccagcagaaccucgagcaggagaaggacaucgccaucaagggcgccaugaagaagcucgagaucgagcucgagcucaagcacugcgagaacaucaccaagcaggucgagaucgccguccagaacgcccaccagcgcuggcucggcgagcuccccgagcucgccgaguaccaggcccucgucaaggccgagcagaagaagugggaggagcagcacgaggucuccgucaacaagcgcaucuccuucgccgucuccgaggccaaggagaaguggaaguccgagcucgagaacaugcgcaagaacauccuccccggcaaggagcucgaggagaagauccacucccuccagaaggagcucgagcucaagaacgaggagguccccgucgucauccgcgccgagcucgccaaggcccgcuccgaguggaacaaggagaagcaggaggagauccaccgcauccaggagcagaacgagcaggacuaccgccaguuccucgacgaccaccgcaacaagaucaacgagguccucgccgccgccaaggaggacuucaugaagcagaagaccgagcuccuccuccagaaggagaccgagcuccagaccugccucgaccagucccgccgcgaguggaccaugcaggaggccaagcgcauccagcucgagaucuaccaguacgaggaggacauccucaccguccucggcguccuccucuccgacacccagaaggagcacaucuccgacuccgaggacaagcagcuccucgagaucauguccaccugcuccuccaaguggauguccguccaguacuucgagaagcucaagggcugcauccagaaggccuuccaggacacccucccccuccucgucgagaacgccgaccccgaguggaagaagcgcaacauggccgagcucuccaaggacuccgccucccagggcaccggccagggcgaccccggccccgccgccggccaccacgcccagccccucgcccuccaggccaccgaggccgaggccgaggagaacaacaaggucgucgaggagcucaucgaggagaacaacgacaugaagaacaagcucgaggagcuccagacccucugcaagacccccccccgcucccucuccgccggcgccaucgagaacgccugccuccccugcuccggcggcgcccucgaggagcuccgcggccaguacaucaaggccgucaagaagaucaagugcgacaugcuccgcuacauccaggaguccaaggagcgcgccgccgagauggucaaggccgagguccuccgcgagcgccaggagaccgcccgcaagaugcgcaaguacuaccucaucugccuccagcagauccuccaggacgacggcaaggagggcgccgagaagaagaucaugaacgccgccuccaagcucgccaccauggccaagcuccucgagacccccaucuccuccaagucccaguccaagaccacccaguccgcccucccccucaccuccgagaugcucaucgccgucaagaaguccaagcgcaacgacgucaaccagaagauccccugcugcaucgaguccaaguccaacuccgucaacaccaucacccgcacccucugcgagcaggcccccaagcgccgcgccgccugcaaccuccagcgccuccucgagaacuccgagcaccaguccaucaagcacgucggcuccaaggagacccaccucgaguuccaguucggcgacggcuccugcaagcaccucaacucccucccccgcaacgucucccccgaguucguccccugcgagggcgagggcggcuucggccuccacaagaagaaggaccuccucuccgacaacggcuccgagucccucccccacuccgccgccuaccccuuccucggcacccucggcaacaagcccuccccccgcugcacccccggccccuccgaguccggcugcaugcacaucaccuuccgcgacuccaacgagcgccucggccucaaggucuacaagugcaacccccucauggaguccgagaacgccgccuccgagaagucccagggccucgacguccaggagccccccgucaaggacggcggcgaccucuccgacugccucggcuggcccuccuccuccgccacccucuccuucgacucccgcgaggccuccuucguccacggccgcccccagggcacccucgagauccccuccgaguccgucaaguccaagcaguucucccccuccggcuaccucuccgacaccgaggaguccaacaugaucugccagaccaugaagugccagcgcuaccagacccccuaccucuccgaggagaccaccuaccucgagcccggcaagaucuccgucaacugcggccaccccucccgccacaaggccgaccgccucaaguccgacuucaagaagcucuccuccacccuccccuccuccgucugccagcagcccucccgcaagcucaucgucccccucuccucccagcaggacuccggcuucgacucccccuucgucaaccucgacuga

SEQ ID NO: 41202 - RNA, 4212 nt, Artificial Sequence
  derived and/or modified sequence opt2 from CEP162__Homo_sapiens__NP_055710
auggccaacugcucccaggaggagcucgacgaggaguucgagcaguucaugaaggagcucuccgacgacuccuucgagaacuccgacaagaccgcccgccaguccaagaaggagaugaagaagaaggacaccguccccugguggaucaccgaggacgacuucaaggacgacggccuccucggcaccaacgucuccuaccucaagaccaagaagaccucccagcccgucauggagaucgaggaggaguccgccgagaagauccaguuccucaaguccuccggcaccucccuccucuccaccgacucccucgagaccaacgagcucgucgucuccgagcucaaccacuccucccucggcgucggccucgacacccucgaggagcaggaggagaaggagcaguucuucgcccgccucgagaagggccucaccuccuccaucgacuacucccgccucaacaaggagcucgacuccaacgacuccacccacuucaaggcccuccacuccaaccaggccaacgccgagcucaccgacgacgagcacgagaacgaguccaagcacgaggagcucgccgagaacuacuccgacgacuucgaggacgaguacgucggcgccccccucaccaccaaggacgaggagaugcccuccaaggagaacuccaaguccgagaagaucuccguccccaagcaggaggaggagaagaccggcaugcucgccaacgucguccuccucgacucccucgacuccgucgccgaggucaaccucgacgagcaggacaagaucacccccaagccccgcugccuccccgagaugaccgagaacgagaugaccggcaccggcgucuccuacggccaguccuccuccgacgucgaggcccuccaccaggccuacugccacaucgcccacucccucggcgacgaggacaagcagaagaucgaguccaacaccgucgaggacaucaaguccuccgucaagggccacccccaggagaacgaggagaacuccaagaacaucuccaccauggaguccgaccuccccaccgucgaggagcucaugaagcccauccgcaucgacuccuucggcaucuccggcuucgaccuccagcccgucuccuccgagaaggucgccgagcgcaaggagaccgaguucuucuccucccucccccucaagaugaaccccaacauccucucccaggacucccagcacgucaaccucuucuucgacaagaacgacgagaacgucauccuccagaagaccaccaacgaguccauggagaacuccugcccccaggucaccgaggucaccgccaccgaggagcacgucgacaagauguaccucaacauccuccgcaagaagaucaccgucaacuccuccucccucucccaggacgacaagaucaacaagaccuaccgcucccagcucuccuccgaggaggagggcgccgucaugggcaagcagguccccuacaagaaggcccgcuccgcccccccccuccucaagcgcaagccccaguccggccucuacgccuccguccgcuccuccggcuacggcaagcccuccuccccccucaagauguucuccacccucgagaagaagaccuccgaggacaucaucaaguccaagaaccuccgcuccaucuccaccuccaaccagccccgcaagaaggagauccucuccggcaccaagcucaucaagcccgccgcccucgacaagcccgcccacaagaccgaguccugccucuccacccgcaagaaguccgagaaccccaccgagaccgacuccugcauccaguuccagaccgacucccucggcuacugcggcgagaacaaggagaagaagcuccucauguucaagcgcguccaggaggccgaggacaaguggcgcggcgcccaggcccucaucgagcagaucaaggccaccuucuccgagaaggagaaggagcucgagaacaagcucgaggagcucaagaagcagcaggagaaggagcucuucaagcucaaccaggacaacuacauccuccaggccaagcucuccuccuucgaggagaccaacaagaagcagcgcuggcuccacuucggcgaggccgccgaccccgucaccggcgagaagcucaagcagauccagaaggagauccaggagcaggagacccuccuccagggcuaccagcaggagaacgagcgccucuacaaccaggucaaggaccuccaggagcagaacaagaagaacgaggagcgcauguucaaggagaaccagucccucuucuccgaggucgccucccucaaggagcagaugcacaagucccgcuuccucucccaggucgucgaggacuccgagcccacccgcaaccagaacuucaccgaccuccucgccgagcuccgcauggcccagaaggagaaggacucccuccucgaggacaucaagcgccucaagcaggacaagcaggcccucgaggucgacuucgagaagaugaagaaggagcgcgaccaggccaaggaccagaucgccuacgucaccggcgagaagcucuacgagaucaagauccucgaggagacccacaagcaggagaucucccgccuccagaagcgccuccagugguacgccgagaaccaggagcuccucgacaaggacgcccuccgccuccgcgaggccaacgaggagaucgagaagcucaagcucgagaucgagaagcucaaggccgaguccggcaaccccuccauccgccagaagauccgccucaaggacaaggccgccgacgccaagaagauccaggaccucgagcgccaggucaaggagauggagggcauccucaagcgccgcuaccccaacucccuccccgcccucauccucgccgccuccgccgccggcgacaccgucgacaagaacaccgucgaguucauggagaagcgcaucaagaagcucgaggccgaccucgagggcaaggacgaggacgccaagaagucccuccgcaccauggagcagcaguuccagaagaugaagauccaguacgagcagcgccucgagcagcaggagcagcuccucgccugcaagcucaaccagcacgacuccccccgcaucaaggcccucgagaaggagcucgacgacaucaaggaggcccaccagaucaccguccgcaaccucgaggccgagaucgacguccucaagcaccagaacgccgagcucgacgucaagaagaacgacaaggacgacgaggacuuccaguccaucgaguuccaggucgagcaggcccacgccaaggccaagcucguccgccucaacgaggagcucgccgccaagaagcgcgagauccaggaccucuccaagaccgucgagcgccuccagaaggaccgccgcaugaugcucuccaaccagaacuccaagggccgcgaggagauguccgccaagcgcgccaagaaggacguccuccacuccuccaagggcaacgccaacuccuuccccggcacccucgacuccaagcucuaccagccccacaccuucaccgacucccacgucuccgagguccuccaggagaacuaccgccucaagaacgagcucgagggccucaucuccgagaagaacgagcucaagaugaaguccgaggccgucaugaaccaguucgagaacuccaugcgccgcgucaaggaggacaccgccgcccacaucgccucccucaaggccucccaccagcgcgagaucgagaagcuccucugccagaacgccgucgagaacuccuccuccaaggucgccgagcucaaccgcaagaucgccacccaggagguccucauccgccacuuccagucccaggucaacgagcuccaguccaagcaggagucccucgucgucuccgagguccgcgaggagauccuccagaaggagaucaccaagcuccucgaggagcuccgcgaggccaaggagaaccacacccccgagaugaagcacuucgucggccucgagaagaagaucaagcagauggagaugcgccacgcccagcgcgagcaggagcuccagcagaucauccagcagacccaccaggucgucgagaccgagcagaacaaggaggucgagaaguggaagcgccucgcccagcucaagaaccgcgagcucgagaaguuccgcaccgagcucgacuccauccucgacguccuccgcgagcuccaccgccagggcgucgucguccccgucgccuucgccgacgagaugaacgcccccgaguacuga

SEQ ID NO: 41203 - RNA, 4368 nt, Artificial Sequence
  derived and/or modified sequence opt2 from CEP164__Homo_sapiens__NP_001258862
auggccggccgcccccuccgcaucggcgaccagcucguccucgaggaggacuacgacgagaccuacauccccuccgagcaggagauccucgaguucgcccgcgagaucggcaucgaccccaucaaggagcccgagcucauguggcucgcccgcgagggcaucgucgccccccuccccggcgaguggaagcccugccaggacaucaccggcgacaucuacuacuucaacuucgccaacggccaguccaugugggaccaccccugcgacgagcacuaccgcucccucgucauccaggagcgcgccaagcucuccaccuccggcgccaucaagaagaagaagaagaagaaggagaagaaggacaagaaggaccgcgacccccccaaguccucccucgcccucggcuccucccucgcccccguccacgucccccucggcggccucgccccccuccgcggccucgucgacaccccccccuccgcccuccgcggcucccaguccgucucccucggcuccuccgucgaguccggccgccagcucggcgagcucaugcuccccucccagggccucaagaccuccgccuacaccaagggccuccucggcuccaucuacgaggacaagaccgcccucucccuccucggccucggcgaggagaccaacgaggaggacgaggaggaguccgacaaccaguccguccacuccuccuccgagccccuccgcaaccuccaccucgacaucggcgcccucggcggcgacuucgaguacgaggagucccuccgcaccucccagcccgaggagaagaaggacgucucccucgacuccgacgccgccggcccccccacccccugcaagcccuccucccccggcgccgacuccucccucuccuccgccgucggcaagggccgccagggcuccggcgcccgccccggccuccccgagaaggaggagaacgagaaguccgagcccaagaucugccgcaaccucgucacccccaaggccgaccccaccggcuccgagcccgccaaggccuccgagaaggaggcccccgaggacaccgucgacgccggcgaggagggcucccgccgcgaggaggccgccaaggagcccaagaagaaggccuccgcccucgaggagggcuccuccgacgccucccaggagcucgagaucuccgagcacaugaaggagccccagcucuccgacuccaucgccuccgaccccaaguccuuccacggccucgacuucggcuuccgcucccgcaucuccgagcaccuccucgacgucgacguccucucccccguccucggcggcgccugccgccaggcccagcagccccucggcaucgaggacaaggacgacucccaguccucccaggacgagcuccaguccaagcaguccaagggccucgaggagcgcuaccaccgccucucccccccccucccccacgaggagcgcgcccagucccccccccgcucccucgccaccgaggaggagcccccccagggccccgagggccagcccgaguggaaggaggccgaggagcucggcgaggacuccgccgccucccucucccuccagcucucccuccagcgcgagcaggcccccuccccccccgccgccugcgagaagggcaaggagcagcacucccaggccgaggagcucggccccggccaggaggaggccgaggaccccgaggagaaggucgccgucucccccaccccccccgucucccccgagguccgcuccaccgagcccgucgccccccccgagcagcucuccgaggccgcccucaaggccauggaggaggccgucgcccagguccucgagcaggaccagcgccaccuccucgaguccaagcaggagaagaugcagcagcuccgcgagaagcucugccaggaggaggaggaggagauccuccgccuccaccagcagaaggagcagucccucuccucccuccgcgagcgccuccagaaggccaucgaggaggaggaggcccgcaugcgcgaggaggagucccagcgccucuccuggcuccgcgcccagguccaguccuccacccaggccgacgaggaccagauccgcgccgagcaggaggccucccuccagaagcuccgcgaggagcucgagucccagcagaaggccgagcgcgccucccucgagcagaagaaccgccagaugcucgagcagcucaaggaggagaucgaggccuccgagaaguccgagcaggccgcccucaacgccgccaaggagaaggcccuccagcagcuccgcgagcagcucgagggcgagcgcaaggaggccgucgccacccucgagaaggagcacuccgccgagcucgagcgccucugcuccucccucgaggccaagcaccgcgaggucgucuccucccuccagaagaagauccaggaggcccagcagaaggaggaggcccagcuccagaagugccucggccaggucgagcaccgcguccaccagaaguccuaccacgucgccggcuacgagcacgagcucuccucccuccuccgcgagaagcgccaggaggucgagggcgagcacgagcgccgccucgacaagaugaaggaggagcaccagcaggucauggccaaggcccgcgagcaguacgaggccgaggagcgcaagcagcgcgccgagcuccucggccaccucaccggcgagcucgagcgccuccagcgcgcccacgagcgcgagcucgagaccguccgccaggagcagcacaagcgccucgaggaccuccgccgccgccaccgcgagcaggagcgcaagcuccaggaccucgagcucgaccucgagacccgcgccaaggacgucaaggcccgccucgcccuccucgagguccaggaggagaccgcccgccgcgagaagcagcagcuccucgacguccagcgccaggucgcccucaaguccgaggaggccaccgccacccaccagcagcucgaggaggcccagaaggagcacacccaccuccuccaguccaaccagcagcuccgcgagauccucgacgagcuccaggcccgcaagcucaagcucgagucccaggucgaccuccuccaggcccagucccagcagcuccagaagcacuucuccucccucgaggccgaggcccagaagaagcagcaccuccuccgcgaggucaccgucgaggagaacaacgccuccccccacuucgagcccgaccuccacaucgaggaccuccgcaagucccucggcaccaaccagaccaaggaggucuccuccucccucucccaguccaaggaggaccucuaccucgacucccucuccucccacaacgucuggcaccuccucuccgccgagggcgucgcccuccgcuccgccaaggaguuccucguccagcagacccgcuccaugcgccgccgccagaccgcccucaaggccgcccagcagcacuggcgccacgagcucgccuccgcccaggaggucgccaaggacccccccggcaucaaggcccucgaggacaugcgcaagaaccucgagaaggagacccgccaccucgacgagaugaaguccgccaugcgcaagggccacaaccuccucaagaagaaggaggagaagcucaaccagcucgaguccucccucugggaggaggccuccgacgagggcacccucggcggcucccccaccaagaaggccgucaccuucgaccucuccgacauggacucccucuccuccgaguccuccgaguccuucucccccccccaccucgacuccacccccucccucaccucccgcaagauccacggccucucccacucccuccgccagaucuccucccagcucuccuccguccucuccauccucgacucccucaacccccaguccccccccccccuccucgccuccaugcccgcccagcuccccccccgcgaccccaaguccacccccacccccaccuacuacggcucccucgcccgcuucuccgcccucuccuccgccacccccaccuccacccagugggccugggacuccggccagggcccccgccuccccuccuccgucgcccagaccgucgacgacuuccuccucgagaaguggcgcaaguacuuccccuccggcaucccccuccucuccaacucccccaccccccucgagucccgccucggcuacauguccgccuccgagcagcuccgccuccuccagcacucccacucccagguccccgaggccggcuccaccaccuuccagggcaucaucgaggccaaccgccgcuggcucgagcgcgucaagaacgacccccgccucccccucuucuccuccacccccaagcccaaggccacccucucccuccuccagcucggccucgacgagcacaaccgcgucaaggucuaccgcuucuga

SEQ ID NO: 41204 - RNA, 4461 nt, Artificial Sequence
  derived and/or modified sequence opt2 from CEP170__Homo_sapiens__NP_001035863
augucccucaccuccugguuccucgucuccuccggcggcacccgccaccgccucccccgcgagaugaucuucgucggccgcgacgacugcgagcucaugcuccagucccgcuccgucgacaagcagcacgccgucaucaacuacgacgccuccaccgacgagcaccucgucaaggaccucggcucccucaacggcaccuucgucaacgacguccgcauccccgagcagaccuacaucacccucaagcucgaggacaagcuccgcuucggcuacgacaccaaccucuucaccgucguccagggcgagaugcgcguccccgaggaggcccucaagcacgagaaguucaccauccagcuccagcucucccagaaguccuccgaguccgagcucuccaaguccgccuccgccaaguccaucgacuccaaggucgccgacgccgccaccgagguccagcacaagaccaccgaggcccucaaguccgaggagaaggccauggacaucuccgccaugccccgcggcaccccccucuacggccagcccuccugguggggcgacgacgaggucgacgagaagcgcgccuucaagaccaacggcaagcccgaggagaagaaccacgaggccggcaccuccggcugcggcaucgacgccaagcaggucgaggagcaguccgccgccgccaacgaggagguccucuuccccuucugccgcgagcccuccuacuucgagauccccaccaaggaguuccagcagcccucccagaucaccgaguccaccauccacgagauccccaccaaggacacccccuccucccacaucaccggcgccggccacgccuccuucaccaucgaguucgacgacuccacccccggcaaggucaccauccgcgaccacgucaccaaguucaccuccgaccagcgccacaaguccaagaaguccucccccggcacccaggaccuccucggcauccagaccggcaugauggcccccgagaacaaggucgccgacuggcucgcccagaacaaccccccccagaugcucugggagcgcaccgaggaggacuccaaguccaucaaguccgacguccccgucuaccucaagcgccucaagggcaacaagcacgacgacggcacccaguccgacuccgagaacgccggcgcccaccgccgcugcuccaagcgcgccacccucgaggagcaccuccgccgccaccacuccgagcacaagaagcuccagaagguccaggccaccgagaagcaccaggaccaggccgucgucuucggcgucgacgacaaccaggacuacaaccgccccgucaucaacgagaagcacaaggaccucaucaaggacugggcccucuccuccgccgccgccgucauggaggagcgcaagccccucaccaccuccggcuuccaccacuccgaggagggcaccuccuccuccggcuccaagcgcugggucucccagugggccucccucgccgccaaccacacccgccacgaccaggaggagcgcaucauggaguucuccgccccccucccccucgagaacgagaccgagaucuccgaguccggcaugaccguccgcuccaccggcuccgccaccucccucgccucccagggcgagcgccgccgccgcacccucccccagcuccccaacgaggagaagucccucgagucccaccgcgccaaggucgucacccagcgcuccgagaucggcgagaagcaggacaccgagcuccaggagaaggagacccccacccaggucuaccagaaggacaagcaggacgccgaccgcccccucuccaagaugaaccgcgccgucaacggcgagacccucaagaccggcggcgacaacaagacccuccuccaccucggcuccuccgcccccggcaaggagaaguccgagaccgacaaggagaccucccucgucaagcagacccucgccaagcuccagcagcaggagcagcgcgaggaggcccaguggacccccaccaagcucuccuccaagaacgucuccggccagaccgacaagugccgcgaggagaccuucaagcaggagucccagccccccgagaagaacuccggccacuccaccuccaagggcgaccgcgucgcccaguccgaguccaagcgccgcaaggccgaggagauccucaagucccagacccccaagggcggcgacaagaaggaguccuccaagucccucguccgccagggcuccuucaccaucgagaagcccucccccaacauccccaucgagcucaucccccacaucaacaagcagaccuccuccacccccuccucccucgcccucaccuccgccucccgcauccgcgagcgcuccgagucccucgaccccgacuccuccauggacaccacccucauccucaaggacaccgaggccgucauggccuuccucgaggccaagcuccgcgaggacaacaagaccgacgagggccccgacacccccuccuacaaccgcgacaacuccaucucccccgaguccgacgucgacaccgccuccaccaucucccucgucaccggcgagaccgagcgcaaguccacccagaagcgcaaguccuucaccucccucuacaaggaccgcugcuccaccggcucccccuccaaggacgucaccaaguccuccuccuccggcgcccgcgagaagauggagaagaagaccaagucccgcuccaccgacgucggcucccgcgccgacggccgcaaguucguccaguccuccggccgcauccgccagcccuccgucgaccucaccgacgacgaccagaccuccuccgucccccacuccgccaucuccgacaucauguccuccgaccaggagaccuacuccugcaagccccacggccgcaccccccucaccuccgccgacgagcacguccacuccaagcucgagggcuccaaggucaccaaguccaagaccucccccgucgucuccggcuccuccuccaaguccaccacccucccccgcccccgccccacccgcaccucccuccuccgccgcgcccgccucggcgaggccuccgacuccgagcucgccgacgccgacaaggccuccgucgccuccgaggucuccaccaccuccuccaccuccaagccccccaccggccgccgcaacaucucccgcaucgaccuccucgcccagccccgccgcacccgccucggcucccucuccgcccgcuccgacuccgaggccaccaucucccgcuccuccgccuccucccgcaccgccgaggccaucauccgcuccggcgcccgccucguccccuccgacaaguucuccccccgcauccgcgccaacuccaucucccgccucuccgacuccaaggucaaguccaugaccuccgcccacggcuccgccuccgucaacucccgcuggcgccgcuuccccaccgacuacgccuccaccuccgaggacgaguucggcuccaaccgcaacucccccaagcacacccgccuccgcaccucccccgcccucaagaccacccgccuccaguccgccggcuccgccaugcccaccuccuccuccuucaagcaccgcaucaaggagcaggaggacuacauccgcgacuggaccgcccaccgcgaggagaucgcccgcaucucccaggaccucgcccucaucgcccgcgagaucaacgacgucgccggcgagaucgacuccgucaccuccuccggcaccgcccccuccaccaccgucuccaccgccgccaccacccccggcuccgccaucgacacccgcgaggagcucgucgaccgcgucuucgacgagucccucaacuuccgcaagauccccccccucguccacuccaagacccccgagggcaacaacggccgcuccggcgacccccgcccccaggccgccgagccccccgaccaccucaccaucacccgccgccgcaccuggucccgcgacgaggucaugggcgacaaccuccuccucuccuccgucuuccaguucuccaagaagauccgccaguccaucgacaagaccgccggcaagauccgcauccucuucaaggacaaggaccgcaacugggacgacaucgaguccaagcuccgcgccgaguccgagguccccaucgucaagaccuccuccauggagaucuccuccauccuccaggagcucaagcgcgucgagaagcagcuccaggccaucaacgccaugaucgaccccgacggcacccucgaggcccucaacaacaugggcuuccccuccgccaugcuccccuccccccccaagcagaaguccucccccgucaacaaccaccacucccccggccagacccccacccucggccagcccgaggcccgcgcccuccaccccgccgccgucuccgccgccgccgaguucgagaacgccgaguccgaggccgacuucuccauccacuucaaccgcuucaaccccgacggcgaggaggaggacgucaccguccaggaguga

SEQ ID NO: 41205 - RNA, 7614 nt, Artificial Sequence
  derived and/or modified sequence opt2 from CEP192__Homo_sapiens__NP_115518
auggaggacuuccgcggcaucgccgaggaguccuuccccuccuuccucaccaacucccucuucggcaacuccggcauccucgagaacgucacccucuccuccaaccucggccuccccgucgccgucuccacccucgcccgcgaccgcuccuccaccgacaaccgcuaccccgacauccaggccuccuaccucgucgagggccgcuucuccguccccuccggcuccucccccggcucccaguccgacgccgagccccgcgagcgccuccagcucuccuuccaggacgacgacuccaucucccgcaagaaguccuacgucgagucccagcgccucuccaacgcccucuccaagcaguccgcccuccagauggagaccgccggccccgaggaggagcccgccggcgccaccgagucccuccagggccaggaccucuucaaccgcgccuccccccucgagcaggcccaggacucccccaucgacuuccaccuccaguccuggaugaacaacaaggagcccaagaucgucguccucgacgccggcaagcacuucgaggacaagacccucaaguccgaccucucccacaccucccuccucgagaacgagaagcucauccuccccaccucccucgaggacuccuccgacgacgacaucgacgacgagauguucuacgacgaccaccucgaggccuacuucgagcagcucgccauccccggcaugaucuacgaggaccucgagggccccgagccccccgagaagggcuucaagcuccccaccaacggccuccgccaggccaacgagaacggcucccucaacugcaaguuccaguccgagaacaacuccucccucaucucccucgacucccacuccuccgagaccacccacaaggaguccgaggagucccaggucaucugccuccccggcaccuccaacuccaucggcaccggcgacucccgccgcuacaccgacggcaugcuccccuucuccuccggcaccuggggcaccgagaaggagaucgagaaccucaagggcaucguccccgaccucaacuccgagugcgccuccaaggacguccucgucaagacccuccgcgccaucgacgucaagcucaacuccgacaacuuccacgacgccaacgccaaccgcggcggcuucgaccucaccgaccccgucaagcagggcgccgagugcccccaccagaacaagaccguccuccacauggacggcugccucgacaccgagacccccaccgucuccauccaggagaacgucgacgucgccucccucaagcccaucuccgacuccggcaucaacuucaccgacgccaucuggucccccaccugcgagcgccgcaccugcgagugccacgaguccaucgagaagaacaaggacaagaccgaccucccccaguccgucgucuaccagaacgaggagggccgcugggucaccgaccucgccuacuacaccuccuucaacuccaagcagaaccucaacgucucccucuccgacgagaugaacgaggacuuccgcuccggcuccgaggccuucgaccucaucgcccaggacgaggaggaguucaacaaggagcaccaguucauccaggaggagaacaucgacgcccacaacaccuccgucgcccucggcgacaccuccuggggcgccaccaucaacuacucccuccuccgcaagucccgcuccaccuccgaccucgacaaggacgacgccuccuaccuccgccucucccucggcgaguucuucgcccagcgcuccgaggcccucggcugccucggcggcggcaacaacgucaagcgccccuccuucggcuacuucauccgcucccccgagaagcgcgagcccaucgcccucauccgcaaguccgacgucucccgcggcaaccucgagaaggagauggcccaccucaaccacgaccucuacuccggcgaccucaacgagcagucccaggcccagcucuccgagggcuccaucacccuccaggucgaggccgucgaguccaccucccaggucgacgagaacgacgucacccucaccgccgacaagggcaagaccgaggacaccuucuucauguccaacaagccccagcgcuacaaggacaagcuccccgacuccggcgacuccaugcuccgcaucuccaccaucgccuccgccaucgccgaggccuccgucaacaccgaccccucccagcucgccgccaugaucaaggcccucuccaacaagacccgcgacaagaccuuccaggaggacgagaagcagaaggacuacucccacguccgccacuuccuccccaacgaccucgagaaguccaacggcuccaacgcccucgacauggagaaguaccucaagaagaccgaggucucccgcuacgaguccgcccucgagaacuucucccgcgccuccauguccgacaccugggaccucucccuccccaaggagcagaccacccaggacauccaccccgucgaccucuccgccaccuccgucuccguccgcgcccccgaggagaacaccgccgccaucgucuacgucgagaacggcgaguccgagaaccaggaguccuuccgcaccaucaacuccuccaacuccgucaccaaccgcgagaacaacuccgccgucgucgacgucaagaccugcuccaucgacaacaagcuccaggacgucggcaacgacgagaaggccaccuccaucuccacccccuccgacuccuacuccuccguccgcaacccccgcaucaccucccucugccuccucaaggacugcgaggagauccgcgacaaccgcgagaaccagcgccagaacgagugcgucuccgagaucuccaacuccgagaagcacgucaccuucgagaaccaccgcaucgucucccccaagaacuccgaccucaagaacaccucccccgagcacggcggccgcggcuccgaggacgagcaggaguccuuccgccccuccaccuccccccucucccacuccucccccuccgagaucuccggcaccuccuccuccggcugcgcccucgaguccuucggcuccgccgcccagcagcagcagccccccugcgagcaggagcucuccccccucgucugcucccccgccggcgucucccgccucaccuacgucuccgagcccgaguccuccuaccccaccaccgccaccgacgacgcccucgaggaccgcaaguccgacaucaccuccgagcucuccaccaccaucauccagggcucccccgccgcccucgaggagcgcgccauggagaagcuccgcgagaagguccccuuccagaaccgcggcaagggcacccucuccuccaucauccagaacaacuccgacacccgcaaggccaccgagaccaccucccucuccuccaagcccgaguacgucaagcccgacuuccgcugguccaaggaccccuccuccaaguccggcaaccuccucgagaccuccgaggucggcuggaccuccaaccccgaggagcucgaccccauccgccucgcccuccucggcaaguccggccucuccugccaggucggcuccgccaccucccaccccgucuccugccaggagcccaucgacgaggaccagcgcaucucccccaaggacaaguccaccgccggccgcgaguucuccggccaggucucccaccagaccaccuccgagaaccagugcacccccauccccuccuccaccguccacuccuccgucgccgacaugcagaacaugcccgccgccguccacgcccuccucacccagcccucccucuccgccgcccccuucgcccagcgcuaccucggcacccuccccuccaccggcuccaccacccucccccagugccacgccggcaacgccaccgucugcggcuucuccggcggccuccccuaccccgccgucgccggcgagcccguccagaacuccgucgccgucggcaucugccucggcuccaacaucggcuccggcuggaugggcaccuccucccucugcaaccccuacuccaacacccucaaccagaaccuccucuccaccaccaagcccuuccccguccccuccgucggcaccaacugcggcaucgagcccugggacuccggcgucaccuccggccucggcuccguccgcguccccgaggagcucaagcucccccacgccugcugcgucggcaucgccucccagacccuccucuccguccucaaccccaccgaccgcuggcuccaggucuccaucggcguccucuccaucuccgucaacggcgagaaggucgaccucuccaccuaccgcugccucgucuucaagaacaaggccaucauccgcccccacgccaccgaggagaucaagguccucuucauccccuccucccccggcgucuuccgcugcaccuucuccgucgccuccuggcccugcuccaccgacgccgagaccaucguccaggccgaggcccucgccuccaccgucacccucaccgccaucgccgagucccccgucaucgaggucgagaccgagaagaaggacguccucgacuucggcgaccucaccuacggcggcuggaaggcccucccccucaagcucaucaaccgcacccacgccaccguccccauccgccucaucaucaacgccaacgccgucgccuggcgcugcuucaccuucuccaaggaguccguccgcgcccccgucgaggucgcccccugcgccgacgucgucacccgccucgccggccccuccgucgucaaccacaugaugcccgccuccuacgacggccaggaccccgaguuccucaugaucuggguccucuuccacucccccaagaagcagaucuccuccuccgacauccucgacuccgccgaggaguucuccgccaaggucgacaucgaggucgacucccccaaccccacccccguccuccgcuccgucucccuccgcgcccgcgccggcaucgcccgcauccacgccccccgcgaccuccagaccaugcacuuccucgccaaggucgccuccucccgcaagcagcaccucccccucaagaacgccggcaacaucgaggucuaccucgacaucaagguccccgagcagggcucccacuucuccgucgaccccaagaaccuccuccucaagcccggcgaggagcacgaggucaucgucuccuucacccccaaggaccccgaggccugcgaggagcgcauccucaagaucuucguccagcccuucggcccccaguacgaggucguccucaagggcgaggucaucuccuccggcuccaagccccucucccccggccccugccucgacauccccuccauccucuccaacaagcaguuccucgccuggggcggcgucccccucggccgcacccagcuccagaagcucgcccuccgcaacaacuccgccuccaccacccagcaccuccgccuccucauccgcggccaggaccaggacugcuuccagcuccagaacaccuucggcuccgagcagcgccucaccuccaacugcgagauccgcauccaccccaaggaggacaucuucaucuccguccucuucgcccccacccgccucuccugcaugcucgcccgccucgagaucaagcagcucggcaaccgcucccagcccggcaucaaguucaccaucccccucuccggcuacggcggcaccuccaaccucauccucgagggcgucaagaagcucuccgacuccuacauggucaccgucaacggccucguccccggcaaggaguccaagaucgucuucuccguccgcaacaccggcucccgcgccgccuucgucaaggccgucggcuucaaggacucccagaagaagguccuccucgaccccaagguccuccgcaucuuccccgacaaguucguccucaaggagcgcacccaggagaacgucacccucaucuacaaccccuccgaccgcggcaucaacaacaagaccgccaccgagcucuccaccgucuaccucuucggcggcgacgagaucucccgccagcaguaccgccgcgcccuccuccacaagcccgagaugaucaagcagauccuccccgagcacuccguccuccagaacaucaacuucgucgaggccuuccaggacgagcuccucgucaccgaggucuacgaccucccccagcgccccaacgacguccagcucuucuacggcuccaugugcaagaucauccucuccgucaucggcgaguuccgcgacugcaucuccucccgcgaguuccuccagcccuccuccaaggccucccucgaguccaccuccgaccucggcgccuccggcaagcacggcggcaacgucucccucgacguccuccccgucaagggcccccagggcuccccccuccucucccgcgccgcccgccccccccucgaccagcucgccuccgaggagcccuggaccguccuccccgagcaccucauccucgucgcccccucccccugcgacauggccaagaccggccgcuuccagaucgucaacaacuccguccgccuccuccgcuucgagcucugcuggcccgcccacugccucaccgucaccccccagcacggcugcgucgcccccgaguccaagcuccagauccucgucucccccaacuccucccucuccaccaagcaguccauguuccccugguccggccucaucuacauccacugcgacgacggccagaagaagaucgucaagguccagauccgcgaggaccucacccaggucgagcuccucacccgccucaccuccaagcccuucggcauccucucccccgucuccgagcccuccgucucccaccucgucaagcccaugaccaagccccccuccaccaaggucgagauccgcaacaaguccaucaccuuccccaccaccgagcccggcgagaccuccgaguccugccucgagcucgagaaccacggcaccaccgacgucaaguggcaccucuccucccucgccccccccuacgucaagggcgucgacgaguccggcgacgucuuccgcgccaccuacgccgccuuccgcugcucccccaucuccggccuccucgagucccacggcauccagaaggucuccaucaccuuccucccccgcggccgcggcgacuacgcccaguucugggacgucgagugccacccccucaaggagccccacaugaagcacacccuccgcuuccagcucuccggccaguccaucgaggccgagaacgagcccgagaacgccugccucuccaccgacucccucaucaagaucgaccaccucgucaagccccgccgccaggccgucuccgaggccuccgcccgcauccccgagcagcucgacgucaccgcccgcggcgucuacgcccccgaggacgucuaccgcuuccgccccaccuccgucggcgagucccgcacccucaaggucaaccuccgcaacaacuccuucaucacccacucccucaaguuccucuccccccgcgagcccuucuacgucaagcacuccaaguacucccuccgcgcccagcacuacaucaacaugcccguccaguucaagcccaaguccgccggcaaguucgaggcccuccucgucauccagaccgacgagggcaaguccaucgccauccgccucaucggcgaggcccucggcaagaacuga

SEQ ID NO: 41206 - RNA, 504 nt, Artificial Sequence
  derived and/or modified sequence opt2 from CEP19__Homo_sapiens__NP_116287
auguacaugggcaugaugugcaccgccaagaagugcggcauccgcuuccagccccccgccaucauccucaucuacgaguccgagaucaagggcaagauccgccagcgcaucaugcccguccgcaacuucuccaaguucuccgacugcacccgcgccgccgagcagcucaagaacaacccccgccacaaguccuaccucgagcaggucucccuccgccagcucgagaagcucuucuccuuccuccgcggcuaccucuccggccagucccucgccgagaccauggagcagauccagcgcgagaccaccaucgaccccgaggaggaccucaacaagcucgacgacaaggagcucgccaagcgcaaguccaucauggacgagcucuucgagaagaaccagaagaagaaggacgaccccaacuucgucuacgacaucgaggucgaguucccccaggacgaccagcuccaguccugcggcugggacaccgaguccgccgacgaguucuga

SEQ ID NO: 41207 - RNA, 7329 nt, Artificial Sequence
  derived and/or modified sequence opt2 from CEP250__Homo_sapiens__NP_009117
auggagacccgcucccccggccucaacaacaugaagccccagucccuccagcucguccucgaggagcagguccucgcccuccagcagcagauggccgagaaccaggccgccuccuggcgcaagcucaagaacucccaggaggcccagcagcgccaggccacccucguccgcaagcuccaggccaagguccuccaguaccgcuccuggugccaggagcucgagaagcgccucgaggccaccggcggccccaucccccagcgcugggagaacgucgaggagcccaaccucgacgagcuccucguccgccucgaggaggagcagcagcgcugcgagucccucgccgaggucaacacccagcuccgccuccacauggagaaggccgacgucgucaacaaggcccuccgcgaggacgucgagaagcucaccgucgacuggucccgcgcccgcgacgagcucaugcgcaaggagucccaguggcagauggagcaggaguucuucaagggcuaccucaagggcgagcacggccgccuccucucccucuggcgcgaggucgucaccuuccgccgccacuuccucgagaugaaguccgccaccgaccgcgaccucauggagcucaaggccgagcacguccgccucuccggcucccuccucaccugcugccuccgccucaccgucggcgcccagucccgcgagcccaacggcuccggccgcauggacggccgcgagcccgcccagcuccuccuccuccucgccaagacccaggagcucgagaaggaggcccacgagcgcucccaggagcucauccagcucaagucccagggcgaccucgagaaggccgagcuccaggaccgcgucaccgagcucuccgcccuccucacccagucccagaagcagaacgaggacuacgagaagaugaucaaggcccuccgcgagaccgucgagauccucgagaccaaccacaccgagcucauggagcacgaggccucccucucccgcaacgcccaggaggagaagcucucccuccagcaggucaucaaggacaucacccaggucauggucgaggagggcgacaacaucgcccagggcuccggccacgagaacucccucgagcucgacuccuccaucuucucccaguucgacuaccaggacgccgacaaggcccucacccucguccgcuccguccucacccgccgccgccaggccguccaggaccuccgccagcagcucgccggcugccaggaggccgucaaccuccuccagcagcagcacgaccagugggaggaggagggcaaggcccuccgccagcgccuccagaagcucaccggcgagcgcgacacccucgccggccagaccgucgaccuccagggcgaggucgacucccucuccaaggagcgcgagcuccuccagaaggcccgcgaggagcuccgccagcagcucgagguccucgagcaggaggccuggcgccuccgccgcgucaacgucgagcuccagcuccagggcgacuccgcccagggccagaaggaggagcagcaggaggagcuccaccucgccguccgcgagcgcgagcgccuccaggagaugcucaugggccucgaggccaagcaguccgagucccucuccgagcucaucacccuccgcgaggcccucgaguccucccaccucgagggcgagcuccuccgccaggagcagaccgaggucaccgccgcccucgcccgcgccgagcaguccaucgccgagcucuccuccuccgagaacacccucaagaccgaggucgccgaccuccgcgccgccgccgucaagcucuccgcccucaacgaggcccucgcccucgacaaggucggccucaaccagcagcuccuccagcucgaggaggagaaccaguccgucugcucccgcauggaggccgccgagcaggcccgcaacgcccuccaggucgaccucgccgaggccgagaagcgccgcgaggcccucugggagaagaacacccaccucgaggcccagcuccagaaggccgaggaggccggcgccgagcuccaggccgaccuccgcgacauccaggaggagaaggaggagauccagaagaagcucuccgagucccgccaccagcaggaggccgccaccacccagcucgagcagcuccaccaggaggccaagcgccaggaggagguccucgcccgcgccguccaggagaaggaggcccucguccgcgagaaggccgcccucgagguccgccuccaggccgucgagcgcgaccgccaggaccucgccgagcagcuccagggccucuccuccgccaaggagcuccucgaguccucccucuucgaggcccagcagcagaacuccgucaucgaggucaccaagggccagcucgagguccagauccagaccgucacccaggccaaggaggucauccagggcgagguccgcugccucaagcucgagcucgacaccgagcgcucccaggccgagcaggagcgcgacgccgccgcccgccagcucgcccaggccgagcaggagggcaagaccgcccucgagcagcagaaggccgcccacgagaaggaggucaaccagcuccgcgagaagugggagaaggagcgcuccuggcaccagcaggagcucgccaaggcccucgagucccucgagcgcgagaagauggagcucgagaugcgccucaaggagcagcagaccgagauggaggccauccaggcccagcgcgaggaggagcgcacccaggccgaguccgcccucugccagaugcagcucgagaccgagaaggagcgcgucucccuccucgagacccuccuccagacccagaaggagcucgccgacgccucccagcagcucgagcgccuccgccaggacaugaagguccagaagcucaaggagcaggagaccaccggcauccuccagacccagcuccaggaggcccagcgcgagcucaaggaggccgcccgccagcaccgcgacgaccucgccgcccuccaggaggaguccuccucccuccuccaggacaagauggaccuccagaagcaggucgaggaccucaagucccagcucgucgcccaggacgacucccagcgccucgucgagcaggagguccaggagaagcuccgcgagacccaggaguacaaccgcauccagaaggagcucgagcgcgagaaggccucccucacccucucccucauggagaaggagcagcgccuccucguccuccaggaggccgacuccauccgccagcaggagcucuccgcccuccgccaggacaugcaggaggcccagggcgagcagaaggagcucuccgcccagauggagcuccuccgccaggaggucaaggagaaggaggccgacuuccucgcccaggaggcccagcuccucgaggagcucgaggccucccacaucaccgagcagcagcuccgcgccucccucugggcccaggaggccaaggccgcccagcuccagcuccgccuccgcuccaccgagucccagcucgaggcccucgccgccgagcagcagcccggcaaccaggcccaggcccaggcccagcucgccucccucuacuccgcccuccagcaggcccucggcuccgucugcgagucccgccccgagcucuccggcggcggcgacuccgcccccuccgucuggggccucgagcccgaccagaacggcgcccgcucccucuucaagcgcggcccccuccucaccgcccucuccgccgaggccgucgccuccgcccuccacaagcuccaccaggaccucuggaagacccagcagacccgcgacguccuccgcgaccagguccagaagcucgaggagcgccucaccgacaccgaggccgagaagucccagguccacaccgagcuccaggaccuccagcgccagcucucccagaaccaggaggagaaguccaagugggagggcaagcagaacucccucgaguccgagcucauggagcuccacgagaccauggccucccuccagucccgccuccgccgcgccgagcuccagcgcauggaggcccagggcgagcgcgagcuccuccaggccgccaaggagaaccucaccgcccaggucgagcaccuccaggccgccgucgucgaggcccgcgcccaggccuccgccgccggcauccucgaggaggaccuccgcaccgcccgcuccgcccucaagcucaagaacgaggaggucgaguccgagcgcgagcgcgcccaggcccuccaggagcagggcgagcucaaggucgcccagggcaaggcccuccaggagaaccucgcccuccucacccagacccucgccgagcgcgaggaggaggucgagacccuccgcggccagauccaggagcucgagaagcagcgcgagaugcagaaggccgcccucgagcuccucucccucgaccucaagaagcgcaaccaggaggucgaccuccagcaggagcagauccaggagcucgagaagugccgcuccguccucgagcaccuccccauggccguccaggagcgcgagcagaagcucaccguccagcgcgagcagauccgcgagcucgagaaggaccgcgagacccagcgcaacguccucgagcaccagcuccucgagcucgagaagaaggaccagaugaucgagucccagcgcggccagguccaggaccucaagaagcagcucgucacccucgagugccucgcccucgagcucgaggagaaccaccacaagauggagugccagcagaagcucaucaaggagcucgagggccagcgcgagacccagcgcgucgcccucacccaccucacccucgaccucgaggagcgcucccaggagcuccaggcccaguccucccagauccacgaccucgagucccacuccaccguccucgcccgcgagcuccaggagcgcgaccaggaggucaagucccagcgcgagcagaucgaggagcuccagcgccagaaggagcaccucacccaggaccucgagcgccgcgaccaggagcucaugcuccagaaggagcgcauccagguccucgaggaccagcgcacccgccagaccaagauccucgaggaggaccucgagcagaucaagcucucccuccgcgagcgcggccgcgagcucaccacccagcgccagcucaugcaggagcgcgccgaggagggcaagggccccuccaaggcccagcgcggcucccucgagcacaugaagcucauccuccgcgacaaggagaaggaggucgagugccagcaggagcacauccacgagcuccaggagcucaaggaccagcucgagcagcagcuccagggccuccaccgcaaggucggcgagaccucccuccuccucucccagcgcgagcaggagaucgucguccuccagcagcagcuccaggaggcccgcgagcagggcgagcucaaggagcagucccuccagucccagcucgacgaggcccagcgcgcccucgcccagcgcgaccaggagcucgaggcccuccagcaggagcagcagcaggcccagggccaggaggagcgcgucaaggagaaggccgacgcccuccagggcgcccucgagcaggcccacaugacccucaaggagcgccacggcgagcuccaggaccacaaggagcaggcccgccgccucgaggaggagcucgccgucgagggccgccgcguccaggcccucgaggagguccucggcgaccuccgcgccgagucccgcgagcaggagaaggcccuccucgcccuccagcagcagugcgccgagcaggcccaggagcacgaggucgagacccgcgcccuccaggacuccuggcuccaggcccaggccguccucaaggagcgcgaccaggagcucgaggcccuccgcgccgagucccaguccucccgccaccaggaggaggccgcccgcgcccgcgccgaggcccuccaggaggcccucggcaaggcccacgccgcccuccagggcaaggagcagcaccuccucgagcaggccgagcucucccgcucccucgaggccuccaccgccacccuccaggccucccucgacgccugccaggcccacucccgccagcucgaggaggcccuccgcauccaggagggcgagauccaggaccaggaccuccgcuaccaggaggacguccagcagcuccagcaggcccucgcccagcgcgacgaggagcuccgccaccagcaggagcgcgagcagcuccucgagaagucccucgcccagcgcguccaggagaacaugauccaggagaagcagaaccucggccaggagcgcgaggaggaggagauccgcggccuccaccaguccguccgcgagcuccagcucacccucgcccagaaggagcaggagauccucgagcuccgcgagacccagcagcgcaacaaccucgaggcccucccccacucccacaagaccucccccauggaggagcagucccucaagcucgacucccucgagccccgccuccagcgcgagcucgagcgccuccaggccgcccuccgccagaccgaggcccgcgagaucgaguggcgcgagaaggcccaggaccucgcccucucccucgcccagaccaaggccuccgucuccucccuccaggaggucgccauguuccuccaggccuccguccucgagcgcgacuccgagcagcagcgccuccaggacgagcucgagcucacccgccgcgcccucgagaaggagcgccuccacucccccggcgccaccuccaccgccgagcucggcucccgcggcgagcagggcguccagcucggcgaggucuccggcgucgaggccgagcccucccccgacggcauggagaagcaguccuggcgccagcgccucgagcaccuccagcaggccgucgcccgccucgagaucgaccgcucccgccuccagcgccacaacguccagcuccgcuccacccucgagcaggucgagcgcgagcgccgcaagcucaagcgcgaggccaugcgcgccgcccaggccggcucccucgagaucuccaaggccaccgccuccucccccacccagcaggacggccgcggccagaagaacuccgacgccaagugcgucgccgagcuccagaaggaggucguccuccuccaggcccagcucacccucgagcgcaagcagaagcaggacuacaucacccgcuccgcccagaccucccgcgagcucgccggccuccaccacucccucucccacucccuccucgccgucgcccaggcccccgaggccaccguccucgaggccgagacccgccgccucgacgagucccucacccagucccucaccucccccggccccguccuccuccaccccucccccuccaccacccaggccgccucccgcuga

SEQ ID NO: 41208 - RNA, 7440 nt, Artificial Sequence
  derived and/or modified sequence opt2 from CEP290__Homo_sapiens__NP_079390
augccccccaacaucaacuggaaggagaucaugaaggucgaccccgacgaccucccccgccaggaggagcucgccgacaaccuccucaucucccucuccaaggucgaggucaacgagcucaaguccgagaagcaggagaacgucauccaccucuuccgcaucacccagucccucaugaagaugaaggcccaggaggucgagcucgcccucgaggaggucgagaaggccggcgaggagcaggccaaguucgagaaccagcucaagaccaaggucaugaagcucgagaacgagcucgagauggcccagcaguccgccggcggccgcgacacccgcuuccuccgcaacgagaucugccagcucgagaagcagcucgagcagaaggaccgcgagcucgaggacauggagaaggagcucgagaaggagaagaaggucaacgagcagcucgcccuccgcaacgaggaggccgagaacgagaacuccaagcuccgccgcgagaacaagcgccucaagaagaagaacgagcagcucugccaggacaucaucgacuaccagaagcagaucgacucccagaaggagacccuccucucccgccgcggcgaggacuccgacuaccgcucccagcucuccaagaagaacuacgagcucauccaguaccucgacgagauccagacccucaccgaggccaacgagaagaucgagguccagaaccaggagaugcgcaagaaccucgaggaguccguccaggagauggagaagaugaccgacgaguacaaccgcaugaaggccaucguccaccagaccgacaacgucaucgaccagcucaagaaggagaacgaccacuaccagcuccagguccaggagcucaccgaccuccucaaguccaagaacgaggaggacgaccccaucauggucgccgucaacgccaaggucgaggaguggaagcucauccucuccuccaaggacgacgagaucaucgaguaccagcagaugcuccacaaccuccgcgagaagcucaagaacgcccagcucgacgccgacaaguccaacgucauggcccuccagcagggcauccaggagcgcgacucccagaucaagaugcucaccgagcaggucgagcaguacaccaaggagauggagaagaacaccugcaucaucgaggaccucaagaacgagcuccagcgcaacaagggcgccuccacccucucccagcagacccacaugaagauccaguccacccucgacauccucaaggagaagaccaaggaggccgagcgcaccgccgagcucgccgaggccgacgcccgcgagaaggacaaggagcucgucgaggcccucaagcgccucaaggacuacgaguccggcgucuacggccucgaggacgccgucgucgagaucaagaacugcaagaaccagaucaagauccgcgaccgcgagaucgagauccucaccaaggagaucaacaagcucgagcucaagaucuccgacuuccucgacgagaacgaggcccuccgcgagcgcgucggccucgagcccaagaccaugaucgaccucaccgaguuccgcaacuccaagcaccucaagcagcagcaguaccgcgccgagaaccagauccuccucaaggagaucgagucccucgaggaggagcgccucgaccucaagaagaagauccgccagauggcccaggagcgcggcaagcgcuccgccaccuccggccucaccaccgaggaccucaaccucaccgagaacaucucccagggcgaccgcaucuccgagcgcaagcucgaccuccucucccucaagaacauguccgaggcccaguccaagaacgaguuccucucccgcgagcucaucgagaaggagcgcgaccucgagcgcucccgcaccgucaucgccaaguuccagaacaagcucaaggagcucgucgaggagaacaagcagcucgaggagggcaugaaggagauccuccaggccaucaaggagaugcagaaggaccccgacgucaagggcggcgagaccucccucaucauccccucccucgagcgccucgucaacgccaucgaguccaagaacgccgagggcaucuucgacgccucccuccaccucaaggcccaggucgaccagcucaccggccgcaacgaggagcuccgccaggagcuccgcgagucccgcaaggaggccaucaacuacucccagcagcucgccaaggccaaccucaagaucgaccaccucgagaaggagaccucccuccuccgccaguccgagggcuccaacgucgucuucaagggcaucgaccuccccgacggcaucgcccccuccuccgccuccaucaucaacucccagaacgaguaccucauccaccuccuccaggagcucgagaacaaggagaagaagcucaagaaccucgaggacucccucgaggacuacaaccgcaaguucgccgucauccgccaccagcagucccuccucuacaaggaguaccucuccgagaaggagaccuggaagaccgaguccaagaccaucaaggaggagaagcgcaagcucgaggaccagguccagcaggacgccaucaaggucaaggaguacaacaaccuccucaacgcccuccagauggacuccgacgagaugaagaagauccucgccgagaacucccgcaagaucaccguccuccaggucaacgagaagucccucauccgccaguacaccacccucgucgagcucgagcgccagcuccgcaaggagaacgagaagcagaagaacgagcuccucuccauggaggccgaggucugcgagaagaucggcugccuccagcgcuucaaggagauggccaucuucaagaucgccgcccuccagaaggucgucgacaacuccgucucccucuccgagcucgagcucgccaacaagcaguacaacgagcucaccgccaaguaccgcgacauccuccagaaggacaacaugcucguccagcgcaccuccaaccucgagcaccucgagugcgagaacaucucccucaaggagcaggucgaguccaucaacaaggagcucgagaucaccaaggagaagcuccacaccaucgagcaggccugggagcaggagaccaagcucggcaacgaguccuccauggacaaggccaagaaguccaucaccaacuccgacaucgucuccaucuccaagaagaucaccaugcucgagaugaaggagcucaacgagcgccagcgcgccgagcacugccagaagauguacgagcaccuccgcaccucccucaagcagauggaggagcgcaacuucgagcucgagaccaaguucgccgagcucaccaagaucaaccucgacgcccagaaggucgagcagaugcuccgcgacgagcucgccgacuccgucuccaaggccgucuccgacgccgaccgccagcgcauccucgagcucgagaagaacgagauggagcucaaggucgaggucuccaagcuccgcgagaucuccgacaucgcccgccgccaggucgagauccucaacgcccagcagcagucccgcgacaaggaggucgagucccuccgcaugcagcuccucgacuaccaggcccaguccgacgagaagucccucaucgccaagcuccaccagcacaacgucucccuccagcucuccgaggccaccgcccucggcaagcucgaguccaucaccuccaagcuccagaagauggaggccuacaaccuccgccucgagcagaagcucgacgagaaggagcaggcccucuacuacgcccgccucgagggccgcaaccgcgccaagcaccuccgccagaccauccagucccuccgccgccaguucuccggcgcccucccccucgcccagcaggagaaguucuccaagaccaugauccagcuccagaacgacaagcucaagaucaugcaggagaugaagaacucccagcaggagcaccgcaacauggagaacaagacccucgagauggagcucaagcucaagggccucgaggagcucaucuccacccucaaggacaccaagggcgcccagaaggucaucaacuggcacaugaagaucgaggagcuccgccuccaggagcucaagcucaaccgcgagcucgucaaggacaaggaggagaucaaguaccucaacaacaucaucuccgaguacgagcgcaccaucuccucccucgaggaggagaucguccagcagaacaaguuccacgaggagcgccagauggccugggaccagcgcgaggucgaccucgagcgccagcucgacaucuucgaccgccagcagaacgagauccucaacgccgcccagaaguucgaggaggccaccggcuccauccccgaccccucccucccccuccccaaccagcucgagaucgcccuccgcaagaucaaggagaacauccgcaucauccucgagacccgcgccaccugcaagucccucgaggagaagcucaaggagaaggaguccgcccuccgccucgccgagcagaacauccucucccgcgacaaggucaucaacgagcuccgccuccgccuccccgccaccgccgagcgcgagaagcucaucgccgagcucggccgcaaggagauggagcccaagucccaccacacccucaagaucgcccaccagaccaucgccaacaugcaggcccgccucaaccagaaggaggagguccucaagaaguaccagcgccuccucgagaaggcccgcgaggagcagcgcgagaucgucaagaagcacgaggaggaccuccacauccuccaccaccgccucgagcuccaggccgacuccucccucaacaaguucaagcagaccgccugggaccucaugaagcagucccccacccccguccccaccaacaagcacuucauccgccucgccgagauggagcagaccgucgccgagcaggacgacucccucuccucccuccucgucaagcucaagaaggucucccaggaccucgagcgccagcgcgagaucaccgagcucaaggucaaggaguucgagaacaucaagcuccagcuccaggagaaccacgaggacgaggucaagaaggucaaggccgaggucgaggaccucaaguaccuccucgaccagucccagaaggagucccagugccucaaguccgagcuccaggcccagaaggaggccaacucccgcgcccccaccaccaccaugcgcaaccucgucgagcgccucaagucccagcucgcccucaaggagaagcagcagaaggcccucucccgcgcccuccucgagcuccgcgccgagaugaccgccgccgccgaggagcgcaucaucuccgccaccucccagaaggaggcccaccucaacguccagcagaucgucgaccgccacacccgcgagcucaagacccaggucgaggaccucaacgagaaccuccucaagcucaaggaggcccucaagaccuccaagaaccgcgagaacucccucaccgacaaccucaacgaccucaacaacgagcuccagaagaagcagaaggccuacaacaagauccuccgcgagaaggaggagaucgaccaggagaacgacgagcucaagcgccagaucaagcgccucaccuccggccuccagggcaagccccucaccgacaacaagcagucccucaucgaggagcuccagcgcaaggucaagaagcucgagaaccagcucgagggcaaggucgaggaggucgaccucaagcccaugaaggagaagaacgccaaggaggagcucauccgcugggaggagggcaagaaguggcaggccaagaucgagggcauccgcaacaagcucaaggagaaggagggcgaggucuucacccucaccaagcagcucaacacccucaaggaccucuucgccaaggccgacaaggagaagcucacccuccagcgcaagcucaagaccaccggcaugaccgucgaccagguccucggcauccgcgcccucgaguccgagaaggagcucgaggagcucaagaagcgcaaccucgaccucgagaacgacauccucuacaugcgcgcccaccaggcccucccccgcgacuccgucgucgaggaccuccaccuccagaaccgcuaccuccaggagaagcuccacgcccucgagaagcaguucuccaaggacaccuacuccaagcccuccaucuccggcaucgaguccgacgaccacugccagcgcgagcaggagcuccagaaggagaaccucaagcucuccuccgagaacaucgagcucaaguuccagcucgagcaggccaacaaggaccucccccgccucaagaaccagguccgcgaccucaaggagaugugcgaguuccucaagaaggagaaggccgagguccagcgcaagcucggccacguccgcggcuccggccgcuccggcaagaccauccccgagcucgagaagaccaucggccucaugaagaaggucgucgagaagguccagcgcgagaacgagcagcucaagaaggccuccggcauccucaccuccgagaagauggccaacaucgagcaggagaacgagaagcucaaggccgagcucgagaagcucaaggcccaccucggccaccagcucuccaugcacuacgaguccaagaccaagggcaccgagaagaucaucgccgagaacgagcgccuccgcaaggagcucaagaaggagaccgacgccgccgagaagcuccgcaucgccaagaacaaccucgagauccucaacgagaagaugaccguccagcucgaggagaccggcaagcgccuccaguucgccgagucccgcggcccccagcucgagggcgccgacuccaaguccuggaaguccaucgucgucacccgcauguacgagaccaagcucaaggagcucgagaccgacaucgccaagaagaaccaguccaucaccgaccucaagcagcucgucaaggaggccaccgagcgcgagcagaaggucaacaaguacaacgaggaccucgagcagcagaucaagauccucaagcacguccccgagggcgccgagaccgagcagggccucaagcgcgagcuccagguccuccgccucgccaaccaccagcucgacaaggagaaggccgagcucauccaccagaucgaggccaacaaggaccaguccggcgccgaguccaccauccccgacgccgaccagcucaaggagaagaucaaggaccucgagacccagcucaagauguccgaccucgagaagcagcaccucaaggaggagaucaagaagcucaagaaggagcucgagaacuucgaccccuccuucuucgaggagaucgaggaccucaaguacaacuacaaggaggaggucaagaagaacauccuccucgaggagaaggucaagaagcucuccgagcagcucggcgucgagcucaccucccccgucgccgccuccgaggaguucgaggacgaggaggagucccccgucaacuuccccaucuacuga

SEQ ID NO: 41209 - RNA, 906 nt, Artificial Sequence
  derived and/or modified sequence opt2 from CEP41__Homo_sapiens__NP_001244087
augucccuccgccgccacaucggcaaccccgaguaccucaugaagcgcaucccccagaacccccgcuaccagcacaucaagucccgccucgacaccggcaacuccaugaccaaguacaccgagaagcucgaggagaucaagaagaacuaccgcuacaagaaggacgagcucuucaagcgccucaaggucaccaccuucgcccagcucaucauccaggucgccucccucuccgaccagacccucgaggucaccgccgaggagauccagcgccucgaggacaacgacuccgccgccuccgaccccgacgccgagaccaccgcccgcaccaacggcaagggcaaccccggcgagcagucccccucccccgagcaguucaucaacaacgccggcgccggcgacuccucccgcuccacccuccaguccgucaucuccggcgucggcgagcucgaccucgacaagggccccgucaagaaggccgagccccacaccaaggacaagcccuaccccgacugccccuuccuccuccucgacguccgcgaccgcgacuccuaccagcagugccacaucgucggcgccuacuccuaccccaucgccacccucucccgcaccaugaaccccuacuccaacgacauccucgaguacaagaacgcccacggcaagaucaucauccucuacgacgacgacgagcgccucgccucccaggccgccaccaccaugugcgagcgcggcuucgagaaccucuucaugcucuccggcggccgccucaaccaggccaacuccuccggccgcgaguccaagguccccggcgcccgcuccgcccagaaccuccccggcggcggccccgccucccacuccaacccccgcucccucuccuccggccaccuccagggcaagcccuggaaguga

SEQ ID NO: 41210 - RNA, 1395 nt, Artificial Sequence
  derived and/or modified sequence opt2 from CEP55__Homo_sapiens__NP_001120654
auguccucccgcuccaccaaggaccucaucaaguccaaguggggcuccaagcccuccaacuccaaguccgagaccacccucgagaagcucaagggcgagaucgcccaccucaagaccuccgucgacgagaucaccuccggcaagggcaagcucaccgacaaggagcgccaccgccuccucgagaagauccgcguccucgaggccgagaaggagaagaacgccuaccagcucaccgagaaggacaaggagauccagcgccuccgcgaccagcucaaggcccgcuacuccaccaccgcccuccucgagcagcucgaggagaccacccgcgagggcgagcgccgcgagcagguccucaaggcccucuccgaggagaaggacguccucaagcagcagcucuccgccgccaccucccgcaucgccgagcucgaguccaagaccaacacccuccgccucucccagaccgucgcccccaacugcuucaacuccuccaucaacaacauccacgagauggagauccagcucaaggacgcccucgagaagaaccagcaguggcucgucuacgaccagcagcgcgaggucuacgucaagggccuccucgccaagaucuucgagcucgagaagaagaccgagaccgccgcccacucccucccccagcagaccaagaagcccgaguccgagggcuaccuccaggaggagaagcagaagugcuacaacgaccuccucgccuccgccaagaaggaccucgaggucgagcgccagaccaucacccagcucuccuucgagcucuccgaguuccgccgcaaguacgaggagacccagaaggagguccacaaccucaaccagcuccucuacucccagcgccgcgccgacguccagcaccucgaggacgaccgccacaagaccgagaagauccagaagcuccgcgaggagaacgacaucgcccgcggcaagcucgaggaggagaagaagcgcuccgaggagcuccucucccagguccaguuccucuacaccucccuccucaagcagcaggaggagcagacccgcgucgcccuccucgagcagcagaugcaggccugcacccucgacuucgagaacgagaagcucgaccgccagcacguccagcaccagcuccacgucauccucaaggagcuccgcaaggcccgcaaccagaucacccagcucgagucccucaagcagcuccacgaguucgccaucaccgagccccucgucaccuuccagggcgagaccgagaaccgcgagaaggucgccgccucccccaagucccccaccgccgcccucaacgagucccucgucgagugccccaagugcaacauccaguaccccgccaccgagcaccgcgaccuccucguccacgucgaguacugcuccaaguga

SEQ ID NO: 41211 - RNA, 1476 nt, Artificial Sequence
  derived and/or modified sequence opt2 from CEP57__Homo_sapiens__NP_001230705
augcucacccgcaucgacaacuccuucgccgagcccucccgcuccaacggcuccaugguccgccacuccuccucccccuacgucgucuaccccuccgacaagcccuuccucaacuccgaccuccgccgcucccccuccaagcccacccucgccuaccccgaguccaacucccgcgccaucuucuccgcccucaagaaccuccaggacaagauccgccgccucgagcucgagcgcauccaggccgaggaguccgucaagacccucucccgcgagaccaucgaguacaagaagguccucgacgagcagauccaggagcgcgagaacuccaagaacgaggaguccaagcacaaccaggagcucaccucccagcuccucgccgccgagaacaagugcaaccuccucgagaagcagcucgaguacaugcgcaacaugaucaagcacgccgagauggagcgcaccuccguccucgagaagcaggucucccucgagcgcgagcgccagcacgaccagacccacguccagucccagcucgagaagcucgaccuccucgagcaggaguacaacaagcucaccaccaugcaggcccucgccgagaagaagaugcaggagcucgaggccaagcuccacgaggaggagcaggagcgcaagcgcaugcaggccaaggccgccgagcuccagaccggccucgagaccaaccgccucaucuucgaggacaaggccacccccugcguccccaacgcccgccgcaucaagaagaagaaguccaagccccccgagaagaaguccucccgcaacuacuucggcgcccagccccacuaccgccucugccucggcgacaugcccuucgucgccggcaaguccaccucccccucccacgccgucgucgccaacguccagcucguccuccaccucaugaagcagcacuccaaggcccucugcaacgaccgcgucaucaacuccaucccccucgccaagcaggucuccucccgcggcggcaaguccaagaagcucuccgucaccccccccuccuccaacggcaucaacgaggagcucuccgagguccuccagacccuccaggacgaguucggccagauguccuucgaccaccagcagcucgccaagcucauccaggagucccccaccgucgagcucaaggacaagcucgagugcgagcucgaggcccucgucggccgcauggaggccaaggccaaccagaucaccaagguccgcaaguaccaggcccagcucgagaagcagaagcucgagaagcagaagaaggagcucaaggccaccaagaagacccucgacgaggagcgcaacuccuccucccgcuccggcaucaccggcaccaccaacaagaaggacuucaugaagcuccgccccggcgagaagcgccgcaagaaccuccagcuccucaaggacaugcaguccauccagaacucccuccaguccuccucccucugcugggacuacuga

SEQ ID NO: 41212 - RNA, 1488 nt, Artificial Sequence
  derived and/or modified sequence opt2 from CEP63__Homo_sapiens__NP_001035842
auggaggcccuccucgagggcauccagaaccgcggccacggcggcggcuuccucaccuccugcgaggccgagcuccaggagcucaugaagcagaucgacaucauggucgcccacaagaaguccgagugggagggccgcacccacgcccucgagaccugccucaagauccgcgagcaggagcucaagucccuccgcucccagcucgacgucacccacaaggaggucggcaugcuccaccagcaggucgaggagcacgagaagaucaagcaggagaugaccauggaguacaagcaggagcucaagaagcuccacgaggagcucugcauccucaagcgcuccuacgagaagcuccagaagaagcagaugcgcgaguuccgcggcaacaccaagaaccaccgcgaggaccgcuccgagaucgagcgccucaccgccaagaucgaggaguuccgccagaagucccucgacugggagaagcagcgccucaucuaccagcagcaggucuccucccucgaggcccagcgcaaggcccucgccgagcaguccgagaucauccaggcccagcucgucaaccgcaagcagaagcucgaguccgucgagcucuccucccaguccgagauccagcaccucuccuccaagcucgagcgcgccaacgacaccaucugcgccaacgagcucgagaucgagcgccucaccaugcgcgucaacgaccucgucggcaccuccaugaccguccuccaggagcagcagcagaaggaggagaagcuccgcgaguccgagaagcuccucgaggcccuccaggaggagaagcgcgagcucaaggccgcccuccagucccaggagaaccucauccacgaggcccgcauccagaaggagaagcuccaggagaaggucaaggccaccaacacccagcacgccgucgaggccaucucccucgaguccgucuccgccaccugcaagcagcucucccaggagcucauggagaaguacgaggagcucaagcgcauggaggcccacaacaacgaguacaaggccgagaucaagaagcucaaggagcagauccuccagggcgagcaguccuacuccuccgcccucgagggcaugaagauggagaucucccaccucacccaggagcuccaccagcgcgacaucaccaucgccuccaccaagggcuccuccuccgacauggagaagcgccuccgcgccgagaugcagaaggccgaggacaaggccgucgagcacaaggagauccucgaccagcucgagucccucaagcucgagaaccgccaccucuccgagauggucaugaagcucgagcucggccuccacgagugcucccuccccgucuccccccucggcuccaucgccacccgcuuccucgaggaggaggagcuccgcucccaccacauccucgagcgccucgacgcccacaucgaggagcucaagcgcgaguccgagaagaccguccgccaguucaccgcccucaaguga

SEQ ID NO: 41213 - RNA, 2274 nt, Artificial Sequence
  derived and/or modified sequence opt2 from CEP68__Homo_sapiens__NP_055962
auggcccucggcgaggagaaggccgaggccgaggccuccgaggacaccaaggcccaguccuacggccgcggcuccugccgcgagcgcgagcucgacauccccggccccauguccggcgagcagcccccccgccucgaggccgagggcggccucaucucccccgucuggggcgccgagggcauccccgcccccaccugcuggaucggcaccgaccccggcggccccucccgcgcccaccagccccaggccuccgacgccaaccgcgagcccgucgccgagcgcuccgagcccgcccucuccggccucccccccgccaccaugggcuccggcgaccuccuccucuccggcgagucccaggucgagaagaccaagcucuccuccuccgaggaguucccccagacccucucccucccccgcaccaccaccaucugcuccggccacgacgccgacaccgaggacgaccccucccucgccgaccucccccaggcccucgaccucucccagcagccccacuccuccggccucuccugccucucccaguggaaguccguccucucccccggcuccgccgcccagcccuccuccugcuccaucuccgccuccuccaccggcuccucccuccagggccaccaggagcgcgccgagccccgcggcggcucccucgccaaggucuccuccucccucgagcccgucgucccccaggagcccuccuccgucgucggccucggcccccgcccccagugguccccccagcccgucuucuccggcggcgacgccuccggccucggccgccgccgccucuccuuccaggccgaguacugggccugcguccuccccgacucccucccccccucccccgaccgccacuccccccucuggaaccccaacaaggaguacgaggaccuccucgacuacaccuacccccuccgccccggcccccagcuccccaagcaccucgacucccgcguccccgccgaccccguccuccaggacuccggcgucgaccucgacuccuucuccgucucccccgccuccacccucaagucccccaccaacgucucccccaacugcccccccgccgaggccaccgcccuccccuucuccggcccccgcgagcccucccucaagcaguggcccucccgcgucccccagaagcagggcggcaugggccucgccuccuggucccagcucgccuccaccccccgcgcccccggcucccgcgacgcccgcugggagcgccgcgagcccgcccuccgcggcgccaaggaccgccucaccaucggcaagcaccucgacaugggcuccccccagcuccgcacccgcgaccgcggcuggcccuccccccgccccgagcgcgagaagcgcaccucccaguccgcccgccgccccaccugcaccgagucccgcuggaaguccgaggaggaggucgaguccgacgacgaguaccucgcccuccccgcccgccucacccaggucuccucccucgucuccuaccucggcuccaucuccacccucgucacccuccccaccggcgacaucaagggccaguccccccucgaggucuccgacuccgacggccccgccuccuuccccuccuccuccucccagucccagcucccccccggcgccgcccuccagggcuccggcgaccccgagggccagaaccccugcuuccuccgcuccuucguccgcgcccacgacuccgccggcgagggcucccucggcuccucccaggcccucggcgucuccuccggccuccucaagacccgccccucccuccccgcccgccucgaccgcuggcccuucuccgaccccgacgucgagggccagcucccccgcaagggcggcgagcagggcaaggagucccucguccagugcgucaagaccuucugcugccagcucgaggagcucaucugcuggcucuacaacgucgccgacgucaccgaccacggcaccgccgcccgcuccaaccucaccucccucaaguccucccuccagcucuaccgccaguucaagaaggacaucgacgagcaccagucccucaccgaguccguccuccagaagggcgagauccuccuccagugccuccucgagaacacccccguccucgaggacguccucggccgcaucgccaagcaguccggcgagcucgagucccacgccgaccgccucuacgacuccauccucgccucccucgacaugcucgccggcugcacccucauccccgacaagaagcccauggccgccauggagcaccccugcgagggcgucuga

SEQ ID NO: 41214 - RNA, 1944 nt, Artificial Sequence
  derived and/or modified sequence opt2 from CEP72__Homo_sapiens__NP_060610
auggcccgcgccggcccccgccucguccucuccgaggaggccguccgcgccaaguccggccucggcccccaccgcgaccucgccgagcuccagucccucuccauccccggcaccuaccaggagaagaucacccaccucggccacucccucaugucccucaccggccucaagucccucgaccucucccgcaacucccucgucucccucgagggcauccaguaccucaccgcccucgagucccucaaccucuacuacaacugcaucuccucccucgccgaggucuuccgccuccacgcccucaccgagcucgucgacgucgacuuccgccucaaccccgucgucaaggucgagcccgacuaccgccucuucgucguccaccuccuccccaagcuccagcagcucgacgaccgccccguccgcgccuccgagcgcaaggccucccgccuccacuucgccuccgaggacucccucgacuccaaggaguccguccccgccucccucaaggagggccgcccccaccacccccgcgccaagugcaccgaggcccucgccaagcagucccucgucauggacgccgacgacgaggccguccucaaccucaucgccgagugcgagugggaccucggccgcccccccggcuccaccuccuucucccagaagggccgcgaggccgacucccgcggcucccaggagucccgccaccuccucuccccccagcucguccaguaccagugcggcgacuccggcaagcagggccgcgagacccgccgcuccuccugccgcggcugcugccucgagaagaugcccuggucccagcucugcggcgagcuccccccccucuacggcgccgagcccgaggccucccgcgccccccgcccccacaccuacuucaccccccaccccgacuccauggacaccgaggacuccgccuccucccagaagcucgaccucuccggcgagaugguccccggcccccuccccgcccccggcaagugccgcaagcgccgcaugcccgucggccgcuuccagaccuucuccgaccaggagggccucggcugccccgagcgcacccacggcuccuccguccccaaggagucccucucccgccaggacuccuccgagucccgcaacggccgcacccucucccagcccgaggccuccgagaccgaggagcagcgcucccgcggcgucaccgacacccgcgagcccucccccggcucccacuccgcccuccccggcaagaagaccgcccuccaggccgcccuccucgagacccuccucgaccucgucgaccgcuccuggggcggcugccgcucccuccacuccaacgaggccuuccucgcccaggcccgccacauccucuccuccgucgaggaguucaccgccgcccaggacuccuccgccauggucggcgaggacgucggcucccucgcccucgaguccaagucccuccagucccgccucgccgagcagcagcagcagcacgcccgcgagauguccgaggucaccgccgagcuccaccacacccacaaggagcucgacgaccuccgccagcaccucgacaagucccucgaggagaacucccgccucaagucccuccuccucuccaugaagaaggaggucaaguccgccgacaccgccgccacccucaaccuccagaucgccggccuccagaccuccgucaagcgccucugcggcgagaucgucgagcucaagcagcaccucgagcacuacgacaagauccaggagcucacccagaugcuccaggagucccacuccucccucgucuccaccaacgagcaccuccuccaggagcucucccagguccgcgcccagcaccgcgccgaggucgagcagaugcacugguccuaccaggagcucaagaagaccauggcccucuucccccacuccuccgccucccacggcggcugccaggccugcuga

SEQ ID NO: 41215 - RNA, 1755 nt, Artificial Sequence
  derived and/or modified sequence opt2 from CEP76__Homo_sapiens__NP_001258918
augucccucccccccgagaaggccuccgagcucaagcagcucauccaccagcagcucuccaagauggacguccacggccgcauccgcgagauccucgccgagaccauccgcgaggagcucgcccccgaccagcagcaccucuccaccgaggaccucaucaaggcccuccgccgccgcggcaucaucgacgacgucaugaaggagcucaacuucgucaccgacuccgucgagcaggagcuccccuccucccccaagcagcccaucugcuucgaccgccaguccacccucaagaaguccgacggcacccgcauggccgacuccaccaccaugcucuccaucuccgaccccauccacaugguccucaucaagaccgacaucuucggcgagaccacccucgucgccuccuacuuccucgaguggcgcuccguccucggcuccgagaacggcgucaccucccucaccgucgagcucaugggcgucggcaccgaguccaaggucuccgucggcauccucaacaucaagcucgagauguaccccccccucaaccagacccucucccaggaggucgucaacacccagcucgcccucgagcgccagaagaccgccgagaaggagcgccucuuccucgucuacgccaagcagugguggcgcgaguaccuccagauccgccccucccacaacucccgccucgucaagaucuucgcccaggacgagaacggcaucaaccgccccgucugcuccuacgucaagccccuccgcgccggccgccuccucgacaccccccgccaggccgcccgcuucgucaacguccucggcuacgagcgcgcccccgucaucggcggcggcggcaagcaggagcaguggugcacccuccucgccuuccucugccgcaacaagggcgacugcgaggaccacgccaaccuccucugcucccuccuccucggcuacggccucgaggccuucgucugcgucggcaccaaggccaagggcgucccccacgccugggucaugaccugcggcaccgacggcgccaucaccuucugggagucccucaccggccaccgcuacauccacaagcccaccaaccccgacgagccccccgucgccgagcagcccaagccccucuaccccuaccgcaccaucggcugcgucuucaaccaccagauguuccucggcaacugccagcccuccgacgccgucgagaccugcgucuucgaccucaacgacgaguccaaguggaagcccauguccgaggaggccaucaaguccgucugcgcccccggcgccaccaccucccucccccccuuccccccccucugcgccuccaccaucgacgccuccgucaccuccaacgagaucgagaugcagcuccgccuccucgucuccgagcaccgcaaggaccucggccucaccaccgucugggaggaccagcucuccuaccuccucucccccgcccucgccuccuacgaguucgagcgcaccaccuccaucuccgccggcaacgaggaguuccaggacgccauccgccgcgccguccccgacggccacaccuucaagggcuuccccauccacuucgucuaccgcaacgcccgccgcgccuucgccaccugccuccgcucccccuucugcgaggagaucaucugcugccgcggcgaccagguccgccucgccguccgcguccgcgucuucaccuaccccgaguccgccugcgccgucuggaucauguucgccugcaaguaccgcuccguccucuga

SEQ ID NO: 41216 - RNA, 2106 nt, Artificial Sequence
  derived and/or modified sequence opt2 from CEP83__Homo_sapiens__NP_057206
auggucgucuccaccuucaccgacauggacaccuuccccaacaacuucccccccggcggcgacuccggccucaccggcucccaguccgaguuccagaagaugcucaucgacgagcgccuccgcugcgagcaccacaaggccaacuaccagacccucaaggccgagcacacccgccuccagaacgagcacgucaagcuccagaacgagcucaagcaccucuucaacgagaagcagacccagcaggagaagcuccagcuccuccucgaggagcuccgcggcgagcucgucgagaagaccaaggaccucgaggagaugaagcuccagauccucaccccccagaagcucgagcuccuccgcgcccagauccagcaggagcucgagacccccaugcgcgagcgcuuccgcaaccucgacgaggaggucgagaaguaccgcgccgucuacaacaagcuccgcuacgagcacaccuuccucaaguccgaguucgagcaccagaaggaggaguacgcccgcauccucgacgagggcaagaucaaguacgaguccgagaucgcccgccucgaggaggacaaggaggagcuccgcaaccagcuccucaacgucgaccucaccaaggacuccaagcgcgucgagcagcucgcccgcgagaaggucuaccucugccagaagcucaagggccucgaggccgaggucgccgagcucaaggccgagaaggagaacuccgaggcccaggucgagaacgcccagcgcauccagguccgccagcucgccgagaugcaggccaccguccgcucccucgaggccgagaagcaguccgccaaccuccgcgccgagcgccucgagaaggagcuccaguccuccuccgagcagaacaccuuccucaucaacaagcuccacaaggccgagcgcgagaucaacacccucuccuccaaggucaaggagcucaagcacuccaacaagcucgagaucaccgacaucaagcucgagaccgcccgcgccaaguccgagcucgagcgcgagcgcaacaagauccaguccgagcucgacggccuccaguccgacaacgagauccucaaggccgccgucgagcaccacaagguccuccucgucgagaaggaccgcgagcucauccgcaagguccaggccgccaaggaggagggcuaccagaagcucgucguccuccaggacgagaagcucgagcucgagaaccgccucgccgaccucgagaagaugaaggucgagcacgacgucuggcgccaguccgagaaggaccaguacgaggagaagcuccgcgccucccagauggccgaggagaucacccgcaaggagcuccaguccguccgccucaagcuccagcagcagaucgucaccaucgagaacgccgagaaggagaagaacgagaacuccgaccucaagcagcagaucuccucccuccagauccaggucaccucccucgcccaguccgagaacgaccuccucaacuccaaccagaugcucaaggagauggucgagcgccucaagcaggagugccgcaacuuccgcucccaggccgagaaggcccagcucgaggccgagaagacccucgaggagaagcagauccaguggcucgaggagaagcacaagcuccacgagcgcaucaccgaccgcgaggagaaguacaaccaggccaaggagaagcuccagcgcgccgccaucgcccagaagaagcgcaagucccuccacgagaacaagcucaagcgccuccaggagaaggucgagguccucgaggccaagaaggaggagcucgagaccgagaaccagguccucaaccgccagaacguccccuucgaggacuacacccgccuccagaagcgccucaaggacauccagcgccgccacaacgaguuccgcucccucauccucguccccaacaugccccccaccgccuccaucaaccccgucuccuuccaguccuccgccaugguccccuccauggagcuccccuuccccccccacaugcaggaggagcagcaccagcgcgagcucucccuccuccgcaagcgccucgaggagcucgagaccacccagcgcaagcagcucgaggagcucggcuccuccggcgaguga

SEQ ID NO: 41217 - RNA, 2418 nt, Artificial Sequence
  derived and/or modified sequence opt2 from CEP85L__Homo_sapiens__NP_001035940
auguggggccgcuuccucgcccccgaggccuccggccgcgacucccccggcggcgcccgcuccuuccccgccggccccgacuacuccuccgccuggcuccccgccaacgagucccucuggcaggccaccaccguccccuccaaccaccgcaacaaccacauccgccgccacuccaucgccuccgacuccggcgacaccggcaucggcaccuccugcuccgacuccgucgaggaccacuccaccuccuccggcacccucuccuucaagcccucccagucccucaucacccuccccaccgcccacgucaugcccuccaacuccuccgccuccaucuccaagcuccgcgagucccucacccccgacggcuccaagugguccaccucccucaugcagacccucggcaaccacucccgcggcgagcaggacuccucccucgacaugaaggacuuccgcccccuccgcaagugguccucccucuccaagcucaccgcccccgacaacugcggccagggcggcaccgucugccgcgaggagucccgcaacggccucgagaagaucggcaaggccaaggcccucaccucccagcuccgcaccaucggccccuccugccuccacgacuccauggagaugcuccgccucgaggacaaggagaucaacaagaagcgcuccuccacccucgacugcaaguacaaguucgaguccugcuccaaggaggacuuccgcgccuccuccuccacccuccgccgccagcccgucgacaugaccuacuccgcccuccccgaguccaagcccaucaugaccuccuccgaggccuucgagccccccaaguaccucaugcucggccagcaggccgucggcggcguccccauccagcccuccguccgcacccagauguggcucaccgagcagcuccgcaccaacccccucgagggccgcaacaccgaggacuccuacucccucgcccccuggcagcagcagcagaucgaggacuuccgccagggcuccgagacccccaugcagguccucaccggcuccucccgccaguccuacucccccggcuaccaggacuucuccaagugggaguccaugcucaagaucaaggagggccuccuccgccagaaggagaucgucaucgaccgccagaagcagcagaucacccaccuccacgagcgcauccgcgacaacgagcuccgcgcccagcacgccaugcucggccacuacgucaacugcgaggacuccuacgucgccucccuccagccccaguacgagaacaccucccuccagacccccuucuccgaggaguccgucucccacucccagcagggcgaguucgagcagaagcucgccuccaccgagaaggagguccuccagcucaacgaguuccucaagcagcgccucucccucuucuccgaggagaagaagaagcucgaggagaagcucaagacccgcgaccgcuacaucuccucccucaagaagaagugccagaaggaguccgagcagaacaaggagaagcagcgccgcaucgagacccucgagaaguaccucgccgaccuccccacccucgacgacguccagucccagucccuccagcuccagauccucgaggagaagaacaagaaccuccaggaggcccucaucgacaccgagaagaagcucgaggagaucaagaagcagugccaggacaaggagacccagcucaucugccagaagaagaaggagaaggagcucgucaccaccguccagucccuccagcagaaggucgagcgcugccucgaggacggcauccgccuccccaugcucgacgccaagcagcuccagaacgagaacgacaaccuccgccagcagaacgagaccgccuccaagaucaucgacucccagcaggacgagaucgaccgcaugauccucgagauccaguccaugcagggcaagcucuccaaggagaagcucaccacccagaagaugauggaggagcucgagaagaaggagcgcaacguccagcgccucaccaaggcccuccucgagaaccagcgccagaccgacgagaccugcucccuccucgaccagggccaggagcccgaccagucccgccagcagaccguccucuccaagcgcccccucuucgaccucaccgucaucgaccagcucuucaaggagauguccugcugccucuucgaccucaaggcccucugcuccauccucaaccagcgcgcccagggcaaggagcccaaccucucccuccuccucggcauccgcuccaugaacugcuccgccgaggagaccgagaacgaccacuccaccgagacccucaccaagaagcucuccgacgucugccagcuccgccgcgacaucgacgagcuccgcaccaccaucuccgaccgcuacgcccaggacaugggcgacaacugcaucacccaguga

SEQ ID NO: 41218 - RNA, 2352 nt, Artificial Sequence
  derived and/or modified sequence opt2 from CEP89__Homo_sapiens__NP_116205
augcuccucggcuuccgccgcggccgccgcucccacuucaagcacaucauccacggccuccuccccgccgccuccgucgcccccaaggccgccgucccccgcaccccccccccccgcucccccaaccccucccccgagcgcccccgcuccgcccucgccgccgccauccucgccaccacccucaccggccgcaccgucgccaucccccagccccgccagcgcucccgcuccgaguccgacgucuccuccgucgagcaggacuccuucaucgagcccuacgccaccaccucccagcuccgcccccgccccaacuggcaguccgagaugggccgccgcuccucccuccccuccuucgagacccucgacuacggcgacgaggaggacaucgagacccagcucuccuccuccggcaaggagcucggcgacgucuccgcccgcgaggaccgcggcggccacuccgacgaccucuacgccgucccccaccgcaaccaggucccccuccuccacgaggucaacuccgaggacgacgagaacaucucccaccaggacggcuuccccggcuccccccccgccccccagcgcacccagcagaaggacggcaagcaccccguccucaaccucaaggacgagaagcccccccucugcgagaagcccccccccucccccgacaucaccggccgcgcccgccagcgcuacaccgagaucacccgcgagaaguucgaggcccucaaggaggagaacauggaccucaacaacaugaaccagucccucacccucgagcucaacaccaugaagcaggccaugaaggagcuccagcucaagcucaagggcauggagaaggagaagcgcaagcucaaggaggccgagaaggccuccucccaggaggucgccgcccccgagcuccucuaccuccgcaagcaggcccaggagcucgucgacgagaacgacggccucaagaugaccguccaccgccucaacgucgagcucucccgcuaccagaccaaguuccgccaccucuccaaggaggagucccucaacaucgagggccuccccuccaagggccccaucccccccuggcuccucgacaucaaguaccucuccccccuccuccucgccuacgaggacaugaugaaggagaaggacgagcucaacgccacccucaaggaggagaugcgcauguuccgcaugcgcguccaggaggucgucaaggagaacgaggagcuccaccaggagcucaacaaguccuccgccgucaccuccgaggaguggcgccagcuccagacccaggccaagcucguccucgaggagaacaagcuccuccucgagcagcucgagauccagcagcgcaaggccaaggacucccaccaggagcgccuccaggaggucuccaagcucaccaagcagcucaugcuccucgaggccaagacccacggccaggagaaggagcucgccgagaaccgcgagcagcucgagauccuccgcgccaagugccaggagcucaagacccacuccgacggcaagaucgccgucgagguccacaaguccaucgucaacgagcucaagucccagcuccagaaggaggaggagaaggagcgcgccgagauggaggagcucauggagaagcucaccguccuccaggcccagaagaagucccuccuccucgagaagaacucccucaccgagcagaacaaggcccucgaggccgagcucgagcgcgcccagaagaucaaccgcaagucccagaagaagaucgagguccucaagaagcaggucgagaaggccaugggcaacgagauguccgcccaccaguaccucgccaaccucgucggccucgccgagaacaucacccaggagcgcgacucccucaugugccucgccaagugccucgaguccgagaaggacggcguccucaacaaggucaucaaguccaacauccgccucggcaagcucgaggagaaggucaagggcuacaagaagcaggccgcccucaagcucggcgacaucucccaccgccuccucgagcagcaggaggacuucgccggcaagaccgcccaguaccgccaggagaugcgccaccuccaccagguccucaaggacaagcaggagguccucgaccaggcccuccagcagaaccgcgagauggagggcgagcucgaggucaucugggaguccaccuuccgcgagaaccgccgcauccgcgagcuccuccaggacacccucacccgcaccggcguccaggacaacccccgcgcccucgucgcccccucccucaacggcgucucccaggccgaccuccucgacggcugcgacgucugcuccuacgaccucaagucccacgcccccaccugcuga

SEQ ID NO: 41219 - RNA, 804 nt, Artificial Sequence
  derived and/or modified sequence opt2 from CER1__Homo_sapiens__NP_005445
augcaccuccuccucuuccagcuccucguccuccucccccucggcaagaccacccgccaccaggacggccgccagaaccaguccucccucucccccguccuccucccccgcaaccagcgcgagcuccccaccggcaaccacgaggaggccgaggagaagcccgaccucuucgucgccgucccccaccucgucgccaccucccccgccggcgagggccagcgccagcgcgagaagaugcucucccgcuucggccgcuucuggaagaagcccgagcgcgagaugcaccccucccgcgacuccgacuccgagcccuucccccccggcacccagucccucauccagcccaucgacggcaugaagauggagaaguccccccuccgcgaggaggccaagaaguucuggcaccacuucauguuccgcaagacccccgccucccagggcgucauccuccccaucaagucccacgagguccacugggagaccugccgcaccguccccuucucccagaccaucacccacgagggcugcgagaaggucgucguccagaacaaccucugcuucggcaagugcggcuccguccacuuccccggcgccgcccagcacucccacaccuccugcucccacugccuccccgccaaguucaccaccaugcaccucccccucaacugcaccgagcucuccuccgucaucaaggucgucaugcucgucgaggagugccagugcaaggucaagaccgagcacgaggacggccacauccuccacgccggcucccaggacuccuucauccccggcgucuccgccuga

SEQ ID NO: 41220 - RNA, 1614 nt, Artificial Sequence
  derived and/or modified sequence opt2 from CERK__Homo_sapiens__NP_073603
augggcgccaccggcgccgccgagccccuccaguccguccucugggucaagcagcagcgcugcgccgucucccucgagcccgcccgcgcccuccuccgcugguggcgcucccccggccccggcgccggcgcccccggcgccgacgccugcuccguccccgucuccgagaucaucgccgucgaggagaccgacguccacggcaagcaccagggcuccggcaaguggcagaagauggagaagcccuacgccuucaccguccacugcgucaagcgcgcccgccgccaccgcuggaagugggcccaggucaccuucuggugccccgaggagcagcucugccaccucuggcuccagacccuccgcgagaugcucgagaagcucaccucccgccccaagcaccuccucgucuucaucaaccccuucggcggcaagggccagggcaagcgcaucuacgagcgcaaggucgccccccucuucacccucgccuccaucaccaccgacaucaucgucaccgagcacgccaaccaggccaaggagacccucuacgagaucaacaucgacaaguacgacggcaucgucugcgucggcggcgacggcauguucuccgagguccuccacggccucaucggccgcacccagcgcuccgccggcgucgaccagaaccacccccgcgccguccucguccccuccucccuccgcaucggcaucauccccgccggcuccaccgacugcgucugcuacuccaccgucggcaccuccgacgccgagaccuccgcccuccacaucgucgucggcgacucccucgccauggacgucuccuccguccaccacaacuccacccuccuccgcuacuccgucucccuccucggcuacggcuucuacggcgacaucaucaaggacuccgagaagaagcgcuggcucggccucgcccgcuacgacuucuccggccucaagaccuuccucucccaccacugcuacgagggcaccgucuccuuccuccccgcccagcacaccgucggcuccccccgcgaccgcaagcccugccgcgccggcugcuucgucugccgccaguccaagcagcagcucgaggaggagcagaagaaggcccucuacggccucgaggccgccgaggacgucgaggaguggcaggucgucugcggcaaguuccucgccaucaacgccaccaacauguccugcgccugccgccgcuccccccgcggccucucccccgccgcccaccucggcgacggcuccuccgaccucauccucauccgcaagugcucccgcuucaacuuccuccgcuuccucauccgccacaccaaccagcaggaccaguucgacuucaccuucgucgaggucuaccgcgucaagaaguuccaguucaccuccaagcacauggaggacgaggacuccgaccucaaggagggcggcaagaagcgcuucggccacaucugcuccucccaccccuccugcugcugcaccgucuccaacuccuccuggaacugcgacggcgagguccuccacucccccgccaucgagguccgcguccacugccagcucguccgccucuucgcccgcggcaucgaggagaaccccaagcccgacucccacuccuga

SEQ ID NO: 41221 - RNA, 1677 nt, Artificial Sequence
  derived and/or modified sequence opt2 from CERKL__Homo_sapiens__NP_001025482
augcccuggcgccgccgccgcaaccgcgucuccgcccucgagggcggccgcgaggaggaggccccccccgaggccgccgccgucccccccgcccuccucaccuccccccagcagaccgaggccgccgccgagcgcauccuccuccgcggcaucuucgagaucggccgcgacuccugcgacgucguccucuccgagcgcgcccuccgcuggcgccccauccagcccgagcgccccgccggcgacuccaaguacgaccuccucugcaaggaggaguucaucgagcucaaggacaucuucuccgucaagcucaagcgccgcugcuccgucaagcagcagcgcuccggcacccuccucggcaucacccucuucaucugccucaagaaggagcagaacaagcucaagaacuccacccucgaccucaucaaccucuccgaggaccacugcgacaucugguuccgccaguucaagaagauccucgccggcuuccccaaccgccccaagucccucaagauccuccucaacccccagucccacaagaaggaggccacccaggucuacuacgagaaggucgagccccuccucaagcucgccggcaucaagaccgacgucaccaucauggaguacgagggccacgcccucucccuccucaaggagugcgagcuccagggcuucgacggcggccaccgcaagccccucuucgccauccacugguccguccagcgccucuucaccggcaugcagacccucgagcccuccgucgucugcgucggcggcgacggcuccgccuccgaggucgcccacgcccuccuccuccgcgcccagaagaacgccggcauggagaccgaccgcauccucacccccguccgcgcccagcucccccucggccucauccccgccggcuccaccaacguccucgcccacucccuccacggcgucccccacgucaucaccgccacccuccacaucaucaugggccacguccagcucgucgacgucugcaccuucuccaccgccggcaagcuccuccgcuucggcuucuccgccauguucggcuucggcggccgcacccucgcccucgccgagaaguaccgcuggaugucccccaaccagcgccgcgacuucgccgucgucaaggcccucgccaagcucaaggccgaggacugcgagaucuccuuccuccccuucaacuccuccgacgacguccaggagcgccgcgcccagggcucccccaaguccgacugcaacgaccaguggcagaugauccagggccaguuccucaacgucuccaucauggccauccccugccucugcuccgucgccccccgcggccucgcccccaacacccgccucaacaacggcuccauggcccucaucaucgcccgcaacaccucccgccccgaguucaucaagcaccucaagcgcuacgccuccgucaagaaccaguucaacuuccccuucgucgagaccuacaccgucgaggaggucaagguccacccccgcaacaacaccggcggcuacaaccccgaggaggaggaggacgagaccgccuccgagaacugcuuccccuggaacgucgacggcgaccucauggaggucgccuccgagguccacauccgccuccacccccgccucaucucccucuacggcggcuccauggaggagaugauccccaaguga

SEQ ID NO: 41222 - RNA, 720 nt, Artificial Sequence
  derived and/or modified sequence opt2 from CERS1__Homo_sapiens__NP_001277194
augcccgaguccgccuggaaguuccucuucuaccucggcuccugguccuacuccgccuaccuccucuucggcaccgacuaccccuucuuccacgacccccccuccgucuucuacgacuggacccccggcauggccgucccccgcgacaucgccgccgccuaccuccuccagggcuccuucuacggccacuccaucuacgccacccucuacauggacaccuggcgcaaggacuccgucgucaugcuccuccaccacgucgucacccucauccucaucgucuccuccuacgccuuccgcuaccacaacgucggcauccucguccucuuccuccacgacaucuccgacguccagcucgaguucaccaagcucaacaucuacuucaagucccgcggcggcuccuaccaccgccuccacgcccucgccgccgaccucggcugccucuccuucggcuucuccugguucugguuccgccucuacugguucccccucaagguccucuacgccaccucccacugcucccuccgcaccguccccgacauccccuucuacuucuucuucaacgcccuccuccuccuccucacccucaugaaccucuacugguuccucuacaucgucgccuucgccgccaagguccucaccggccagguccacgagcucaaggaccuccgcgaguacgacaccgccgaggcccagucccucaagcccuccaaggccgaguga

SEQ ID NO: 41223 - RNA, 1203 nt, Artificial Sequence
  derived and/or modified sequence opt2 from CERS2__Homo_sapiens__XP_011507753
auggucccccucgcccuccacuuccccggcgaggucggccuccaggagaccgccguccgcaugcuccagacccucuacgacuacuucuggugggagcgccucuggcuccccgucaaccucaccugggccgaccucgaggaccgcgacggccgcgucuacgccaaggccuccgaccucuacaucacccucccccucgcccuccucuuccucaucguccgcuacuucuucgagcucuacgucgccaccccccucgccgcccuccucaacaucaaggagaagacccgccuccgcgccccccccaacgccacccucgagcacuucuaccucaccuccggcaagcagcccaagcaggucgaggucgagcuccucucccgccaguccggccucuccggccgccaggucgagcgcugguuccgccgccgccgcaaccaggaccgccccucccuccucaagaaguuccgcgaggccuccuggcgcuucaccuucuaccucaucgccuucaucgccggcauggccgucaucgucgacaagcccugguucuacgacaugaagaaggucugggagggcuaccccauccaguccaccauccccucccaguacugguacuacaugaucgagcucuccuucuacuggucccuccucuucuccaucgccuccgacgucaagcgcaaggacuucaaggagcagaucauccaccacgucgccaccaucauccucaucuccuucuccugguucgccaacuacauccgcgccggcacccucaucauggcccuccacgacuccuccgacuaccuccucgaguccgccaagauguucaacuacgccggcuggaagaacaccugcaacaacaucuucaucgucuucgccaucgucuucaucaucacccgccucgucauccuccccuucuggauccuccacugcacccucgucuacccccucgagcucuaccccgccuucuucggcuacuacuucuucaacuccaugaugggcguccuccagcuccuccacaucuucugggccuaccucauccuccgcauggcccacaaguucaucaccggcaagcucgucgaggacgagcgcuccgaccgcgaggagaccgaguccuccgagggcgaggaggccgccgccggcggcggcgccaagucccgcccccucgccaacggccaccccauccucaacaacaaccaccgcaagaacgacuga

SEQ ID NO: 41224 - RNA, 1185 nt, Artificial Sequence
  derived and/or modified sequence opt2 from CERS3__Homo_sapiens__NP_001277270
augcuccacaccaccgcccgccgcgccgcccgcauguucuggaccuucaaggagugguucuggcucgagcgcuucuggcucccccccaccaucaagugguccgaccucgaggaccacgacggccucgucuucgucaagcccucccaccucuacgucaccauccccuacgccuuccuccuccucaucauccgccgcgucuucgagaaguucgucgccuccccccucgccaaguccuucggcaucaaggagaccguccgcaaggucacccccaacaccguccucgagaacuucuucaagcacuccacccgccagccccuccagaccgacaucuacggccucgccaagaagugcaaccucaccgagcgccaggucgagcgcugguuccgcucccgccgcaaccaggagcgccccucccgccucaagaaguuccaggaggccugcuggcgcuucgccuucuaccucaugaucaccgucgccggcaucgccuuccucuacgacaagcccuggcucuacgaccucugggaggucuggaacggcuaccccaagcagccccuccuccccucccaguacugguacuacauccucgagauguccuucuacuggucccuccucuuccgccucggcuucgacgucaagcgcaaggacuuccucgcccacaucauccaccaccucgccgccaucucccucauguccuucuccuggugcgccaacuacauccgcuccggcacccucgucaugaucguccacgacgucgccgacaucuggcucgaguccgccaagauguucuccuacgccggcuggacccagaccugcaacacccucuucuucaucuucuccaccaucuucuucaucucccgccucaucgucuuccccuucuggauccucuacugcacccucauccuccccauguaccaccucgagcccuucuucuccuacaucuuccucaaccuccagcucaugauccuccagguccuccaccucuacuggggcuacuacauccucaagaugcucaaccgcugcaucuucaugaaguccauccaggacguccgcuccgacgacgaggacuacgaggaggaggaggaggaggaggaggaggaggccaccaagggcaaggagauggacugccucaagaacggccuccgcgccgagcgccaccucauccccaacggccagcacggccacuga

SEQ ID NO: 41225 - RNA, 1185 nt, Artificial Sequence
  derived and/or modified sequence opt2 from CERS4__Homo_sapiens__NP_078828
augcucuccuccuucaacgagugguucuggcaggaccgcuucuggcucccccccaacgucaccuggaccgagcucgaggaccgcgacggccgcgucuacccccacccccaggaccuccucgccgcccucccccucgcccucguccuccucgccaugcgccucgccuucgagcgcuucaucggccucccccucucccgcuggcucggcguccgcgaccagacccgccgccaggucaagcccaacgccacccucgagaagcacuuccucaccgagggccaccgccccaaggagccccagcucucccuccucgccgcccagugcggccucacccuccagcagacccagcgcugguuccgccgccgccgcaaccaggaccgcccccagcucaccaagaaguucugcgaggccuccuggcgcuuccucuucuaccucuccuccuucgucggcggccucuccguccucuaccacgaguccuggcucugggcccccgucaugugcugggaccgcuaccccaaccagacccucaagcccucccucuacuggugguaccuccucgagcucggcuucuaccucucccuccucauccgccuccccuucgacgucaagcgcaaggacuucaaggagcaggucauccaccacuucgucgccgucauccucaugaccuucuccuacuccgccaaccuccuccgcaucggcucccucguccuccuccuccacgacuccuccgacuaccuccucgaggccugcaagauggucaacuacaugcaguaccagcaggucugcgacgcccucuuccucaucuucuccuucgucuucuucuacacccgccucguccucuuccccacccagauccucuacaccaccuacuacgaguccaucuccaaccgcggccccuucuucggcuacuacuucuucaacggccuccucaugcuccuccagcuccuccacgucuucugguccugccucauccuccgcaugcucuacuccuucaugaagaagggccagauggagaaggacauccgcuccgacgucgaggaguccgacuccuccgaggaggccgccgccgcccaggagccccuccagcucaagaacggcgccgccggcggcccccgccccgcccccaccgacggcccccgcucccgcgucgccggccgccucaccaaccgccacaccaccgccaccuga

SEQ ID NO: 41226 - RNA, 1179 nt, Artificial Sequence
  derived and/or modified sequence opt2 from CERS6__Homo_sapiens__NP_001243055
auggccggcauccucgccugguucuggaacgagcgcuucuggcucccccacaacgucaccugggccgaccucaagaacaccgaggaggccaccuucccccaggccgaggaccucuaccucgccuucccccucgccuucugcaucuucaugguccgccucaucuucgagcgcuucgucgccaagcccugcgccaucgcccucaacauccaggccaacggcccccagaucgccccccccaacgccauccucgagaaggucuucaccgccaucaccaagcaccccgacgagaagcgccucgagggccucuccaagcagcucgacugggacguccgcuccauccagcgcugguuccgccagcgccgcaaccaggagaagcccuccacccucacccgcuucugcgaguccauguggcgcuucuccuucuaccucuacgucuucaccuacggcguccgcuuccucaagaagacccccuggcucuggaacacccgccacugcugguacaacuaccccuaccagccccucaccaccgaccuccacuacuacuacauccucgagcucuccuucuacuggucccucauguucucccaguucaccgacaucaagcgcaaggacuucggcaucauguuccuccaccaccucgucuccaucuuccucaucaccuucuccuacgucaacaacauggcccgcgucggcacccucguccucugccuccacgacuccgccgacgcccuccucgaggccgccaagauggccaacuacgccaaguuccagaagaugugcgaccuccucuucgucauguucgccgucgucuucaucaccacccgccucggcaucuucccccucuggguccucaacaccacccucuucgaguccugggagaucgucggccccuaccccuccuggugggucuucaaccuccuccuccuccucguccagggccucaacugcuucugguccuaccucaucgucaagaucgccugcaaggccgucucccgcggcaaggccggcaaguggaacccccuccacgucuccaaggacgaccgcuccgacaucgaguccuccuccgacgaggaggacuccgagccccccggcaagaacccccacaccgccaccaccaccaacggcaccuccggcaccaacggcuaccuccucaccggcuccugcuccauggacgacuga

SEQ ID NO: 41227 - RNA, 1704 nt, Artificial Sequence
  derived and/or modified sequence opt2 from CES1__Homo_sapiens__NP_001020365
auguggcuccgcgccuucauccucgccacccucuccgccuccgccgccuggggccaccccuccuccccccccgucgucgacaccguccacggcaagguccucggcaaguucgucucccucgagggcuucgcccagcccgucgccaucuuccucggcauccccuucgccaagcccccccucggcccccuccgcuucacccccccccagcccgccgagcccugguccuucgucaagaacgccaccuccuacccccccaugugcacccaggaccccaaggccggccagcuccucuccgagcucuucaccaaccgcaaggagaacaucccccucaagcucuccgaggacugccucuaccucaacaucuacacccccgccgaccucaccaagaagaaccgccuccccgucauggucuggauccacggcggcggccucauggucggcgccgccuccaccuacgacggccucgcccucgccgcccacgagaacgucgucgucgucaccauccaguaccgccucggcaucuggggcuucuucuccaccggcgacgagcacucccgcggcaacuggggccaccucgaccaggucgccgcccuccgcuggguccaggacaacaucgccuccuucggcggcaaccccggcuccgucaccaucuucggcgaguccgccggcggcgaguccgucuccguccucguccucuccccccucgccaagaaccucuuccaccgcgccaucuccgaguccggcgucgcccucaccuccguccucgucaagaagggcgacgucaagccccucgccgagcagaucgccaucaccgccggcugcaagaccaccaccuccgccgucaugguccacugccuccgccagaagaccgaggaggagcuccucgagaccacccucaagaugaaguuccucucccucgaccuccagggcgacccccgcgagucccagccccuccucggcaccgucaucgacggcaugcuccuccucaagacccccgaggagcuccaggccgagcgcaacuuccacaccguccccuacauggucggcaucaacaagcaggaguucggcuggcucauccccaugcagcucauguccuacccccucuccgagggccagcucgaccagaagaccgccaugucccuccucuggaaguccuacccccucgucugcaucgccaaggagcucauccccgaggccaccgagaaguaccucggcggcaccgacgacaccgucaagaagaaggaccucuuccucgaccucaucgccgacgucauguucggcguccccuccgucaucgucgcccgcaaccaccgcgacgccggcgcccccaccuacauguacgaguuccaguaccgccccuccuucuccuccgacaugaagcccaagaccgucaucggcgaccacggcgacgagcucuucuccgucuucggcgcccccuuccucaaggagggcgccuccgaggaggagauccgccucuccaagauggucaugaaguucugggccaacuucgcccgcaacggcaaccccaacggcgagggccucccccacuggcccgaguacaaccagaaggagggcuaccuccagaucggcgccaacacccaggccgcccagaagcucaaggacaaggaggucgccuucuggaccaaccucuucgccaagaaggccgucgagaagcccccccagaccgagcacaucgagcucuga

SEQ ID NO: 41228 - RNA, 1872 nt, Artificial Sequence
  derived and/or modified sequence opt2 from CES2__Homo_sapiens__NP_003860
augaccgcccagucccgcucccccaccacccccaccuuccccggccccucccagcgcaccccccucacccccugccccguccagaccccccgccucggcaaggcccucauccacugcuggaccgaccccggccagccccucggcgagcagcagcgcguccgccgccagcgcaccgagaccuccgagcccaccaugcgccuccaccgccuccgcgcccgccucuccgccgucgccugcggccuccuccuccuccucguccgcggccagggccaggacuccgccucccccauccgcaccacccacaccggccagguccucggcucccucguccacgucaagggcgccaacgccggcguccagaccuuccucggcauccccuucgccaagcccccccucggcccccuccgcuucgccccccccgagccccccgaguccugguccggcguccgcgacggcaccacccaccccgccaugugccuccaggaccucaccgccgucgaguccgaguuccucucccaguucaacaugaccuuccccuccgacuccauguccgaggacugccucuaccucuccaucuacacccccgcccacucccacgagggcuccaaccuccccgucauggucuggauccacggcggcgcccucgucuucggcauggccucccucuacgacggcuccaugcucgccgcccucgagaacgucgucgucgucaucauccaguaccgccucggcguccucggcuucuucuccaccggcgacaagcacgccaccggcaacuggggcuaccucgaccaggucgccgcccuccgcuggguccagcagaacaucgcccacuucggcggcaaccccgaccgcgucaccaucuucggcgaguccgccggcggcaccuccgucuccucccucgucgucucccccaucucccagggccucuuccacggcgccaucauggaguccggcgucgcccuccuccccggccucaucgccuccuccgccgacgucaucuccaccgucgucgccaaccucuccgccugcgaccaggucgacuccgaggcccucgucggcugccuccgcggcaaguccaaggaggagauccucgccaucaacaagcccuucaagaugauccccggcgucgucgacggcgucuuccucccccgccacccccaggagcuccucgccuccgccgacuuccagcccguccccuccaucgucggcgucaacaacaacgaguucggcuggcucauccccaaggucaugcgcaucuacgacacccagaaggagauggaccgcgaggccucccaggccgcccuccagaagaugcucacccuccucaugcucccccccaccuucggcgaccuccuccgcgaggaguacaucggcgacaacggcgacccccagacccuccaggcccaguuccaggagaugauggccgacuccauguucgucauccccgcccuccaggucgcccacuuccagugcucccgcgcccccgucuacuucuacgaguuccagcaccagcccuccuggcucaagaacauccgccccccccacaugaaggccgaccacggcgacgagcuccccuucgucuuccgcuccuucuucggcggcaacuacaucaaguucaccgaggaggaggagcagcucucccgcaagaugaugaaguacugggccaacuucgcccgcaacggcaaccccaacggcgagggccucccccacuggccccucuucgaccaggaggagcaguaccuccagcucaaccuccagcccgccgucggccgcgcccucaaggcccaccgccuccaguucuggaagaaggcccucccccagaagauccaggagcucgaggagcccgaggagcgccacaccgagcucuga

SEQ ID NO: 41229 - RNA, 633 nt, Artificial Sequence
  derived and/or modified sequence opt2 from CES3__Homo_sapiens__NP_001172105
auggagcagaugucccgcgaggacaugcucgccaucuccacccccguccucaccucccucgacgucccccccgagaugaugcccaccgucaucgacgaguaccucggcuccaacuccgacgcccaggccaagugccaggccuuccaggaguucaugggcgacgucuucaucaacguccccaccgucuccuucucccgcuaccuccgcgacuccggcucccccgucuucuucuacgaguuccagcaccgccccuccuccuucgccaagaucaagcccgccugggucaaggccgaccacggcgccgagggcgccuucgucuucggcggccccuuccucauggacgaguccucccgccucgccuuccccgaggccaccgaggaggagaagcagcucucccucaccaugauggcccaguggacccacuucgcccgcaccggcgaccccaacuccaaggcccucccccccuggccccaguucaaccaggccgagcaguaccucgagaucaaccccgucccccgcgccggccagaaguuccgcgaggccuggaugcaguucugguccgagacccuccccuccaagauccagcaguggcaccagaagcagaagaaccgcaaggcccaggaggaccucuga

SEQ ID NO: 41230 - RNA, 519 nt, Artificial Sequence
  derived and/or modified sequence opt2 from CETN1__Homo_sapiens__NP_004057
auggccuccggcuucaagaagcccuccgccgccuccaccggccagaagcgcaaggucgcccccaagcccgagcucaccgaggaccagaagcaggagguccgcgaggccuucgaccucuucgacgucgacggcuccggcaccaucgacgccaaggagcucaaggucgccaugcgcgcccucggcuucgagccccgcaaggaggagaugaagaagaugaucuccgaggucgaccgcgagggcaccggcaagaucuccuucaacgacuuccucgccgucaugacccagaagauguccgagaaggacaccaaggaggagauccucaaggccuuccgccucuucgacgacgacgagaccggcaagaucuccuucaagaaccucaagcgcgucgccaacgagcucggcgagaaccucaccgacgaggagcuccaggagaugaucgacgaggccgaccgcgacggcgacggcgaggucaacgaggaggaguuccuccgcaucaugaagaagaccucccucuacuga

SEQ ID NO: 41231 - RNA, 519 nt, Artificial Sequence
  derived and/or modified sequence opt2 from CETN2__Homo_sapiens__NP_004335
auggccuccaacuucaagaaggccaacauggccuccuccucccagcgcaagcgcaugucccccaagcccgagcucaccgaggagcagaagcaggagauccgcgaggccuucgaccucuucgacgccgacggcaccggcaccaucgacgucaaggagcucaaggucgccaugcgcgcccucggcuucgagcccaagaaggaggagaucaagaagaugaucuccgagaucgacaaggagggcaccggcaagaugaacuucggcgacuuccucaccgucaugacccagaagauguccgagaaggacaccaaggaggagauccucaaggccuucaagcucuucgacgacgacgagaccggcaagaucuccuucaagaaccucaagcgcgucgccaaggagcucggcgagaaccucaccgacgaggagcuccaggagaugaucgacgaggccgaccgcgacggcgacggcgaggucuccgagcaggaguuccuccgcaucaugaagaagaccucccucuacuga

SEQ ID NO: 41232 - RNA, 504 nt, Artificial Sequence
  derived and/or modified sequence opt2 from CETN3__Homo_sapiens__NP_004356
augucccucgcccuccgcuccgagcucgucgucgacaagaccaagcgcaagaagcgccgcgagcucuccgaggagcagaagcaggagaucaaggacgccuucgagcucuucgacaccgacaaggacgaggccaucgacuaccacgagcucaaggucgccaugcgcgcccucggcuucgacgucaagaaggccgacguccucaagauccucaaggacuacgaccgcgaggccaccggcaagaucaccuucgaggacuucaacgaggucgucaccgacuggauccucgagcgcgacccccacgaggagauccucaaggccuucaagcucuucgacgacgacgacuccggcaagaucucccuccgcaaccuccgccgcgucgcccgcgagcucggcgagaacauguccgacgaggagcuccgcgccaugaucgaggaguucgacaaggacggcgacggcgagaucaaccaggaggaguucaucgccaucaugaccggcgacaucuga

SEQ ID NO: 41233 - RNA, 1482 nt, Artificial Sequence
  derived and/or modified sequence opt2 from CETP__Homo_sapiens__NP_000069
augcucgccgccaccguccucacccucgcccuccucggcaacgcccacgccugcuccaagggcaccucccacgaggccggcaucgucugccgcaucaccaagcccgcccuccucguccucaaccacgagaccgccaaggucauccagaccgccuuccagcgcgccuccuaccccgacaucaccggcgagaaggccaugaugcuccucggccaggucaaguacggccuccacaacauccagaucucccaccucuccaucgccuccucccaggucgagcucgucgaggccaaguccaucgacgucuccauccagaacgucuccgucgucuucaagggcacccucaaguacggcuacaccaccgccugguggcucggcaucgaccaguccaucgacuucgagaucgacuccgccaucgaccuccagaucaacacccagcucaccugcgacuccggccgcguccgcaccgacgcccccgacugcuaccucuccuuccacaagcuccuccuccaccuccagggcgagcgcgagcccggcuggaucaagcagcucuucaccaacuucaucuccuucacccucaagcucguccucaagggccagaucugcaaggagaucaacgucaucuccaacaucauggccgacuucguccagacccgcgccgccuccauccucuccgacggcgacaucggcgucgacaucucccucaccggcgaccccgucaucaccgccuccuaccucgagucccaccacaagggccacuucaucuacaagaacgucuccgaggaccucccccuccccaccuucucccccacccuccucggcgacucccgcaugcucuacuucugguucuccgagcgcgucuuccacucccucgccaaggucgccuuccaggacggccgccucaugcucucccucaugggcgacgaguucaaggccguccucgagaccuggggcuucaacaccaaccaggagaucuuccaggaggucgucggcggcuuccccucccaggcccaggucaccguccacugccucaagaugcccaagaucuccugccagaacaagggcgucgucgucaacuccuccgucauggucaaguuccucuucccccgccccgaccagcagcacuccgucgccuacaccuucgaggaggacaucgucaccaccguccaggccuccuacuccaagaagaagcucuuccucucccuccucgacuuccagaucacccccaagaccgucuccaaccucaccgaguccuccuccgaguccguccaguccuuccuccaguccaugaucaccgccgucggcauccccgaggucaugucccgccucgaggucgucuucaccgcccucaugaacuccaagggcgucucccucuucgacaucaucaaccccgagaucaucacccgcgacggcuuccuccuccuccagauggacuucggcuuccccgagcaccuccucgucgacuuccuccagucccucuccuga

SEQ ID NO: 41234 - RNA, 534 nt, Artificial Sequence
  derived and/or modified sequence opt2 from CFAP126__Homo_sapiens__NP_001013647
auggccaccaacuacuccgccaaccaguacgagaaggccuucuccuccaaguaccuccagaacuggucccccaccaagcccaccaaggaguccaucuccucccacgagggcuacacccagaucaucgccaacgaccgcggccaccuccuccccuccgucccccgcuccaaggccaaccccuggggcuccuucaugggcaccuggcagaugccccucaagaucccccccgcccgcgucacccucaccucccgcaccaccgccggcgccgccucccucaccaaguggauccagaagaaccccgaccuccucaaggccuccaacggccucugccccgagauccucggcaagccccacgaccccgacucccagaagaagcuccgcaagaaguccaucaccaagaccguccagcaggcccgcucccccaccaucauccccuccucccccgccgccaaccucaacucccccgacgagcuccaguccucccaccccuccgccggccacacccccggcccccagcgccccgccaaguccuga

SEQ ID NO: 41235 - RNA, 1104 nt, Artificial Sequence
  derived and/or modified sequence opt2 from CFAP36__Homo_sapiens__NP_001269690
auggccgccgaggaggaggacgaggucgagugggucgucgaguccaucgccggcuuccuccgcggccccgacugguccauccccauccucgacuucgucgagcagaagugcgaggucaacugcaagggcggccacgucaucacccccggcucccccgagcccgucauccucgucgccugcgucccccucgucuucgacgacgaggaggaguccaagcucaccuacaccgagauccaccaggaguacaaggagcucgucgagaagcuccucgagggcuaccucaaggagaucggcaucaacgaggaccaguuccaggaggccugcaccuccccccucgccaagacccacaccucccaggccauccuccagcccguccucgccgccgaggacuucaccaucuucaaggccaugaugguccagaagaacaucgagaugcagcuccaggccauccgcaucauccaggagcgcaacggcguccuccccgacugccucaccgacggcuccgacgucgucuccgaccucgagcacgaggagaugaagauccuccgcgagguccuccgcaaguccaaggaggaguacgaccaggaggaggagcgcaagcgcaagaagcagcucuccgaggccaagaccgaggagcccaccguccacuccuccgaggccgccaucaugaacaacucccagggcgacggcgagcacuucgcccacccccccuccgaggucaagaugcacuucgccaaccaguccaucgagccccucggccgcaaggucgagcgcuccgagaccuccucccucccccagaaggaccucaagauccccggccucgagcacgccuccaucgagggccccaucgccaaccucuccguccucggcaccgaggagcuccgccagcgcgagcacuaccucaagcagaagcgcgacaagcucauguccaugcgcaaggacaugcgcaccaagcagauccagaacauggagcagaagggcaagcccaccggcgaggucgaggagaugaccgagaagcccgagaugaccgccgaggagaagcagacccuccucaagcgccgccuccucgccgagaagcucaaggaggaggucaucaacaaguga

SEQ ID NO: 41236 - RNA, 2949 nt, Artificial Sequence
  derived and/or modified sequence opt2 from CFAP44__Homo_sapiens__NP_060808
augaaggagcccgacgaccaggacaccgacggcgagaaguccgucaccuccaaguccgacggcaagaagucccuccgcuccuccaaguccgagucccgcucccccguccaggaggacaacaccuuccucgaggacgacaccgacgagaccuucaccaagggcgagggcuccuaccucgaggaggacuccgacgaggagcgccucgagggcucccucuccuccuuccaguacggcgaccuccaguccaccaccgucccccagcagacccccgcccccgccgucgaggaggccgaggaggaggucaagaagaagaucuccgaguccuucuucuacgacuacauggagcucgccuccaugcccuucgucacccucgacuccaacaucccccucgaccuccucacccucguccacuccuucggcuacgacugccgcaagcgcgccaaccuccagcuccucgacgacuccaucgccaucuacaucgccggcaaccagcucaucuuccucaaccucaagaccaaggagcagaucuaccuccgcuccuccuccggcgagggcaucggcgucaucggcguccacccccacaagaccuacuucaccgucgccgagaagggcuccuuccccgacaucaucaucuacgaguaccccucccuccgccccuaccgcguccuccgcgacggcaccgagaagggcuacgccuacgucgacuucaacuacuccggcaaccuccucgccuccgucggcuccaaccccgacuacacccucaccaucuggaacuggaaggaggagcagcccauccuccgcaccaaggccuucucccaggaggucuucaaggucaccuucaaccccgacaaggaggagcagcucaccaccuccggcuccggccacaucaaguucugggagauggccuucaccuucaccggccucaagcuccagggcucccucggccgcuucggcaagaccaucaccaccgacaucgagggcuacauggagcuccccgacggcaagguccucuccggcuccgaguggggcaacaugcuccucugggagggcggccucaucaaggucgagcucugccgcggcaccuccaaguccugccacaacggccccaucaaccagaucaugcucuacgagggcgaggucaucaccgucggcuccgacggcuacguccgcaucugggacuucgagaccaucgacaccgccgacgucaucgacgagaccggccuccucgagaucgagcccaucaacgagcuccaggucgacaagaacgucaaccucuucuccaugaucaagaugaacgagaccggcaacaacuucuggcucgcccaggacgccaacggcgccaucuggaagcucgaccucuccuucuccaacaucacccaggaccccgagugccucuucuccuuccacuccggcgccaucgaggccgucgccgucuccccccucaccuaccucauggccaccaccgcccucgacugcuccguccgcaucuacgacuucgccuccaagaccccccucgcccagaugaaguucaagcagggcggcaccgcccucgucugggucccccgcauggucaacuucaccggcgcccagaucaucgucggcuucgaggacggcgucguccgcauccucgagcucuacgaccccaagggccucaccaucuucgccggccgcaagaagauccucgacgccgacauccagcucaagcaggucuucaagccccacaccgccugcgucaccgcccucgccuacgagcgcgacggcgagauccucgccaccggcuccaaggaccagaccgucuucuucuucgaggucgagcgcgacuacaagcccaucggcuacaucaacacccccggccccgucugccagcucauguggucccccaugucccaccccgaguccacccuccucaucaucugcgagaacggcuacauccucgaggccccccuccccaccaucaagcaggaggaggacgaccacgacgucgucuccuacgagaucaaggacaugugcaucaagugcuuccacuucuccuccgucaaguccaagauccuccgccucaucgagaucgagaagcgcgagcgccagcgcgagcucaaggagaagauccgcgaggagcgccgcaacaagcucgccgccgagaugggcgaggacggcgagaaggaguuccaggaggaggaggaggagaaggaggaggaggaggaggaggaggagccccuccccgagaucuucauccccuccacccccucccccauccucugcggcuucuacuccgagcccggcaaguucugggucucccucggcggcuacgacuccggcuuccucuaccacugcgaguucccccccugcgacgaguccuccgacuucaaggagcagaaggacgagcccaucgacguccgcuaccucgccgacaccgaggacaaccccauccagaccaucaccuucaacaucaacaaggucaugauguucugcggcaugaagaacggcgccauccgcgucuacguccucaaccagaacgaccccucccucaccucccucgucgacuacuggcacuucaacaugcacgacaacaacuacggcugcaucaaguccaucgccaacuccuucgacgaccgcuuccucgucaccgccggcgccgacggcaacaucuucgucuucaacaucuucuccgaguucaugcuccgcaaggacaugaaggccaagguccccuccccccgcuucggcaucgagaccgagcccauccccgaggacaucgaggaccccaaggccuacuccaucgagaacgcccgccgcaagcgcgagcacgacaagcucaugaaggaggucggcgagaucaaggcccgcaagcgcgagcagaucaaggcccuccgcuccgaguucugcaaccuccucgagaugaacgagaagcuccccaagcacaugcaguucaagcgcaccgucucccucaucuga

SEQ ID NO: 41237 - RNA, 1659 nt, Artificial Sequence
  derived and/or modified sequence opt2 from CFAP52__Homo_sapiens__NP_001074025
auggacaacaagaucucccccgaggcccaggucgccgagcucgagcucgacgccgucaucggcuucaacgacaucauccucugggacuacaagaaccgcgagcuccucgcccgccucucccuccacaagggcaagaucgaggcccucgccuucucccccaacgaccucuaccucgucucccucggcggccccgacgacggcuccgucgucgucugguccaucgccaagcgcgacgccaucugcggcucccccgccgccggccucaacgucggcaacgccaccaacgucaucuucucccgcugccgcgacgagauguucaugaccgccggcaacggcaccauccgcgucugggagcucgaccuccccaaccgcaagaucuggcccaccgagugccagaccggccagcucaagcgcaucgucauguccaucggcgucgacgacgacgacuccuucuucuaccucggcaccaccaccggcgacauccucaagaugaacccccgcaccaagcuccucaccgacgucggccccgccaaggacaaguucucccucggcgucuccgccauccgcugccucaagaugggcggccuccucgucggcuccggcgccggccuccucgucuucugcaagucccccggcuacaagcccaucaagaagauccagcuccagggcggcaucaccuccaucacccuccgcggcgagggccaccaguuccucgucggcaccgaggagucccacaucuaccgcgucuccuucaccgacuucaaggagacccucaucgccaccugccacuucgacgccgucgaggacaucgucuuccccuucggcaccgccgagcucuucgccaccugcgccaagaaggacauccgcgucuggcacaccuccuccaaccgcgagcuccuccgcaucaccguccccaacaugaccugccacggcaucgacuucaugcgcgacggcaaguccaucaucuccgccuggaacgacggcaagauccgcgccuucgcccccgagaccggccgccucauguacgucaucaacaacgcccaccgcaucggcgucaccgccaucgccaccaccuccgacugcaagcgcgucaucuccggcggcggcgagggcgagguccgcgucuggcagaucggcugccagacccagaagcucgaggaggcccucaaggagcacaaguccuccgucuccugcauccgcgucaagcgcaacaacgaggagugcgucaccgccuccaccgacggcaccugcaucaucugggaccucguccgccuccgccgcaaccagaugauccucgccaacacccucuuccagugcgucugcuaccaccccgaggaguuccagaucaucaccuccggcaccgaccgcaagaucgccuacugggaggucuucgacggcaccgucauccgcgagcucgagggcucccucuccggcuccaucaacggcauggacaucacccaggagggcguccacuucgucaccggcggcaacgaccaccucgucaaggucugggacuacaacgagggcgaggucacccacgucggcgucggccacuccggcaacaucacccgcauccgcaucucccccggcaaccaguacaucgucuccgucuccgccgacggcgccauccuccgcuggaaguaccccuacaccuccuga

SEQ ID NO: 41238 - RNA, 1545 nt, Artificial Sequence
  derived and/or modified sequence opt2 from CFAP53__Homo_sapiens__NP_659457
auguacucccagcgcuucggcaccguccagcgcgaggucaagggccccacccccaaggucgucaucguccgcuccaagccccccaagggccagggcgccgagcaccaccucgagcgcauccgccgcucccaccagaagcacaacgccauccucgccuccaucaaguccuccgagcgcgaccgccucaaggccgagugggaccagcacaacgacugcaagauccucgacucccucguccgcgcccgcaucaaggacgccguccagggcuucaucaucaacaucgaggagcgccgcaacaagcuccgcgagcuccucgcccucgaggagaacgaguacuucaccgagaugcagcucaagaaggagaccaucgaggagaagaaggaccgcaugcgcgagaagaccaagcuccucaaggagaagaacgagaaggagcgccaggacuucgucgccgagaagcucgaccagcaguuccgcgagcgcugcgaggagcuccgcgucgagcuccucuccauccaccagaagaaggucugcgaggagcgcaaggcccagaucgccuucaacgaggagcucucccgccagaagcucgucgaggagcagauguucuccaagcucugggaggaggaccgccucgccaaggagaagcgcgaggcccaggaggcccgccgccagaaggagcucauggagaacacccgccucggccucaacgcccagaucaccuccaucaaggcccagcgccaggccacccagcuccucaaggaggaggaggcccgccucgucgaguccaacaacgcccagaucaagcacgagaacgagcaggacaugcucaagaagcagaaggccaagcaggagacccgcaccauccuccagaaggcccuccaggagcgcaucgagcacauccagcaggaguaccgcgacgagcaggaccucaacaugaagcucguccagcgcgcccuccaggaccuccaggaggaggccgacaagaagaagcagaagcgcgaggacaugauccgcgagcagaagaucuaccacaaguaccucgcccagcgccgcgaggaggagaaggcccaggagaaggaguucgaccgcauccucgaggaggacaaggccaagaagcucgccgagaaggacaaggagcuccgccucgagaaggaggcccgccgccagcucgucgacgaggucaugugcacccgcaagcuccagguccaggagaagcuccagcgcgaggccaaggagcaggaggagcgcgccauggagcagaagcacaucaacgagucccucaaggagcucaacugcgaggagaaggagaacuucgcccgccgccagcgccucgcccaggaguaccgcaagcagcuccagaugcagaucgccuaccagcagcagucccaggaggccgagaaggaggagaagcgccgcgaguucgaggccggcgucgccgccaacaagaugugccucgacaagguccaggagguccucuccacccaccagguccucccccagaacauccaccccaugcgcaaggccugccccuccaagcucccccccuga

SEQ ID NO: 41239 - RNA, 3366 nt, Artificial Sequence
  derived and/or modified sequence opt2 from CFAP57__Homo_sapiens__XP_011539101
auguccgccgucgucgcccagacccuccacgucuucggccuccgcucccacgucgccaacaacaucuucuacuucgacgagcagaucaucaucuuccccuccggcaaccacugcgucaaguacaacgucgaccagaaguggcagaaguucauccccggcuccgagaagucccagggcaugcucgcccucuccaucucccccaaccgccgcuaccucgccaucuccgagaccguccaggagaagcccgccaucaccaucuacgagcucuccuccauccccugccgcaagcgcaagguccucaacaacuucgacuuccagguccagaaguucaucuccauggccuucucccccgacuccaaguaccuccucgcccagaccuccccccccgaguccaaccucgucuacuggcucugggagaagcagaaggucauggccaucguccgcaucgacacccagaacaaccccgucuaccaggucuccuucuccccccaggacaacacccaggucugcgucaccggcaacggcauguucaagcuccuccgcuucgccgagggcacccucaagcagaccuccuuccagcgcggcgagccccagaacuaccucgcccacaccugggucgccgacgacaagaucgucgucggcaccgacaccggcaagcucuuccucuucgaguccggcgaccagcgcugggagaccuccaucauggucaaggagcccaccaacggcuccaagucccucgacgucauccaggaguccgagucccucaucgaguucccccccgucuccuccccccuccccuccuacgagcagauggucgccgccuccucccacucccagauguccaugccccaggucuucgccaucgccgccuacuccaagggcuucgccugcuccgccggccccggccgcguccuccucuucgagaagauggaggagaaggacuucuaccgcgagucccgcgagauccgcauccccgucgacccccaguccaacgaccccucccaguccgacaagcaggacguccucugccucugcuucucccccuccgaggagacccucgucgccuccaccuccaagaaccagcucuacuccaucaccaugucccucaccgagaucuccaagggcgagcccgcccacuucgaguaccucauguacccccuccacuccgcccccaucaccggccucgccaccugcauccgcaagccccucaucgccaccugcucccucgaccgcuccauccgccucuggaacuacgagaccaacacccucgagcucuucaaggaguaccaggaggaggccuacuccaucucccuccaccccuccggccacuucaucgucgucggcuucgccgacaagcuccgccucaugaaccuccucaucgacgacauccgcuccuucaaggaguacuccguccgcggcugcggcgagugcuccuucuccaacggcggccaccucuucgccgccgucaacggcaacgucauccacgucuacaccaccaccucccucgagaacaucuccucccucaagggccacaccggcaagaugcuccucaccuucgacgaccaguuccuccucaccgccgccgaggacggcugccucuucaccuggaaggucuucgacaaggacggccgcggcaucaagcgcgagcgcgaggucggcuucgccgaggagguccucgucaccaagaccgacauggaggagaaggcccaggucaugcucgagcucaagacccgcgucgaggagcucaagauggagaacgaguaccagcuccgccucaaggacaugaacuacuccgagaagaucaaggagcucaccgacaaguucauccaggagauggagucccucaagaccaagaaccagguccuccgcaccgagaaggagaagcaggacgucuaccaccacgagcacaucgaggaccuccucgacaagcagucccgcgagcuccaggacauggagugcugcaacaaccagaagcuccuccucgaguacgagaaguaccaggagcuccagcucaagucccagcgcaugcaggaggaguacgagaagcagcuccgcgacaacgacgagaccaagucccaggcccucgaggagcucaccgaguucuacgaggccaagcuccaggagaagaccacccuccucgaggaggcccaggaggacguccgccagcagcuccgcgaguucgaggagaccaagaagcagaucgaggaggacgaggaccgcgagauccaggacaucaagaccaaguacgagaagaagcuccgcgacgagaaggaguccaaccuccgccucaagggcgagaccggcaucaugcgcaagaaguucuccucccuccagaaggagaucgaggagcgcaccaacgacaucgagacccucaagggcgagcagaugaagcuccagggcgucaucaagucccucgagaaggacauccagggccucaagcgcgagauccaggagcgcgacgagaccauccaggacaaggagaagcgcaucuacgaccucaagaagaagaaccaggagcucggcaaguucaaguucguccucgacuacaagaucaaggagcucaagaagcagaucgagccccgcgagaacgagauccgcgucaugaaggagcagauccaggagauggaggccgagcucgagaacuuccacaagcagaacacccagcucgagcucaacaucaccgagcucuggcagaagcuccgcgccaccgaccaggagaugcgccgcgagcgccagaaggagcgcgaccucgaggcccucgucaagcgcuucaagaccgaccuccacaacugcgucgccuacauccaggagccccgccuccucaaggagaagguccgcggccucuucgagaaguacguccagcgcgccgacauggucgagaucgccggccucaacaccgaccuccagcaggaguacacccgccagcgcgagcaccucgagcgcaaccucgccacccucaagaagaaggucgucaaggagggcgagcuccaccgcaccgacuacguccgcaucaugcaggagaacgucucccucaucaaggagaucaacgagcuccgccgcgagcucaaguucacccgcucccaggucuacgaccucgaggccgcccucaagcucaccaagaagguccgcccccaggaggucuccgagaccgagcccucccgcgacaugcucuccaccgcccccaccgcccgccucaacgagcaggaggagaccggccgcaucaucgagaugcagcgccucgagauccagcgccuccgcgaccagauccaggagcaggagcaggucaccggcuuccacacccucgccggcguccgccuccccucccucuccaacuccgaggucgaccucgaggucaagaccaacuga

SEQ ID NO: 41240 - RNA, 2619 nt, Artificial Sequence
  derived and/or modified sequence opt2 from CFAP58__Homo_sapiens__NP_001008723
auggccgaggagaagggcggcaagcagguccucgaggaguccgccuucgaggagauggagcgcgacuuccagggcguccuccacgagcucuccggcgacaagucccucgagaaguuccgcaucgaguacgagcgccuccacgccgucaugaagaaguccuacgacaacgagaagcgccucauggccaagugccgcgagcucaacgccgagaucgucgucaacuccgccaaggucgccaccgcccucaagcucucccaggacgaccagaccaccaucgccucccucaagaaggagaucgagaaggccuggaagauggucgacuccgccuacgacaaggagcagaaggccaaggagaccauccucgcccucaaggaggagaucgucaaccucaccaagcucgucgagcagggcuccggccucuccauggaccagcacuccaacauccgcgaccuccuccgcuucaaggaggaggucaccaaggagcgcgaccagcuccucuccgaggucgucaagcuccgcgagucccucgcccagaccaccgagcagcagcaggagaccgagcgcuccaaggaggaggccgagcacgccaucucccaguuccagcaggagauccagcagcgccagaacgaggccucccgcgaguuccgcaagaaggagaagcucgagaaggagcucaagcagauccaggccgacauggacucccgccagaccgagaucaaggcccuccagcaguacguccagaaguccaaggaggagcuccagaagcucgagcagcagcucaaggagcagaagauccucaacgagcgcgccgccaaggagcucgagcaguuccagaugcgcaacgccaagcuccagcaggagaacgagcagcacucccucgucugcgagcagcucucccaggagaaccagcagaaggcccucgagcucaaggccaaggaggaggagguccaccagaugcgccucgacaucggcaagcucaacaagauccgcgagcagauccacaagaagcuccaccacaccgaggaccagaaggccgaggucgagcagcacaaggagacccucaagaaccagaucgucggccucgagcgcgaggucgaggccuccaagaagcaggccgagcucgaccgcaaggccauggacgagcuccuccgcgagcgcgacauccucaacaagaacaugcucaaggccgucaacgccacccagaagcagaccgaccucgucaagcuccacgagcaggccaagcgcaaccucgagggcgagauccagaacuacaaggacgaggcccagaagcagcgcaagaucaucuuccaccucgagaaggagcgcgaccgcuacaucaaccaggccuccgaccucacccagaagguccucaugaacauggaggacaucaagguccgcgagacccagaucuucgacuaccgcaagaagaucgccgaguccgagaucaagcucaagcagcagcagaaccucuacgaggccguccgcuccgaccgcaaccucuacuccaagaaccucgucgaggcccaggacgagaucaccgacaugaagcgcaagcucaagaucaugauccaccaggucgacgagcucaaggaggacaucuccgccaaggaguccgcccucgucaagcuccaccucgagcagcagcgcaucgagaaggagaaggagacccucaaggccgagcuccagaagcuccgccagcaggcccucgagaccaagcacuucaucgagaagcaggaggccgaggagcgcaagcuccuccgcaucaucgccgaggccgacggcgagcgccuccgccagaagaaggagcucgaccaggucaucuccgagcgcgacauccucggcucccagcucguccgccgcaacgacgagcucgcccuccucuacgagaagaucaagauccagcaguccguccucaacaagggcgagucccaguacaaccagcgccucgaggacaugcgcauccuccgccucgagaucaagaagcuccgccgcgagaagggcauccucgcccgcuccauggccaacgucgaggagcuccgccaggaguucuuccacaugcagcgcgagcuccucaaggagcgcacccgcugccgcgcccucgaggaggagcucgagaacccccucaacguccaccgcuggcgcaagcucgaggccuccgaccccaacgccuacgagcucauccagaagauccacacccuccagaagcgccucaucuccaagaccgaggaggucgucgagaaggagcuccuccuccaggagaaggagaagcucuacauggagcucaagcacguccucgcccgccagcccggccccgaggccgccgagcagcucaagcucuaccgccgcacccuccacgacaagaagcagcagcucaagguccucuccuccgagcucaacauguacgagguccaguccaaggaguacaaguacgaggucgagaagcucaccaacgagcuccagaaccucaagaagaaguaccucgcccagaagcgcaaggagcagcuccagaagaacaaggacaccgcccccauggacaacaccuuccucauggucaagcccaacggccccggcuucaccggcggcggcuucccccuccgcuccaccaagaugaccuucuga

SEQ ID NO: 41241 - RNA, 3714 nt, Artificial Sequence
  derived and/or modified sequence opt2 from CFAP61__Homo_sapiens__NP_056400
auguccguccucaccuccccccgcggcaaggucgaggucguccacugccgccgcaccgagucccaggacgucuacugcaucaagucccucauccgcaaguucaccugcaagcucuucggcaagcucaacaucaucuaccuccucgagaaggccaaccucgccgucacccucugcaacgacaaggaggagaucauggcccaggccaccuuccucgacuaccccaacuggaacgucgccaagcaggacgacugggucuccgucuuccgcgagcucgacuccgacauccccugcaccccccucaacacccucuucaugcaccucuucgucgccgucgacgaguacuccgucggcugcugcaaggagauccuccgcaccgucuacaaggccguccccgagcuccacuucaucuuccucaucguccccuccuacaugucccucggcuccacccucaucaccgucuucgaccaggucggcaacauccccugccucaccuacgaggaggacuucgccguccacaucugccaccgccacucccacuacccccagcuccacguccgcaaggcccgcgucgaggaccacgacgaccucaugcccaucuucaugcgcuacgacaccauccucaaggagaccuacggcgaguacuuccucgccgagcucaucgaggcccaggacgaggagaaccacgccgucgucugcgaggucgagggcaccgccgucggcuucauguccgucugcucccgcgucaacaugcagcuccuccacgagugcuucgaccucggccccuuccacggccucugcuucccccaccccgacgacguccucgaguccccccaggaccucuccguccgccgcucccaggacgccgagcuccgcuccuccucccagggcucccagaagaucgucgaggagcuccaggagcccgucucccccgacaccauggagaacauccagggcaacaucgcccgcgaggccgccuccgaggaggcccucaccgccguccaguccggcaacgucuccgagcccgaggacaucgagaagcucuccgacaucuccaccggcuacgcccaguaccaccacgucuccucccgcucccucgccucccucguccuccccgaggagcccguccacuuccgccccaucuaccgcggcgccuccgccgccuucugcauccagcucuucugcaucgacgagaaguacgaggcccgcucccucgacuucaugaacuucgucuucucccucuucuccgacaagaacuucugcgucaucucccucccccaccucacccccgaguucuuccucauccagaacuucgucaagaugguccccuucaacaccugcacccucgagcaggaccucuacgucuuccaccgcgccggccuccucaaguccaucaacauccgcuucgccacccuccucgacacccccggcgucgagaaccucgucuccacccucaugcucaacaaguccauccucgaggaccucgaccgcuacaacaaggcccgcaaggaccccgacggcacccuccuccaggccuucgucgccgaggucgccgagcagaucgucggcaucgccgucauccgcaacgagauggacaucgaguacauccgcucccacuacaacaucgaggacuucaucuacuucucccaccaccagcgcgaggagcacggccacaugcaccacuucgcccucaaccccaucuuccgccacuacaccaaguucuuccucaaggagauccuccgccucggcuucaaguccugccucuacuaccgcgucuaccccaagucccgcgagggcaaguuccagaaccccuacgcccacucccucaccuccgcccuccacuaccucguccccguccgcccccgccgccagaucgucuacccccucgagaagcucggcaucaacgcccccuccaaggccgucuccaaggaccccauguccuacgcccucaaccacaccaaccgcaagcucacccucgagcccaagaucaccgucaacgccaagaucaucgucgucggcgccuccuccgucggcaucuccuuccucgagacccucgucuucugcucccacaugaaguucaacaaccucacccucaucuccacccacggccuccccggcaagaagcuccucgacaccgagcagcgcaaguuccucgccuccgaccacugcuucaacgacaaggacuacgcccucaugucccucugcuccugggucaacgucgucgucggccgcaugaccggcaucgaccgcgccgccaagcacgucguccucuccaccgacgagaucguccccuacgaccaccucauccucugcaccggccagcaguaccagguccccugccccaccgaggccgacaucucccagcaccucaccaaccgcgagguccccaacuccucccagcgccgcuacaccggcaagguccccugcaaccacuucacccucaacgaggaggaggacugcuucaaggcccucaucuggauccgcaacaacuccaucaccaccgagggcaacaucaucgucuacggcaacaccaucgacaccuacaccaccgucgagacccuccucaaccucggcgucuccggcucccgcauccaccucguccagcccccccccgccuccaccaucaccugcaucaacaacuacuccgucgaguccgccgucgccgacgcccucggcgccgccggcgucaccauguaccgcgacgccauccucgcccaguggaacgacggccuccaccccgaccccaucuacuccgccuccuucaccacccccaccaagcccuuccgccuccagugcuccauguucuucuccuucugcgagaagaacgucgacuacgagaccuucaaggcccucaacgacgccugccucgucuacgacucccgccucgucaucgacaccaacuuccacaccaacgacaucgccauccgcgccgccggcucccucaccaaguucuccaaccgcuacuacuccaacgaguggacccacuccaacuucuccuccaaggagaucggcuuccagcucgccgccgccaugcuccaccucuucgaccccacccucgagcccgucaccgagccccccgccaaccucgaccgccucauccccauguacaagggcgccaagauccagggcggcauccuccccggcuccuaccacuaccuccacaucgccaagcccgccauccccaccccccucgagguccagauggcccagcccaacuacggccucgagcucgucaccggcuccgccaagaacggcaccuacuuccgcauccacaucaacaaguacaagauggucgagaccaucaccugccucucccgcgagcccuuccccgccuccaacuacauccgccucuucggccagcacgagcagcuccucaacaaccucugcgcccgcuacgacgagaaccucaucaccgaccucuacuccuacuucaccgagcccuggugccucgcccucuuccacgaccgcuucaucgaccuccgcaaggagcuccgccagauccucgccuccaaggaggaggaggaccuccccuccaucgagcagcucgcccaccagaucgaggacgaggagaucaaccccaccgagaagccccgccaguaccucaagcgcgucuucgaggaguccaucuacaagacccucgucgagcgcuccacccucgacuaccuccacuacaaccgcuaccaccuccccauguacgccuggcccggcaucgucuga

SEQ ID NO: 41242 - RNA, 2826 nt, Artificial Sequence
  derived and/or modified sequence opt2 from CFAP69__Homo_sapiens__NP_001034795
auguggaccgaggaggccggcgccaccgccgaggcccaggaguccggcauccgcaacaaguccuccuccuccucccagauccccgucgucggcgucgucaccgaggacgacgaggcccaggacgucuucaagcccauggaccucaaccgcgucaucaagcuccucgaggagaccgacaaggacggccucgaggagaagcagcucaaguucgucaagaagcucguccagugcuaccagaacggccucccccuccgcgaccucgcccagaucuucaagauccucaaccucugcuccggcaagaucaagaaccagccccgcuucaucgaguccgccuacgacaucaucaagcucugcggccuccccuuccucaagaagaaggucuccgacgagaucaccuacgccgaggacaccgccaacuccaucgcccuccucggcgaccucaugaagauccccuccuccgagcuccgcauccagaucugcaagugcaucgucgacuucuaccacgccgagccccccaagaagcacauccccggcuaccagcaggccuccuccuccuacaagauccagauggccgaggucggcggccucgccaagaccaugguccaguccaugacccuccucgagaaccagcucgucgagaagcucuggguccucaagguccuccagcaccucuccaccuccgaggucaacugcaccaucaugaugaaggcccaggccgccuccggcaucugcacccaccucaacgaccccgaccccuccggccagcuccucuuccgcuccuccgagauccucuggaaccuccucgagaaguccuccaaggaggaggucauccagcagcucuccaaccucgagugccuccucgcccucaaggaggucuucaagaaccucuucaugcgcggcuucucccacuacgaccgccagcuccgcaacgacauccucgucaucaccaccaucaucgcccagaaccccgaggcccccaugaucgagugcggcuucaccaaggaccucauccucuucgccaccuucaacgaggucaagucccagaaccuccucgucaagggccucaagcucuccaacuccuacgaggacuucgagcucaagaagcuccucuucaacgucaucgucauccucugcaaggaccuccccaccguccagcuccucaucgacggcaaggucauccucgcccucuucaccuacgucaagaagcccgagaagcagaagaucaucgacugguccgccgcccagcacgaggagcuccagcuccacgccaucgccacccucuccuccgucgccccccuccucaucgaggaguacauguccugccagggcaacgcccgcguccucgccuuccucgaguggugcgaguccgaggaccccuucuucucccacggcaacuccuuccacggcaccggcggccgcggcaacaaguucgcccagaugcgcuacucccuccgccuccuccgcgccgucgucuaccucgaggacgagaccgucaacaaggaccucugcgagaagggcaccauccagcagaugaucggcaucuucaagaacaucaucuccaagcccaacgagaaggaggaggccaucguccucgagauccaguccgacauccuccucauccucuccggccucugcgagaaccacauccagcgcaaggagaucuucggcaccgagggcgucgacaucguccuccacgucaugaagaccgacccccgcaagcuccaguccggccucggcuacaacguccuccucuucuccacccucgacuccaucuggugcugcauccucggcugcuaccccuccgaggacuacuuccucgagaaggagggcaucuuccuccuccucgaccuccucgcccucaaccagaagaaguucugcaaccucauccucggcaucauggucgaguucugcgacaaccccaagaccgccgcccacgucaacgccuggcagggcaagaaggaccagaccgccgccucccuccucaucaagcucuggcgcaaggaggagaaggagcucggcgucaagcgcgacaagaacggcaagaucaucgacaccaagaagccccucuucaccuccuuccaggaggagcagaagaucaucccccuccccgccaacugccccuccaucgccgucauggacgucuccgagaacauccgcgccaagaucuacgccauccucggcaagcucgacuucgagaaccuccccggccucuccgccgaggacuucgucacccucugcaucauccaccgcuaccucgacuucaagaucggcgagaucuggaacgagaucuacgaggagaucaagcucgagaagcuccgccccgucaccaccgacaagaaggcccucgaggccaucaccaccgccuccgagaacaucggcaagauggucgccucccuccaguccgacaucaucgagucccaggccugccaggacaugcagaacgagcagaaggucuacgccaagauccaggccacccacaagcagcgcgagcucgccaacaaguccugggaggacuuccucgcccgcaccuccaacgccaagacccucaagaaggccaagucccuccaggagaaggccaucgaggccucccgcuaccacaagcgcccccagaacgccaucuuccaccagacccacaucaagggccucaacaccaccguccccuccggcggcgucgucaccgucgaguccacccccgcccgccucgucggcggcccccucgucgacaccgacaucgcccucaagaagcuccccauccgcggcggcgcccuccagcgcgucaaggccgucaagaucgucgacgcccccaagaaguccauccccaccuga

SEQ ID NO: 41243 - RNA, 1362 nt, Artificial Sequence
  derived and/or modified sequence opt2 from CFAP97__Homo_sapiens__NP_001278962
auggaccaguucggcgacauccucgagggcgaggucgaccacuccuucuucgacuccgacuucgaggagggcaagaagugcgagaccaacuccgucuucgacaagcagaacgacgaccccaaggagcgcaucgacaaggacaccaagaacgucaacuccaacaccggcaugcagaccaccgagaacuaccucaccgagaagggcaacgagcgcaacgucaaguucccccccgagcaccccgucgagaacgacgucacccagaccgucuccuccuucucccuccccgccuccucccgcuccaagaagcucugcgacgucaccaccggccucaagauccacgucuccauccccaaccgcauccccaagaucgucaaggagggcgaggacgacuacuacaccgacggcgaggaguccuccgacgacggcaagaaguaccacgucaaguccaaguccgccaagcccuccaccaacgucaagaaguccauccgcaagaaguacugcaaggucuccuccuccuccuccuccucccucuccuccuccuccuccggcuccggcaccgacugccucgacgccggcuccgacucccaccucuccgacuccucccccuccuccaaguccuccaagaagcacgucuccggcaucacccuccucucccccaagcacaaguacaaguccggcaucaaguccaccgagacccagcccuccuccaccacccccaagugcggccacuaccccgaggaguccgaggacaccgucaccgacgucuccccccucuccacccccgacaucuccccccuccaguccuucgagcucggcaucgccaacgaccagaaggucaagaucaagaagcaggagaacgucucccaggagaucuacgaggacgucgaggaccucaagaacaacuccaaguaccucaaggccgccaagaagggcaaggagaagcacgagcccgacgucuccuccaaguccuccuccguccucgacuccucccucgaccaccgccacaagcagaagguccuccacgacaccauggaccucaaccaccuccucaaggccuuccuccagcucgacaagaagggcccccagaagcaccacuucgaccagcccuccgucgcccccggcaagaacuacuccuucacccgcgaggagguccgccagaucgaccgcgagaaccagcgccuccucaaggagcucucccgccaggccgagaagcccggcuccaaguccaccaucccccgcuccgccgaccacccccccaagcucuaccacuccgcccucaaccgccagaaggagcagcagcgcaucgagcgcgagaaccucaccaucucccucugccaccccggcugguccgccgucaccuga

SEQ ID NO: 41244 - RNA, 2295 nt, Artificial Sequence
  derived and/or modified sequence opt2 from CFB__Homo_sapiens__NP_001701
augggcuccaaccucuccccccagcucugccucaugcccuucauccucggccuccucuccggcggcgucaccaccacccccuggucccucgcccgcccccagggcuccugcucccucgagggcgucgagaucaagggcggcuccuuccgccuccuccaggagggccaggcccucgaguacgucugccccuccggcuucuaccccuaccccguccagacccgcaccugccgcuccaccggcuccugguccacccucaagacccaggaccagaagaccguccgcaaggccgagugccgcgccauccacugcccccgcccccacgacuucgagaacggcgaguacuggccccgcucccccuacuacaacgucuccgacgagaucuccuuccacugcuacgacggcuacacccuccgcggcuccgccaaccgcaccugccaggucaacggccgcugguccggccagaccgccaucugcgacaacggcgccggcuacugcuccaaccccggcauccccaucggcacccgcaaggucggcucccaguaccgccucgaggacuccgucaccuaccacugcucccgcggccucacccuccgcggcucccagcgccgcaccugccaggagggcggcuccugguccggcaccgagcccuccugccaggacuccuucauguacgacaccccccaggaggucgccgaggccuuccucuccucccucaccgagaccaucgagggcgucgacgccgaggacggccacggccccggcgagcagcagaagcgcaagaucguccucgaccccuccggcuccaugaacaucuaccucguccucgacggcuccgacuccaucggcgccuccaacuucaccggcgccaagaagugccucgucaaccucaucgagaaggucgccuccuacggcgucaagccccgcuacggccucgucaccuacgccaccuaccccaagaucugggucaaggucuccgaggccgacuccuccaacgccgacugggucaccaagcagcucaacgagaucaacuacgaggaccacaagcucaaguccggcaccaacaccaagaaggcccuccaggccgucuacuccaugauguccuggcccgacgacgucccccccgagggcuggaaccgcacccgccacgucaucauccucaugaccgacggccuccacaacaugggcggcgaccccaucaccgucaucgacgagauccgcgaccuccucuacaucggcaaggaccgcaagaacccccgcgaggacuaccucgacgucuacgucuucggcgucggcccccucgucaaccaggucaacaucaacgcccucgccuccaagaaggacaacgagcagcacgucuucaaggucaaggacauggagaaccucgaggacgucuucuaccagaugaucgacgagucccagucccucucccucugcggcauggucugggagcaccgcaagggcaccgacuaccacaagcagcccuggcaggccaagaucuccgucauccgccccuccaagggccacgaguccugcaugggcgccgucgucuccgaguacuucguccucaccgccgcccacugcuucaccgucgacgacaaggagcacuccaucaaggucuccgucggcggcgagaagcgcgaccucgagaucgaggucguccucuuccaccccaacuacaacaucaacggcaagaaggaggccggcauccccgaguucuacgacuacgacgucgcccucaucaagcucaagaacaagcucaaguacggccagaccauccgccccaucugccuccccugcaccgagggcaccacccgcgcccuccgccucccccccaccaccaccugccagcagcagaaggaggagcuccuccccgcccaggacaucaaggcccucuucgucuccgaggaggagaagaagcucacccgcaaggaggucuacaucaagaacggcgacaagaagggcuccugcgagcgcgacgcccaguacgcccccggcuacgacaaggucaaggacaucuccgaggucgucaccccccgcuuccucugcaccggcggcgucucccccuacgccgaccccaacaccugccgcggcgacuccggcggcccccucaucguccacaagcgcucccgcuucauccaggucggcgucaucuccuggggcgucgucgacgucugcaagaaccagaagcgccagaagcagguccccgcccacgcccgcgacuuccacaucaaccucuuccagguccuccccuggcucaaggagaagcuccaggacgaggaccucggcuuccucuga

SEQ ID NO: 41245 - RNA, 672 nt, Artificial Sequence
  derived and/or modified sequence opt2 from CFC1B__Homo_sapiens__NP_001072998
augaccuggcgccaccacguccgccuccucuucaccgucucccucgcccuccagaucaucaaccucggcaacuccuaccagcgcgagaagcacaacggcggccgcgaggaggucaccaaggucgccacccagaagcaccgccaguccccccucaacuggaccuccucccacuucggcgaggucaccggcuccgccgagggcuggggccccgaggagccccuccccuacuccugggccuucggcgagggcgccuccgcccgcccccgcugcugccgcaacggcggcaccugcguccucggcuccuucugcgucugccccgcccacuucaccggccgcuacugcgagcacgaccagcgccgcuccgagugcggcgcccucgagcacggcgccuggacccuccgcgccugccaccucugccgcugcaucuucggcgcccuccacugccucccccuccagacccccgaccgcugcgaccccaaggacuuccucgccucccacgcccacggccccuccgccggcggcgcccccucccuccuccuccuccuccccugcgcccuccuccaccgccuccuccgccccgacgcccccgcccacccccgcucccucguccccuccguccuccagcgcgagcgccgccccugcggccgccccggccucggccaccgccucuga

SEQ ID NO: 41246 - RNA, 672 nt, Artificial Sequence
  derived and/or modified sequence opt2 from CFC1__Homo_sapiens__NP_115934
augaccuggcgccaccacguccgccuccucuucaccgucucccucgcccuccagaucaucaaccucggcaacuccuaccagcgcgagaagcacaacggcggccgcgaggaggucaccaaggucgccacccagaagcaccgccaguccccccucaacuggaccuccucccacuucggcgaggucaccggcuccgccgagggcuggggccccgaggagccccuccccuacucccgcgccuucggcgagggcgccuccgcccgcccccgcugcugccgcaacggcggcaccugcguccucggcuccuucugcgucugccccgcccacuucaccggccgcuacugcgagcacgaccagcgccgcuccgagugcggcgcccucgagcacggcgccuggacccuccgcgccugccaccucugccgcugcaucuucggcgcccuccacugccucccccuccagacccccgaccgcugcgaccccaaggacuuccucgccucccacgcccacggccccuccgccggcggcgcccccucccuccuccuccuccuccccugcgcccuccuccaccgccuccuccgccccgacgcccccgcccacccccgcucccucguccccuccguccuccagcgcgagcgccgccccugcggccgccccggccucggccaccgccucuga

SEQ ID NO: 41247 - RNA, 762 nt, Artificial Sequence
  derived and/or modified sequence opt2 from CFD__Homo_sapiens__NP_001919
augcacuccugggagcgccucgccguccucguccuccucggcgccgccgccugcgccgcccccccccgcggccgcauccucggcggccgcgaggccgaggcccacgcccgccccuacauggccuccguccagcucaacggcgcccaccucugcggcggcguccucgucgccgagcaguggguccucuccgccgcccacugccucgaggacgccgccgacggcaagguccagguccuccucggcgcccacucccucucccagcccgagcccuccaagcgccucuacgacguccuccgcgccgucccccaccccgacucccagcccgacaccaucgaccacgaccuccuccuccuccagcucuccgagaaggccacccucggccccgccguccgcccccuccccuggcagcgcgucgaccgcgacgucgcccccggcacccucugcgacgucgccggcuggggcaucgucaaccacgccggccgccgccccgacucccuccagcacguccuccuccccguccucgaccgcgccaccugcaaccgccgcacccaccacgacggcgccaucaccgagcgccucaugugcgccgaguccaaccgccgcgacuccugcaagggcgacuccggcggcccccucgucugcggcggcguccucgagggcgucgucaccuccggcucccgcgucugcggcaaccgcaagaagcccggcaucuacacccgcgucgccuccuacgccgccuggaucgacuccguccucgccuga

SEQ ID NO: 41248 - RNA, 900 nt, Artificial Sequence
  derived and/or modified sequence opt2 from CFDP1__Homo_sapiens__NP_006315
auggaggaguucgacuccgaggacuucuccaccuccgaggaggacgaggacuacguccccuccggcggcgaguacuccgaggacgacgucaacgagcucgucaaggaggacgaggucgacggcgaggagcagacccagaagacccagggcaagaagcgcaaggcccaguccauccccgcccgcaagcgccgccagggcggccucucccucgaggaggaggaggaggaggacgccaacuccgaguccgagggcuccuccuccgaggaggaggacgacgccgccgagcaggagaagggcaucggcuccgaggacgcccgcaagaagaaggaggacgagcucugggccuccuuccucaacgacgucggccccaaguccaaggucccccccuccacccaggucaagaagggcgaggagaccgaggagaccuccuccuccaagcuccucgucaaggccgaggagcucgagaagcccaaggagaccgagaaggucaagaucaccaaggucuucgacuucgccggcgaggagguccgcgucaccaaggaggucgacgccaccuccaaggaggccaaguccuucuucaagcagaacgagaaggagaagccccaggccaacguccccuccgcccuccccucccuccccgccggcuccggccucaagcgcuccuccggcauguccucccuccucggcaagaucggcgccaagaagcagaagauguccacccucgagaaguccaagcucgacugggaguccuucaaggaggaggagggcaucggcgaggagcucgccauccacaaccgcggcaaggagggcuacaucgagcgcaaggccuuccucgaccgcgucgaccaccgccaguucgagaucgagcgcgaccuccgccucuccaagaugaagcccuga

SEQ ID NO: 41249 - RNA, 3696 nt, Artificial Sequence
  derived and/or modified sequence opt2 from CFH__Homo_sapiens__NP_000177
augcgccuccucgccaagaucaucugccucaugcucugggccaucugcgucgccgaggacugcaacgagcuccccccccgccgcaacaccgagauccucaccggcuccugguccgaccagaccuaccccgagggcacccaggccaucuacaagugccgccccggcuaccgcucccucggcaacgucaucauggucugccgcaagggcgagugggucgcccucaacccccuccgcaagugccagaagcgccccugcggccaccccggcgacacccccuucggcaccuucacccucaccggcggcaacgucuucgaguacggcgucaaggccgucuacaccugcaacgagggcuaccagcuccucggcgagaucaacuaccgcgagugcgacaccgacggcuggaccaacgacauccccaucugcgaggucgucaagugccuccccgucaccgcccccgagaacggcaagaucgucuccuccgccauggagcccgaccgcgaguaccacuucggccaggccguccgcuucgucugcaacuccggcuacaagaucgagggcgacgaggagaugcacugcuccgacgacggcuucugguccaaggagaagcccaagugcgucgagaucuccugcaagucccccgacgucaucaacggcucccccaucucccagaagaucaucuacaaggagaacgagcgcuuccaguacaagugcaacaugggcuacgaguacuccgagcgcggcgacgccgucugcaccgaguccggcuggcgcccccuccccuccugcgaggagaaguccugcgacaaccccuacauccccaacggcgacuacuccccccuccgcaucaagcaccgcaccggcgacgagaucaccuaccagugccgcaacggcuucuaccccgccacccgcggcaacaccgccaagugcaccuccaccggcuggauccccgccccccgcugcacccucaagcccugcgacuaccccgacaucaagcacggcggccucuaccacgagaacaugcgccgccccuacuuccccgucgccgucggcaaguacuacuccuacuacugcgacgagcacuucgagacccccuccggcuccuacugggaccacauccacugcacccaggacggcuggucccccgccguccccugccuccgcaagugcuacuuccccuaccucgagaacggcuacaaccagaaccacggccgcaaguucguccagggcaaguccaucgacgucgccugccaccccggcuacgcccuccccaaggcccagaccaccgucaccugcauggagaacggcuggucccccaccccccgcugcauccgcgucaagaccugcuccaaguccuccaucgacaucgagaacggcuucaucuccgagucccaguacaccuacgcccucaaggagaaggccaaguaccagugcaagcucggcuacgucaccgccgacggcgagaccuccggcuccaucaccugcggcaaggacggcugguccgcccagcccaccugcaucaaguccugcgacauccccgucuucaugaacgcccgcaccaagaacgacuucaccugguucaagcucaacgacacccucgacuacgagugccacgacggcuacgaguccaacaccggcuccaccaccggcuccaucgucugcggcuacaacggcugguccgaccuccccaucugcuacgagcgcgagugcgagcuccccaagaucgacguccaccucguccccgaccgcaagaaggaccaguacaaggucggcgagguccucaaguucuccugcaagcccggcuucaccaucgucggccccaacuccguccagugcuaccacuucggccucucccccgaccuccccaucugcaaggagcagguccaguccugcggccccccccccgagcuccucaacggcaacgucaaggagaagaccaaggaggaguacggccacuccgaggucgucgaguacuacugcaacccccgcuuccucaugaagggccccaacaagauccagugcgucgacggcgaguggaccacccuccccgucugcaucgucgaggaguccaccugcggcgacauccccgagcucgagcacggcugggcccagcucuccuccccccccuacuacuacggcgacuccgucgaguucaacugcuccgaguccuucaccaugaucggccaccgcuccaucaccugcauccacggcgucuggacccagcucccccagugcgucgccaucgacaagcucaagaagugcaaguccuccaaccucaucauccucgaggagcaccucaagaacaagaaggaguucgaccacaacuccaacauccgcuaccgcugccgcggcaaggagggcuggauccacaccgucugcaucaacggccgcugggaccccgaggucaacugcuccauggcccagauccagcucugccccccccccccccagauccccaacucccacaacaugaccaccacccucaacuaccgcgacggcgagaaggucuccguccucugccaggagaacuaccucauccaggagggcgaggagaucaccugcaaggacggccgcuggcaguccaucccccucugcgucgagaagauccccugcucccagcccccccagaucgagcacggcaccaucaacuccucccgcuccucccaggaguccuacgcccacggcaccaagcucuccuacaccugcgagggcggcuuccgcaucuccgaggagaacgagaccaccugcuacaugggcaagugguccucccccccccagugcgagggccuccccugcaaguccccccccgagaucucccacggcgucgucgcccacauguccgacuccuaccaguacggcgaggaggucaccuacaagugcuucgagggcuucggcaucgacggccccgccaucgccaagugccucggcgagaaguggucccacccccccuccugcaucaagaccgacugccucucccuccccuccuucgagaacgccauccccaugggcgagaagaaggacgucuacaaggccggcgagcaggucaccuacaccugcgccaccuacuacaagauggacggcgccuccaacgucaccugcaucaacucccgcuggaccggccgccccaccugccgcgacaccuccugcgucaacccccccaccguccagaacgccuacaucgucucccgccagauguccaaguaccccuccggcgagcgcguccgcuaccagugccgcucccccuacgagauguucggcgacgaggaggucaugugccucaacggcaacuggaccgagcccccccagugcaaggacuccaccggcaagugcggcccccccccccccaucgacaacggcgacaucaccuccuucccccucuccgucuacgcccccgccuccuccgucgaguaccagugccagaaccucuaccagcucgagggcaacaagcgcaucaccugccgcaacggccagugguccgagccccccaagugccuccaccccugcgucaucucccgcgagaucauggagaacuacaacaucgcccuccgcuggaccgccaagcagaagcucuacucccgcaccggcgaguccgucgaguucgucugcaagcgcggcuaccgccucuccucccgcucccacacccuccgcaccaccugcugggacggcaagcucgaguaccccaccugcgccaagcgcuga

SEQ ID NO: 41250 - RNA, 993 nt, Artificial Sequence
  derived and/or modified sequence opt2 from CFHR1__Homo_sapiens__NP_002104
auguggcuccucgucuccgucauccucaucucccgcaucuccuccgucggcggcgaggccaccuucugcgacuuccccaagaucaaccacggcauccucuacgacgaggagaaguacaagcccuucucccagguccccaccggcgaggucuucuacuacuccugcgaguacaacuucgucucccccuccaaguccuucuggacccgcaucaccugcaccgaggagggcuggucccccacccccaagugccuccgccucugcuucuuccccuucgucgagaacggccacuccgaguccuccggccagacccaccucgagggcgacaccguccagaucaucugcaacaccggcuaccgccuccagaacaacgagaacaacaucuccugcgucgagcgcggcugguccaccccccccaagugccgcuccaccgacaccuccugcgucaacccccccaccguccagaacgcccacauccucucccgccagauguccaaguaccccuccggcgagcgcguccgcuacgagugccgcucccccuacgagauguucggcgacgaggaggucaugugccucaacggcaacuggaccgagcccccccagugcaaggacuccaccggcaagugcggcccccccccccccaucgacaacggcgacaucaccuccuucccccucuccgucuacgcccccgccuccuccgucgaguaccagugccagaaccucuaccagcucgagggcaacaagcgcaucaccugccgcaacggccagugguccgagccccccaagugccuccaccccugcgucaucucccgcgagaucauggagaacuacaacaucgcccuccgcuggaccgccaagcagaagcucuaccuccgcaccggcgaguccgccgaguucgucugcaagcgcggcuaccgccucuccucccgcucccacacccuccgcaccaccugcugggacggcaagcucgaguaccccaccugcgccaagcgcuga

SEQ ID NO: 41251 - RNA, 813 nt, Artificial Sequence
  derived and/or modified sequence opt2 from CFHR2__Homo_sapiens__NP_005657
auguggcuccucgucuccgucauccucaucucccgcaucuccuccgucggcggcgaggccauguucugcgacuuccccaagaucaaccacggcauccucuacgacgaggagaaguacaagcccuucucccagguccccaccggcgaggucuucuacuacuccugcgaguacaacuucgucucccccuccaaguccuucuggacccgcaucaccugcgccgaggagggcuggucccccacccccaagugccuccgccucugcuucuuccccuucgucgagaacggccacuccgaguccuccggccagacccaccucgagggcgacaccguccagaucaucugcaacaccggcuaccgccuccagaacaacgagaacaacaucuccugcgucgagcgcggcugguccaccccccccaagugccgcuccaccaucuccgccgagaagugcggcccccccccccccaucgacaacggcgacaucaccuccuuccuccucuccgucuacgcccccggcuccuccgucgaguaccagugccagaaccucuaccagcucgagggcaacaaccagaucaccugccgcaacggccagugguccgagccccccaagugccucgaccccugcgucaucucccaggagaucauggagaaguacaacaucaagcucaaguggaccaaccagcagaagcucuacucccgcaccggcgacaucgucgaguucgucugcaaguccggcuaccaccccaccaagucccacuccuuccgcgccaugugccagaacggcaagcucgucuaccccuccugcgaggagaaguga

SEQ ID NO: 41252 - RNA, 810 nt, Artificial Sequence
  derived and/or modified sequence opt2 from CFHR3__Homo_sapiens__NP_001160096
augcuccuccucaucaacgucauccucacccucugggucuccugcgccaacggccaggucaagcccugcgacuuccccgacaucaagcacggcggccucuuccacgagaacaugcgccgccccuacuuccccgucgccgucggcaaguacuacuccuacuacugcgacgagcacuucgagacccccuccggcuccuacugggacuacauccacugcacccagaacggcuggucccccgccguccccugccuccgcaagugcuacuuccccuaccucgagaacggcuacaaccagaacuacggccgcaaguucguccagggcaacuccaccgaggucgccugccaccccggcuacggccuccccaaggcccagaccaccgucaccugcaccgagaagggcuggucccccaccccccgcugcauccgcgucaacuccuccgagaagugcggcccccccccccccaucuccaacggcgacaccaccuccuuccuccucaaggucuacgucccccagucccgcgucgaguaccagugccagcccuacuacgagcuccagggcuccaacuacgucaccugcuccaacggcgagugguccgagcccccccgcugcauccaccccugcaucaucaccgaggagaacaugaacaagaacaacaucaagcucaagggccgcuccgaccgcaaguacuacgccaagaccggcgacaccaucgaguucaugugcaagcucggcuacaacgccaacaccuccauccucuccuuccaggccgucugccgcgagggcaucgucgaguacccccgcugcgaguga

SEQ ID NO: 41253 - RNA, 1734 nt, Artificial Sequence
  derived and/or modified sequence opt2 from CFHR4__Homo_sapiens__NP_001188480
augcuccuccucaucaacgucauccucacccucugggucuccugcgccaacggccaggucaagcccugcgacuuccccgagauccagcacggcggccucuacuacaagucccuccgccgccucuacuuccccgccgccgccggccaguccuacuccuacuacugcgaccagaacuucgucacccccuccggcuccuacugggacuacauccacugcacccaggacggcuggucccccaccguccccugccuccgcaccugcuccaaguccgacgucgagaucgagaacggcuucaucuccgaguccuccuccaucuacauccucaacgaggagacccaguacaacugcaagcccggcuacgccaccgccgagggcaacuccuccggcuccaucaccugccuccagaacggcugguccacccagcccaucugcaucaaguucugcgacaugcccgucuucgagaacucccgcgccaaguccaacggcaugugguucaagcuccacgacacccucgacuacgagugcuacgacggcuacgaguccuccuacggcaacaccaccgacuccaucgucugcggcgaggacggcuggucccaccuccccaccugcuacaacuccuccgagaacugcggcccccccccccccaucuccaacggcgacaccaccuccuucccccagaaggucuaccuccccuggucccgcgucgaguaccagugccaguccuacuacgagcuccagggcuccaaguacgucaccugcuccaacggcgacugguccgagcccccccgcugcaucuccaugaagcccugcgaguuccccgagauccagcacggccaccucuacuacgagaacacccgccgccccuacuuccccgucgccaccggccaguccuacuccuacuacugcgaccagaacuucgucacccccuccggcuccuacugggacuacauccacugcacccaggacggcuggcuccccaccguccccugccuccgcaccugcuccaaguccgacaucgagaucgagaacggcuucaucuccgaguccuccuccaucuacauccucaacaaggagauccaguacaagugcaagcccggcuacgccaccgccgacggcaacuccuccggcuccaucaccugccuccagaacggcugguccgcccagcccaucugcaucaaguucugcgacaugcccgucuucgagaacucccgcgccaaguccaacggcaugcgcuucaagcuccacgacacccucgacuacgagugcuacgacggcuacgagaucuccuacggcaacaccaccggcuccaucgucugcggcgaggacggcuggucccacuuccccaccugcuacaacuccuccgagaagugcggcccccccccccccaucuccaacggcgacaccaccuccuuccuccucaaggucuacgucccccagucccgcgucgaguaccagugccaguccuacuacgagcuccagggcuccaacuacgucaccugcuccaacggcgagugguccgagcccccccgcugcauccaccccugcaucaucaccgaggagaacaugaacaagaacaacauccagcucaagggcaaguccgacaucaaguacuacgccaagaccggcgacaccaucgaguucaugugcaagcucggcuacaacgccaacaccuccguccucuccuuccaggccgucugccgcgagggcaucgucgaguacccccgcugcgaguga

SEQ ID NO: 41254 - RNA, 1710 nt, Artificial Sequence
  derived and/or modified sequence opt2 from CFHR5__Homo_sapiens__NP_110414
augcuccuccucuucuccgucauccucaucuccugggucuccaccgucggcggcgagggcacccucugcgacuuccccaagauccaccacggcuuccucuacgacgaggaggacuacaaccccuucucccagguccccaccggcgaggucuucuacuacuccugcgaguacaacuucgucucccccuccaaguccuucuggacccgcaucaccugcaccgaggagggcuggucccccacccccaagugccuccgcaugugcuccuuccccuucgucaagaacggccacuccgaguccuccggccucauccaccucgagggcgacaccguccagaucaucugcaacaccggcuacucccuccagaacaacgagaagaacaucuccugcgucgagcgcggcugguccaccccccccaucugcuccuucaccaagggcgagugccacguccccauccucgaggccaacgucgacgcccagcccaagaaggaguccuacaaggucggcgacguccucaaguucuccugccgcaagaaccucauccgcgucggcuccgacuccguccagugcuaccaguucggcuggucccccaacuuccccaccugcaagggccagguccgcuccugcggcccccccccccagcucuccaacggcgaggucaaggagauccgcaaggaggaguacggccacaacgaggucgucgaguacgacugcaaccccaacuucaucaucaacggccccaagaagauccagugcgucgacggcgaguggaccacccuccccaccugcgucgagcaggucaagaccugcggcuacauccccgagcucgaguacggcuacguccagcccuccgucccccccuaccagcacggcgucuccgucgaggucaacugccgcaacgaguacgccaugaucggcaacaacaugaucaccugcaucaacggcaucuggaccgagcuccccaugugcgucgccacccaccagcucaagcgcugcaagaucgccggcgucaacaucaagacccuccucaagcucuccggcaaggaguucaaccacaacucccgcauccgcuaccgcugcuccgacaucuuccgcuaccgccacuccgucugcaucaacggcaaguggaaccccgaggucgacugcaccgagaagcgcgagcaguucugccccccccccccccagauccccaacgcccagaacaugaccaccaccgucaacuaccaggacggcgagaaggucgccguccucugcaaggagaacuaccuccuccccgaggccaaggagaucgucugcaaggacggccgcuggcagucccucccccgcugcgucgaguccaccgccuacugcggccccccccccuccaucaacaacggcgacaccaccuccuucccccucuccgucuacccccccggcuccaccgucaccuaccgcugccaguccuucuacaagcuccagggcuccgucaccgucaccugccgcaacaagcagugguccgagcccccccgcugccucgaccccugcgucgucuccgaggagaacaugaacaagaacaacauccagcucaaguggcgcaacgacggcaagcucuacgccaagaccggcgacgccgucgaguuccagugcaaguucccccacaaggccaugaucuccuccccccccuuccgcgccaucugccaggagggcaaguucgaguaccccaucugcgaguga

SEQ ID NO: 41255 - RNA, 1752 nt, Artificial Sequence
  derived and/or modified sequence opt2 from CFI__Homo_sapiens__NP_000195
augaagcuccuccacgucuuccuccucuuccucugcuuccaccuccgcuucugcaaggucaccuacaccucccaggaggaccucgucgagaagaagugccucgccaagaaguacacccaccucuccugcgacaaggucuucugccagcccuggcagcgcugcaucgagggcaccugcgucugcaagcuccccuaccagugccccaagaacggcaccgccgucugcgccaccaaccgccgcuccuuccccaccuacugccagcagaagucccucgagugccuccaccccggcaccaaguuccucaacaacggcaccugcaccgccgagggcaaguucuccgucucccucaagcacggcaacaccgacuccgagggcaucgucgaggucaagcucgucgaccaggacaagaccauguucaucugcaaguccuccugguccaugcgcgaggccaacgucgccugccucgaccucggcuuccagcagggcgccgacacccagcgccgcuucaagcucuccgaccucuccaucaacuccaccgagugccuccacguccacugccgcggccucgagaccucccucgccgagugcaccuucaccaagcgccgcaccaugggcuaccaggacuucgccgacgucgucugcuacacccagaaggccgacucccccauggacgacuucuuccagugcgucaacggcaaguacaucucccagaugaaggccugcgacggcaucaacgacugcggcgaccaguccgacgagcucugcugcaaggccugccagggcaagggcuuccacugcaaguccggcgucugcauccccucccaguaccagugcaacggcgaggucgacugcaucaccggcgaggacgaggucggcugcgccggcuucgccuccgucgcccaggaggagaccgagauccucaccgccgacauggacgccgagcgccgccgcaucaagucccuccuccccaagcucuccugcggcgucaagaaccgcaugcacauccgccgcaagcgcaucgucggcggcaagcgcgcccagcucggcgaccuccccuggcaggucgccaucaaggacgccuccggcaucaccugcggcggcaucuacaucggcggcugcuggauccucaccgccgcccacugccuccgcgccuccaagacccaccgcuaccagaucuggaccaccgucgucgacuggauccaccccgaccucaagcgcaucgucaucgaguacgucgaccgcaucaucuuccacgagaacuacaacgccggcaccuaccagaacgacaucgcccucaucgagaugaagaaggacggcaacaagaaggacugcgagcucccccgcuccauccccgccugcguccccuggucccccuaccucuuccagcccaacgacaccugcaucgucuccggcuggggccgcgagaaggacaacgagcgcgucuucucccuccaguggggcgaggucaagcucaucuccaacugcuccaaguucuacggcaaccgcuucuacgagaaggagauggagugcgccggcaccuacgacggcuccaucgacgccugcaagggcgacuccggcggcccccucgucugcauggacgccaacaacgucaccuacgucuggggcgucgucuccuggggcgagaacugcggcaagcccgaguuccccggcgucuacaccaaggucgccaacuacuucgacuggaucuccuaccacgucggccgccccuucaucucccaguacaacgucuga

SEQ ID NO: 41256 - RNA, 501 nt, Artificial Sequence
  derived and/or modified sequence opt2 from CFL1__Homo_sapiens__NP_005498
auggccuccggcgucgccgucuccgacggcgucaucaaggucuucaacgacaugaagguccgcaaguccuccacccccgaggaggucaagaagcgcaagaaggccguccucuucugccucuccgaggacaagaagaacaucauccucgaggagggcaaggagauccucgucggcgacgucggccagaccgucgacgaccccuacgccaccuucgucaagaugcuccccgacaaggacugccgcuacgcccucuacgacgccaccuacgagaccaaggaguccaagaaggaggaccucgucuucaucuucugggcccccgaguccgccccccucaaguccaagaugaucuacgccuccuccaaggacgccaucaagaagaagcucaccggcaucaagcacgagcuccaggccaacugcuacgaggaggucaaggaccgcugcacccucgccgagaagcucggcggcuccgccgucaucucccucgagggcaagccccucuga

SEQ ID NO: 41257 - RNA, 501 nt, Artificial Sequence
  derived and/or modified sequence opt2 from CFL2__Homo_sapiens__NP_068733
auggccuccggcgucaccgucaacgacgaggucaucaaggucuucaacgacaugaagguccgcaaguccuccacccaggaggagaucaagaagcgcaagaaggccguccucuucugccucuccgacgacaagcgccagaucaucgucgaggaggccaagcagauccucgucggcgacaucggcgacaccgucgaggaccccuacaccuccuucgucaagcuccucccccucaacgacugccgcuacgcccucuacgacgccaccuacgagaccaaggaguccaagaaggaggaccucgucuucaucuucugggcccccgaguccgccccccucaaguccaagaugaucuacgccuccuccaaggacgccaucaagaagaaguucaccggcaucaagcacgaguggcaggucaacggccucgacgacaucaaggaccgcuccacccucggcgagaagcucggcggcaacgucgucgucucccucgagggcaagccccucuga

SEQ ID NO: 41258 - RNA, 666 nt, Artificial Sequence
  derived and/or modified sequence opt2 from CFLAR__Homo_sapiens__NP_001120656
auguccgccgaggucauccaccaggucgaggaggcccucgacaccgacgagaaggagaugcuccucuuccucugccgcgacgucgccaucgacgucgucccccccaacguccgcgaccuccucgacauccuccgcgagcgcggcaagcucuccgucggcgaccucgccgagcuccucuaccgcguccgccgcuucgaccuccucaagcgcauccucaagauggaccgcaaggccgucgagacccaccuccuccgcaacccccaccucgucuccgacuaccgcguccucauggccgagaucggcgaggaccucgacaaguccgacgucuccucccucaucuuccucaugaaggacuacaugggccgcggcaagaucuccaaggagaaguccuuccucgaccucgucgucgagcucgagaagcucaaccucgucgcccccgaccagcucgaccuccucgagaagugccucaagaacauccaccgcaucgaccucaagaccaagauccagaaguacaagcaguccguccagggcgccggcaccuccuaccgcaacguccuccaggccgccauccagaagucccucaaggaccccuccaacaacuuccgcaugaucacccccuacgcccacugccccgaccucaagauccucggcaacugcuccauguga

SEQ ID NO: 41259 - RNA, 1410 nt, Artificial Sequence
  derived and/or modified sequence opt2 from CFP__Homo_sapiens__NP_002612
augaucaccgagggcgcccaggccccccgccuccuccuccccccccuccuccuccuccucacccuccccgccaccggcuccgaccccguccucugcuucacccaguacgaggaguccuccggcaagugcaagggccuccucggcggcggcgucuccgucgaggacugcugccucaacaccgccuucgccuaccagaagcgcuccggcggccucugccagcccugccgcuccccccgcuggucccucugguccaccugggcccccugcuccgucaccugcuccgagggcucccagcuccgcuaccgccgcugcgucggcuggaacggccagugcuccggcaaggucgcccccggcacccucgaguggcagcuccaggccugcgaggaccagcagugcugccccgagaugggcggcugguccggcuggggccccugggagcccugcuccgucaccugcuccaagggcacccgcacccgccgccgcgccugcaaccaccccgcccccaagugcggcggccacugccccggccaggcccaggaguccgaggccugcgacacccagcaggucugccccacccacggcgccugggccaccuggggccccuggacccccugcuccgccuccugccacggcggcccccacgagcccaaggagacccgcucccgcaagugcuccgcccccgagcccucccagaagccccccggcaagcccugccccggccucgccuacgagcagcgccgcugcaccggccucccccccugccccgucgccggcggcuggggccccuggggccccgucucccccugccccgucaccugcggccucggccagaccauggagcagcgcaccugcaaccaccccgucccccagcacggcggccccuucugcgccggcgacgccacccgcacccacaucugcaacaccgccguccccugccccgucgacggcgagugggacuccuggggcgaguggucccccugcauccgccgcaacaugaaguccaucuccugccaggagauccccggccagcagucccgcggccgcaccugccgcggccgcaaguucgacggccaccgcugcgccggccagcagcaggacauccgccacugcuacuccauccagcacugcccccucaagggcuccugguccgagugguccaccuggggccucugcaugccccccugcggccccaaccccacccgcgcccgccagcgccucugcaccccccuccuccccaaguacccccccaccgucuccauggucgagggccagggcgagaagaacgucaccuucuggggccgcccccucccccgcugcgaggagcuccagggccagaagcucgucgucgaggagaagcgccccugccuccacguccccgccugcaaggaccccgaggaggaggagcucuga

SEQ ID NO: 41260 - RNA, 4443 nt, Artificial Sequence
  derived and/or modified sequence opt2 from CFTR__Homo_sapiens__NP_000483
augcagcgcuccccccucgagaaggccuccgucgucuccaagcucuucuucuccuggacccgccccauccuccgcaagggcuaccgccagcgccucgagcucuccgacaucuaccagauccccuccgucgacuccgccgacaaccucuccgagaagcucgagcgcgagugggaccgcgagcucgccuccaagaagaaccccaagcucaucaacgcccuccgccgcugcuucuucuggcgcuucauguucuacggcaucuuccucuaccucggcgaggucaccaaggccguccagccccuccuccucggccgcaucaucgccuccuacgaccccgacaacaaggaggagcgcuccaucgccaucuaccucggcaucggccucugccuccucuucaucguccgcacccuccuccuccaccccgccaucuucggccuccaccacaucggcaugcagaugcgcaucgccauguucucccucaucuacaagaagacccucaagcucuccucccgcguccucgacaagaucuccaucggccagcucgucucccuccucuccaacaaccucaacaaguucgacgagggccucgcccucgcccacuucgucuggaucgccccccuccaggucgcccuccucaugggccucaucugggagcuccuccaggccuccgccuucugcggccucggcuuccucaucguccucgcccucuuccaggccggccucggccgcaugaugaugaaguaccgcgaccagcgcgccggcaagaucuccgagcgccucgucaucaccuccgagaugaucgagaacauccaguccgucaaggccuacugcugggaggaggccauggagaagaugaucgagaaccuccgccagaccgagcucaagcucacccgcaaggccgccuacguccgcuacuucaacuccuccgccuucuucuucuccggcuucuucgucgucuuccucuccguccuccccuacgcccucaucaagggcaucauccuccgcaagaucuucaccaccaucuccuucugcaucguccuccgcauggccgucacccgccaguuccccugggccguccagaccugguacgacucccucggcgccaucaacaagauccaggacuuccuccagaagcaggaguacaagacccucgaguacaaccucaccaccaccgaggucgucauggagaacgucaccgccuucugggaggagggcuucggcgagcucuucgagaaggccaagcagaacaacaacaaccgcaagaccuccaacggcgacgacucccucuucuucuccaacuucucccuccucggcacccccguccucaaggacaucaacuucaagaucgagcgcggccagcuccucgccgucgccggcuccaccggcgccggcaagaccucccuccucauggucaucaugggcgagcucgagcccuccgagggcaagaucaagcacuccggccgcaucuccuucugcucccaguucuccuggaucaugcccggcaccaucaaggagaacaucaucuucggcgucuccuacgacgaguaccgcuaccgcuccgucaucaaggccugccagcucgaggaggacaucuccaaguucgccgagaaggacaacaucguccucggcgagggcggcaucacccucuccggcggccagcgcgcccgcaucucccucgcccgcgccgucuacaaggacgccgaccucuaccuccucgacucccccuucggcuaccucgacguccucaccgagaaggagaucuucgaguccugcgucugcaagcucauggccaacaagacccgcauccucgucaccuccaagauggagcaccucaagaaggccgacaagauccucauccuccacgagggcuccuccuacuucuacggcaccuucuccgagcuccagaaccuccagcccgacuucuccuccaagcucaugggcugcgacuccuucgaccaguucuccgccgagcgccgcaacuccauccucaccgagacccuccaccgcuucucccucgagggcgacgcccccgucuccuggaccgagaccaagaagcaguccuucaagcagaccggcgaguucggcgagaagcgcaagaacuccauccucaaccccaucaacuccauccgcaaguucuccaucguccagaagaccccccuccagaugaacggcaucgaggaggacuccgacgagccccucgagcgccgccucucccucguccccgacuccgagcagggcgaggccauccucccccgcaucuccgucaucuccaccggccccacccuccaggcccgccgccgccaguccguccucaaccucaugacccacuccgucaaccagggccagaacauccaccgcaagaccaccgccuccacccgcaaggucucccucgccccccaggccaaccucaccgagcucgacaucuacucccgccgccucucccaggagaccggccucgagaucuccgaggagaucaacgaggaggaccucaaggagugcuucuucgacgacauggaguccauccccgccgucaccaccuggaacaccuaccuccgcuacaucaccguccacaagucccucaucuucguccucaucuggugccucgucaucuuccucgccgaggucgccgccucccucgucguccucuggcuccucggcaacaccccccuccaggacaagggcaacuccacccacucccgcaacaacuccuacgccgucaucaucaccuccaccuccuccuacuacgucuucuacaucuacgucggcgucgccgacacccuccucgccaugggcuucuuccgcggccucccccucguccacacccucaucaccgucuccaagauccuccaccacaagaugcuccacuccguccuccaggcccccauguccacccucaacacccucaaggccggcggcauccucaaccgcuucuccaaggacaucgccauccucgacgaccuccucccccucaccaucuucgacuucauccagcuccuccucaucgucaucggcgccaucgccgucgucgccguccuccagcccuacaucuucgucgccaccguccccgucaucgucgccuucaucaugcuccgcgccuacuuccuccagaccucccagcagcucaagcagcucgaguccgagggccgcucccccaucuucacccaccucgucaccucccucaagggccucuggacccuccgcgccuucggccgccagcccuacuucgagacccucuuccacaaggcccucaaccuccacaccgccaacugguuccucuaccucuccacccuccgcugguuccagaugcgcaucgagaugaucuucgucaucuucuucaucgccgucaccuucaucuccauccucaccaccggcgagggcgagggccgcgucggcaucauccucacccucgccaugaacaucauguccacccuccagugggccgucaacuccuccaucgacgucgacucccucaugcgcuccgucucccgcgucuucaaguucaucgacaugcccaccgagggcaagcccaccaaguccaccaagcccuacaagaacggccagcucuccaaggucaugaucaucgagaacucccacgucaagaaggacgacaucuggcccuccggcggccagaugaccgucaaggaccucaccgccaaguacaccgagggcggcaacgccauccucgagaacaucuccuucuccaucucccccggccagcgcgucggccuccucggccgcaccggcuccggcaaguccacccuccucuccgccuuccuccgccuccucaacaccgagggcgagauccagaucgacggcgucuccugggacuccaucacccuccagcaguggcgcaaggccuucggcgucaucccccagaaggucuucaucuucuccggcaccuuccgcaagaaccucgaccccuacgagcagugguccgaccaggagaucuggaaggucgccgacgaggucggccuccgcuccgucaucgagcaguuccccggcaagcucgacuucguccucgucgacggcggcugcguccucucccacggccacaagcagcucaugugccucgcccgcuccguccucuccaaggccaagauccuccuccucgacgagcccuccgcccaccucgaccccgucaccuaccagaucauccgccgcacccucaagcaggccuucgccgacugcaccgucauccucugcgagcaccgcaucgaggccaugcucgagugccagcaguuccucgucaucgaggagaacaagguccgccaguacgacuccauccagaagcuccucaacgagcgcucccucuuccgccaggccaucucccccuccgaccgcgucaagcucuucccccaccgcaacuccuccaagugcaaguccaagccccagaucgccgcccucaaggaggagaccgaggaggagguccaggacacccgccucuga

SEQ ID NO: 41261 - RNA, 351 nt, Artificial Sequence
  derived and/or modified sequence opt2 from CGA__Homo_sapiens__NP_000726
auggacuacuaccgcaaguacgccgccaucuuccucgucacccucuccgucuuccuccacguccuccacuccgcccccgacguccaggacugccccgagugcacccuccaggagaaccccuucuucucccagcccggcgcccccauccuccagugcaugggcugcugcuucucccgcgccuaccccaccccccuccgcuccaagaagaccaugcucguccagaagaacgucaccuccgaguccaccugcugcgucgccaaguccuacaaccgcgucaccgucaugggcggcuucaaggucgagaaccacaccgccugccacugcuccaccugcuacuaccacaaguccuga

SEQ ID NO: 41262 - RNA, 468 nt, Artificial Sequence
  derived and/or modified sequence opt2 from CGB1__Homo_sapiens__NP_203695
auguccaagcgccuccuccuccuccuccuccucuccaugggcggcaccugggccuccaaggagccccuccgcccccgcugccgccccaucaacgccacccucgccgucgagaaggagggcugccccgucugcaucaccgucaacaccaccaucugcgccggcuacugccccaccaugacccgcguccuccagggcguccuccccgcccucccccaggucgucugcaacuaccgcgacguccgcuucgaguccauccgccuccccggcugcccccgcggcgucaaccccgucgucuccuacgccgucgcccucuccugccagugcgcccucugccgccgcuccaccaccgacugcggcggccccaaggaccacccccucaccugcgacgacccccgcuuccaggacuccuccuccuccaaggcccccccccccucccuccccucccccucccgccuccccggccccuga

SEQ ID NO: 41263 - RNA, 492 nt, Artificial Sequence
  derived and/or modified sequence opt2 from CGB2__Homo_sapiens__NP_203696
auguccaagggccuccuccuccuccuccuccucuccaugggcggcaccugggccuccaaggagccccuccgcccccgcugccgccccaucaacgccacccucgccgucgagaaggagggcugccccgucugcaucaccgucaacaccaccaucugcgccggcuacugccccaccaugacccgcguccuccagggcguccuccccgcccucccccaggucgucugcaacuaccgcgacguccgcuucgaguccauccgccuccccggcugcccccgcggcgucaaccccgucgucuccuacgccgucgcccucuccugccagugcgcccucugccgccgcuccaccaccgacugcggcggccccaaggaccacccccucaccugcgacgacccccgcuuccaggccuccuccuccuccaaggcccccccccccucccuccccucccccucccgccuccccggccccuccgacacccccauccucccccaguga

SEQ ID NO: 41264 - RNA, 498 nt, Artificial Sequence
  derived and/or modified sequence opt2 from CGB5__Homo_sapiens__NP_149032
auggagauguuccagggccuccuccuccuccuccuccucuccaugggcggcaccugggccuccaaggagccccuccgcccccgcugccgccccaucaacgccacccucgccgucgagaaggagggcugccccgucugcaucaccgucaacaccaccaucugcgccggcuacugccccaccaugacccgcguccuccagggcguccuccccgcccucccccaggucgucugcaacuaccgcgacguccgcuucgaguccauccgccuccccggcugcccccgcggcgucaaccccgucgucuccuacgccgucgcccucuccugccagugcgcccucugccgccgcuccaccaccgacugcggcggccccaaggaccacccccucaccugcgacgacccccgcuuccaggacuccuccuccuccaaggcccccccccccucccuccccucccccucccgccuccccggccccuccgacacccccauccucccccaguga

SEQ ID NO: 41265 - RNA, 498 nt, Artificial Sequence
  derived and/or modified sequence opt2 from CGB7__Homo_sapiens__XP_011525821
auggagauguuccagggccuccuccuccuccuccuccucuccaugggcggcaccugggccucccgcgagaugcuccgcccccgcugccgccccaucaacgccacccucgccgucgagaaggagggcugccccgucugcaucaccgucaacaccaccaucugcgccggcuacugccccaccaugacccgcguccuccagggcguccuccccgcccucccccaggucgucugcaacuaccgcgacguccgcuucgaguccauccgccuccccggcugcccccgcggcgucaaccccgucgucuccuacgccgucgcccucuccugccagugcgcccucugccgccgcuccaccaccgacugcggcggccccaaggaccacccccucaccugcgacgacccccgcuuccaggccuccuccuccuccaaggcccccccccccucccuccccucccccucccgccuccccggccccuccgacacccccauccucccccaguga

SEQ ID NO: 41266 - RNA, 3612 nt, Artificial Sequence
  derived and/or modified sequence opt2 from CGN__Homo_sapiens__XP_005245422
auggagcaggcccccaacauggccgagccccgcggccccgucgaccacggcguccagauccgcuucaucaccgagcccgucuccggcgccgagaugggcacccuccgccgcggcggccgccgccccgccaaggacgcccgcgccuccaccuacggcgucgccguccgcguccagggcaucgccggccagcccuucgucguccucaacuccggcgagaagggcggcgacuccuucggcguccagaucaagggcgccaacgaccagggcgccuccggcgcccucuccuccgaccucgagcuccccgagaaccccuacucccaggucaagggcuuccccgcccccucccaguccuccaccuccgacgaggagcccggcgccuacuggaacggcaagcuccuccgcucccacucccaggccucccucgccggccccggccccgucgaccccuccaaccgcuccaacuccaugcucgagcucgcccccaaggucgccucccccggcuccaccaucgacaccgccccccucuccuccgucgacucccucaucaacaaguucgacucccagcucggcggccaggcccgcggccgcaccggccgccgcacccgcaugcucccccccgagcagcgcaagcgcuccaagucccucgacucccgccucccccgcgacaccuucgaggagcgcgagcgccaguccaccaaccacuggaccuccuccaccaaguacgacaaccacgucggcaccuccaagcagcccgcccagucccagaaccucuccccccucuccggcuucucccgcucccgccagacccaggacuggguccuccaguccuucgaggagccccgccgcuccgcccaggaccccaccaugcuccaguucaaguccacccccgaccuccuccgcgaccagcaggaggccgccccccccggcuccgucgaccacaugaaggccaccaucuacggcauccuccgcgagggcuccuccgaguccgagaccuccguccgccgcaaggucucccucguccucgagaagaugcagccccucgucauggucuccuccggcuccaccaaggccgucgccggccagggcgagcucacccgcaaggucgaggagcuccagcgcaagcucgacgaggaggucaagaagcgccagaagcucgagcccucccaggucggccucgagcgccagcucgaggagaagaccgaggagugcucccgccuccaggagcuccucgagcgccgcaagggcgaggcccagcaguccaacaaggagcuccagaacaugaagcgccuccucgaccagggcgaggaccuccgccacggccucgagacccaggucauggagcuccagaacaagcucaagcacguccagggccccgagcccgccaaggagguccuccucaaggaccuccucgagacccgcgagcuccucgaggagguccucgagggcaagcagcgcgucgaggagcagcuccgccuccgcgagcgcgagcucaccgcccucaagggcgcccucaaggaggaggucgccucccgcgaccaggaggucgagcacguccgccagcaguaccagcgcgacaccgagcagcuccgccgcuccaugcaggacgccacccaggaccacgccguccucgaggccgagcgccagaagauguccgcccucguccgcggccuccagcgcgagcucgaggagaccuccgaggagaccggccacuggcaguccauguuccagaagaacaaggaggaccuccgcgccaccaagcaggagcuccuccagcuccgcauggagaaggaggagauggaggaggagcucggcgagaagaucgagguccuccagcgcgagcucgagcaggcccgcgccuccgccggcgacacccgccaggucgagguccucaagaaggagcuccuccgcacccaggaggagcucaaggagcuccaggccgagcgccagucccaggaggucgccggccgccaccgcgaccgcgagcucgagaagcagcucgccguccuccgcgucgaggccgaccgcggccgcgagcucgaggagcagaaccuccagcuccagaagacccuccagcagcuccgccaggacugcgaggaggccuccaaggccaagauggucgccgaggccgaggccaccguccucggccagcgccgcgccgccgucgagaccacccuccgcgagacccaggaggagaacgacgaguuccgccgccgcauccucggccucgagcagcagcucaaggagacccgcggccucgucgacggcggcgaggccgucgaggcccgccuccgcgacaagcuccagcgccucgaggccgagaagcagcagcucgaggaggcccucaacgccucccaggaggaggagggcucccucgccgccgccaagcgcgcccucgaggcccgccucgaggaggcccagcgcggccucgcccgccucggccaggagcagcagacccucaaccgcgcccucgaggaggagggcaagcagcgcgagguccuccgccgcggcaaggccgagcucgaggagcagaagcgccuccucgaccgcaccgucgaccgccucaacaaggagcucgagaagaucggcgaggacuccaagcaggcccuccagcagcuccaggcccagcucgaggacuacaaggagaaggcccgccgcgaggucgccgacgcccagcgccaggccaaggacugggccuccgaggccgagaagaccuccggcggccucucccgccuccaggacgagauccagcgccuccgccaggcccuccaggccucccaggccgagcgcgacaccgcccgccucgacaaggagcuccucgcccagcgccuccagggccucgagcaggaggccgagaacaagaagcgcucccaggacgaccgcgcccgccagcucaagggccucgaggagaaggucucccgccucgagaccgagcucgacgaggagaagaacaccgucgagcuccucaccgaccgcgucaaccgcggccgcgaccaggucgaccagcuccgcaccgagcucaugcaggagcgcuccgcccgccaggaccucgagugcgacaagaucucccucgagcgccagaacaaggaccucaagacccgccucgccuccuccgagggcuuccagaagcccuccgccucccucucccagcucgagucccagaaccagcuccuccaggagcgccuccaggccgaggagcgcgagaagaccguccuccaguccaccaaccgcaagcucgagcgcaaggucaaggagcucuccauccagaucgaggacgagcgccagcacgucaacgaccagaaggaccagcucucccuccgcgucaaggcccucaagcgccaggucgacgaggccgaggaggagaucgagcgccucgacggccuccgcaagaaggcccagcgcgaggucgaggagcagcacgaggucaacgagcagcuccaggcccgcaucaagucccucgagaaggacuccuggcgcaaggccucccgcuccgccgccgaguccgcccucaagaacgagggccucuccuccgacgaggaguucgacuccgucuacgaccccuccuccaucgccucccuccucaccgaguccaaccuccagaccuccuccugcuga

SEQ ID NO: 41267 - RNA, 3909 nt, Artificial Sequence
  derived and/or modified sequence opt2 from CGNL1__Homo_sapiens__NP_116255
auggagcucuacuucggcgaguaccagcacguccagcaggaguacggcguccaccuccgccucgccuccgacgacacccagaagucccgcuccucccagaacuccaaggccggcuccuacggcgucuccauccgcguccagggcaucgacggccaccccuacaucguccucaacaacaccgagcgcugccucgccggcaccuccuucuccgagaacggcccccccuuccccccccccgucaucaacaaccucccccuccacuccuccaacggcuccguccccaaggagaacuccgaggagcuccagcuccccgagaaccccuacgcccagcccucccccauccgcaaccucaagcagccccuccuccacgagggcaagaacggcguccucgaccgcaaggacggcuccgucaagcccucccaccuccucaacuuccagcgccaccccgagcuccuccagcccuacgaccccgagaagaacgagcucaaccuccagaaccaccagcccuccgaguccaacuggcucaagacccucaccgaggagggcaucaacaacaagaagcccuggaccugcuuccccaagcccuccaacucccagcccaccucccccucccucgaggaccccgccaaguccggcgucaccgccauccgccucugcuccuccgucgucaucgaggaccccaagaagcagaccuccgucugcgucaacguccaguccugcaccaaggagcgcgucggcgaggaggcccucuucaccuccggccgcccccucaccgcccacuccccccacgcccaccccgagaccaagaagacccgccccgacguccuccccuuccgccgccaggacuccgccggccccguccucgacggcgcccgcucccgccgcuccuccuccuccuccaccacccccaccuccgccaacucccucuaccgcuuccuccucgacgaccaggagugcgccauccacgccgacaacgucaaccgccacgagaaccgccgcuacauccccuuccuccccggcaccggccgcgacaucgacaccggcuccauccccggcgucgaccagcucaucgagaaguucgaccagaagcccggccuccagcgccgcggccgcuccggcaagcgcaaccgcaucaacaccgacgaccgcaagcgcucccgcuccgucgacuccgccuuccccuucggccuccagggcaacuccgaguaccucaucgaguucucccgcaaccucggcaaguccuccgagcaccuccuccgccccucccaggucugcccccagcgcccccucucccaggagcgccgcggcaagcaguccgucggccgcaccuucgccaagcuccagggcgccgcccacggcgccuccugcgcccacucccgccccccccagcccaacaucgacggcaagguccucgagaccgagggcucccaggaguccaccgucauccgcgcccccucccucggcgcccaguccaagaaggaggaggaggucaagaccgccaccgccacccucaugcuccagaaccgcgccaccgccaccucccccgacuccggcgccaagaagaucuccgucaagaccuuccccuccgccuccaacacccaggccacccccgaccuccucaagggccagcaggagcucacccagcagaccaacgaggagaccgccaagcagauccucuacaacuaccucaaggagggcuccaccgacaacgacgacgccaccaagcgcaaggucaaccucgucuucgagaagauccagacccucaagucccgcgccgccggcuccgcccagggcaacaaccaggccugcaacuccaccuccgaggucaaggaccuccucgagcagaaguccaagcucaccaucgaggucgccgagcuccagcgccagcuccagcucgaggucaagaaccagcagaacaucaaggaggagcgcgagcgcaugcgcgccaaccucgaggagcuccgcucccagcacaacgagaaggucgaggagaacuccacccuccagcagcgccucgaggaguccgagggcgagcuccgcaagaaccucgaggagcucuuccaggucaagauggagcgcgagcagcaccagaccgagauccgcgaccuccaggaccagcucuccgagaugcacgacgagcucgacuccgccaagcgcuccgaggaccgcgagaagggcgcccucaucgaggagcuccuccaggccaagcaggaccuccaggaccuccucaucgccaaggaggagcaggaggaccuccuccgcaagcgcgagcgcgagcucaccgcccucaagggcgcccucaaggaggaggucuccucccacgaccaggagauggacaagcucaaggagcaguacgacgccgagcuccaggcccuccgcgaguccgucgaggaggccaccaagaacgucgagguccucgccucccgcuccaacaccuccgagcaggaccaggccggcaccgagaugcgcgucaagcuccuccaggaggagaacgagaagcuccagggccgcuccgaggagcucgagcgccgcgucgcccagcuccagcgccagaucgaggaccucaagggcgacgaggccaaggccaaggagacccucaagaaguacgagggcgagauccgccagcucgaggaggcccucguccacgcccgcaaggaggagaaggaggccgucuccgcccgccgcgcccucgagaacgagcucgaggccgcccagggcaaccucucccagaccacccaggagcagaagcagcucuccgagaagcucaaggaggaguccgagcagaaggagcagcuccgccgccucaagaacgagauggagaacgagcgcuggcaccucggcaagaccaucgagaagcuccagaaggagauggccgacaucgucgaggccucccgcaccuccacccucgagcuccagaaccagcucgacgaguacaaggagaagaaccgccgcgagcucgccgagaugcagcgccagcucaaggagaagacccucgaggccgagaagucccgccucaccgccaugaagaugcaggacgagaugcgccucauggaggaggagcuccgcgacuaccagcgcgcccaggacgaggcccucaccaagcgccagcuccucgagcagacccucaaggaccucgaguacgagcucgaggccaagucccaccucaaggacgaccgcucccgccucgucaagcagauggaggacaaggucucccagcucgagauggagcucgaggaggagcgcaacaacuccgaccuccucuccgagcgcaucucccgcucccgcgagcagauggagcagcuccgcaacgagcuccuccaggagcgcgccgcccgccaggaccucgagugcgacaagaucucccucgagcgccagaacaaggaccucaagucccgcaucauccaccucgagggcuccuaccgcuccuccaaggagggccucgucguccagauggaggcccgcaucgccgagcucgaggaccgccucgaguccgaggagcgcgaccgcgccaaccuccagcucuccaaccgccgccucgagcgcaaggucaaggagcucgucaugcaggucgacgacgagcaccucucccucaccgaccagaaggaccagcucucccuccgccucaaggccaugaagcgccaggucgaggaggccgaggaggagaucgaccgccucgaguccuccaagaagaagcuccagcgcgagcucgaggagcagauggacaugaacgagcaccuccagggccagcucaacuccaugaagaaggaccuccgccucaagaagcuccccuccaagguccucgacgacauggacgacgacgacgaccucuccaccgacggcggcucccucuacgaggcccccgucuccuacaccuucuccaaggacuccaccgucgccucccagaucuga

SEQ ID NO: 41268 - RNA, 999 nt, Artificial Sequence
  derived and/or modified sequence opt2 from CGRRF1__Homo_sapiens__NP_006559
auggccgccgucuuccucgucacccucuacgaguacuccccccucuucuacaucgccgucgucuucaccugcuucaucgucaccaccggccucguccucggcugguucggcugggacguccccgucauccuccgcaacuccgaggagacccaguucuccacccgcgucuucaagaagcagaugcgccaggucaagaaccccuucggccucgagaucaccaaccccuccuccgccuccaucaccaccggcaucacccucaccaccgacugccucgaggacucccuccucaccugcuacuggggcugcuccguccagaagcucuacgaggcccuccagaagcacgucuacugcuuccgcaucuccaccccccaggcccucgaggacgcccucuacuccgaguaccucuaccaggagcaguacuucaucaagaaggacuccaaggaggagaucuacugccagcucccccgcgacaccaagaucgaggacuucggcaccgucccccgcucccgcuacccccucgucgcccuccucacccucgccgacgaggacgaccgcgagaucuacgacaucaucuccauggucuccgucauccacauccccgaccgcaccuacaagcucuccugccgcauccucuaccaguaccuccuccucgcccagggccaguuccacgaccucaagcagcucuucauguccgccaacaacaacuucacccccuccaacaacuccuccuccgaggagaagaacaccgaccgcucccuccucgagaaggucggccucuccgaguccgaggucgagcccuccgaggagaacuccaaggacugcgucgucugccagaacggcaccgucaacuggguccuccuccccugccgccacaccugccucugcgacggcugcgucaaguacuuccagcagugccccaugugccgccaguucguccaggaguccuucgcccucugcucccagaaggagcaggacaaggacaagcccaagacccucuga

SEQ ID NO: 41269 - RNA, 819 nt, Artificial Sequence
  derived and/or modified sequence opt2 from CH25H__Homo_sapiens__NP_003947
auguccugccacaacugcuccgacccccagguccucugcuccuccggccagcucuuccuccagccccucugggaccaccuccgcuccugggaggcccuccuccagucccccuucuuccccgucaucuucuccaucaccaccuacgucggcuucugccuccccuucgucguccucgacauccucugcuccuggguccccgcccuccgccgcuacaagauccaccccgacuucucccccuccgcccagcagcuccuccccugccucggccagacccucuaccagcacgucauguucgucuuccccgucacccuccuccacugggcccgcucccccgcccuccucccccacgaggcccccgagcuccuccuccuccuccaccacauccucuucugccuccuccucuucgacauggaguucuucgucuggcaccuccuccaccacaagguccccuggcucuaccgcaccuuccacaagguccaccaccagaacuccuccuccuucgcccucgccacccaguacauguccgucugggagcucuucucccucggcuucuucgacaugaugaacgucacccuccucggcugccacccccucaccacccucaccuuccacgucgucaacaucuggcucuccgucgaggaccacuccggcuacaacuuccccugguccacccaccgccucguccccuucggcugguacggcggcgucguccaccacgaccuccaccacucccacuucaacugcaacuucgcccccuacuucacccacugggacaagauccucggcacccuccgcaccgccuccguccccgcccgcuga

SEQ ID NO: 41270 - RNA, 660 nt, Artificial Sequence
  derived and/or modified sequence opt2 from CHAC1__Homo_sapiens__NP_001136248
augggcggcgcccagcucgagcuccccuccggcgcccgccccggcgucugcguccgccgcuccuuccgcgcccacgccggcgaccagccccgccgcccccccggccccauccccguccccggcaccaugaagcaggaguccgccgcccccaacaccccccccaccucccagucccccacccccuccgcccaguucccccgcaacgacggcgacccccaggcccucuggaucuucggcuacggcucccucgucuggcgccccgacuucgccuacuccgacucccgcgucggcuucguccgcggcuacucccgccgcuucuggcagggcgacaccuuccaccgcggcuccgacaagaugcccggccgcgucgucacccuccucgaggaccacgagggcugcaccuggggcgucgccuaccagguccagggcgagcagaaccccggcuaccucggccccgcccccgaggaggccaucgccacccagauccucgccugccgcggcuucuccggccacaaccucgaguaccuccuccgccucgccgacuucaugcagcucugcggcccccaggcccaggacgagcaccucgccgccaucgucgacgccgucggcaccaugcuccccugcuucugccccaccgagcaggcccucgcccucgucuga

SEQ ID NO: 41271 - RNA, 1323 nt, Artificial Sequence
  derived and/or modified sequence opt2 from CHAD__Homo_sapiens__XP_011522516
augcacggcucccgccucggcgagcgcccccgcccccucccccgcggcggccgcggccgcaucuccggccgcgagcgcgucaagcccuccggccucgacgccccccgccgcuccuggcucggcugccgccuccgcuccggcccccccuacaaggagggcggccgccccgagcgccucggccucgccgccgcccgcgccccccccccccuccucccccccgcccccgcccccggcguccccgccaugguccgccccaugcuccuccucucccucggccuccucgccggccuccuccccgcccucgccgccugcccccagaacugccacugccacuccgaccuccagcacgucaucugcgacaaggucggccuccagaagauccccaaggucuccgagaagaccaagcuccucaaccuccagcgcaacaacuuccccguccucgccgccaacuccuuccgcgccaugcccaaccucgucucccuccaccuccagcacugccagauccgcgaggucgccgccggcgccuuccgcggccucaagcagcucaucuaccucuaccucucccacaacgacauccgcguccuccgcgccggcgccuucgacgaccucaccgagcucaccuaccucuaccucgaccacaacaaggucaccgagcucccccgcggccuccucuccccccucgucaaccucuucauccuccagcucaacaacaacaagauccgcgagcuccgcgccggcgccuuccagggcgccaaggaccuccgcuggcucuaccucuccgagaacgcccucuccucccuccagcccggcgcccucgacgacgucgagaaccucgccaaguuccacgucgaccgcaaccagcucuccuccuaccccuccgccgcccucuccaagcuccgcgucgucgaggagcucaagcucucccacaacccccucaaguccauccccgacaacgccuuccaguccuucggccgcuaccucgagacccucuggcucgacaacaccaaccucgagaaguucuccgacggcgccuuccucggcgucaccacccucaagcacguccaccucgagaacaaccgccucaaccagcuccccuccaacuuccccuucgacucccucgagacccucgcccucaccaacaaccccuggaagugcaccugccagcuccgcggccuccgccgcuggcucgaggccaaggccucccgccccgacgccaccugcgccucccccgccaaguucaagggccagcacauccgcgacaccgacgccuuccgcuccugcaaguuccccaccaagcgcuccaagaaggccggccgccacuga

SEQ ID NO: 41272 - RNA, 2871 nt, Artificial Sequence
  derived and/or modified sequence opt2 from CHAF1A__Homo_sapiens__NP_005474
augcucgaggagcucgagugcggcgcccccggcgcccgcggcgccgccaccgccauggacugcaaggaccgccccgccuuccccgucaagaagcucauccaggcccgccuccccuucaagcgccucaaccucguccccaagggcaaggccgacgacauguccgacgaccagggcaccuccguccaguccaagucccccgaccucgaggccucccucgacacccucgagaacaacugccacgucggcuccgacaucgacuuccgccccaagcucgucaacggcaagggcccccucgacaacuuccuccgcaaccgcaucgagaccuccaucggccaguccaccgucaucaucgaccucaccgaggacuccaacgagcagcccgacucccucgucgaccacaacaagcucaacuccgaggccucccccucccgcgaggccaucaacggccagcgcgaggacaccggcgaccagcagggccuccucaaggccauccagaacgacaagcucgccuuccccggcgagacccucuccgacauccccugcaagaccgaggaggagggcgucggcugcggcggcgccggccgccgcggcgacucccaggagugcuccccccgcuccugccccgagcucaccuccggcccccgcaugugcccccgcaaggagcaggacuccugguccgaggccggcggcauccucuucaagggcaagguccccauggucguccuccaggacauccucgccguccgccccccccagaucaagucccuccccgccaccccccagggcaagaacaugacccccgaguccgagguccucgaguccuuccccgaggaggacuccguccucucccacuccucccucuccucccccuccuccaccuccucccccgagggcccccccgccccccccaagcagcacuccuccaccucccccuuccccaccuccaccccccuccgccgcaucaccaagaaguucgucaagggcuccaccgagaagaacaagcuccgccuccagcgcgaccaggagcgccucggcaagcagcucaagcuccgcgccgagcgcgaggagaaggagaagcucaaggaggaggccaagcgcgccaaggaggaggccaagaagaagaaggaggaggagaaggagcucaaggagaaggagcgccgcgagaagcgcgagaaggacgagaaggagaaggccgagaagcagcgccucaaggaggagcgccgcaaggagcgccaggaggcccucgaggccaagcucgaggagaagcgcaagaaggaggaggagaagcgccuccgcgaggaggagaagcgcaucaaggccgagaaggccgagaucacccgcuucuuccagaagcccaagaccccccaggcccccaagacccucgccggcuccugcggcaaguucgcccccuucgagaucaaggagcacaugguccucgccccccgccgccgcaccgccuuccaccccgaccucugcucccagcucgaccagcuccuccagcagcaguccggcgaguucuccuuccucaaggaccucaagggccgccagccccuccgcuccggccccacccacgucuccacccgcaacgccgacaucuucaacuccgacgucgucaucgucgagcgcggcaagggcgacggcguccccgagcgccgcaaguucggccgcaugaagcuccuccaguucugcgagaaccaccgccccgccuacuggggcaccuggaacaagaagaccgcccucauccgcgcccgcgaccccugggcccaggacaccaagcuccucgacuacgaggucgacuccgacgaggagugggaggaggaggagcccggcgagucccucucccacuccgagggcgacgacgacgacgacaugggcgaggacgaggacgaggacgacggcuucuucgucccccacggcuaccucuccgaggacgagggcgucaccgaggagugcgccgaccccgagaaccacaagguccgccagaagcucaaggccaaggagugggacgaguuccucgccaagggcaagcgcuuccgcguccuccagcccgucaagaucggcugcgucugggccgccgaccgcgacugcgccggcgacgaccucaagguccuccagcaguucgccgccugcuuccucgagacccuccccgcccaggaggagcagacccccaaggccuccaagcgcgagcgccgcgacgagcagauccucgcccagcuccucccccuccuccacggcaacgucaacggcuccaaggucaucauccgcgaguuccaggagcacugccgccgcggccuccucuccaaccacaccggcuccccccgcucccccuccaccaccuaccuccacacccccacccccuccgaggacgccgccauccccuccaagucccgccucaagcgccucaucuccgagaacuccgucuacgagaagcgccccgacuuccgcaugugcugguacguccacccccagguccuccaguccuuccagcaggagcaccuccccguccccugccagugguccuacgucaccuccguccccuccgcccccaaggaggacuccggcuccguccccuccaccggccccucccagggcacccccaucucccucaagcgcaaguccgccggcuccaugugcaucacccaguucaugaagaagcgccgccacgacggccagaucggcgccgaggacauggacggcuuccaggccgacaccgaggaggaggaggaggaggagggcgacugcaugaucgucgacguccccgacgccgccgagguccaggcccccugcggcgccgccuccggcgccggcggcggcgucggcgucgacaccggcaaggccacccucaccgccuccccccucggcgccuccuga

SEQ ID NO: 41273 - RNA, 1680 nt, Artificial Sequence
  derived and/or modified sequence opt2 from CHAF1B__Homo_sapiens__NP_005432
augaaggucaucaccugcgagaucgccuggcacaacaaggagcccgucuacucccucgacuuccagcacggcaccgccggccgcauccaccgccucgccuccgccggcgucgacaccaacguccgcaucuggaaggucgagaagggccccgacggcaaggccaucgucgaguuccucuccaaccucgcccgccacaccaaggccgucaacgucguccgcuucucccccaccggcgagauccucgccuccggcggcgacgacgccgucauccuccucuggaaggucaacgacaacaaggagcccgagcagaucgccuuccaggacgaggacgaggcccagcucaacaaggagaacuggaccgucgucaagacccuccgcggccaccucgaggacgucuacgacaucugcugggccaccgacggcaaccucauggccuccgccuccgucgacaacaccgccaucaucugggacgucuccaagggccagaagaucuccaucuucaacgagcacaaguccuacguccagggcgucaccugggacccccucggccaguacgucgccacccucuccugcgaccgcguccuccgcgucuacuccauccagaagaagcgcgucgccuucaacgucuccaagaugcucuccggcaucggcgccgagggcgaggcccgcuccuaccgcauguuccacgacgacuccaugaaguccuucuuccgccgccucuccuucacccccgacggcucccuccuccucacccccgccggcugcgucgaguccggcgagaacgucaugaacaccaccuacgucuucucccgcaagaaccucaagcgccccaucgcccaccuccccugccccggcaaggccacccucgccguccgcugcugccccgucuacuucgagcuccgccccgucgucgagaccggcgucgagcucaugucccuccccuaccgccucgucuucgccgucgccuccgaggacuccguccuccucuacgacacccagcaguccuuccccuucggcuacgucuccaacauccacuaccacacccucuccgacaucuccugguccuccgacggcgccuuccucgccaucuccuccaccgacggcuacugcuccuucgucaccuucgagaaggacgagcucggcaucccccucaaggagaagcccguccucaacaugcgcacccccgacaccgccaagaagaccaagucccagacccaccgcggcuccucccccggcccccgccccgucgagggcacccccgccucccgcacccaggaccccuccucccccggcaccacccccccccaggcccgccaggcccccgcccccaccgucauccgcgacccccccuccaucacccccgccgucaaguccccccuccccggccccuccgaggagaagacccuccagcccuccucccagaacaccaaggcccaccccucccgccgcgucacccucaacacccuccaggccugguccaagaccaccccccgccgcaucaaccucaccccccucaagaccgacaccccccccuccuccguccccaccuccgucaucuccacccccuccaccgaggagauccaguccgagacccccggcgacgcccagggcuccccccccgagcucaagcgcccccgccucgacgagaacaagggcggcaccgagucccucgaccccuga

SEQ ID NO: 41274 - RNA, 2439 nt, Artificial Sequence
  derived and/or modified sequence opt2 from CHAMP1__Homo_sapiens__NP_001157617
auggaggccuuccaggagcuccgcaagcccuccgcccgccucgagugcgaccacugcuccuuccgcggcaccgacuacgagaacguccagauccacaugggcaccauccaccccgaguucugcgacgagauggacgccggcggccucggcaagaugaucuucuaccagaaguccgccaagcucuuccacugccacaagugcuucuucaccuccaagauguacuccaacgucuacuaccacaucaccuccaagcacgccucccccgacaaguggaacgacaagcccaagaaccagcucaacaaggagaccgaccccgucaagucccccccccuccccgagcaccagaagauccccugcaacuccgccgagcccaaguccauccccgcccucuccauggagacccagaagcucggcuccguccucucccccgagucccccaagcccaccccccucaccccccucgagccccagaagcccggcuccgucgucucccccgagcuccagaccccccuccccucccccgagcccuccaagcccgccuccgucuccucccccgagccccccaaguccguccccgucugcgagucccagaagcucgcccccguccccucccccgagccccagaagcccgcccccgucucccccgaguccgucaaggccacccucuccaaccccaagccccagaagcagucccacuuccccgagacccucggcccccccuccgccuccucccccgagucccccguccucgccgccucccccgagcccuggggccccucccccgccgccucccccgagucccgcaaguccgcccgcaccaccucccccgagccccgcaagcccucccccuccgagucccccgagcccuggaagcccuuccccgccgucucccccgagccccgccgccccgcccccgccgucucccccggcuccuggaagcccggcccccccggcuccccccgccccuggaaguccaaccccuccgccuccuccggccccuggaagcccgccaagcccgcccccuccgucucccccggccccuggaagcccauccccuccgucucccccggccccuggaagcccacccccuccgucuccuccgccuccuggaaguccuccuccgucucccccuccuccuggaaguccccccccgccucccccgaguccuggaaguccggcccccccgagcuccgcaagaccgcccccacccucucccccgagcacuggaaggccgucccccccgucucccccgagcuccgcaagcccggccccccccucucccccgagauccgcucccccgccggcucccccgagcuccgcaagcccuccggcucccccgaccucuggaagcucucccccgaccagcgcaagaccucccccgccucccucgacuuccccgagucccagaaguccucccgcggcggcucccccgaccucuggaaguccuccuucuucaucgagccccagaagcccgucuuccccgagacccgcaagcccggccccuccggccccuccgagucccccaaggccgccuccgacaucuggaagcccguccucuccaucgacaccgagccccgcaagcccgcccucuuccccgagcccgccaagaccgccccccccgccucccccgaggcccgcaagcgcgcccucuuccccgagccccgcaagcacgcccucuuccccgagcuccccaaguccgcccucuucuccgagucccagaaggccgucgagcucggcgacgagcuccagaucgacgccaucgacgaccagaagugcgacauccucguccaggaggagcuccucgccucccccaagaagcuccucgaggacacccucuuccccuccuccaagaagcucaagaaggacaaccaggaguccuccgacgccgagcucuccuccuccgaguacaucaagaccgaccucgacgccauggacaucaagggccaggaguccuccuccgaccaggagcaggucgacgucgaguccaucgacuucuccaaggagaacaagauggacaugaccucccccgagcagucccgcaacguccuccaguucaccgaggagaaggaggccuucaucuccgaggaggagaucgccaaguacaugaagcgcggcaagggcaaguacuacugcaagaucugcugcugccgcgccaugaagaagggcgccguccuccaccaccucgucaacaagcacaacguccacucccccuacaagugcaccaucugcggcaaggccuuccuccucgagucccuccucaagaaccacgucgccgcccacggccagucccuccucaagugcccccgcugcaacuucgaguccaacuucccccgcggcuucaagaagcaccucacccacugccagucccgccacaacgaggaggccaacaagaagcucauggaggcccucgagcccccccucgaggagcagcagaucuga

SEQ ID NO: 41275 - RNA, 1893 nt, Artificial Sequence
  derived and/or modified sequence opt2 from CHAT__Homo_sapiens__NP_001136401
auggccgccaagacccccuccuccgaggaguccggccuccccaagcuccccguccccccccuccagcagacccucgccaccuaccuccagugcaugcgccaccucgucuccgaggagcaguuccgcaagucccaggccaucguccagcaguucggcgcccccggcggccucggcgagacccuccagcagaagcuccucgagcgccaggagaagaccgccaacugggucuccgaguacuggcucaacgacauguaccucaacaaccgccucgcccuccccgucaacuccucccccgccgucaucuucgcccgccagcacuuccccggcaccgacgaccagcuccgcuucgccgccucccucaucuccggcguccucuccuacaaggcccuccucgacucccacuccauccccaccgacugcgccaagggccagcucuccggccagccccucugcaugaagcaguacuacggccucuucuccuccuaccgccuccccggccacacccaggacacccucgucgcccagaacuccuccaucaugcccgagcccgagcacgucaucgucgccugcugcaaccaguucuucguccucgacgucgucaucaacuuccgccgccucuccgagggcgaccucuucacccagcuccgcaagaucgucaagauggccuccaacgaggacgagcgccucccccccaucggccuccucaccuccgacggccgcuccgagugggccgaggcccgcaccguccucgucaaggacuccaccaaccgcgacucccucgacaugaucgagcgcugcaucugccucgucugccucgacgcccccggcggcgucgagcucuccgacacccaccgcgcccuccagcuccuccacggcggcggcuacuccaagaacggcgccaaccgcugguacgacaagucccuccaguucgucgucggccgcgacggcaccugcggcgucgucugcgagcacucccccuucgacggcaucguccucguccagugcaccgagcaccuccucaagcacaugacccaguccucccgcaagcucauccgcgccgacuccgucuccgagcuccccgccccccgccgccuccgcuggaagugcucccccgagauccagggccaccucgccuccuccgccgagaagcuccagcgcaucgucaagaaccucgacuucaucgucuacaaguucgacaacuacggcaagaccuucaucaagaagcagaagugcucccccgacgccuucauccaggucgcccuccagcucgccuucuaccgccuccaccgccgccucguccccaccuacgaguccgccuccauccgccgcuuccaggagggccgcgucgacaacauccgcuccgccacccccgaggcccucgccuucguccgcgccgucaccgaccacaaggccgccguccccgccuccgagaagcuccuccuccucaaggacgccauccgcgcccagaccgccuacaccgucauggccaucaccggcauggccaucgacaaccaccuccucgcccuccgcgagcucgcccgcgccaugugcaaggagcuccccgagauguucauggacgagaccuaccucauguccaaccgcuucguccucuccaccucccagguccccaccaccaccgagauguucugcugcuacggccccgucguccccaacggcuacggcgccugcuacaacccccagcccgagaccauccucuucugcaucuccuccuuccacuccugcaaggagaccuccuccuccaaguucgccaaggccgucgaggagucccucaucgacaugcgcgaccucugcucccuccucccccccaccgaguccaagccccucgccaccaaggagaaggccacccgccccucccagggccaccagcccuga

SEQ ID NO: 41276 - RNA, 429 nt, Artificial Sequence
  derived and/or modified sequence opt2 from CHCHD10__Homo_sapiens__NP_998885
augccccgcggcucccgcuccgccgccucccgccccgccucccgccccgccgcccccuccgcccacccccccgcccaccccccccccuccgccgccgcccccgcccccgcccccuccggccagcccggccucauggcccagauggccaccaccgccgccggcgucgccgucggcuccgccgucggccacgucaugggcuccgcccucaccggcgccuucuccggcggcuccuccgagcccucccagcccgccguccagcaggcccccacccccgccgccccccagccccuccagaugggccccugcgccuacgagauccgccaguuccucgacugcuccaccacccaguccgaccucucccucugcgagggcuucuccgaggcccucaagcagugcaaguacuaccacggccucuccucccuccccuga

SEQ ID NO: 41277 - RNA, 357 nt, Artificial Sequence
  derived and/or modified sequence opt2 from CHCHD1__Homo_sapiens__NP_976043
auggccacccccucccuccgcggccgccucgcccgcuucggcaacccccgcaagcccguccucaagcccaacaagccccucauccucgccaaccgcgucggcgagcgccgccgcgagaagggcgaggccaccugcaucaccgagauguccgucaugauggccugcuggaagcagaacgaguuccgcgacgacgccugccgcaaggagauccagggcuuccucgacugcgccgcccgcgcccaggaggcccgcaagaugcgcuccauccaggagacccucggcgaguccggcucccuccuccccaacaagcucaacaagcuccuccagcgcuuccccaacaagcccuaccucuccuga

SEQ ID NO: 41278 - RNA, 684 nt, Artificial Sequence
  derived and/or modified sequence opt2 from CHCHD3__Homo_sapiens__NP_060282
augggcggcaccaccuccacccgccgcgucaccuucgaggccgacgagaacgagaacaucaccgucgucaagggcauccgccucuccgagaacgucaucgaccgcaugaaggaguccucccccuccggcuccaagucccagcgcuacuccggcgccuacggcgccuccgucuccgacgaggagcucaagcgccgcgucgccgaggagcucgcccucgagcaggccaagaaggaguccgaggaccagaagcgccucaagcaggccaaggagcucgaccgcgagcgcgccgccgccaacgagcagcucacccgcgccauccuccgcgagcgcaucugcuccgaggaggagcgcgccaaggccaagcaccucgcccgccagcucgaggagaaggaccgcguccucaagaagcaggacgccuucuacaaggagcagcucgcccgccucgaggagcgcuccuccgaguucuaccgcgucaccaccgagcaguaccagaaggccgccgaggaggucgaggccaaguucaagcgcuacgagucccaccccgucugcgccgaccuccaggccaagauccuccagugcuaccgcgagaacacccaccagacccucaagugcuccgcccucgccacccaguacaugcacugcgucaaccacgccaagcaguccaugcucgagaagggcggcuga

SEQ ID NO: 41279 - RNA, 333 nt, Artificial Sequence
  derived and/or modified sequence opt2 from CHCHD5__Homo_sapiens__NP_115685
augcaggccgcccucgaggucaccgcccgcuacugcggccgcgagcucgagcaguacggccagugcgucgccgccaagcccgaguccuggcagcgcgacugccacuaccucaagauguccaucgcccagugcaccuccucccaccccaucauccgccagauccgccaggccugcgcccagcccuucgaggccuucgaggagugccuccgccagaacgaggccgccgucggcaacugcgccgagcacaugcgccgcuuccuccagugcgccgagcagguccagcccccccgcucccccgccaccgucgaggcccagccccuccccgccuccuga

SEQ ID NO: 41280 - RNA, 708 nt, Artificial Sequence
  derived and/or modified sequence opt2 from CHCHD6__Homo_sapiens__NP_115719
augggcuccaccgaguccuccgagggccgccgcgucuccuucggcgucgacgaggaggagcgcguccgcguccuccagggcguccgccucuccgagaacgucgucaaccgcaugaaggagcccuccucccccccccccgcccccaccuccuccaccuucggccuccaggacggcaaccuccgcgccccccacaaggaguccacccucccccgcuccggcuccuccggcggccagcagcccuccggcaugaaggagggcgucaagcgcuacgagcaggagcacgccgccauccaggacaagcucuuccaggucgccaagcgcgagcgcgaggccgccaccaagcacuccaaggccucccuccccaccggcgagggcuccaucucccacgaggagcagaaguccguccgccucgcccgcgagcucgagucccgcgaggccgagcuccgccgccgcgacaccuucuacaaggagcagcucgagcgcaucgagcgcaagaacgccgagauguacaagcucuccuccgagcaguuccacgaggccgccuccaagauggaguccaccaucaagccccgccgcgucgagcccgucugcuccggccuccaggcccagauccuccacugcuaccgcgaccgcccccacgagguccuccucugcuccgaccucgucaaggccuaccagcgcugcgucuccgccgcccacaagggcuga

SEQ ID NO: 41281 - RNA, 333 nt, Artificial Sequence
  derived and/or modified sequence opt2 from CHCHD7__Homo_sapiens__NP_001011668
augaagugcgaggagacccacgcccccaacuccaacugggucuacgucaugcuccccuccaagaagaccguccgcaugcccuccgucacccagcgccuccgcgaccccgacaucaaccccugccucuccgaguccgacgccuccacccgcugccucgacgagaacaacuacgaccgcgagcgcugcuccaccuacuuccuccgcuacaagaacugccgccgcuucuggaacuccaucgucaugcagcgccgcaagaacggcgucaagcccuucaugcccaccgccgccgagcgcgacgagauccuccgcgccgucggcaacaugcccuacuga

SEQ ID NO: 41282 - RNA, 5397 nt, Artificial Sequence
  derived and/or modified sequence opt2 from CHD1__Homo_sapiens__XP_005271923
augaacggccacuccgacgaggaguccguccgcaacuccuccggcgaguccucccaguccgacgacgacuccggcuccgccuccggcuccggcuccggcuccuccuccggcuccuccuccgacggcuccuccucccaguccggcuccuccgacuccgacuccggcuccgaguccggcucccaguccgaguccgaguccgacaccucccgcgagaacaagguccaggccaagccccccaaggucgacggcgccgaguucuggaaguccucccccuccauccucgccguccagcgcuccgccauccucaagaagcagcagcagcagcagcagcagcagcagcaccaggccuccuccaacuccggcuccgaggaggacuccuccuccuccgaggacuccgacgacuccuccuccgaggucaagcgcaagaagcacaaggacgaggacuggcagauguccggcuccggcucccccucccaguccggcuccgacuccgaguccgaggaggagcgcgagaaguccuccugcgacgagaccgaguccgacuacgagcccaagaacaaggucaagucccgcaagccccagaaccgcuccaaguccaagaacggcaagaagauccucggccagaagaagcgccagaucgacuccuccgaggaggacgacgacgaggaggacuacgacaacgacaagcgcuccucccgccgccaggccaccgucaacgucuccuacaaggaggacgaggagaugaagaccgacuccgacgaccuccucgaggucugcggcgaggacgucccccagcccgaggaggaggaguucgagaccaucgagcgcuucauggacugccgcaucggccgcaagggcgccaccggcgccaccaccaccaucuacgccgucgaggccgacggcgaccccaacgccggcuucgagaagaacaaggagcccggcgagauccaguaccucaucaaguggaagggcuggucccacauccacaacaccugggagaccgaggagacccucaagcagcagaacguccgcggcaugaagaagcucgacaacuacaagaagaaggaccaggagaccaagcgcuggcucaagaacgccucccccgaggacgucgaguacuacaacugccagcaggagcucaccgacgaccuccacaagcaguaccagaucgucgagcgcaucaucgcccacuccaaccagaaguccgccgccggcuaccccgacuacuacugcaaguggcagggccuccccuacuccgagugcuccugggaggacggcgcccucaucuccaagaaguuccaggccugcaucgacgaguacuucucccgcaaccaguccaagaccacccccuucaaggacugcaagguccucaagcagcgcccccgcuucgucgcccucaagaagcagcccuccuacaucggcggccacgagggccucgagcuccgcgacuaccagcucaacggccucaacuggcucgcccacuccuggugcaagggcaacuccugcauccucgccgacgagaugggccucggcaagaccauccagaccaucuccuuccucaacuaccucuuccacgagcaccagcucuacggccccuuccuccucgucgucccccucuccacccucaccuccuggcagcgcgagauccagaccugggccucccagaugaacgccgucgucuaccucggcgacaucaacucccgcaacaugauccgcacccacgaguggacccaccaccagaccaagcgccucaaguucaacauccuccucaccaccuacgagauccuccucaaggacaaggccuuccucggcggccucaacugggccuucaucggcgucgacgaggcccaccgccucaagaacgacgacucccuccucuacaagacccucaucgacuucaaguccaaccaccgccuccucaucaccggcaccccccuccagaacucccucaaggagcucuggucccuccuccacuucaucaugcccgagaaguucuccuccugggaggacuucgaggaggagcacggcaagggccgcgaguacggcuacgccucccuccacaaggagcucgagcccuuccuccuccgccgcgucaagaaggacgucgagaagucccuccccgccaaggucgagcagauccuccgcauggagauguccgcccuccagaagcaguacuacaaguggauccucacccgcaacuacaaggcccucuccaagggcuccaagggcuccaccuccggcuuccucaacaucaugauggagcucaagaagugcugcaaccacugcuaccucaucaagccccccgacaacaacgaguucuacaacaagcaggaggcccuccagcaccucauccgcuccuccggcaagcucauccuccucgacaagcuccucauccgccuccgcgagcgcggcaaccgcguccucaucuucucccagaugguccgcaugcucgacauccucgccgaguaccucaaguaccgccaguuccccuuccagcgccucgacggcuccaucaagggcgagcuccgcaagcaggcccucgaccacuucaacgccgagggcuccgaggacuucugcuuccuccucuccacccgcgccggcggccucggcaucaaccucgccuccgccgacaccgucgucaucuucgacuccgacuggaacccccagaacgaccuccaggcccaggcccgcgcccaccgcaucggccagaagaagcaggucaacaucuaccgccucgucaccaagggcuccgucgaggaggacauccucgagcgcgccaagaagaagaugguccucgaccaccucgucauccagcgcauggacaccaccggcaagaccguccuccacaccggcuccgcccccuccuccuccacccccuucaacaaggaggagcucuccgccauccucaaguucggcgccgaggagcucuucaaggagcccgagggcgaggagcaggagccccaggagauggacaucgacgagauccucaagcgcgccgagacccacgagaacgagcccggcccccucaccgucggcgacgagcuccucucccaguucaaggucgccaacuucuccaacauggacgaggacgacaucgagcucgagcccgagcgcaacuccaagaacugggaggagaucauccccgaggaccagcgccgccgccucgaggaggaggagcgccagaaggagcucgaggagaucuacaugcucccccgcaugcgcaacugcgccaagcagaucuccuucaacggcuccgagggccgccgcucccgcucccgccgcuacuccggcuccgacuccgacuccaucuccgagggcaagcgccccaagaagcgcggccgcccccgcaccaucccccgcgagaacaucaagggcuucuccgacgccgagauccgccgcuucaucaaguccuacaagaaguucggcggcccccucgagcgccucgacgccaucgcccgcgacgccgagcucgucgacaaguccgagaccgaccuccgccgccucggcgagcucguccacaacggcugcaucaaggcccucaaggacuccuccuccggcaccgagcgcaccggcggccgccucggcaaggucaagggccccaccuuccgcaucuccggcguccaggucaacgccaagcucgucaucucccacgaggaggagcucaucccccuccacaaguccauccccuccgaccccgaggagcgcaagcaguacaccauccccugccacaccaaggccgcccacuucgacaucgacuggggcaaggaggacgacuccaaccuccucaucggcaucuacgaguacggcuacggcuccugggagaugaucaagauggaccccgaccucucccucacccacaagauccuccccgacgaccccgacaagaagccccaggccaagcagcuccagacccgcgccgacuaccucaucaagcuccucucccgcgaccucgccaagaaggaggcccucuccggcgccggcuccuccaagcgccgcaaggcccgcgccaagaagaacaaggccaugaaguccaucaaggucaaggaggagaucaaguccgacuccuccccccuccccuccgagaaguccgacgaggacgacgacaaggacgagaucuccuccgucaagcaccccaacaagaagaucaagaccgagcgcgacuccgaggagaagcccgagcccgacgucuacaucaagaaggagcccgaggagaagcgcgaggccaaggagaaggagaacaagaaggagcucaagcgcgagaucaaggagaaggaggacaagaaggacaucaaggagaaggacuucaaggagaagcgcgagaacaaggucaaggaggccauccagaaggagaaggacaucaaggaggagaagcucuccgaguccaaguccgacggccgcgagcgcuccaagaaguccuccgucuccgacgcccccguccacaucaccgccuccggcgagcccguccccaucuccgaggaguccgaggagcucgaccagaagaccuucuccaucugcaaggagcgcaugcgccccgucaaggccgcccucaagcagcucgaccgccccgagaagggccucuccgagcgcgagcagcucgagcacacccgccagugccucaucaagaucggcgaccacaucaccgagugccucaaggaguacaccaaccccgagcagaucaagcaguggcgcaagaaccucuggaucuucgucuccaaguucaccgaguucgacgcccgcaagcuccacaagcucuacaagcacgccaucaagaagcgccaggagucccagcagaacuccgaccagaacuccaaccucaacccccacgucauccgcaaccccgacgucgagcgccucaaggagaacaccaaccacgacgacuccucccgcgacuccuacuccuccgaccgccaccucacccaguaccacgaccaccacaaggaccgccaccagggcgacuccuacaagaaguccgacucccgcaagcgccccuacuccuccuucuccaacggcaaggaccaccgcgacugggaccacuacaagcaggacucccgcuacuacuccgaccgcgagaagcaccgcaagcucgacgaccaccgcucccgcgaccaccgcuccaaccucgagggcucccucaaggaccgcucccacuccgaccaccgcucccacuccgaccaccgccuccacuccgaccaccgcuccuccuccgaguacacccaccacaaguccucccgcgacuaccgcuaccacuccgacuggcagauggaccaccgcgccuccuccuccggcccccgcuccccccucgaccagcgcucccccuacggcucccgcucccccuucgagcacuccgucgagcacaaguccacccccgagcacaccugguccucccgcaagaccuga

SEQ ID NO: 41283 - RNA, 1506 nt, Artificial Sequence
  derived and/or modified sequence opt2 from CHD2__Homo_sapiens__NP_001036037
augaugcgcaacaaggacaagucccaggaggaggacuccucccuccacuccaacgccuccucccacuccgccuccgaggaggccuccggcuccgacuccggcucccaguccgaguccgagcagggcuccgaccccggcuccggccacggcuccgaguccaacuccuccuccgaguccuccgagucccaguccgaguccgaguccgaguccgccggcuccaagucccagcccguccuccccgaggccaaggagaagcccgccuccaagaaggagcgcaucgccgacgucaagaagaugugggaggaguaccccgacgucuacggcguccgccgcuccaaccgcucccgccaggagcccucccgcuucaacaucaaggaggaggccuccuccggcuccgaguccggcucccccaagcgccgcggccagcgccagcucaagaagcaggagaaguggaagcaggagcccuccgaggacgagcaggagcagggcaccuccgccgaguccgagcccgagcagaagaaggucaaggcccgccgccccgucccccgccgcaccguccccaagccccgcgucaagaagcagcccaagacccagcgcggcaagcgcaagaagcaggacuccuccgacgaggacgacgacgacgacgaggcccccaagcgccagacccgccgccgcgccgccaagaacgucuccuacaaggaggacgacgacuucgagaccgacuccgacgaccucaucgagaugaccggcgagggcgucgacgagcagcaggacaacuccgagaccaucgagaagguccucgacucccgccucggcaagaagggcgccaccggcgccuccaccaccgucuacgccaucgaggccaacggcgaccccuccggcgacuucgacaccgagaaggacgagggcgagauccaguaccucaucaaguggaagggcugguccuacauccacuccaccugggaguccgaggagucccuccagcagcagaaggucaagggccucaagaagcucgagaacuucaagaagaaggaggacgagaucaagcaguggcucggcaaggucucccccgaggacgucgaguacuucaacugccagcaggagcucgccuccgagcucaacaagcaguaccagaucgucgagcgcgucaucgccgucaagaccuccaaguccacccucggccagaccgacuuccccgcccacucccgcaagcccgcccccuccaacgagcccgaguaccucugcaaguggaugggccuccccuacuccgagugcuccugggaggacgaggcccucaucggcaagaaguuccagaacugcaucgacuccuuccacucccgcaacaacuccaagaccauccccacccgcgagugcaaggcccucaagcagcgcccccgcuucgucgcccucaagaagcagcccgccuaccucggcggcgagaaccucgagcuccgcgacuaccagcucgagggccucaacuggcucgcccacuccuggugcaaguga

SEQ ID NO: 41284 - RNA, 6180 nt, Artificial Sequence
  derived and/or modified sequence opt2 from CHD3__Homo_sapiens__NP_001005271
auggccuccccccuccgcgacgaggaggaggaggaggaggagauggucgucuccgaggaggaggaggaggaggaggaggagggcgacgaggaggaggaggaggaggucgaggccgccgacgaggacgacgaggaggacgacgacgagggcguccucggccgcggccccggccacgaccgcggccgcgaccgccacuccccccccggcugccaccucuucccccccccccccccccccccccccccccuccccccccccccccccccccccccccccgacaaggacgacauccgccuccuccccuccgcccucggcgucaagaagcgcaagcgcggccccaagaagcagaaggagaacaagcccggcaagccccgcaagcgcaagaagcgcgacuccgaggaggaguucggcuccgagcgcgacgaguaccgcgagaaguccgaguccggcggcuccgaguacggcaccggccccggccgcaagcgccgccgcaagcaccgcgagaagaaggagaagaagaccaagcgccgcaagaagggcgagggcgacggcggccagaagcaggucgagcagaaguccuccgccacccuccuccucaccuggggccucgaggacgucgagcacgucuucuccgaggaggacuaccacacccucaccaacuacaaggccuucucccaguucaugcgcccccucaucgccaagaagaaccccaagauccccauguccaagaugaugaccauccucggcgccaaguggcgcgaguucuccgccaacaaccccuucaagggcuccgccgccgccgucgccgccgccgccgccgccgccgccgccgccgucgccgagcaggucuccgccgccgucuccuccgccacccccaucgcccccuccggcccccccgcccucccccccccccccgccgccgacauccagcccccccccauccgccgcgccaagaccaaggagggcaagggccccggccacaagcgccgcuccaaguccccccgcguccccgacggccgcaagaagcuccgcggcaagaagauggccccccucaagaucaagcucggccuccucggcggcaagcgcaagaagggcggcuccuacgucuuccaguccgacgagggccccgagcccgaggccgaggaguccgaccucgacuccggcuccguccacuccgccuccggccgccccgacggccccguccgcaccaagaagcucaagcgcggccgccccggccgcaagaagaagaagguccucggcugccccgccgucgccggcgaggaggaggucgacggcuacgagaccgaccaccaggacuacugcgaggucugccagcagggcggcgagaucauccucugcgacaccugcccccgcgccuaccaccucgucugccucgaccccgagcucgaccgcgcccccgagggcaagugguccugcccccacugcgagaaggagggcguccagugggaggccaaggaggaggaggaggaguacgaggaggagggcgaggaggagggcgagaaggaggaggaggacgaccacauggaguacugccgcgucugcaaggacggcggcgagcuccucugcugcgacgccugcaucuccuccuaccacauccacugccucaaccccccccuccccgacauccccaacggcgaguggcucugcccccgcugcaccugccccguccucaagggccgcguccagaagauccuccacuggcgcuggggcgagccccccgucgccguccccgccccccagcaggccgacggcaaccccgacgucccccccccccgcccccuccagggccgcuccgagcgcgaguucuucgucaagugggucggccucuccuacuggcacugcuccugggccaaggagcuccagcucgagaucuuccaccucgucauguaccgcaacuaccagcgcaagaacgacauggacgagccccccccccucgacuacggcuccggcgaggacgacggcaaguccgacaagcgcaaggucaaggacccccacuacgccgagauggaggagaaguacuaccgcuucggcaucaagcccgaguggaugaccguccaccgcaucaucaaccacuccgucgacaagaagggcaacuaccacuaccucgucaaguggcgcgaccuccccuacgaccaguccaccugggaggaggacgagaugaacauccccgaguacgaggagcacaagcaguccuacuggcgccaccgcgagcucaucaugggcgaggaccccgcccagccccgcaaguacaagaagaagaagaaggagcuccagggcgacggcccccccuccucccccaccaacgaccccaccgucaaguacgagacccagccccgcuucaucaccgccaccggcggcacccuccacauguaccagcucgagggccucaacuggcuccgcuucuccugggcccagggcaccgacaccauccucgccgacgagaugggccucggcaagaccauccagaccaucgucuuccucuacucccucuacaaggagggccacaccaagggccccuuccucgucuccgccccccucuccaccaucaucaacugggagcgcgaguuccagaugugggcccccaaguucuacgucgucaccuacaccggcgacaaggacucccgcgccaucauccgcgagaacgaguucuccuucgaggacaacgccaucaagggcggcaagaaggccuucaagaugaagcgcgaggcccaggucaaguuccacguccuccucaccuccuacgagcucaucaccaucgaccaggccgcccucggcuccauccgcugggccugccucgucgucgacgaggcccaccgccucaagaacaaccaguccaaguucuuccgcguccucaacggcuacaagaucgaccacaagcuccuccucaccggcaccccccuccagaacaaccucgaggagcucuuccaccuccucaacuuccucacccccgagcgcuucaacaaccucgagggcuuccucgaggaguucgccgacaucuccaaggaggaccagaucaagaagcuccacgaccuccucggcccccacaugcuccgccgccucaaggccgacgucuucaagaacaugcccgccaagaccgagcucaucguccgcgucgagcucucccccaugcagaagaaguacuacaaguacauccucacccgcaacuucgaggcccucaacucccgcggcggcggcaaccaggucucccuccucaacaucaugauggaccucaagaagugcugcaaccaccccuaccucuuccccgucgccgccauggagucccccaagcuccccuccggcgccuacgagggcggcgcccucaucaaguccuccggcaagcucaugcuccuccagaagaugcuccgcaagcucaaggagcagggccaccgcguccucaucuucucccagaugaccaagaugcucgaccuccucgaggacuuccucgacuacgagggcuacaaguacgagcgcaucgacggcggcaucaccggcgcccuccgccaggaggccaucgaccgcuucaacgcccccggcgcccagcaguucugcuuccuccucuccacccgcgccggcggccucggcaucaaccucgccaccgccgacaccgucaucaucuucgacuccgacuggaacccccacaacgacauccaggccuucucccgcgcccaccgcaucggccaggccaacaaggucaugaucuaccgcuucgucacccgcgccuccgucgaggagcgcaucacccaggucgccaagcgcaagaugaugcucacccaccucgucguccgccccggccucggcuccaaggccggcuccauguccaagcaggagcucgacgacauccucaaguucggcaccgaggagcucuucaaggacgagaacgagggcgagaacaaggaggaggacuccuccgucauccacuacgacaacgaggccaucgcccgccuccucgaccgcaaccaggacgccaccgaggacaccgacguccagaacaugaacgaguaccucuccuccuucaaggucgcccaguacgucguccgcgaggaggacaagaucgaggagaucgagcgcgagaucaucaagcaggaggagaacgucgaccccgacuacugggagaagcuccuccgccaccacuacgagcagcagcaggaggaccucgcccgcaaccucggcaagggcaagcgcguccgcaagcaggucaacuacaacgacgccgcccaggaggaccaggacaaccaguccgaguacuccgucggcuccgaggaggaggacgaggacuucgacgagcgccccgagggccgccgccaguccaagcgccagcuccgcaacgagaaggacaagccccuccccccccuccucgcccgcgucggcggcaacaucgagguccucggcuucaacacccgccagcgcaaggccuuccucaacgccgucaugcgcuggggcaugcccccccaggacgccuucaccacccaguggcucguccgcgaccuccgcggcaagaccgagaaggaguucaaggccuacgucucccucuucaugcgccaccucugcgagcccggcgccgacggcuccgagaccuucgccgacggcgucccccgcgagggccucucccgccagcagguccucacccgcaucggcgucaugucccucgucaagaagaagguccaggaguucgagcacaucaacggccgcugguccaugcccgagcucaugcccgaccccuccgccgacuccaagcgcuccucccgcgccuccucccccaccaagaccucccccaccacccccgaggccuccgccaccaacucccccugcaccuccaagcccgccacccccgcccccuccgagaagggcgagggcauccgcaccccccucgagaaggaggaggccgagaaccaggaggagaagcccgagaagaacucccgcaucggcgagaagauggagaccgaggccgacgcccccucccccgcccccucccucggcgagcgccucgagccccgcaagaucccccucgaggacgagguccccggcguccccggcgagauggagcccgagcccggcuaccgcggcgaccgcgagaaguccgccaccgaguccacccccggcgagcgcggcgaggagaagccccucgacggccaggagcaccgcgagcgccccgagggcgagaccggcgaccucggcaagcgcgaggacgucaagggcgaccgcgagcuccgccccggcccccgcgacgagccccgcuccaacggccgccgcgaggagaagaccgagaagccccgcuucauguucaacaucgccgacggcggcuucaccgagcuccacacccucuggcagaacgaggagcgcgccgccaucuccuccggcaagcucaacgagaucuggcaccgccgccacgacuacuggcuccucgccggcaucguccuccacggcuacgcccgcuggcaggacauccagaacgacgcccaguucgccaucaucaacgagcccuucaagaccgaggccaacaagggcaacuuccucgagaugaagaacaaguuccucgcccgccgcuucaagcuccucgagcaggcccucgucaucgaggagcagcuccgccgcgccgccuaccucaaccucucccaggagcccgcccaccccgccauggcccuccacgcccgcuucgccgaggccgagugccucgccgagucccaccagcaccucuccaaggagucccucgccggcaacaagcccgccaacgccguccuccacaagguccucaaccagcucgaggagcuccucuccgacaugaaggccgacgucacccgccuccccgccacccucucccgcaucccccccaucgccgcccgccuccagauguccgagcgcuccauccucucccgccucgccuccaagggcaccgagccccaccccacccccgccuacccccccggccccuacgccaccccccccggcuacggcgccgccuucuccgccgcccccgucggcgcccucgccgccgccggcgccaacuacucccagaugcccgccggcuccuucaucaccgccgccaccaacggcccccccguccucgucaagaaggagaaggagauggucggcgcccucgucuccgacggccucgaccgcaaggagccccgcgccggcgaggucaucugcaucgacgacuga

SEQ ID NO: 41285 - RNA, 5718 nt, Artificial Sequence
  derived and/or modified sequence opt2 from CHD4__Homo_sapiens__NP_001284482
auggccuccggccucggcucccccucccccugcuccgccggcuccgaggaggaggacauggacgcccuccucaacaacucccucccccccccccaccccgagaacgaggaggaccccgaggaggaccucuccgagaccgagacccccaagcucaagaagaagaagaagcccaagaagccccgcgaccccaagauccccaaguccaagcgccagaagaaggagcucggcgacuccuccggcgagggccccgaguucgucgaggaggaggaggaggucgcccuccgcuccgacuccgagggcuccgacuacacccccggcaagaagaagaagaagaagcucggccccaagaaggagaagaaguccaaguccaagcgcaaggaggaggaggaggaggaggacgacgacgacgacuccaaggagcccaaguccuccgcccagcuccucgaggacuggggcauggaggacaucgaccacgucuucuccgaggaggacuaccgcacccucaccaacuacaaggccuucucccaguucguccgcccccucaucgccgccaagaaccccaagaucgccgucuccaagaugaugaugguccucggcgccaaguggcgcgaguucuccaccaacaaccccuucaagggcuccuccggcgccuccgucgccgccgccgccgccgccgccgucgccgucgucgaguccauggucaccgccaccgaggucgcccccccccccccccccgucgagguccccauccgcaaggccaagaccaaggagggcaagggccccaacgcccgccgcaagcccaagggcuccccccgcguccccgacgccaagaagcccaagcccaagaaggucgccccccucaagaucaagcucggcggcuucggcuccaagcgcaagcgcuccuccuccgaggacgacgaccucgacgucgaguccgacuucgacgacgccuccaucaacuccuacuccgucuccgacggcuccaccucccgcuccucccgcucccgcaagaagcuccgcaccaccaagaagaagaagaagggcgaggaggaggucaccgccgucgacggcuacgagaccgaccaccaggacuacugcgaggucugccagcagggcggcgagaucauccucugcgacaccugcccccgcgccuaccacauggucugccucgaccccgacauggagaaggcccccgagggcaagugguccugcccccacugcgagaaggagggcauccagugggaggccaaggaggacaacuccgagggcgaggagauccucgaggaggucggcggcgaccucgaggaggaggacgaccaccacauggaguucugccgcgucugcaaggacggcggcgagcuccucugcugcgacaccugccccuccuccuaccacauccacugccucaaccccccccuccccgagauccccaacggcgaguggcucugcccccgcugcaccugccccgcccucaagggcaagguccagaagauccucaucuggaaguggggccagccccccucccccacccccgucccccgcccccccgacgccgaccccaacacccccucccccaagccccucgagggccgccccgagcgccaguucuucgucaaguggcagggcauguccuacuggcacugcuccugggucuccgagcuccagcucgagcuccacugccaggucauguuccgcaacuaccagcgcaagaacgacauggacgagccccccuccggcgacuucggcggcgacgaggagaagucccgcaagcgcaagaacaaggaccccaaguucgccgagauggaggagcgcuucuaccgcuacggcaucaagcccgaguggaugaugauccaccgcauccucaaccacuccgucgacaagaagggccacguccacuaccucaucaaguggcgcgaccuccccuacgaccaggccuccugggaguccgaggacgucgagauccaggacuacgaccucuucaagcaguccuacuggaaccaccgcgagcucaugcgcggcgaggagggccgccccggcaagaagcucaagaaggucaagcuccgcaagcucgagcgcccccccgagacccccaccgucgaccccaccgucaaguacgagcgccagcccgaguaccucgacgccaccggcggcacccuccaccccuaccagauggagggccucaacuggcuccgcuucuccugggcccagggcaccgacaccauccucgccgacgagaugggccucggcaagaccguccagaccgccgucuuccucuacucccucuacaaggagggccacuccaagggccccuuccucgucuccgccccccucuccaccaucaucaacugggagcgcgaguucgagaugugggcccccgacauguacgucgucaccuacgucggcgacaaggacucccgcgccaucauccgcgagaacgaguucuccuucgaggacaacgccauccgcggcggcaagaaggccucccgcaugaagaaggaggccuccgucaaguuccacguccuccucaccuccuacgagcucaucaccaucgacauggccauccucggcuccaucgacugggccugccucaucgucgacgaggcccaccgccucaagaacaaccaguccaaguucuuccgcguccucaacggcuacucccuccagcacaagcuccuccucaccggcaccccccuccagaacaaccucgaggagcucuuccaccuccucaacuuccucacccccgagcgcuuccacaaccucgagggcuuccucgaggaguucgccgacaucgccaaggaggaccagaucaagaagcuccacgacaugcucggcccccacaugcuccgccgccucaaggccgacgucuucaagaacaugcccuccaagaccgagcucaucguccgcgucgagcucucccccaugcagaagaaguacuacaaguacauccucacccgcaacuucgaggcccucaacgcccgcggcggcggcaaccaggucucccuccucaacgucgucauggaccucaagaagugcugcaaccaccccuaccucuuccccgucgccgccauggaggcccccaagaugcccaacggcauguacgacggcuccgcccucauccgcgccuccggcaagcuccuccuccuccagaagaugcucaagaaccucaaggagggcggccaccgcguccucaucuucucccagaugaccaagaugcucgaccuccucgaggacuuccucgagcacgagggcuacaaguacgagcgcaucgacggcggcaucaccggcaacaugcgccaggaggccaucgaccgcuucaacgcccccggcgcccagcaguucugcuuccuccucuccacccgcgccggcggccucggcaucaaccucgccaccgccgacaccgucaucaucuacgacuccgacuggaacccccacaacgacauccaggccuucucccgcgcccaccgcaucggccagaacaagaaggucaugaucuaccgcuucgucacccgcgccuccgucgaggagcgcaucacccaggucgccaagaagaagaugaugcucacccaccucgucguccgccccggccucggcuccaagaccggcuccauguccaagcaggagcucgacgacauccucaaguucggcaccgaggagcucuucaaggacgaggccaccgacggcggcggcgacaacaaggagggcgaggacuccuccgucauccacuacgacgacaaggccaucgagcgccuccucgaccgcaaccaggacgagaccgaggacaccgagcuccagggcaugaacgaguaccucuccuccuucaaggucgcccaguacgucguccgcgaggaggagaugggcgaggaggaggaggucgagcgcgagaucaucaagcaggaggaguccgucgaccccgacuacugggagaagcuccuccgccaccacuacgagcagcagcaggaggaccucgcccgcaaccucggcaagggcaagcgcauccgcaagcaggucaacuacaacgacggcucccaggaggaccgcgacuggcaggacgaccaguccgacaaccaguccgacuacuccgucgccuccgaggagggcgacgaggacuucgacgagcgcuccgaggccccccgccgccccucccgcaagggccuccgcaacgacaaggacaagccccuccccccccuccucgcccgcgucggcggcaacaucgagguccucggcuucaacgcccgccagcgcaaggccuuccucaacgccaucaugcgcuacggcaugcccccccaggacgccuucaccacccaguggcucguccgcgaccuccgcggcaaguccgagaaggaguucaaggccuacgucucccucuucaugcgccaccucugcgagcccggcgccgacggcgccgagaccuucgccgacggcgucccccgcgagggccucucccgccagcacguccucacccgcaucggcgucaugucccucauccgcaagaagguccaggaguucgagcacgucaacggccgcugguccaugcccgagcucgccgaggucgaggagaacaagaagaugucccagcccggcucccccucccccaagacccccacccccuccacccccggcgacacccagcccaacacccccgcccccgucccccccgccgaggacggcaucaagaucgaggagaacucccucaaggaggaggaguccaucgagggcgagaaggaggucaaguccaccgcccccgagaccgccaucgagugcacccaggcccccgcccccgccuccgaggacgagaaggucgucgucgagccccccgagggcgaggagaaggucgagaaggccgaggucaaggagcgcaccgaggagcccauggagaccgagcccaagggcgccgccgacgucgagaaggucgaggagaaguccgccaucgaccucacccccaucgucgucgaggacaaggaggagaagaaggaggaggaggagaagaaggaggucaugcuccagaacggcgagacccccaaggaccucaacgacgagaagcagaagaagaacaucaagcagcgcuucauguucaacaucgccgacggcggcuucaccgagcuccacucccucuggcagaacgaggagcgcgccgccaccgucaccaagaagaccuacgagaucuggcaccgccgccacgacuacuggcuccucgccggcaucaucaaccacggcuacgcccgcuggcaggacauccagaacgacccccgcuacgccauccucaacgagcccuucaagggcgagaugaaccgcggcaacuuccucgagaucaagaacaaguuccucgcccgccgcuucaagcuccucgagcaggcccucgucaucgaggagcagcuccgccgcgccgccuaccucaacauguccgaggaccccucccaccccuccauggcccucaacacccgcuucgccgaggucgagugccucgccgagucccaccagcaccucuccaaggaguccauggccggcaacaagcccgccaacgccguccuccacaagguccucaagcagcucgaggagcuccucuccgacaugaaggccgacgucacccgccuccccgccaccaucgcccgcaucccccccgucgccguccgccuccagauguccgagcgcaacauccucucccgccucgccaaccgcgcccccgagcccaccccccagcaggucgcccagcagcaguga

SEQ ID NO: 41286 - RNA, 8148 nt, Artificial Sequence
  derived and/or modified sequence opt2 from CHD6__Homo_sapiens__NP_115597
augaagaugaagauccagaagaaggagaagcagcucuccaaccucaagguccucaaccacucccccauguccgacgccuccgucaacuucgacuacaagucccccucccccuucgacugcuccaccgaccaggaggagaagaucgaggacgucgccucccacugccucccccagaaggaccucuacaccgccgaggaggaggccgccacccucuucccccgcaagaugaccucccacaacggcauggaggacuccggcggcggcggcaccggcgucaagaagaagcgcaagaagaaggagcccggcgaccaggagggcgccgccaagggcuccaaggaccgcgagcccaagcccaagcgcaagcgcgagcccaaggagcccaaggagccccgcaaggccaaggagcccaagaaggccaaggagcacaaggagcccaagcagaaggacggcgccaagaaggcccgcaagccccgcgaggccuccggcaccaaggaggccaaggagaagcgcuccugcaccgacuccgccgcccgcaccaagucccgcaaggccuccaaggagcagggccccacccccgucgagaagaagaagaagggcaagcgcaaguccgagaccaccgucgagucccucgagcucgaccagggccucaccaaccccucccuccgcucccccgaggaguccaccgaguccaccgacucccagaagcgccgcuccggccgccaggucaagcgccgcaaguacaacgaggaccucgacuucaaggucgucgacgacgacggcgagaccaucgccguccucggcgccggccgcaccuccgcccucuccgccuccacccucgccuggcaggccgaggagccccccgaggacgacgccaacaucaucgagaagauccucgccuccaagaccguccaggagguccaccccggcgagccccccuucgaccucgagcucuucuacgucaaguaccgcaacuucuccuaccuccacugcaagugggccaccauggaggagcucgagaaggacccccgcaucgcccagaagaucaagcgcuuccgcaacaagcaggcccagaugaagcacaucuucaccgagcccgacgaggaccucuucaaccccgacuacgucgaggucgaccgcauccucgaggucgcccacaccaaggacgccgagaccggcgaggaggucacccacuaccucgucaaguggugcucccuccccuacgaggaguccaccugggagcucgaggaggacgucgaccccgccaaggucaaggaguucgagucccuccagguccuccccgagaucaagcacgucgagcgccccgccuccgacuccuggcagaagcucgagaagucccgcgaguacaagaacuccaaccagcuccgcgaguaccagcucgagggcaugaacuggcuccucuucaacugguacaaccgcaagaacugcauccucgccgacgagaugggccucggcaagaccauccaguccaucaccuuccucuccgagaucuuccuccgcggcauccacggccccuuccucaucaucgccccccucuccaccaucaccaacugggagcgcgaguuccgcaccuggaccgagaugaacgccaucgucuaccacggcucccagaucucccgccagaugauccagcaguacgagauggucuaccgcgacgcccagggcaacccccucuccggcgucuucaaguuccacgucgucaucaccaccuucgagaugauccucgccgacugccccgagcucaagaagauccacugguccugcgucaucaucgacgaggcccaccgccucaagaaccgcaacugcaagcuccucgagggccucaagcucauggcccucgagcacaagguccuccucaccggcaccccccuccagaacuccgucgaggagcucuucucccuccucaacuuccucgagcccucccaguuccccuccgagaccgccuuccucgaggaguucggcgaccucaagaccgaggagcaggucaagaagcuccaguccauccucaagcccaugaugcuccgccgccucaaggacgacgucgagaagaaccucgcccccaagcaggagaccaucaucgaggucgagcucaccaacauccagaagaaguacuaccgcgccauccucgagaagaacuucuccuuccucaccaagggcgccaaccagcacaacaugcccaaccucaucaacaccaugauggagcuccgcaagugcugcaaccaccccuaccucaucaacggcgccgaggagaagauccucgaggacuuccgcaagacccacucccccgacgcccccgacuuccagcuccaggccaugauccaggccgccggcaagcucguccucaucgacaagcuccuccccaagcucaucgccggcggccacaagguccucaucuucucccagaugguccgcugccucgacauccucgaggacuaccucauccagcgccgcuacaccuacgagcgcaucgacggccgcguccgcggcaaccuccgccaggccgccaucgaccgcuucugcaagcccgacuccgaccgcuucgucuuccuccucugcacccgcgccggcggccucggcaucaaccucaccgccgccgacaccugcaucaucuucgacuccgacuggaacccccagaacgaccuccaggcccaggcccgcugccaccgcaucggccaguccaaggccgucaaggucuaccgccucaucacccgcaacuccuacgagcgcgagauguucgacaaggccucccucaagcucggccucgacaaggccguccuccaggacaucaaccgcaagggcggcaccaacggcguccagcagcucuccaagauggaggucgaggaccuccuccgcaagggcgccuacggcgcccucauggacgaggaggacgagggcuccaaguucugcgaggaggacaucgaccagauccuccagcgccgcacccacaccaucaccauccaguccgagggcaagggcuccaccuucgccaaggccuccuucgucgccuccggcaaccgcaccgacaucucccucgacgaccccaacuucuggcagaagugggccaagaucgccgagcucgacaccgaggccaagaacgagaaggagucccucgucaucgaccgcccccgcguccgcaagcagaccaagcacuacaacuccuucgaggaggacgagcucauggaguucuccgagcucgacuccgacuccgacgagcgccccacccgcucccgccgccucaacgacaaggcccgccgcuaccuccgcgccgagugcuuccgcgucgagaagaaccuccucaucuucggcuggggccgcuggaaggacauccucacccacggccgcuucaaguggcaccucaacgagaaggacauggagaugaucugccgcgcccuccucgucuacugcgucaagcacuacaagggcgacgagaagaucaaguccuucaucugggagcucaucacccccaccaaggacggccaggcccagacccuccagaaccacuccggccucuccgcccccgucccccgcggccgcaagggcaagaagaccaagaaccagcuccucauccccgagcucaaggacgccgacuggcucgccaccugcaaccccgaggucguccuccacgacgacggcuacaagaagcaccucaagcagcacugcaacaagguccuccuccgcguccgcaugcucuacuaccucaaggccgagauccucggcgaggccgccgagaaggccuucgagggcucccccgcccgcgagcucgacgucccccuccccgacaucgacuacauggagauccccgucgacuggugggacgccgaggccgacaagucccuccucaucggcgucuucaagcacggcuacgagcgcuacaacgccaugcgcgccgaccccgcccucugcuuccucgagaaggucggcaugcccgacgagaagucccucuccgccgagcagggcgucaccgacggcaccuccgacauccccgagcgcggcaacaccgacaaggaggacaacgccgaggacaaggucgacggccuccagaagcagaccgaguccuccuccgacggcggcgacggcgucuucuccgagaagaaggacgacucccgcgccgcccaggacggcuccgaccccgacaagucccccuggcccgucuccuccgcccucaccgcccgccuccgccgccucgucaccgucuaccagcgcugcaaccgcaaggagcucugccgccccgagauccucggccccggcaaccagggcuacuggguccaggaggagauguuccgccgcaccuccgagauggaccucaucaacaaggaggcccagaagcgcuggacccgccgcgagcaggccgacuucuaccgcaccgucuccuccuucggcgucgucuacgaccaggagaagaagaccuucgacuggacccaguuccgcaucaucucccgccucgacaagaaguccgacgagucccucgagcaguacuucuacuccuucgucgccaugugccgcaacgucugccgccuccccaccuggaaggacggcggcccccccgacaccaccaucuacgucgagcccaucaccgaggagcgcgccgcccgcacccucuaccgcaucgagcuccuccgcaagguccgcgagcagguccucaagugcccccagcuccacgagcgccuccagcucugccgccccucccucuaccuccccgucuggugggagugcggcaagcacgaccgcgaccuccucaucggcaccgccaagcacggccucaaccgcaccgacugcuacaucaugaacgacccccagcucuccuuccucgacgccuaccgcaacuacgcccagcacaagcgcuccggcacccaggcccccggcaaccucugcugccucuaccagaccaacuccaagcucuacgagucccucaccuacucccagaugucccgcaccuccgagucccucgagaacgagcccgagaaccucguccgcgucgagucccgcgacgaccaccucucccuccccgacgucaccugcgagaacuucaucuccaagguccaggacgucaucuccaucaaccacgacgagucccuccuccccgagucccucgaguccaugauguacggcaagaagguccucucccaggagcccuccuccuuccaggagucccccuccaccaacaccgagucccgcaaggacgucaucaccaucuccaucuccaaggacggcaacugccaguccggcggccccgaggccgagaucgccuccggccccaccuucaugggcucccucgaggccggcggcgucgcccaggccaacaucaagaacggcaagcaccuccucauguccaucuccaaggagggcgagcucugcugcuccgaggccggccagcgccccgagaacaucggccagcucgaggccaagugccucgccucccccucccucaaccccggcaacgaguccggcuucgucgacaugugcucccucuccgucugcgacuccaagcgcaaccucuccuccgaccagcagcucaucgaccuccucgagaacaagucccucgaguccaagcucauccucucccagaaccacuccgacgaggaggaggaggaggaggagaacgaggaggagaaccucgccauggccgucggcaugggcgagcgccccgagguccuccaccucaccgagcccaccaccaacaucucccgcgagaagaaccagggcuuccaggacgagaccaagaagggcucccucgaggucgccaaccagacccccggccuccagcgcgccuuccccgcccccgccgccugccagugccacugcaagcacauggagcgcuggaugcacggccucgagaacgacgaguucgagaucgagaagcccaaggccuacauccccgaccucuucaaguccaagaccaacaccaucgccauggagggcgagcccaccgccauccccucccagcccuucaaggucaagcacgagcuccucaaggagcccuggaaggaguccgccgagggccagaacgucuuccccaccuacccccucgagggcuccgagcucaaguccgaggacauggacuucgagaacaaggacgacuacgaccgcgacggcaacugccacucccaggacuaccccggcaaguacuccgaggaggaguccaaguccuccaccuccggcaucaccggcgacaucggcgacgagcuccaggaggcccgcgcccccaccaucgcccagcuccuccaggagaagacccucuacuccuucuccgaguggcccaaggaccgcgucaucaucaaccgccucgacaacaucugccacgucguccucaagggcaaguggcccuccucccagcaguacgagcccuccggcacccuccccacccccguccucaccuccuccgccggcucccgcaccucccucuccgagcccgaggccgccgagcacuccuucuccaacggcgccgcccucgccgcccagauccacaaggaguccuuccucgcccccgucuucaccaaggacgagcagaagcaccgccgccccuacgaguucgaggucgagcgcgacgccaaggcccgcggccucgagcaguucuccgccacccacggccacacccccaucauccucaacggcuggcacggcgaguccgccauggaccucuccugcuccuccgagggcucccccggcgccaccucccccuuccccgucuccgccuccacccccaagaucggcgccaucuccucccuccagggcgcccucggcauggaccucuccggcauccuccaggccggccucauccaccccgucaccggccagaucgucaacggcucccuccgccgcgacgacgccgccacccgccgccgccgcggccgccgcaagcacgucgagggcggcauggaccucaucuuccucaaggagcagacccuccaggccggcauccucgagguccacgaggaccccggccaggccacccucuccaccacccaccccgagggccccggccccgccaccuccgcccccgagcccgccaccgccgccuccucccaggccgagaaguccauccccuccaagucccuccucgacuggcuccgccagcaggccgacuacucccucgagguccccggcuucggcgccaacuucuccgacaagcccaagcagcgccgcccccgcugcaaggagcccggcaagcucgacgucuccucccucuccggcgaggagcgcguccccgccauccccaaggagcccggccuccgcggcuuccuccccgagaacaaguucaaccacacccucgccgagcccauccuccgcgacaccggcccccgccgccgcggccgccgcccccgcuccgagcuccucaaggcccccuccaucgucgccgacucccccuccggcaugggcccccucuucaugaacggccucaucgccggcauggaccucgucggccuccagaacaugcgcaacaugcccggcaucccccucaccggccucgucggcuuccccgccggcuucgccaccaugcccaccggcgaggaggucaaguccacccucuccaugcuccccaugaugcuccccggcauggccgccgucccccagauguucggcgucggcggccuccucuccccccccauggccaccaccugcaccuccaccgcccccgccucccucuccuccaccaccaaguccggcaccgccgucaccgagaagaccgccgaggacaagcccuccucccacgacgucaagaccgacacccucgccgaggacaagcccggccccggccccuucuccgaccaguccgagcccgccaucaccaccuccucccccgucgccuucaaccccuuccucauccccggcgucucccccggccucaucuaccccuccauguuccucucccccggcaugggcauggcccuccccgccaugcagcaggcccgccacuccgagaucgucggccucgagucccagaagcgcaagaagaagaagaccaagggcgacaaccccaacucccaccccgagcccgcccccuccugcgagcgcgagcccuccggcgacgagaacugcgccgagcccuccgccccccuccccgccgagcgcgagcacggcgcccaggccggcgagggcgcccucaaggacuccaacaacgacaccaacuga

SEQ ID NO: 41287 - RNA, 8994 nt, Artificial Sequence
  derived and/or modified sequence opt2 from CHD7__Homo_sapiens__NP_060250
auggccgaccccggcaugaugucccucuucggcgaggacggcaacaucuucuccgagggccucgagggccucggcgagugcggcuaccccgagaaccccgucaaccccaugggccagcagaugcccaucgaccagggcuucgccucccuccagcccucccuccaccaccccuccaccaaccagaaccagaccaagcucacccacuucgaccacuacaaccaguacgagcagcagaagaugcaccucauggaccagcccaaccgcaugauguccaacacccccggcaacggccucgccuccccccacucccaguaccacaccccccccgucccccaggucccccacggcggcuccggcggcggccagaugggcgucuaccccggcaugcagaacgagcgccacggccaguccuucgucgacuccuccuccauguggggcccccgcgccguccagguccccgaccagauccgcgcccccuaccagcagcagcagccccagccccagcccccccagcccgcccccuccggcccccccgcccagggccacccccagcacaugcagcagaugggcuccuacauggcccgcggcgacuucuccaugcagcagcacggccagccccagcagcgcaugucccaguucucccagggccaggagggccucaaccagggcaaccccuucaucgccaccuccggccccggccaccucucccacgucccccagcagucccccuccauggcccccucccuccgccacuccguccagcaguuccaccaccaccccuccaccgcccuccacggcgaguccgucgcccacuccccccgcuucucccccaaccccccccagcagggcgccguccgcccccagacccucaacuucuccucccgcucccagaccguccccucccccaccaucaacaacuccggccaguacucccgcuaccccuacuccaaccucaaccagggccucgucaacaacaccggcaugaaccagaaccucggccucaccaacaacacccccaugaaccaguccgucccccgcuaccccaacgccgucggcuuccccuccaacuccggccagggccucaugcaccagcagcccauccaccccuccggcucccucaaccagaugaacacccagaccaugcaccccucccagccccagggcaccuacgccucccccccccccaugucccccaugaaggccauguccaaccccgccggcaccccccccccccagguccgccccggcuccgccggcauccccauggaggucggcuccuaccccaacaugccccacccccagcccucccaccagccccccggcgccaugggcaucggccagcgcaacaugggcccccgcaacaugcagcagucccgccccuucaucggcauguccuccgccccccgcgagcucaccggccacaugcgccccaacggcugccccggcgucggccucggcgacccccaggccauccaggagcgccucauccccggccagcagcaccccggccagcagcccuccuuccagcagcuccccaccugccccccccuccagccccaccccggccuccaccaccaguccucccccccccacccccaccaccagcccugggcccagcuccaccccuccccccagaacaccccccagaagguccccguccaccagcacucccccuccgagcccuuccucgagaagcccguccccgacaugacccaggucuccggccccaacgcccagcucgucaaguccgacgacuaccuccccuccaucgagcagcagccccagcagaagaagaagaagaagaagaacaaccacaucgucgccgaggaccccuccaagggcuucggcaaggacgacuuccccggcggcgucgacaaccaggagcucaaccgcaacucccucgacggcucccaggaggagaagaagaagaagaagcgcuccaaggccaagaaggaccccaaggagcccaaggagcccaaggagaagaaggagcccaaggagcccaagacccccaaggcccccaagauccccaaggagcccaaggagaagaaggccaagaccgccacccccaagcccaaguccuccaagaaguccuccaacaagaagcccgacuccgaggccuccgcccucaagaagaaggucaacaagggcaagaccgagggcuccgagaacuccgaccucgacaagacccccccccccucccccccccccgaggaggacgaggaccccggcguccagaagcgccgcuccucccgccaggucaagcgcaagcgcuacaccgaggaccucgaguucaagaucuccgacgaggaggccgacgacgccgacgccgccggccgcgacucccccuccaacaccucccaguccgagcagcaggaguccgucgacgccgagggccccgucgucgagaagaucauguccucccgcuccgucaagaagcagaaggaguccggcgaggaggucgagaucgaggaguucuacgucaaguacaagaacuucuccuaccuccacugccagugggccuccaucgaggaccucgagaaggacaagcgcauccagcagaagaucaagcgcuucaaggccaagcagggccagaacaaguuccucuccgagaucgaggacgagcucuucaaccccgacuacgucgaggucgaccgcaucauggacuucgcccgcuccaccgacgaccgcggcgagcccgucacccacuaccucgucaaguggugcucccuccccuacgaggacuccaccugggagcgccgccaggacaucgaccaggccaagaucgaggaguucgagaagcucaugucccgcgagcccgagaccgagcgcgucgagcgcccccccgccgacgacuggaagaaguccgaguccucccgcgaguacaagaacaacaacaagcuccgcgaguaccagcucgagggcgucaacuggcuccucuucaacugguacaacaugcgcaacugcauccucgccgacgagaugggccucggcaagaccauccaguccaucaccuuccucuacgagaucuaccucaagggcauccacggccccuuccucgucaucgccccccucuccaccauccccaacugggagcgcgaguuccgcaccuggaccgagcucaacgucgucgucuaccacggcucccaggccucccgccgcaccauccagcucuacgagauguacuucaaggacccccagggccgcgucaucaagggcuccuacaaguuccacgccaucaucaccaccuucgagaugauccucaccgacugccccgagcuccgcaacauccccuggcgcugcgucgucaucgacgaggcccaccgccucaagaaccgcaacugcaagcuccucgagggccucaagaugauggaccucgagcacaagguccuccucaccggcaccccccuccagaacaccgucgaggagcucuucucccuccuccacuuccucgagcccucccgcuuccccuccgagaccaccuucaugcaggaguucggcgaccucaagaccgaggagcagguccagaagcuccaggccauccucaagcccaugaugcuccgccgccucaaggaggacgucgagaagaaccucgcccccaaggaggagaccaucaucgaggucgagcucaccaacauccagaagaaguacuaccgcgccauccucgagaagaacuucaccuuccucuccaagggcggcggccaggccaacguccccaaccuccucaacaccaugauggagcuccgcaagugcugcaaccaccccuaccucaucaacggcgccgaggagaagauccucgaggaguucaaggagacccacaacgccgagucccccgacuuccagcuccaggccaugauccaggccgccggcaagcucguccucaucgacaagcuccuccccaagcucaaggccggcggccaccgcguccucaucuucucccagaugguccgcugccucgacauccucgaggacuaccucauccagcgccgcuaccccuacgagcgcaucgacggccgcguccgcggcaaccuccgccaggccgccaucgaccgcuucuccaagcccgacuccgaccgcuucgucuuccuccucugcacccgcgccggcggccucggcaucaaccucaccgccgccgacaccugcaucaucuucgacuccgacuggaacccccagaacgaccuccaggcccaggcccgcugccaccgcaucggccaguccaaguccgucaagaucuaccgccucaucacccgcaacuccuacgagcgcgagauguucgacaaggccucccucaagcucggccucgacaaggccguccuccaguccauguccggccgcgagaacgccaccaacggcguccagcagcucuccaagaaggagaucgaggaccuccuccgcaagggcgccuacggcgcccucauggacgaggaggacgagggcuccaaguucugcgaggaggacaucgaccagauccuccuccgccgcacccacaccaucaccaucgaguccgagggcaagggcuccaccuucgccaaggccuccuucgucgccuccggcaaccgcaccgacaucucccucgacgaccccaacuucuggcagaagugggccaagaaggccgagcucgacaucgacgcccucaacggccgcaacaaccucgucaucgacaccccccgcguccgcaagcagacccgccucuacuccgccgucaaggaggacgagcucauggaguucuccgaccucgaguccgacuccgaggagaagcccugcgccaagccccgccgcccccaggacaagucccagggcuacgcccgcuccgagugcuuccgcgucgagaagaaccuccucgucuacggcuggggccgcuggaccgacauccucucccacggccgcuacaagcgccagcucaccgagcaggacgucgagaccaucugccgcaccauccucgucuacugccucaaccacuacaagggcgacgagaacaucaaguccuucaucugggaccucaucacccccaccgccgacggccagacccgcgcccucgucaaccacuccggccucuccgcccccgucccccgcggccgcaagggcaagaaggucaaggcccaguccacccagcccgucguccaggacgccgacuggcucgccuccugcaaccccgacgcccucuuccaggaggacuccuacaagaagcaccucaagcaccacugcaacaagguccuccuccgcguccgcaugcucuacuaccuccgccaggaggucaucggcgaccaggccgacaagauccucgagggcgccgacuccuccgaggccgacgucuggauccccgagcccuuccacgccgagguccccgccgacuggugggacaaggaggccgacaagucccuccucaucggcgucuucaagcacggcuacgagaaguacaacuccaugcgcgccgaccccgcccucugcuuccucgagcgcgucggcaugcccgacgccaaggccaucgccgccgagcagcgcggcaccgacaugcucgccgacggcggcgacggcggcgaguucgaccgcgaggacgaggaccccgaguacaagcccacccgcacccccuucaaggacgagaucgacgaguucgccaacucccccuccgaggacaaggaggaguccauggagauccacgccaccggcaagcacuccgaguccaacgccgagcucggccagcucuacuggcccaacaccuccacccucaccacccgccuccgccgccucaucaccgccuaccagcgcuccuacaagcgccagcagaugcgccaggaggcccucaugaagaccgaccgccgccgccgccgcccccgcgaggagguccgcgcccucgaggccgagcgcgaggccaucaucuccgagaagcgccagaaguggacccgccgcgaggaggccgacuucuaccgcgucgucuccaccuucggcgucaucuucgaccccgucaagcagcaguucgacuggaaccaguuccgcgccuucgcccgccucgacaagaaguccgacgagucccucgagaaguacuucuccugcuucgucgccaugugccgccgcgucugccgcaugcccgucaagcccgacgacgagccccccgaccucuccuccaucaucgagcccaucaccgaggagcgcgccucccgcacccucuaccgcaucgagcuccuccgcaagauccgcgagcagguccuccaccacccccagcucggcgagcgccucaagcucugccagcccucccucgaccuccccgaguggugggagugcggccgccacgaccgcgaccuccucgucggcgccgccaagcacggcgucucccgcaccgacuaccacauccucaacgaccccgagcucuccuuccucgacgcccacaagaacuucgcccagaaccgcggcgccggcaacaccuccucccucaacccccucgccgucggcuucguccagaccccccccgucaucuccuccgcccacauccaggacgagcgcguccucgagcaggccgagggcaaggucgaggagcccgagaaccccgccgccaaggagaagugcgagggcaaggaggaggaggaggagaccgacggcuccggcaaggaguccaagcaggagugcgaggccgaggccuccuccgucaagaacgagcucaagggcgucgaggucggcgccgacaccggcuccaaguccaucuccgagaagggcuccgaggaggacgaggaggagaagcucgaggacgacgacaaguccgaggaguccucccagcccgaggccggcgccgucucccgcggcaagaacuucgacgaggaguccaacgccuccauguccaccgcccgcgacgagacccgcgacggcuucuacauggaggacggcgaccccuccgucgcccagcuccuccacgagcgcaccuucgccuucuccuucuggcccaaggaccgcgucaugaucaaccgccucgacaacaucugcgaggccguccucaagggcaaguggcccgucaaccgccgccagauguucgacuuccagggccucauccccggcuacacccccaccaccgucgacuccccccuccagaagcgcuccuucgccgagcucuccauggucggccaggccuccaucuccggcuccgaggacaucaccaccuccccccagcucuccaaggaggacgcccucaaccucuccgucccccgccagcgccgccgccgccgccgcaagaucgagaucgaggccgagcgcgccgccaagcgccgcaaccucauggagauggucgcccagcuccgcgagucccaggucgucuccgagaacggccaggagaaggucgucgaccucuccaaggccucccgcgaggccaccuccuccaccuccaacuucuccucccucuccuccaaguucauccuccccaacgucuccacccccgucuccgacgccuucaagacccagauggagcuccuccaggccggccucucccgcacccccacccgccaccuccucaacggcucccucgucgacggcgagccccccaugaagcgccgccgcggccgccgcaagaacgucgagggccucgaccuccucuucaugucccacaagcgcaccucccucuccgccgaggacgccgaggucaccaaggccuucgaggaggacaucgagaccccccccacccgcaacauccccucccccggccagcucgaccccgacacccgcauccccgucaucaaccucgaggacggcacccgccucgucggcgaggacgcccccaagaacaaggaccucgucgaguggcucaagcuccaccccaccuacaccgucgacaugcccuccuacguccccaagaacgccgacguccucuucuccuccuuccagaagcccaagcagaagcgccaccgcugccgcaaccccaacaagcucgacaucaacacccucaccggcgaggagcgcguccccgucgucaacaagcgcaacggcaagaagaugggcggcgccauggccccccccaugaaggaccucccccgcuggcucgaggagaaccccgaguucgccgucgcccccgacuggaccgacaucgucaagcaguccggcuucguccccgaguccauguucgaccgccuccucaccggccccgucguccgcggcgagggcgccucccgccgcggccgccgccccaaguccgagaucgcccgcgccgccgccgccgccgccgccgucgccuccaccuccggcaucaacccccuccucgucaacucccucuucgccggcauggaccucaccucccuccagaaccuccagaaccuccagucccuccagcucgccggccucaugggcuucccccccggccucgccaccgccgccaccgccggcggcgacgccaagaaccccgccgccguccucccccucaugcuccccggcauggccggccuccccaacgucuucggccucggcggccuccucaacaacccccucuccgccgccaccggcaacaccaccaccgccuccucccagggcgagcccgaggacuccaccuccaagggcgaggagaagggcaacgagaacgaggacgagaacaaggacuccgagaaguccaccgacgccgucuccgccgccgacuccgccaacggcuccgucggcgccgccaccgcccccgccggccuccccuccaacccccucgccuucaaccccuuccuccucuccaccauggcccccggccucuucuaccccuccauguuccucccccccggccucggcggccucacccuccccggcuuccccgcccucgccggccuccagaacgccgucggcuccuccgaggagaaggccgccgacaaggccgagggcggccccuucaaggacggcgagacccucgagggcuccgacgccgaggagucccucgacaagaccgccgaguccucccuccucgaggacgagaucgcccagggcgaggagcucgacucccucgacggcggcgacgagaucgagaacaacgagaacgacgaguga

SEQ ID NO: 41288 - RNA, 7746 nt, Artificial Sequence
  derived and/or modified sequence opt2 from CHD8__Homo_sapiens__NP_001164100
auggccgaccccaucauggaccucuucgacgaccccaaccucuucggccucgacucccucaccgacgacuccuucaaccaggucacccaggaccccaucgaggaggcccucggccuccccuccucccucgacucccucgaccagaugaaccaggacggcggcggcggcgacgucggcaacuccuccgccuccgagcucguccccccccccgaggagaccgcccccaccgagcucuccaaggaguccaccgcccccgcccccgaguccaucacccuccacgacuacaccacccagcccgccucccaggagcagcccgcccagcccguccuccagaccuccacccccaccuccggccuccuccaggucuccaagucccaggagauccucucccagggcaaccccuucaugggcgucuccgccaccgccgucuccuccuccuccgccggcggccagcccccccaguccgcccccaagaucgucauccucaaggccccccccuccuccuccgucaccggcgcccacgucgcccagauccaggcccagggcaucaccuccaccgcccagccccucgucgccggcaccgccaacggcggcaaggucaccuucaccaagguccucaccggcaccccccuccgccccggcgucuccaucgucuccggcaacaccguccucgccgccaagguccccggcaaccaggccgccguccagcgcaucguccagcccucccgccccgucaagcagcucguccuccagcccgucaagggcuccgcccccgccggcaaccccggcgccaccggccccccccucaagcccgccgucacccucaccuccacccccacccagggcgaguccaagcgcaucacccucguccuccagcagccccaguccggcggcccccagggccaccgccacgucguccucggcucccuccccggcaagaucguccuccagggcaaccagcucgccgcccucacccaggccaagaacgcccagggccagcccgccaaggucgucaccauccagcuccagguccagcagccccagcagaagauccagaucgucccccagccccccuccucccagccccagccccagcagccccccuccacccagcccgucacccucuccuccguccagcaggcccagaucaugggccccggccagucccccggccagcgccucuccguccccgucaaggucguccuccagccccaggccggcuccucccagggcgccuccuccggccucuccgucgucaagguccucuccgccuccgaggucgccgcccucuccucccccgccuccuccgccccccacuccggcggcaagaccggcauggaggagaaccgccgccucgagcaccagaagaagcaggagaaggccaaccgcaucgucgccgaggccaucgcccgcgcccgcgcccgcggcgagcagaacaucccccgcguccucaacgaggacgagcuccccuccguccgccccgaggaggagggcgagaagaagcgccgcaagaaguccgccggcgagcgccucaaggaggagaagcccaagaaguccaagaccuccggcgccuccaagaccaagggcaaguccaagcucaacaccaucacccccgucgucggcaagaagcgcaagcgcaacaccuccuccgacaacuccgacgucgaggucaugcccgcccaguccccccgcgaggacgaggaguccuccauccagaagcgccgcuccaaccgccaggucaagcgcaagaaguacaccgaggaccucgacaucaagaucaccgacgacgaggaggaggaggaggucgacgucaccggccccaucaagcccgagcccauccuccccgagcccguccaggagcccgacggcgagacccuccccuccaugcaguucuucgucgagaaccccuccgaggaggacgccgccaucgucgacaagguccucuccaugcgcaucgucaagaaggagcuccccuccggccaguacaccgaggccgaggaguucuucgucaaguacaagaacuacuccuaccuccacugcgagugggccaccaucucccagcucgagaaggacaagcgcauccaccagaagcucaagcgcuucaagaccaagauggcccagaugcgccacuucuuccacgaggacgaggagcccuucaaccccgacuacgucgaggucgaccgcauccucgacgagucccacuccaucgacaaggacaacggcgagcccgucaucuacuaccucgucaaguggugcucccuccccuacgaggacuccaccugggagcucaaggaggacgucgacgagggcaagauccgcgaguucaagcgcauccagucccgccaccccgagcucaagcgcgucaaccgcccccaggccuccgccuggaagaagcucgagcucucccacgaguacaagaaccgcaaccagcuccgcgaguaccagcucgagggcgucaacuggcuccucuucaacugguacaaccgccagaacugcauccucgccgacgagaugggccucggcaagaccauccaguccaucgccuuccuccaggaggucuacaacgucggcauccacggccccuuccucgucaucgccccccucuccaccaucaccaacugggagcgcgaguucaacaccuggaccgagaugaacaccaucgucuaccacggcucccucgccucccgccagaugauccagcaguacgagauguacugcaaggacucccgcggccgccucauccccggcgccuacaaguucgacgcccucaucaccaccuucgagaugauccucuccgacugccccgagcuccgcgagaucgaguggcgcugcgucaucaucgacgaggcccaccgccucaagaaccgcaacugcaagcuccucgacucccucaagcacauggaccucgagcacaagguccuccucaccggcaccccccuccagaacaccgucgaggagcucuucucccuccuccacuuccucgagcccucccaguuccccuccgaguccgaguuccucaaggacuucggcgaccucaagaccgaggagcagguccagaagcuccaggccauccucaagcccaugaugcuccgccgccucaaggaggacgucgagaagaaccucgcccccaagcaggagaccaucaucgaggucgagcucaccaacauccagaagaaguacuaccgcgccauccucgagaagaacuucuccuuccucuccaagggcgccggccacaccaacaugcccaaccuccucaacaccaugauggagcuccgcaagugcugcaaccaccccuaccucaucaacggcgccgaggagaagauccucaccgaguuccgcgaggccugccacaucaucccccacgacuuccaccuccaggccaugguccgcuccgccggcaagcucguccucaucgacaagcuccuccccaagcucaaggccggcggccacaagguccucaucuucucccagaugguccgcugccucgacauccucgaggacuaccucauccagcgccgcuaccucuacgagcgcaucgacggccgcguccgcggcaaccuccgccaggccgccaucgaccgcuucuccaagcccgacuccgaccgcuucgucuuccuccucugcacccgcgccggcggccucggcaucaaccucaccgccgccgacaccugcaucaucuucgacuccgacuggaacccccagaacgaccuccaggcccaggcccgcugccaccgcaucggccaguccaaggccgucaaggucuaccgccucaucacccgcaacuccuacgagcgcgagauguucgacaaggccucccucaagcucggccucgacaaggccguccuccaguccauguccggccgcgacggcaacaucaccggcauccagcaguucuccaagaaggagaucgaggaccuccuccgcaagggcgccuacgccgccaucauggaggaggacgacgagggcuccaaguucugcgaggaggacaucgaccagauccuccuccgccgcaccaccaccaucaccaucgaguccgagggcaagggcuccaccuucgccaaggccuccuucgucgccuccgagaaccgcaccgacaucucccucgacgaccccaacuucuggcagaagugggccaagaaggccgaccucgacauggaccuccucaacuccaagaacaaccucgucaucgacaccccccgcguccgcaagcagacccgccacuucuccacccucaaggacgacgaccucgucgaguucuccgaccucgaguccgaggacgacgagcgcccccgcucccgccgccacgaccgccaccacgccuacggccgcaccgacugcuuccgcgucgagaagcaccuccucgucuacggcuggggccgcuggcgcgacauccucucccacggccgcuucaagcgccgcaugaccgagcgcgacgucgagaccaucugccgcgccauccucgucuacugccuccuccacuaccgcggcgacgagaacaucaagggcuucaucugggaccucaucucccccgccgagaacggcaagaccaaggagcuccagaaccacuccggccucuccauccccgucccccgcggccgcaagggcaagaaggucaagucccaguccaccuucgacauccacaaggccgacuggauccgcaaguacaaccccgacacccucuuccaggacgaguccuacaagaagcaccucaagcaccagugcaacaagguccuccuccgcguccgcaugcucuacuaccuccgccaggaggucaucggcgaccaggccgagaagguccucggcggcgccaucgccuccgagaucgacaucugguuccccgucgucgaccagcucgagguccccaccaccuggugggacuccgaggccgacaagucccuccucaucggcgucuucaagcacggcuacgagaaguacaacaccaugcgcgccgaccccgcccucugcuuccucgagaaggccggccgccccgacgacaaggccaucgccgccgagcaccgcguccucgacaacuucuccgacaucgucgagggcgucgacuucgacaaggacugcgaggaccccgaguacaagccccuccagggcccccccaaggaccaggacgacgagggcgacccccucaugaugauggacgaggagaucuccgucaucgacggcgacgaggcccaggucacccagcagcccggccaccucuucuggccccccggcuccgcccucaccgcccgccuccgccgccucgucaccgccuaccagcgcuccuacaagcgcgagcagaugaagaucgaggccgccgagcgcggcgaccgccgccgccgccgcugcgaggccgccuucaagcucaaggagaucgcccgccgcgagaagcagcagcgcuggacccgccgcgagcagaccgacuucuaccgcgucgucuccaccuucggcgucgaguacgaccccgacaccaugcaguuccacugggaccgcuuccgcaccuucgcccgccucgacaagaagaccgacgagucccucaccaaguacuuccacggcuucgucgccaugugccgccaggucugccgccucccccccgccgccggcgacgagccccccgaccccaaccucuucaucgagcccaucaccgaggagcgcgccucccgcacccucuaccgcaucgagcuccuccgccgccuccgcgagcagguccucugccacccccuccucgaggaccgccucgcccucugccagccccccggccccgagcuccccaaguggugggagcccguccgccacgacggcgagcuccuccgcggcgccgcccgccacggcgucucccagaccgacugcaacaucaugcaggaccccgacuucuccuuccucgccgcccgcaugaacuacaugcagaaccaccaggccggcgcccccgcccccucccucucccgcugcuccaccccccuccuccaccagcaguacaccucccgcaccgccuccccccucccccuccgccccgacgcccccgucgagaagucccccgaggagaccgccacccagguccccucccucgagucccucacccucaagcucgagcacgaggucgucgcccgcucccgccccaccccccaggacuacgagaugcgcgucucccccuccgacaccaccccccucgucucccgcuccgucccccccgucaagcucgaggacgaggacgacuccgacuccgagcucgaccucuccaagcucucccccuccuccuccuccuccuccuccuccuccuccuccuccuccuccaccgacgaguccgaggacgagaaggaggagaagcucaccgaccagucccgcuccaagcucuacgacgaggagucccuccucucccucaccaugucccaggacggcuuccccaacgaggacggcgagcagaugacccccgagcuccuccuccuccaggagcgccagcgcgccuccgaguggcccaaggaccgcguccucaucaaccgcaucgaccucgucugccaggccguccucuccggcaaguggcccuccucccgccgcucccaggagauggucaccggcggcauccucggccccggcaaccaccuccucgacucccccucccucacccccggcgaguacggcgacucccccguccccaccccccgcuccuccuccgccgccuccauggccgaggaggaggccuccgccgucuccaccgccgccgcccaguucaccaagcuccgccgcggcauggacgagaaggaguucaccguccagaucaaggacgaggagggccucaagcucaccuuccagaagcacaagcucauggccaacggcgucaugggcgacggccacccccucuuccacaagaagaagggcaaccgcaagaagcucgucgagcucgaggucgagugcauggaggagcccaaccaccucgacgucgaccucgagacccgcauccccgucaucaacaaggucgacggcacccuccucgucggcgaggacgccccccgccgcgccgagcucgagauguggcuccagggccaccccgaguucgccgucgacccccgcuuccucgccuacauggaggaccgccgcaagcagaaguggcagcgcugcaagaagaacaacaaggccgagcucaacugccucggcauggagcccguccagaccgccaacucccgcaacggcaagaagggccaccacaccgagaccgucuucaaccgcguccuccccggccccaucgcccccgaguccuccaagaagcgcgcccgccgcaugcgccccgaccucuccaagaugauggcccucaugcagggcggcuccaccggcucccucucccuccacaacaccuuccagcacuccuccuccggccuccaguccgucuccucccucggccacuccuccgccaccuccgccucccuccccuucaugcccuucgucaugggcggcgcccccuccuccccccacgucgacuccuccaccaugcuccaccaccaccaccaccacccccacccccaccaccaccaccaccaccaccccggccuccgcgcccccggcuaccccuccucccccgucaccaccgccuccggcaccacccuccgccuccccccccuccagcccgaggaggacgacgacgaggacgaggaggacgacgacgaccucucccagggcuacgacuccuccgagcgcgacuucucccucaucgacgaccccaugaugcccgccaacuccgacuccuccgaggacgccgacgacuga

SEQ ID NO: 41289 - RNA, 1785 nt, Artificial Sequence
  derived and/or modified sequence opt2 from CHDH__Homo_sapiens__NP_060867
auguggugccuccuccgcggccucggccgccccggcgcccucgcccgcggcgcccucggccagcagcagucccucggcgcccgcgcccucgccuccgccggcuccgagucccgcgacgaguacuccuacgucgucgucggcgccggcuccgccggcugcguccucgccggccgccucaccgaggaccccgccgagcgcguccuccuccucgaggccggccccaaggacguccucgccggcuccaagcgccucuccuggaagauccacaugcccgccgcccucgucgccaaccucugcgacgaccgcuacaacuggugcuaccacaccgagguccagcgcggccucgacggccgcguccucuacuggccccgcggccgcgucuggggcggcuccuccucccucaacgccauggucuacguccgcggccacgccgaggacuacgagcgcuggcagcgccagggcgcccgcggcugggacuacgcccacugccuccccuacuuccgcaaggcccagggccacgagcucggcgccucccgcuaccgcggcgccgacggcccccuccgcgucucccgcggcaagaccaaccacccccuccacugcgccuuccucgaggccacccagcaggccggcuacccccucaccgaggacaugaacggcuuccagcaggagggcuucggcuggauggacaugaccauccacgagggcaagcgcugguccgccgccugcgccuaccuccaccccgcccucucccgcaccaaccucaaggccgaggccgagacccucgucucccgcguccucuucgagggcacccgcgccgucggcgucgaguacgucaagaacggccagucccaccgcgccuacgccuccaaggaggucauccucuccggcggcgccaucaacuccccccagcuccucaugcucuccggcaucggcaacgccgacgaccucaagaagcucggcauccccgucgucugccaccuccccggcgucggccagaaccuccaggaccaccucgagaucuacauccagcaggccugcacccgccccaucacccuccacuccgcccagaagccccuccgcaaggucugcaucggccucgaguggcucuggaaguucaccggcgagggcgccaccgcccaccucgagaccggcggcuucauccgcucccagcccggcgucccccaccccgacauccaguuccacuuccuccccucccaggucaucgaccacggccgcguccccacccagcaggaggccuaccagguccacgucggccccaugcgcggcaccuccgucggcuggcucaagcuccgcuccgccaacccccaggaccaccccgucauccagcccaacuaccucuccaccgagaccgacaucgaggacuuccgccucugcgucaagcucacccgcgagaucuucgcccaggaggcccucgcccccuuccgcggcaaggagcuccagcccggcucccacauccaguccgacaaggagaucgacgccuucguccgcgccaaggccgacuccgccuaccaccccuccugcaccugcaagaugggccagcccuccgaccccaccgccgucgucgacccccagacccgcguccucggcgucgagaaccuccgcgucgucgacgccuccaucaugcccuccauggucuccggcaaccucaacgcccccaccaucaugaucgccgagaaggccgccgacaucaucaagggccagcccgcccucugggacaaggacguccccgucuacaagccccgcacccucgccacccagcgcuga

SEQ ID NO: 41290 - RNA, 1329 nt, Artificial Sequence
  derived and/or modified sequence opt2 from CHEK1__Homo_sapiens__NP_001231775
auggccguccccuucgucgaggacugggaccucguccagacccucggcgagggcgccuacggcgagguccagcucgccgucaaccgcgucaccgaggaggccgucgccgucaagaucgucgacaugaagcgcgccgucgacugccccgagaacaucaagaaggagaucugcaucaacaagaugcucaaccacgagaacgucgucaaguucuacggccaccgccgcgagggcaacauccaguaccucuuccucgaguacugcuccggcggcgagcucuucgaccgcaucgagcccgacaucggcaugcccgagcccgacgcccagcgcuucuuccaccagcucauggccggcgucgucuaccuccacggcaucggcaucacccaccgcgacaucaagcccgagaaccuccuccucgacgagcgcgacaaccucaagaucuccgacuucggccucgccaccgucuuccgcuacaacaaccgcgagcgccuccucaacaagaugugcggcacccuccccuacgucgcccccgagcuccucaagcgccgcgaguuccacgccgagcccgucgacgucugguccugcggcaucguccucaccgccaugcucgccggcgagcuccccugggaccagcccuccgacuccugccaggaguacuccgacuggaaggagaagaagaccuaccucaaccccuggaagaagaucgacuccgccccccucgcccuccuccacaagauccucgucgagaaccccuccgcccgcaucaccauccccgacaucaagaaggaccgcugguacaacaagccccucaagaagggcgccaagcgcccccgcgucaccuccggcggcgucuccgagucccccuccggcuucuccaagcacauccaguccaaccucgacuucucccccgucaacuccgccuccuccgaggagaacgucaaguacuccuccucccagcccgagccccgcaccggccucucccucugggacaccucccccuccuacaucgacaagcucguccagggcaucuccuucucccagcccaccugccccgaccacaugcuccucaacucccagcuccucggcacccccggcuccucccagaaccccuggcagcgccucgucaagcgcaugacccgcuucuucaccaagcucgacgccgacaaguccuaccagugccucaaggagaccugcgagaagcucggcuaccaguggaagaaguccugcaugaaccagggcgacggccucgaguucaagcgccacuuccucaagaucaagggcaagcucaucgacaucgucuccucccagaagaucuggcuccccgccaccuga

SEQ ID NO: 41291 - RNA, 969 nt, Artificial Sequence
  derived and/or modified sequence opt2 from CHEK2__Homo_sapiens__NP_001244316
auguccaagacccucggcuccggcgccugcggcgaggucaagcucgccuucgagcgcaagaccugcaagaaggucgccaucaagaucaucuccaagcgcaaguucgccaucggcuccgcccgcgaggccgaccccgcccucaacgucgagaccgagaucgagauccucaagaagcucaaccaccccugcaucaucaagaucaagaacuucuucgacgccgaggacuacuacaucguccucgagcucauggagggcggcgagcucuucgacaaggucgucggcaacaagcgccucaaggaggccaccugcaagcucuacuucuaccagaugcuccucgccguccaguaccuccacgagaacggcaucauccaccgcgaccucaagcccgagaacguccuccucuccucccaggaggaggacugccucaucaagaucaccgacuucggccacuccaagauccucggcgagaccucccucaugcgcacccucugcggcacccccaccuaccucgcccccgagguccucgucuccgucggcaccgccggcuacaaccgcgccgucgacugcuggucccucggcgucauccucuucaucugccucuccggcuacccccccuucuccgagcaccgcacccaggucucccucaaggaccagaucaccuccggcaaguacaacuucauccccgaggucugggccgaggucuccgagaaggcccucgaccucgucaagaagcuccucgucgucgaccccaaggcccgcuucaccaccgaggaggcccuccgccaccccuggcuccaggacgaggacaugaagcgcaaguuccaggaccuccucuccgaggagaacgaguccaccgcccucccccagguccucgcccagcccuccaccucccgcaagcgcccccgcgagggcgaggccgagggcgccgagaccaccaagcgccccgccgucugcgccgccguccucuga

SEQ ID NO: 41292 - RNA, 2751 nt, Artificial Sequence
  derived and/or modified sequence opt2 from CHERP__Homo_sapiens__NP_006378
auggagaugccccucccccccgacgaccaggagcuccgcaacgucaucgacaagcucgcccaguucgucgcccgcaacggccccgaguucgagaagaugaccauggagaagcagaaggacaaccccaaguucuccuuccucuucggcggcgaguucuacuccuacuacaagugcaagcucgcccucgagcagcagcagcucaucugcaagcagcagacccccgagcucgagcccgccgccaccaugcccccccucccccagcccccccucgcccccgccgcccccaucccccccgcccagggcgcccccuccauggacgagcucauccagcagucccaguggaaccuccagcagcaggagcagcaccuccucgcccuccgccaggagcaggucaccgccgccgucgcccacgccgucgagcagcagaugcagaagcuccucgaggagacccagcucgacaugaacgaguucgacaaccuccuccagcccaucaucgacaccugcaccaaggacgccaucuccgccggcaagaacuggauguucuccaacgccaagucccccccccacugcgagcucauggccggccaccuccgcaaccgcaucaccgccgacggcgcccacuucgagcuccgccuccaccucaucuaccucaucaacgacguccuccaccacugccagcgcaagcaggcccgcgagcuccucgccgcccuccagaaggucgucguccccaucuacugcaccuccuuccucgccgucgaggaggacaagcagcagaagaucgcccgccuccuccagcucugggagaagaacggcuacuucgacgacuccaucauccagcagcuccagucccccgcccucggccucggccaguaccaggccacccucaucaacgaguacuccuccgucguccagcccguccagcucgccuuccagcagcagauccagacccucaagacccagcacgaggaguucgucaccucccucgcccagcagcagcagcagcagcagcagcagcagcagcagcuccagaugccccagauggaggccgaggucaaggccaccccccccccccccgcccccccccccgcccccgcccccgcccccgccaucccccccaccacccagcccgacgacuccaagccccccauccagaugcccggcuccuccgaguacgaggcccccggcggcguccaggaccccgccgccgccggcccccgcggccccggcccccacgaccagaucccccccaacaagccccccugguucgaccagccccaccccgucgcccccuggggccagcagcagccccccgagcagccccccuacccccaccaccagggcggccccccccacugcccccccuggaacaacucccacgagggcauguggggcgagcagcgcggcgaccccggcuggaacggccagcgcgacgcccccuggaacaaccagcccgacgccgccuggaacucccaguucgagggccccuggaacucccagcacgagcagccccccuggggcggcggccagcgcgagccccccuuccgcaugcagcgccccccccacuuccgcggccccuuccccccccaccagcagcacccccaguucaaccagcccccccacccccacaacuucaaccgcuuccccccccgcuucaugcaggacgacuuccccccccgccaccccuucgagcgcccccccuacccccaccgcuucgacuacccccagggcgacuuccccgccgagaugggccccccccaccaccaccccggccaccgcaugccccaccccggcaucaacgagcacccccccugggccggcccccagcaccccgacuucggcccccccccccacggcuucaacggccagcccccccacaugcgccgccagggccccccccacaucaaccacgacgaccccucccucguccccaacguccccuacuucgaccuccccgccggccucauggccccccucgucaagcucgaggaccacgaguacaagccccucgaccccaaggacauccgccuccccccccccaugccccccuccgagcgccuccucgccgccgucgaggccuucuacuccccccccucccacgaccgcccccgcaacuccgagggcugggagcagaacggccucuacgaguucuuccgcgccaagaugcgcgcccgccgccgcaagggccaggagaagcgcaacuccggccccucccgcucccgcucccgcuccaagucccgcggccgcuccuccucccgcuccaacucccgcuccuccaaguccuccggcuccuacucccgcucccgcucccgcuccugcucccgcuccuacucccgcucccgcucccgcucccgcucccgcucccgcuccucccgcucccgcucccgcucccagucccgcucccgcuccaaguccuacucccccggccgccgccgccgcucccgcucccgcucccccaccccccccuccuccgccggccucggcuccaacuccgccccccccauccccgacucccgccucggcgaggagaacaagggccaccagaugcucgucaagaugggcugguccggcuccggcggccucggcgccaaggagcagggcauccaggaccccaucaagggcggcgacguccgcgacaagugggaccaguacaagggcgucggcgucgcccucgacgaccccuacgagaacuaccgccgcaacaaguccuacuccuucaucgcccgcaugaaggcccgcgacgagugcaaguga

SEQ ID NO: 41293 - RNA, 1995 nt, Artificial Sequence
  derived and/or modified sequence opt2 from CHFR__Homo_sapiens__NP_001154816
auggagcgccccgaggagggcaagcaguccccccccccccagcccuggggccgccuccuccgccucggcgccgaggagggcgagccccacguccuccuccgcaagcgcgaguggaccaucggccgccgccgcggcugcgaccucuccuuccccuccaacaagcucgucuccggcgaccacugccgcaucgucgucgacgagaaguccggccaggucacccucgaggacaccuccaccuccggcaccgucaucaacaagcucaaggucgucaagaagcagaccugcccccuccagaccggcgacgucaucuaccucgucuaccgcaagaacgagcccgagcacaacgucgccuaccucuacgagucccucuccgagaagcagggcaugacccaggaguccuucgaggccaacaaggagaacgucuuccacggcaccaaggacaccuccggcgccggcgccggccgcggcgccgacccccgcgucccccccuccucccccgccacccaggucugcuucgaggagccccagcccuccaccuccaccuccgaccucuuccccaccgccuccgccuccuccaccgagcccucccccgccggccgcgagcgcuccuccuccugcggcuccggcggcggcggcaucucccccaagggcuccggccccuccgucgccuccgacgaggucuccuccuucgccuccgcccuccccgaccgcaagaccgccuccuucuccucccucgagccccaggaccaggaggaccucgagcccgucaagaagaagaugcgcggcgacggcgaccucgaccucaacggccagcuccucgucgcccagccccgccgcaacgcccagaccguccacgaggacguccgcgccgccgccggcaagcccgacaagauggaggagacccucaccugcaucaucugccaggaccuccuccacgacugcgucucccuccagcccugcaugcacaccuucugcgccgccugcuacuccggcuggauggagcgcuccucccucugccccaccugccgcugccccgucgagcgcaucugcaagaaccacauccucaacaaccucgucgaggccuaccucauccagcaccccgacaagucccgcuccgaggaggacguccaguccauggacgcccgcaacaagaucacccaggacaugcuccagcccaagguccgccgcuccuucuccgacgaggagggcuccuccgaggaccuccucgagcucuccgacgucgacuccgaguccuccgacaucucccagcccuacgucgucugccgccagugccccgaguaccgccgccaggccgcccagcccccccacugccccgcccccgagggcgagcccggcgccccccaggcccucggcgacgcccccuccaccuccgucucccucaccaccgccguccaggacuacgucugcccccuccagggcucccacgcccucugcaccugcugcuuccagcccaugcccgaccgccgcgccgagcgcgagcaggacccccgcgucgccccccagcagugcgccgucugccuccagcccuucugccaccucuacuggggcugcacccgcaccggcugcuacggcugccucgcccccuucugcgagcucaaccucggcgacaagugccucgacggcguccucaacaacaacuccuacgaguccgacauccucaagaacuaccucgccacccgcggccucaccuggaagaacaugcucaccgagucccucgucgcccuccagcgcggcgucuuccuccucuccgacuaccgcgucaccggcgacaccguccucugcuacugcugcggccuccgcuccuuccgcgagcucaccuaccaguaccgccagaacauccccgccuccgagcuccccgucgccgucaccucccgccccgacugcuacuggggccgcaacugccgcacccaggucaaggcccaccacgccaugaaguucaaccacaucugcgagcagacccgcuucaagaacuga

SEQ ID NO: 41294 - RNA, 921 nt, Artificial Sequence
  derived and/or modified sequence opt2 from CHGA__Homo_sapiens__NP_001288619
augcgcuccgccgccguccucgcccuccuccucugcgccggccaggucaccgcccuccccgucaacucccccaugaacaagggcgacaccgaggucaugaagugcaucgucgaggucaucuccgacacccucuccaagcccucccccaugcccgucucccaggagugcuucgagacccuccgcggcgacgagcgcauccucuccauccuccgccaccagaaccuccucaaggagcuccaggaccucgcccuccagggcgccaaggagcgcgcccaccagcagaagaagcacuccggcuucgaggacgagcucuccgagguccucgagaaccaguccucccaggccgagcucaagggccgcuccgaggcccucgccgucgacggcgccggcaagcccggcgccgaggaggcccaggaccccgagggcaagggcgagcaggagcacucccagcagaaggaggaggaggaggagauggccgucgucccccagggccucuuccgcggcggcaaguccggcgagcucgagcaggaggaggagcgccucuccaaggagugggaggacuccaagcgcugguccaagauggaccagcucgccaaggagcucaccgccgagaagcgccucgagggccaggaggaggaggaggacaaccgcgacuccuccaugaagcucuccuuccgcgcccgcgccuacggcuuccgcggccccggcccccagcuccgccgcggcuggcgccccuccucccgcgaggacucccucgaggccggccucccccuccagguccgcggcuaccccgaggagaagaaggaggaggagggcuccgccaaccgccgccccgaggaccaggagcucgagucccucuccgccaucgaggccgagcucgagaaggucgcccaccagcuccaggcccuccgccgcggcuga

SEQ ID NO: 41295 - RNA, 2034 nt, Artificial Sequence
  derived and/or modified sequence opt2 from CHGB__Homo_sapiens__NP_001810
augcagcccacccuccuccucucccuccucggcgccgucggccucgccgccgucaacuccaugcccgucgacaaccgcaaccacaacgagggcauggucacccgcugcaucaucgagguccucuccaacgcccucuccaaguccuccgccccccccaucacccccgagugccgccagguccucaagaccucccgcaaggacgucaaggacaaggagaccaccgagaacgagaacaccaaguucgagguccgccuccuccgcgaccccgccgacgccuccgaggcccacgaguccuccucccgcggcgaggccggcgcccccggcgaggaggacauccagggccccaccaaggccgacaccgagaagugggccgagggcggcggccacucccgcgagcgcgccgacgagccccaguggucccucuaccccuccgacucccaggucuccgaggaggucaagacccgccacuccgagaagucccagcgcgaggacgaggaggaggaggagggcgagaacuaccagaagggcgagcgcggcgaggacuccuccgaggagaagcaccucgaggagcccggcgagacccagaacgccuuccucaacgagcgcaagcaggccuccgccaucaagaaggaggagcucgucgcccgcuccgagacccacgccgccggccacucccaggagaagacccacucccgcgagaaguccucccaggaguccggcgaggagaccggcucccaggagaaccacccccaggaguccaagggccagccccgcucccaggaggaguccgaggagggcgaggaggacgccaccuccgaggucgacaagcgccgcacccgcccccgccaccaccacggccgcucccgccccgaccgcuccucccagggcggcucccuccccuccgaggagaagggccacccccaggaggaguccgaggaguccaacgucuccauggccucccucggcgagaagcgcgaccaccacuccacccacuaccgcgccuccgaggaggagcccgaguacggcgaggagaucaagggcuaccccggcguccaggcccccgaggaccucgagugggagcgcuaccgcggccgcggcuccgaggaguaccgcgccccccgcccccaguccgaggaguccugggacgaggaggacaagcgcaacuaccccucccucgagcucgacaagauggcccacggcuacggcgaggaguccgaggaggagcgcggccucgagcccggcaagggccgccaccaccgcggccgcggcggcgagccccgcgccuacuucauguccgacacccgcgaggagaagcgcuuccucggcgagggccaccaccgcguccaggagaaccagauggacaaggcccgccgccacccccagggcgccuggaaggagcucgaccgcaacuaccucaacuacggcgaggagggcgcccccggcaaguggcagcagcagggcgaccuccaggacaccaaggagaaccgcgaggaggcccgcuuccaggacaagcaguacuccucccaccacaccgccgagaagcgcaagcgccucggcgagcucuucaaccccuacuacgacccccuccaguggaaguccucccacuucgagcgccgcgacaacaugaacgacaacuuccucgagggcgaggaggagaacgagcucacccucaacgagaagaacuucuuccccgaguacaacuacgacuggugggagaagaagcccuucuccgaggacgucaacuggggcuacgagaagcgcaaccucgcccgcguccccaagcucgaccucaagcgccaguacgaccgcgucgcccagcucgaccagcuccuccacuaccgcaagaaguccgccgaguuccccgacuucuacgacuccgaggagcccgucuccacccaccaggaggccgagaacgagaaggaccgcgccgaccagaccguccucaccgaggacgagaagaaggagcucgagaaccucgccgccauggaccucgagcuccagaagaucgccgagaaguucucccagcgcggcuga

SEQ ID NO: 41296 - RNA, 987 nt, Artificial Sequence
  derived and/or modified sequence opt2 from CHI3L1__Homo_sapiens__XP_011507410
augggcgucaaggccucccagaccggcuucgucguccucguccuccuccagugcugcuccgccuacaagcucgucugcuacuacaccuccuggucccaguaccgcgagggcgacggcuccugcuuccccgacgcccucgaccgcuuccucugcacccacaucaucuacuccuucgccaacaucuccaacgaccacaucgacaccugggaguggaacgacgucacccucuacggcaugcucaacacccucaagaaccgcaaccccaaccucaagacccuccucuccgucggcggcuggaacuucggcucccagcgcgccgacuucggcccccgcuucuccaagaucgccuccaacacccagucccgccgcaccuucaucaaguccgucccccccuuccuccgcacccacggcuucgacggccucgaccucgccuggcucuaccccggccgccgcgacaagcagcacuucaccacccucaucaaggagaugaaggccgaguucaucaaggaggcccagcccggcaagaagcagcuccuccucuccgccgcccucuccgccggcaaggucaccaucgacuccuccuacgacaucgccaagaucucccagcaccucgacuucaucuccaucaugaccuacgacuuccacggcgccuggcgcggcaccaccggccaccacuccccccucuuccgcggccaggaggacgccucccccgaccgcuucuccaacaccaucugcgacuuccuccgcggcgccaccguccaccgcauccucggccagcagguccccuacgccaccaagggcaaccagugggucggcuacgacgaccaggaguccgucaaguccaagguccaguaccucaaggaccgccagcucgccggcgccauggucugggcccucgaccucgacgacuuccagggcuccuucugcggccaggaccuccgcuucccccucaccaacgccaucaaggacgcccucgccgccaccuga

SEQ ID NO: 41297 - RNA, 675 nt, Artificial Sequence
  derived and/or modified sequence opt2 from CHIC1__Homo_sapiens__NP_001034929
auguccauccuccuccccaacauggccgaguucgacaccaucuccgagcucgaggaggaggaggaggaggaggccgccaccuccuccuccucccccuccuccuccuccuccgucuccggccccgacgacgacgaggaggacgaggaggaggaggaggaggaggaggaggaggaggaggaggaggaggaggaggaggaggaggaggcccccccccccccccgcgucgucuccgaggagcaccuccgccgcuacgcccccgaccccguccucguccgcggcgccggccacaucaccgucuucggccucuccaacaaguucgacaccgaguuccccuccguccucaccggcaaggucgcccccgaggaguucaagaccuccaucggccgcgucaacgccugccucaagaaggcccuccccgucaacgucaaguggcuccucugcggcugccucugcugcugcugcacccucggcugcucccucuggcccgucaucugccucaacaagcgcacccgccgcuccauccagaagcucaucgagugggagaacaaccgccucuaccacaagcucgcccuccacuggaagcucaccaagcgcaagugcgagaccuccaacaugauggaguacgucauccucaucgaguuccuccccaaguaccccaucuuccgccccgacuga

SEQ ID NO: 41298 - RNA, 498 nt, Artificial Sequence
  derived and/or modified sequence opt2 from CHIC2__Homo_sapiens__NP_036242
auggccgacuucgacgagaucuacgaggaggaggaggacgaggagcgcgcccucgaggagcagcuccucaaguacucccccgaccccgucgucguccgcggcuccggccacgucaccgucuucggccucuccaacaaguucgaguccgaguuccccuccucccucaccggcaaggucgcccccgaggaguucaaggccuccaucaaccgcgucaacuccugccucaagaagaaccuccccgucaacguccgcuggcuccucugcggcugccucugcugcugcugcacccucggcugcuccauguggcccgucaucugccucuccaagcgcacccgccgcuccaucgagaagcuccucgagugggagaacaaccgccucuaccacaagcucugccuccacuggcgccucuccaagcgcaagugcgagaccaacaacaugauggaguacgucauccucaucgaguuccuccccaagacccccaucuuccgccccgacuga

SEQ ID NO: 41299 - RNA, 1344 nt, Artificial Sequence
  derived and/or modified sequence opt2 from CHIT1__Homo_sapiens__NP_001243054
augguccgcuccgucgccugggccggcuucaugguccuccucaugauccccuggggcuccgccgccaagcucgucugcuacuucaccaacugggcccaguaccgccagggcgaggcccgcuuccuccccaaggaccucgaccccucccucugcacccaccucaucuacgccuucgccggcaugaccaaccaccagcucuccaccaccgaguggaacgacgagacccucuaccaggaguucaacggccucaagaagauguucaccgacauggucgccaccgccaacaaccgccagaccuucgucaacuccgccauccgcuuccuccgcaaguacuccuucgacggccucgaccucgacugggaguaccccggcucccagggcucccccgccgucgacaaggagcgcuucaccacccucguccaggaccucgccaacgccuuccagcaggaggcccagaccuccggcaaggagcgccuccuccucuccgccgccguccccgccggccagaccuacgucgacgccggcuacgaggucgacaagaucgcccagaaccucgacuucgucaaccucauggccuacgacuuccacggcuccugggagaaggucaccggccacaacuccccccucuacaagcgccaggaggaguccggcgccgccgccucccucaacgucgacgccgccguccagcaguggcuccagaagggcacccccgccuccaagcucauccucggcaugcccaccuacggccgcuccuucacccucgccuccuccuccgacacccgcgucggcgcccccgccaccggcuccggcacccccggccccuucaccaaggagggcggcaugcucgccuacuacgaggucugcuccuggaagggcgccaccaagcagcgcauccaggaccagaagguccccuacaucuuccgcgacaaccagugggucggcuucgacgacgucgaguccuucaagaccaaggucuccuaccucaagcagaagggccucggcggcgccauggucugggcccucgaccucgacgacuucgccggcuucuccugcaaccagggccgcuacccccucauccagacccuccgccaggagcucucccuccccuaccuccccuccggcacccccgagcucgagguccccaagcccggccagcccuccgagcccgagcacggccccucccccggccaggacaccuucugccagggcaaggccgacggccucuaccccaacccccgcgagcgcuccuccuucuacuccugcgccgccggccgccucuuccagcaguccugccccaccggccucgucuucuccaacuccugcaagugcugcaccuggaacuga

SEQ ID NO: 41300 - RNA, 1320 nt, Artificial Sequence
  derived and/or modified sequence opt2 from CHKA__Homo_sapiens__NP_997634
augaagaccaaguucugcaccggcggcgaggccgagcccuccccccucggccuccuccucuccugcggcuccggcuccgccgcccccgcccccggcgucggccagcagcgcgacgccgccuccgaccucgaguccaagcagcucggcggccagcagcccccccucgcccucccccccccccccccccucccccucccccucccccucccccagcccccccccccccagccccccgccgacgagcagcccgagccccgcacccgccgccgcgccuaccucuggugcaaggaguuccuccccggcgccuggcgcggccuccgcgaggacgaguuccacaucuccgucauccgcggcggccucuccaacaugcucuuccagugcucccuccccgacaccaccgccacccucggcgacgagccccgcaagguccuccuccgccucuacggcgccauccuccagaugggcgccgaggccaugguccucgaguccgucauguucgccauccucgccgagcgcucccucggccccaagcucuacggcaucuucccccagggccgccucgagcaguucauccccucccgccgccucgacaccgaggagcucucccuccccgacaucuccgccgagaucgccgagaagauggccaccuuccacggcaugaagaugcccuucaacaaggagcccaaguggcucuucggcaccauggagaaguaccucaaggagguccuccgcaucaaguucaccgaggagucccgcaucaagaagcuccacaagcuccucuccuacaaccucccccucgagcucgagaaccuccgcucccuccucgaguccacccccucccccgucgucuucugccacaacgacugccaggagggcaacauccuccuccucgagggccgcgagaacuccgagaagcagaagcucaugcucaucgacuucgaguacuccuccuacaacuaccgcggcuucgacaucggcaaccacuucugcgaguggauguacgacuacuccuacgagaaguaccccuucuuccgcgccaacauccgcaaguaccccaccaagaagcagcagcuccacuucaucuccuccuaccuccccgccuuccagaacgacuucgagaaccucuccaccgaggagaaguccaucaucaaggaggagaugcuccucgaggucaaccgcuucgcccucgccucccacuuccucuggggccucugguccaucguccaggccaagaucuccuccaucgaguucggcuacauggacuacgcccaggcccgcuucgacgccuacuuccaccagaagcgcaagcucggcgucuga

SEQ ID NO: 41301 - RNA, 1188 nt, Artificial Sequence
  derived and/or modified sequence opt2 from CHKB__Homo_sapiens__NP_005189
auggccgccgaggccaccgccgucgccggcuccggcgccgucggcggcugccucgccaaggacggccuccagcaguccaagugccccgacaccacccccaagcgccgccgcgccuccucccucucccgcgacgccgagcgccgcgccuaccaguggugccgcgaguaccucggcggcgccuggcgccgcguccagcccgaggagcuccgcgucuaccccgucuccggcggccucuccaaccuccucuuccgcugcucccuccccgaccaccuccccuccgucggcgaggagccccgcgagguccuccuccgccucuacggcgccauccuccagggcgucgacucccucguccucgaguccgucauguucgccauccucgccgagcgcucccucggcccccagcucuacggcgucuuccccgagggccgccucgagcaguacauccccucccgcccccucaagacccaggagcuccgcgagcccguccucuccgccgccaucgccaccaagauggcccaguuccacggcauggagaugcccuucaccaaggagccccacuggcucuucggcaccauggagcgcuaccucaagcagauccaggaccucccccccaccggccuccccgagaugaaccuccucgagauguacucccucaaggacgagaugggcaaccuccgcaagcuccucgaguccacccccucccccgucgucuucugccacaacgacauccaggagggcaacauccuccuccucuccgagcccgagaacgccgacucccucaugcucgucgacuucgaguacuccuccuacaacuaccgcggcuucgacaucggcaaccacuucugcgagugggucuacgacuacacccacgaggaguggcccuucuacaaggcccgccccaccgacuaccccacccaggagcagcagcuccacuucauccgccacuaccucgccgaggccaagaagggcgagacccucucccaggaggagcagcgcaagcucgaggaggaccuccucgucgaggucucccgcuacgcccucgccucccacuucuucuggggccucugguccauccuccaggccuccauguccaccaucgaguucggcuaccucgacuacgcccagucccgcuuccaguucuacuuccagcagaagggccagcucaccuccguccacuccuccuccuga

SEQ ID NO: 41302 - RNA, 3516 nt, Artificial Sequence
  derived and/or modified sequence opt2 from CHL1__Homo_sapiens__NP_001240317
auggagccccuccuccucggccgcggccucaucgucuaccucauguuccuccuccucaaguucuccaaggccaucgagauccccuccuccguccagcagguccccaccaucaucaagcaguccaagguccaggucgccuuccccuucgacgaguacuuccagaucgagugcgaggccaagggcaaccccgagcccaccuucuccuggaccaaggacggcaaccccuucuacuucaccgaccaccgcaucauccccuccaacaacuccggcaccuuccgcauccccaacgagggccacaucucccacuuccagggcaaguaccgcugcuucgccuccaacaagcucggcaucgccauguccgaggagaucgaguucaucguccccuccguccccaaguuccccaaggagaagaucgacccccucgaggucgaggagggcgaccccaucguccuccccugcaacccccccaagggccuccccccccuccacaucuacuggaugaacaucgagcucgagcacaucgagcaggacgagcgcgucuacaugucccagaagggcgaccucuacuucgccaacgucgaggagaaggacucccgcaacgacuacugcugcuucgccgccuucccccgccuccgcaccaucguccagaagaugcccaugaagcucaccgucaacucccucaagcacgccaacgacuccuccuccuccaccgagaucggcuccaaggccaacuccaucaagcagcgcaagcccaagcuccuccucccccccaccgaguccggcuccgaguccuccaucaccauccucaagggcgagauccuccuccucgagugcuucgccgagggccuccccaccccccaggucgacuggaacaagaucggcggcgaccuccccaagggccgcgagaccaaggagaacuacggcaagacccucaagaucgagaacgucuccuaccaggacaagggcaacuaccgcugcaccgccuccaacuuccucggcaccgccacccacgacuuccacgucaucgucgaggagcccccccgcuggaccaagaagccccaguccgccgucuacuccaccggcuccaacggcauccuccucugcgaggccgagggcgagccccagcccaccaucaaguggcgcgucaacggcucccccgucgacaaccaccccuucgccggcgacgucgucuucccccgcgagaucuccuucaccaaccuccagcccaaccacaccgccgucuaccagugcgaggccuccaacguccacggcaccauccucgccaacgccaacaucgacgucgucgacguccgcccccucauccagaccaaggacggcgagaacuacgccaccgucgucggcuacuccgccuuccuccacugcgaguucuucgccucccccgaggccgucgucuccuggcagaaggucgaggaggucaagccccucgagggccgccgcuaccacaucuacgagaacggcacccuccagaucaaccgcaccaccgaggaggacgccggcuccuacuccugcugggucgagaacgccaucggcaagaccgccgucaccgccaaccucgacauccgcaacgccaccaagcuccgcgucucccccaagaacccccgcauccccaagcuccacaugcucgagcuccacugcgaguccaagugcgacucccaccucaagcacucccucaagcucuccugguccaaggacggcgaggccuucgagaucaacggcaccgaggacggccgcaucaucaucgacggcgccaaccucaccaucuccaacgucacccucgaggaccagggcaucuacugcugcuccgcccacaccgcccucgacuccgccgccgacaucacccaggucaccguccucgacguccccgacccccccgagaaccuccaccucuccgagcgccagaaccgcuccguccgccucaccugggaggccggcgccgaccacaacuccaacaucuccgaguacaucgucgaguucgagggcaacaaggaggagcccggccgcugggaggagcucacccgcguccagggcaagaagaccaccgucauccucccccucgcccccuucguccgcuaccaguuccgcgucaucgccgucaacgaggucggccgcucccagcccucccagcccuccgaccaccacgagaccccccccgccgcccccgaccgcaacccccagaacauccgcguccaggccucccagcccaaggagaugaucaucaagugggagccccucaaguccauggagcagaacggccccggccucgaguaccgcgucaccuggaagccccagggcgcccccgucgagugggaggaggagaccgucaccaaccacacccuccgcgucaugacccccgccgucuacgcccccuacgacgucaagguccaggccaucaaccagcucggcuccggccccgacccccaguccgucacccucuacuccggcgaggacuaccccgacaccgcccccgucauccacggcgucgacgucaucaacuccacccucgucaaggucaccugguccaccguccccaaggaccgcguccacggccgccucaagggcuaccagaucaacugguggaagaccaagucccuccucgacggccgcacccaccccaaggaggucaacauccuccgcuucuccggccagcgcaacuccggcaugguccccucccucgacgccuucuccgaguuccaccucaccguccucgccuacaacuccaagggcgccggccccgaguccgagcccuacaucuuccagacccccgagggcguccccgagcagcccaccuuccucaaggucaucaaggucgacaaggacaccgccacccucuccuggggccuccccaagaagcucaacggcaaccucaccggcuaccuccuccaguaccagaucaucaacgacaccuacgagaucggcgagcucaacgacaucaacaucaccacccccuccaagcccuccuggcaccucuccaaccucaacgccaccaccaaguacaaguucuaccuccgcgccugcaccucccagggcugcggcaagcccaucaccgaggaguccuccacccucggcgagggcaaguacgccggccucuacgacgacaucuccacccagggcugguucaucggccucaugugcgccaucgcccuccucacccuccuccuccucaccgucugcuucgucaagcgcaaccgcggcggcaaguacuccgucaaggagaaggaggaccuccaccccgaccccgagauccaguccgucaaggacgagaccuucggcgaguacuccgacuccgacgagaagccccucaagggcucccuccgcucccucaaccgcgacaugcagcccaccgaguccgccgacucccucgucgaguacggcgagggcgaccacggccucuucuccgaggacggcuccuucaucggcgccuacgccggcuccaaggagaagggcuccgucgaguccaacggcuccuccaccgccaccuucccccuccgcgccuga

SEQ ID NO: 41303 - RNA, 1962 nt, Artificial Sequence
  derived and/or modified sequence opt2 from CHM__Homo_sapiens__NP_000381
auggccgacacccuccccuccgaguucgacgucaucgucaucggcaccggccuccccgaguccaucaucgccgccgccugcucccgcuccggccgccgcguccuccacgucgacucccgcuccuacuacggcggcaacugggccuccuucuccuucuccggccuccucuccuggcucaaggaguaccaggagaacuccgacaucgucuccgacucccccgucuggcaggaccagauccucgagaacgaggaggccaucgcccucucccgcaaggacaagaccauccagcacgucgaggucuucugcuacgccucccaggaccuccacgaggacgucgaggaggccggcgcccuccagaagaaccacgcccucgucaccuccgccaacuccaccgaggccgccgacuccgccuuccuccccaccgaggacgagucccucuccaccauguccugcgagaugcucaccgagcagacccccuccuccgaccccgagaacgcccucgaggucaacggcgccgaggucaccggcgagaaggagaaccacugcgacgacaagaccugcguccccuccaccuccgccgaggacauguccgagaacguccccaucgccgaggacaccaccgagcagcccaagaagaaccgcaucaccuacucccagaucaucaaggagggccgccgcuucaacaucgaccucgucuccaagcuccucuacucccgcggccuccucaucgaccuccucaucaaguccaacgucucccgcuacgccgaguucaagaacaucacccgcauccucgccuuccgcgagggccgcgucgagcagguccccugcucccgcgccgacgucuucaacuccaagcagcucaccauggucgagaagcgcaugcucaugaaguuccucaccuucugcauggaguacgagaaguaccccgacgaguacaagggcuacgaggagaucaccuucuacgaguaccucaagacccagaagcucacccccaaccuccaguacaucgucaugcacuccaucgccaugaccuccgagaccgccuccuccaccaucgacggccucaaggccaccaagaacuuccuccacugccucggccgcuacggcaacacccccuuccucuucccccucuacggccagggcgagcucccccagugcuucugccgcaugugcgccgucuucggcggcaucuacugccuccgccacuccguccagugccucgucgucgacaaggagucccgcaagugcaaggccaucaucgaccaguucggccagcgcaucaucuccgagcacuuccucgucgaggacuccuacuuccccgagaacaugugcucccgcguccaguaccgccagaucucccgcgccguccucaucaccgaccgcuccguccucaagaccgacuccgaccagcagaucuccauccucaccguccccgccgaggagcccggcaccuucgccguccgcgucaucgagcucugcuccuccaccaugaccugcaugaagggcaccuaccucguccaccucaccugcaccuccuccaagaccgcccgcgaggaccucgaguccgucguccagaagcucuucguccccuacaccgagauggagaucgagaacgagcaggucgagaagccccgcauccucugggcccucuacuucaacaugcgcgacuccuccgacaucucccgcuccugcuacaacgaccuccccuccaacgucuacgucugcuccggccccgacugcggccucggcaacgacaacgccgucaagcaggccgagacccucuuccaggagaucugccccaacgaggacuucugcccccccccccccaaccccgaggacaucauccucgacggcgacucccuccagcccgaggccuccgaguccuccgccauccccgaggccaacuccgagaccuucaaggaguccaccaaccucggcaaccucgaggaguccuccgaguga

SEQ ID NO: 41304 - RNA, 1971 nt, Artificial Sequence
  derived and/or modified sequence opt2 from CHML__Homo_sapiens__NP_001812
auggccgacaaccuccccaccgaguucgacgucgucaucaucggcaccggccuccccgaguccauccucgccgccgccugcucccgcuccggccagcgcguccuccacaucgacucccgcuccuacuacggcggcaacugggccuccuucuccuucuccggccuccucuccuggcucaaggaguaccagcagaacaacgacaucggcgaggaguccaccgucgucuggcaggaccucauccacgagaccgaggaggccaucacccuccgcaagaaggacgagaccauccagcacaccgaggccuucugcuacgccucccaggacauggaggacaacgucgaggagaucggcgcccuccagaagaaccccucccucggcgucuccaacaccuucaccgagguccucgacuccgcccuccccgaggagucccagcucuccuacuucaacuccgacgagaugcccgccaagcacacccagaaguccgacaccgagaucucccucgaggucaccgacgucgaggaguccgucgagaaggagaaguacugcggcgacaagaccugcaugcacaccgucuccgacaaggacggcgacaaggacgaguccaaguccaccgucgaggacaaggccgacgagcccauccgcaaccgcaucaccuacucccagaucgucaaggagggccgccgcuucaacaucgaccucgucuccaagcuccucuacucccagggccuccucaucgaccuccucaucaaguccgacgucucccgcuacgucgaguucaagaacgucacccgcauccucgccuuccgcgagggcaaggucgagcagguccccugcucccgcgccgacgucuucaacuccaaggagcucaccauggucgagaagcgcaugcucaugaaguuccucaccuucugccucgaguacgagcagcaccccgacgaguaccaggccuuccgccagugcuccuucuccgaguaccucaagaccaagaagcucacccccaaccuccagcacuucguccuccacuccaucgccaugaccuccgaguccuccugcaccaccaucgacggccucaacgccaccaagaacuuccuccagugccucggccgcuucggcaacacccccuuccucuucccccucuacggccagggcgagaucccccagggcuucugccgcaugugcgccgucuucggcggcaucuacugccuccgccacaagguccagugcuucgucgucgacaaggaguccggccgcugcaaggccaucaucgaccacuucggccagcgcaucaacgccaaguacuucaucgucgaggacuccuaccucuccgaggagaccugcuccaacguccaguacaagcagaucucccgcgccguccucaucaccgaccaguccauccucaagaccgaccucgaccagcagaccuccauccucaucgucccccccgccgagcccggcgccugcgccguccgcgucaccgagcucugcuccuccaccaugaccugcaugaaggacaccuaccucguccaccucaccugcuccuccuccaagaccgcccgcgaggaccucgaguccgucgucaagaagcucuucacccccuacaccgagaccgagaucaacgaggaggagcucaccaagccccgccuccucugggcccucuacuucaacaugcgcgacuccuccggcaucucccgcuccuccuacaacggccuccccuccaacgucuacgucugcuccggccccgacugcggccucggcaacgagcacgccgucaagcaggccgagacccucuuccaggagaucuuccccaccgaggaguucugcccccccccccccaaccccgaggacaucaucuucgacggcgacgacaagcagcccgaggcccccggcaccaacaacgucgucauggccaagcucgaguccuccgaggaguccaagaaccucgagucccccgagaagcaccuccagaacuga

SEQ ID NO: 41305 - RNA, 723 nt, Artificial Sequence
  derived and/or modified sequence opt2 from CHMP1A__Homo_sapiens__NP_001076783
auggacguccacggcgaggccgccggcgaggccggccaggagggcggcgagggccuccagggcggcgccggccaguccgaggagggccccuccgccgagaagugccgcgucugccccugcgucugccgcgagcgccacccccaggaggagcgccgcugcgagcucgccuccgacggcgucccccgccgccgcuccggccuccagggcgccgacuccugcgacuacgagggcggcgaccaggaguacggccccggcgaccagucccccggccagggccccgagcaccacggccccgccgagggccuccucuccgacggccagguccgcgccgccggcgccgagcccggccgccccuacaucggcgacggcggccuccacgagcucggccaccaccccgaccacgccgccggcgccggcggccagccccaccacgccgaccgccgcggcgaguggcccggcggcgccggccccgcccagcccgccgcccgcggccgccucugccgcggccgcgagcucugcgcccagcccggcggccccgccgucaccgaggucggccgccucgaggagcucgccgucccccgccgcugcgcccccccccucccccgcgacguccucgagggcuccugcccccuccccaccgccuccugccucugcgccgaccccgccggccuccgccccgccgccacccuccgccucucccccgcccgccccgccuggcccuga

SEQ ID NO: 41306 - RNA, 600 nt, Artificial Sequence
  derived and/or modified sequence opt2 from CHMP1B__Homo_sapiens__NP_065145
auguccaacauggagaagcaccucuucaaccucaaguucgccgccaaggagcucucccgcuccgccaagaagugcgacaaggaggagaaggccgagaaggccaagaucaagaaggccauccagaagggcaacauggaggucgcccgcauccacgccgagaacgccauccgccagaagaaccaggccgucaacuuccuccgcauguccgcccgcgucgacgccgucgccgcccgcguccagaccgccgucaccaugggcaaggucaccaaguccauggccggcgucgucaaguccauggacgccacccucaagaccaugaaccucgagaagaucuccgcccucauggacaaguucgagcaccaguucgagacccucgacguccagacccagcagauggaggacaccauguccuccaccaccacccucaccaccccccagaaccaggucgacaugcuccuccaggagauggccgacgaggccggccucgaccucaacauggagcucccccagggccagaccggcuccgucggcaccuccgucgccuccgccgagcaggacgagcucucccagcgccucgcccgccuccgcgaccaggucuga

SEQ ID NO: 41307 - RNA, 519 nt, Artificial Sequence
  derived and/or modified sequence opt2 from CHMP2B__Homo_sapiens__NP_001231573
auggagcucgagaucaagaagauggccaagaucggcaacaaggaggccugcaagguccucgccaagcagcucguccaccuccgcaagcagaagacccgcaccuucgccgucuccuccaaggucaccuccauguccacccagaccaaggucaugaacucccagaugaagauggccggcgccauguccaccaccgccaagaccaugcaggccgucaacaagaagauggacccccagaagacccuccagaccaugcagaacuuccagaaggagaacaugaagauggagaugaccgaggagaugaucaacgacacccucgacgacaucuucgacggcuccgacgacgaggaggagucccaggacaucgucaaccagguccucgacgagaucggcaucgagaucuccggcaagauggccaaggcccccuccgccgcccgcucccuccccuccgccuccaccuccaaggccaccaucuccgacgaggagaucgagcgccagcucaaggcccucggcgucgacuga

SEQ ID NO: 41308 - RNA, 471 nt, Artificial Sequence
  derived and/or modified sequence opt2 from CHMP3__Homo_sapiens__NP_001005753
augauccgcucccgcaaggccgucuccaagcucuacgccuccaaggcccacaugaacuccguccucaugggcaugaagaaccagcucgccguccuccgcgucgccggcucccuccagaaguccaccgaggucaugaaggccaugcagucccucgucaagauccccgagauccaggccaccaugcgcgagcucuccaaggagaugaugaaggccggcaucaucgaggagaugcucgaggacaccuucgaguccauggacgaccaggaggagauggaggaggaggccgagauggagaucgaccgcauccucuucgagaucaccgccggcgcccucggcaaggcccccuccaaggucaccgacgcccuccccgagcccgagccccccggcgccauggccgccuccgaggacgaggaggaggaggaggaggcccucgaggccaugcagucccgccucgccacccuccgcuccuga

SEQ ID NO: 41309 - RNA, 798 nt, Artificial Sequence
  derived and/or modified sequence opt2 from CHMP4A__Homo_sapiens__NP_054888
augucccgccgccgccccgaggacggccucggcaaggccggccccugcgucaugcgccaccaccccccccgcuccaaggccgaggucuggcgcacccuccgcggcggcggcggccgcggcgagcucgccauguccggccucggccgccucuucggcaagggcaagaaggagaagggccccacccccgaggaggccauccagaagcucaaggagaccgagaagauccucaucaagaagcaggaguuccucgagcagaagauccagcaggagcuccagaccgccaagaaguacggcaccaagaacaagcgcgccgcccuccaggcccuccgccgcaagaagcgcuucgagcagcagcucgcccagaccgacggcacccucuccacccucgaguuccagcgcgaggccaucgagaacgccaccaccaacgccgagguccuccgcaccauggagcucgccgcccaguccaugaagaaggccuaccaggacauggacaucgacaaggucgacgagcucaugaccgacaucaccgagcagcaggaggucgcccagcagaucuccgacgccaucucccgccccaugggcuucggcgacgacgucgacgaggacgagcuccucgaggagcucgaggagcucgagcaggaggagcucgcccaggagcuccucaacgucggcgacaaggaggaggagcccuccgucaagcuccccuccguccccuccacccaccuccccgccggccccgcccccaaggucgacgaggacgaggaggcccucaagcagcucgccgagugggucuccuga

SEQ ID NO: 41310 - RNA, 675 nt, Artificial Sequence
  derived and/or modified sequence opt2 from CHMP4B__Homo_sapiens__NP_789782
auguccgucuucggcaagcucuucggcgccggcggcggcaaggccggcaagggcggccccaccccccaggaggccauccagcgccuccgcgacaccgaggagaugcucuccaagaagcaggaguuccucgagaagaagaucgagcaggagcucaccgccgccaagaagcacggcaccaagaacaagcgcgccgcccuccaggcccucaagcgcaagaagcgcuacgagaagcagcucgcccagaucgacggcacccucuccaccaucgaguuccagcgcgaggcccucgagaacgccaacaccaacaccgagguccucaagaacaugggcuacgccgccaaggccaugaaggccgcccacgacaacauggacaucgacaaggucgacgagcucaugcaggacaucgccgaccagcaggagcucgccgaggagaucuccaccgccaucuccaagcccgucggcuucggcgaggaguucgacgaggacgagcucauggccgagcucgaggagcucgagcaggaggagcucgacaagaaccuccucgagaucuccggccccgagaccgucccccuccccaacguccccuccaucgcccuccccuccaagcccgccaagaagaaggaggaggaggacgacgacaugaaggagcucgagaacugggccggcuccauguga

SEQ ID NO: 41311 - RNA, 702 nt, Artificial Sequence
  derived and/or modified sequence opt2 from CHMP4C__Homo_sapiens__NP_689497
auguccaagcucggcaaguucuucaagggcggcggcuccuccaagucccgcgccgcccccuccccccaggaggcccucguccgccuccgcgagaccgaggagaugcucggcaagaagcaggaguaccucgagaaccgcauccagcgcgagaucgcccucgccaagaagcacggcacccagaacaagcgcgccgcccuccaggcccucaagcgcaagaagcgcuucgagaagcagcucacccagaucgacggcacccucuccaccaucgaguuccagcgcgaggcccucgagaacucccacaccaacaccgagguccuccgcaacaugggcuucgccgccaaggccaugaaguccguccacgagaacauggaccucaacaagaucgacgaccucaugcaggagaucaccgagcagcaggacaucgcccaggagaucuccgaggccuucucccagcgcgucggcuucggcgacgacuucgacgaggacgagcucauggccgagcucgaggagcucgagcaggaggagcucaacaagaagaugaccaacauccgccuccccaacguccccuccuccucccuccccgcccagcccaaccgcaagcccggcauguccuccaccgcccgccgcucccgcgccgccuccucccagcgcgccgaggaggaggacgacgacaucaagcagcucgccgccugggccaccuga

SEQ ID NO: 41312 - RNA, 516 nt, Artificial Sequence
  derived and/or modified sequence opt2 from CHMP5__Homo_sapiens__NP_001182465
augaaccgccucuucggcaaggccaagcccaaggcccccccccccucccucaccgacugcaucggcaccgucgacucccgcgccgaguccaucgacaagaagaucucccgccucgacgccgagcucgucaaguacaaggaccagaucaagaagaugcgcgagggccccgccaagaacauggucaagcagaaggcccuccgcguccucaagcagaagcgcauguacgagcagcagcgcgacaaccucgcccagcaguccuucaacauggagcaggccaacuacaccauccagucccucaaggacaccaagaccaccgucgacgccaugaagcucggcgucaaggagaugaagaaggccuacaagcaggucaagaucgaccagaucgaggaccuccaggaccagcucgaggacaugauggaggacgccaacgagauccaggaggcccucucccgcuccuacggcacccccgagcucgacgaggacgaccucgaggccggcugguccuccggcggcuga

SEQ ID NO: 41313 - RNA, 1302 nt, Artificial Sequence
  derived and/or modified sequence opt2 from CHN1__Homo_sapiens__NP_001020372
auggcccucacccucuucgacaccgacgaguaccgcccccccgucuggaaguccuaccucuaccagcuccagcaggaggccccccacccccgccgcaucaccugcaccugcgaggucgagaaccgccccaaguacuacggccgcgaguuccacggcaugaucucccgcgaggccgccgaccagcuccucaucgucgccgagggcuccuaccucauccgcgagucccagcgccagcccggcaccuacacccucgcccuccgcuucggcucccagacccgcaacuuccgccucuacuacgacggcaagcacuucgucggcgagaagcgcuucgaguccauccacgaccucgucaccgacggccucaucacccucuacaucgagaccaaggccgccgaguacaucgccaagaugaccaucaaccccaucuacgagcacgucggcuacaccacccucaaccgcgagcccgccuacaagaagcacaugcccguccucaaggagacccacgacgagcgcgacuccaccggccaggacggcgucuccgagaagcgcguccacaccuuccgcggcccccacuggugcgaguacugcgccaacuucauguggggccucaucgcccagggcgucaagugcgccgacugcggccucaacguccacaagcagugcuccaagaugguccccaacgacugcaagcccgaccucaagcacgucaagaaggucuacuccugcgaccucaccacccucgucaaggcccacaccaccaagcgccccauggucgucgacaugugcauccgcgagaucgagucccgcggccucaacuccgagggccucuaccgcgucuccggcuucuccgaccucaucgaggacgucaagauggccuucgaccgcgacggcgagaaggccgacaucuccgucaacauguacgaggacaucaacaucaucaccggcgcccucaagcucuacuuccgcgaccuccccaucccccucaucaccuacgacgccuaccccaaguucaucgaguccgccaagaucauggaccccgacgagcagcucgagacccuccacgaggcccucaagcuccucccccccgcccacugcgagacccuccgcuaccucauggcccaccucaagcgcgucacccuccacgagaaggagaaccucaugaacgccgagaaccucggcaucgucuucggccccacccucaugcgcucccccgagcucgacgccauggccgcccucaacgacauccgcuaccagcgccucgucgucgagcuccucaucaagaacgaggacauccucuucuga

SEQ ID NO: 41314 - RNA, 999 nt, Artificial Sequence
  derived and/or modified sequence opt2 from CHN2__Homo_sapiens__NP_001035025
auguucuccgaggagcucuggcucgagaacgagaagaagugcgccgucguccgcaaguccaagcagggccgcaagcgccaggagcuccucgccgucgccuucggcgucaaggucggcgucaagggcggcuuccucuggcccccccucaagcucuucgccugcucccagaucuccucccucguccgccgcgccgcccucacccacaacgacaaccacuucaacuacgagaagacccacaacuucaagguccacaccuuccgcggcccccacuggugcgaguacugcgccaacuucauguggggccucaucgcccagggcguccgcugcuccgacugcggccucaacguccacaagcagugcuccaagcacguccccaacgacugccagcccgaccucaagcgcaucaagaaggucuacugcugcgaccucaccacccucgucaaggcccacaacacccagcgccccauggucgucgacaucugcauccgcgagaucgaggcccgcggccucaaguccgagggccucuaccgcgucuccggcuucaccgagcacaucgaggacgucaagauggccuucgaccgcgacggcgagaaggccgacaucuccgccaacgucuaccccgacaucaacaucaucaccggcgcccucaagcucuacuuccgcgaccuccccauccccgucaucaccuacgacaccuacuccaaguucaucgacgccgccaagaucuccaacgccgacgagcgccucgaggccguccacgagguccucaugcuccucccccccgcccacuacgagacccuccgcuaccucaugauccaccucaagaaggucaccaugaacgagaaggacaacuucaugaacgccgagaaccucggcaucgucuucggccccacccucaugcgcccccccgaggacuccacccucaccacccuccacgacaugcgcuaccagaagcucaucguccagauccucaucgagaacgaggacguccucuucuga

SEQ ID NO: 41315 - RNA, 765 nt, Artificial Sequence
  derived and/or modified sequence opt2 from CHODL__Homo_sapiens__NP_001191103
augaccgccggcuccgcccacucccagaaggucugcuucgccgacuucaagcaccccugcuacaagauggccuacuuccacgagcucuccucccgcgucuccuuccaggaggcccgccucgccugcgaguccgagggcggcguccuccucucccucgagaacgaggccgagcagaagcucaucgaguccaugcuccagaaccucaccaagcccggcaccggcaucuccgacggcgacuucuggaucggccucuggcgcaacggcgacggccagaccuccggcgccugccccgaccucuaccagugguccgacggcuccaacucccaguaccgcaacugguacaccgacgagcccuccugcggcuccgagaagugcgucgucauguaccaccagcccaccgccaaccccggccucggcggccccuaccucuaccaguggaacgacgaccgcugcaacaugaagcacaacuacaucugcaaguacgagcccgagaucaaccccaccgcccccgucgagaagcccuaccucaccaaccagcccggcgacacccaccagaacgucgucgucaccgaggccggcaucauccccaaccucaucuacgucgucauccccaccaucccccuccuccuccucauccucgucgccuucggcaccugcugcuuccagaugcuccacaaguccaagggccgcaccaagaccucccccaaccaguccacccucuggaucuccaaguccacccgcaaggaguccggcauggaggucuga

SEQ ID NO: 41316 - RNA, 942 nt, Artificial Sequence
  derived and/or modified sequence opt2 from CHORDC1__Homo_sapiens__NP_001137545
auggcccuccucugcuacaaccgcggcugcggccagcgcuucgaccccgagaccaacuccgacgacgccugcaccuaccaccccggcguccccgucuuccacgacgcccucaagggcugcaccaagggccgccacaacuccgagaagccccccgagcccgucaagcccgaggucaagaccaccgagaagaaggagcucugcgagcucaagcccaaguuccaggagcacaucauccaggcccccaagcccgucgaggccaucaagcgccccucccccgacgagcccaugaccaaccucgagcucaagaucuccgccucccucaagcaggcccucgacaagcucaagcucuccuccggcaacgaggagaacaagaaggaggaggacaacgacgagaucaagaucggcaccuccugcaagaacggcggcugcuccaagaccuaccagggccucgagucccucgaggaggucugcgucuaccacuccggcguccccaucuuccacgagggcaugaaguacugguccugcugccgccgcaagaccuccgacuucaacaccuuccucgcccaggagggcugcaccaagggcaagcacauguggaccaagaaggacgccggcaagaaggucguccccugccgccacgacuggcaccagaccggcggcgaggucaccaucuccgucuacgccaagaacucccuccccgagcucucccgcgucgaggccaacuccacccuccucaacguccacaucgucuucgagggcgagaaggaguucgaccagaacgucaagcucuggggcgucaucgacgucaagcgcuccuacgucaccaugaccgccaccaagaucgagaucaccaugcgcaaggccgagcccaugcagugggccucccucgagcuccccgccgccaagaagcaggagaagcagaaggacgccaccaccgacuga

SEQ ID NO: 41317 - RNA, 588 nt, Artificial Sequence
  derived and/or modified sequence opt2 from CHP1__Homo_sapiens__NP_009167
augggcucccgcgccuccacccuccuccgcgacgaggagcucgaggagaucaagaaggagaccggcuucucccacucccagaucacccgccucuacucccgcuucaccucccucgacaagggcgagaacggcacccucucccgcgaggacuuccagcgcauccccgagcucgccaucaacccccucggcgaccgcaucaucaacgccuucuuccccgagggcgaggaccaggucaacuuccgcggcuucaugcgcacccucgcccacuuccgccccaucgaggacaacgagaaguccaaggacgucaacggccccgagccccucaacucccgcuccaacaagcuccacuucgccuuccgccucuacgaccucgacaaggacgagaagaucucccgcgacgagcuccuccagguccuccgcaugauggucggcgucaacaucuccgacgagcagcucggcuccaucgccgaccgcaccauccaggaggccgaccaggacggcgacuccgccaucuccuucaccgaguucgucaagguccucgagaaggucgacgucgagcagaagauguccauccgcuuccuccacuga

SEQ ID NO: 41318 - RNA, 591 nt, Artificial Sequence
  derived and/or modified sequence opt2 from CHP2__Homo_sapiens__NP_071380
augggcucccgcuccucccacgccgccgucauccccgacggcgacuccauccgccgcgagaccggcuucucccaggccucccuccuccgccuccaccaccgcuuccgcgcccucgaccgcaacaagaagggcuaccucucccgcauggaccuccagcagaucggcgcccucgccgucaacccccucggcgaccgcaucaucgaguccuucuuccccgacggcucccagcgcgucgacuuccccggcuucguccgcguccucgcccacuuccgccccgucgaggacgaggacaccgagacccaggaccccaagaagcccgagccccucaacucccgccgcaacaagcuccacuacgccuuccagcucuacgaccucgaccgcgacggcaagaucucccgccacgagaugcuccagguccuccgccucauggucggcguccaggucaccgaggagcagcucgagaacaucgccgaccgcaccguccaggaggccgacgaggacggcgacggcgccgucuccuucgucgaguucaccaagucccucgagaagauggacgucgagcagaagauguccauccgcauccucaaguga

SEQ ID NO: 41319 - RNA, 2328 nt, Artificial Sequence
  derived and/or modified sequence opt2 from CHPF__Homo_sapiens__NP_078812
augcgcgccucccuccuccucuccguccuccgccccgccggccccgucgccgucggcaucucccucggcuucacccucucccuccucuccgucaccugggucgaggagcccugcggccccggccccccccagcccggcgacuccgagcuccccccccgcggcaacaccaacgccgcccgccgccccaacuccguccagcccggcgccgagcgcgagaagcccggcgccggcgagggcgccggcgagaacugggagccccgcguccuccccuaccaccccgcccagcccggccaggccgccaagaaggccguccgcacccgcuacaucuccaccgagcucggcauccgccagcgccuccucgucgccguccucaccucccagaccacccuccccacccucggcgucgccgucaaccgcacccucggccaccgccucgagcgcgucgucuuccucaccggcgcccgcggccgccgcgccccccccggcauggccgucgucacccucggcgaggagcgccccaucggccaccuccaccucgcccuccgccaccuccucgagcagcacggcgacgacuucgacugguucuuccucguccccgacaccaccuacaccgaggcccacggccucgcccgccucaccggccaccucucccucgccuccgccgcccaccucuaccucggccgcccccaggacuucaucggcggcgagcccacccccggccgcuacugccacggcggcuucggcguccuccucucccgcaugcuccuccagcagcuccgcccccaccucgagggcugccgcaacgacaucgucuccgcccgccccgacgaguggcucggccgcugcauccucgacgccaccggcgucggcugcaccggcgaccacgagggcguccacuacucccaccucgagcucucccccggcgagcccguccaggagggcgacccccacuuccgcuccgcccucaccgcccaccccguccgcgaccccguccacauguaccagcuccacaaggccuucgcccgcgccgagcucgagcgcaccuaccaggagauccaggagcuccagugggagauccagaacaccucccaccucgccgucgacggcgaccgcgccgccgccuggcccgucggcauccccgcccccucccgccccgccucccgcuucgagguccuccgcugggacuacuucaccgagcagcacgccuucuccugcgccgacggcuccccccgcugcccccuccgcggcgccgaccgcgccgacgucgccgacguccucggcaccgcccucgaggagcucaaccgccgcuaccaccccgcccuccgccuccagaagcagcagcucgucaacggcuaccgccgcuucgaccccgcccgcggcauggaguacacccucgaccuccagcucgaggcccucaccccccagggcggccgccgcccccucacccgccgcguccagcuccuccgcccccucucccgcgucgagauccuccccguccccuacgucaccgaggccucccgccucaccguccuccucccccucgccgccgccgagcgcgaccucgcccccggcuuccucgaggccuucgccaccgccgcccucgagcccggcgacgccgccgccgcccucacccuccuccuccucuacgagccccgccaggcccagcgcgucgcccacgccgacgucuucgcccccgucaaggcccacgucgccgagcucgagcgccgcuuccccggcgcccgcguccccuggcucuccguccagaccgccgcccccuccccccuccgccucauggaccuccucuccaagaagcacccccucgacacccucuuccuccucgccggccccgacaccguccucacccccgacuuccucaaccgcugccgcaugcacgccaucuccggcuggcaggccuucuuccccaugcacuuccaggccuuccaccccgccgucgcccccccccagggccccggcccccccgagcucggccgcgacaccggccgcuucgaccgccaggccgccuccgaggccugcuucuacaacuccgacuacgucgccgcccgcggccgccucgccgccgccuccgagcaggaggaggagcuccucgagucccucgacgucuacgagcucuuccuccacuucuccucccuccacguccuccgcgccgucgagcccgcccuccuccagcgcuaccgcgcccagaccugcuccgcccgccucuccgaggaccucuaccaccgcugccuccaguccguccucgagggccucggcucccgcacccagcucgccaugcuccucuucgagcaggagcagggcaacuccaccuga

SEQ ID NO: 41320 - RNA, 1221 nt, Artificial Sequence
  derived and/or modified sequence opt2 from CHPT1__Homo_sapiens__NP_064629
auggccgccggcgccggcgccggcuccgccccccgcuggcuccgcgcccucuccgagccccucuccgccgcccagcuccgccgccucgaggagcaccgcuacuccgccgccggcgucucccuccucgagcccccccuccagcucuacuggaccuggcuccuccaguggaucccccucuggauggcccccaacuccaucacccuccucggccucgccgucaacgucgucaccacccucguccucaucuccuacugccccaccgccaccgaggaggcccccuacuggaccuaccuccucugcgcccucggccucuucaucuaccagucccucgacgccaucgacggcaagcaggcccgccgcaccaacuccugcuccccccucggcgagcucuucgaccacggcugcgacucccucuccaccgucuucauggccgucggcgccuccaucgccgcccgccucggcaccuaccccgacugguucuucuucugcuccuucaucggcauguucgucuucuacugcgcccacuggcagaccuacgucuccggcaugcuccgcuucggcaaggucgacgucaccgagauccagaucgcccucgucaucgucuucguccucuccgccuucggcggcgccaccaugugggacuacaccauccccauccucgagaucaagcucaagauccuccccguccucggcuuccucggcggcgucaucuucuccugcuccaacuacuuccacgucauccuccacggcggcgucggcaagaacggcuccaccaucgccggcaccuccguccucucccccggccuccacaucggccucaucaucauccucgccaucaugaucuacaagaaguccgccaccgacgucuucgagaagcaccccugccucuacauccucauguucggcugcgucuucgccaaggucucccagaagcucgucgucgcccacaugaccaaguccgagcucuaccuccaggacaccgucuuccucggccccggccuccucuuccucgaccaguacuucaacaacuucaucgacgaguacgucguccucuggauggccauggucaucuccuccuucgacauggucaucuacuucuccgcccucugccuccagaucucccgccaccuccaccucaacaucuucaagaccgccugccaccaggcccccgagcagguccagguccucuccuccaagucccaccagaacaacauggacuga

SEQ ID NO: 41321 - RNA, 396 nt, Artificial Sequence
  derived and/or modified sequence opt2 from CHRAC1__Homo_sapiens__NP_059140
auggccgacgucgucgucggcaaggacaagggcggcgagcagcgccucaucucccucccccucucccgcauccgcgucaucaugaaguccucccccgaggucuccuccaucaaccaggaggcccucguccucaccgccaaggccaccgagcucuucguccagugccucgccaccuacuccuaccgccacggcuccggcaaggagaagaagguccucaccuacuccgaccucgccaacaccgcccagcaguccgagaccuuccaguuccucgccgacauccuccccaagaagauccucgccuccaaguaccucaagaugcucaaggaggagaagcgcgaggaggacgaggagaacgacaacgacaacgaguccgaccacgacgaggccgacuccuga

SEQ ID NO: 41322 - RNA, 2865 nt, Artificial Sequence
  derived and/or modified sequence opt2 from CHRD__Homo_sapiens__NP_001291401
augcccucccuccccgccccccccgccccccuccuccuccucggccuccuccuccucggcucccgccccgcccgcggcgccggccccgagccccccguccuccccauccgcuccgagaaggagccccuccccguccgcggcgccgccggcugcaccuucggcggcaaggucuacgcccucgacgagaccuggcaccccgaccucggcgagcccuucggcgucaugcgcugcguccucugcgccugcgaggccccccaguggggccgccgcacccgcggccccggccgcgucuccugcaagaacaucaagcccgagugccccacccccgccugcggccagccccgccagcuccccggccacugcugccagaccugcccccaggagcgcuccuccuccgagcgccagcccuccggccucuccuucgaguacccccgcgaccccgagcaccgcuccuacuccgaccgcggcgagcccggcgccgaggagcgcgcccgcggcgacggccacaccgacuucgucgcccuccucaccggcccccgcucccaggccgucgcccgcgcccgcgucucccuccuccgcuccucccuccgcuucuccaucuccuaccgccgccucgaccgccccacccgcauccgcuucuccgacuccaacggcuccguccucuucgagcaccccgccgcccccacccaggacggccucgucugcggcgucuggcgcgccgucccccgccucucccuccgccuccuccgcgccgagcagcuccacgucgcccucgucacccucacccaccccuccggcgaggucuggggcccccucauccgccaccgcgcccucgccgccgagaccuucuccgccauccucacccucgagggccccccccagcagggcgucggcggcaucacccuccucacccucuccgacaccgaggacucccuccacuuccuccuccucuuccgcggccuccucgagccccgcuccggcggccucacccaggucccccuccgccuccagauccuccaccagggccagcuccuccgcgagcuccaggccaacgucuccgcccaggagcccggcuucgccgagguccuccccaaccucaccguccaggagauggacuggcucguccucggcgagcuccagauggcccucgagugggccggccgccccggccuccgcaucuccggccacaucgccgcccgcaaguccugcgacguccuccaguccguccucugcggcgccgacgcccucauccccguccagaccggcgccgccggcuccgccucccucacccuccucggcaacggcucccucaucuaccagguccaggucgucggcaccuccuccgaggucgucgccaugacccucgagaccaagccccagcgccgcgaccagcgcaccguccucugccacauggccggccuccagcccggcggccacaccgccgucggcaucugccccggccucggcgcccgcggcgcccacaugcuccuccagaacgagcucuuccucaacgucggcaccaaggacuuccccgacggcgagcuccgcggccacgucgccgcccuccccuacugcggccacuccgcccgccacgacacccuccccgucccccucgccggcgcccucguccucccccccgucaagucccaggccgccggccacgccuggcucucccucgacacccacugccaccuccacuacgagguccuccucgccggccucggcggcuccgagcagggcaccgucaccgcccaccuccucggcccccccggcacccccggcccccgccgccuccucaagggcuucuacggcuccgaggcccagggcgucgucaaggaccucgagcccgagcuccuccgccaccucgccaagggcauggccucccucaugaucaccaccaagggcuccccccgcggcgagcuccgcggccagguccacaucgccaaccagugcgaggucggcggccuccgccucgaggccgccggcgccgagggcguccgcgcccucggcgcccccgacaccgccuccgccgccccccccgucguccccggccuccccgcccucgcccccgccaagcccggcggccccggccgcccccgcgaccccaacaccugcuucuucgagggccagcagcgcccccacggcgcccgcugggcccccaacuacgacccccucugcucccucugcaccugccagcgccgcaccgucaucugcgaccccgucgucugccccccccccuccugcccccaccccguccaggcccccgaccagugcugccccgucugccccgagaagcaggacguccgcgaccuccccggccucccccgcucccgcgaccccggcgagggcugcuacuucgacggcgaccgcuccuggcgcgccgccggcacccgcuggcaccccgucgucccccccuucggccucaucaagugcgccgucugcaccugcaagggcggcaccggcgagguccacugcgagaagguccagugcccccgccucgccugcgcccagcccguccgcgucaaccccaccgacugcugcaagcagugccccgucggcuccggcgcccacccccagcucggcgaccccaugcaggccgacggcccccgcggcugccgcuucgccggccagugguuccccgagucccaguccuggcaccccuccgucccccccuucggcgagauguccugcaucaccugccgcugcggcgccggcgucccccacugcgagcgcgacgacugcucccucccccucuccugcggcuccggcaaggagucccgcugcugcucccgcugcaccgcccaccgccgcccccccgagacccgcaccgaccccgagcucgagaaggaggccgagggcuccuga

SEQ ID NO: 41323 - RNA, 1137 nt, Artificial Sequence
  derived and/or modified sequence opt2 from CHRDL1__Homo_sapiens__NP_001137455
augcgcaagaaguggaagaugggcggcaugaaguacaucuucucccuccucuucuuccuccuccucgagggcggcaagaccgagcaggucaagcacuccgagaccuacugcauguuccaggacaagaaguaccgcgucggcgagcgcuggcaccccuaccucgagcccuacggccucgucuacugcgucaacugcaucugcuccgagaacggcaacguccucugcucccgcguccgcugccccaacguccacugccucucccccguccacaucccccaccucugcugcccccgcugccccggcgacggcgagcucuccugggagcacuccgacggcgacaucuuccgccagcccgccaaccgcgaggcccgccacuccuaccaccgcucccacuacgaccccccccccucccgccaggccggcggccucucccgcuuccccggcgcccgcucccaccgcggcgcccucauggacucccagcaggccuccggcaccaucguccagaucgucaucaacaacaagcacaagcacggccaggucugcgucuccaacggcaagaccuacucccacggcgaguccuggcaccccaaccuccgcgccuucggcaucgucgagugcguccucugcaccugcaacgucaccaagcaggagugcaagaagauccacugccccaaccgcuaccccugcaaguacccccagaagaucgacggcaagugcugcaaggucugccccggcaagaaggccaaggaggagcuccccggccaguccuucgacaacaagggcuacuucugcggcgaggagaccaugcccgucuacgaguccgucuucauggaggacggcgagaccacccgcaagaucgcccucgagaccgagcgccccccccaggucgagguccacgucuggaccauccgcaagggcauccuccagcacuuccacaucgagaagaucuccaagcgcauguucgaggagcucccccacuucaagcucgucacccgcaccacccucucccaguggaagaucuucaccgagggcgaggcccagaucucccagaugugcuccucccgcgucugccgcaccgagcucgaggaccucgucaagguccucuaccucgagcgcuccgagaagggccacugcuga

SEQ ID NO: 41324 - RNA, 1239 nt, Artificial Sequence
  derived and/or modified sequence opt2 from CHRFAM7A__Homo_sapiens__XP_011520455
augcagaaguacugcaucuaccagcacuuccaguuccagcuccucauccagcaccucuggaucgccgccaacugcgacaucgccgacgagcgcuucgacgccaccuuccacaccaacguccucgucaacuccuccggccacugccaguaccucccccccggcaucuucaaguccuccugcuacaucgacguccgcugguuccccuucgacguccagcacugcaagcucaaguucggcuccugguccuacggcggcuggucccucgaccuccagaugcaggaggccgacaucuccggcuacauccccaacggcgagugggaccucgucggcauccccggcaagcgcuccgagcgcuucuacgagugcugcaaggagcccuaccccgacgucaccuucaccgucaccaugcgccgccgcacccucuacuacggccucaaccuccucauccccugcguccucaucuccgcccucgcccuccucgucuuccuccuccccgccgacuccggcgagaagaucucccucggcaucaccguccuccucucccucaccgucuucaugcuccucgucgccgagaucaugcccgccaccuccgacuccgucccccucaucgcccaguacuucgccuccaccaugaucaucgucggccucuccgucgucgucaccgucaucguccuccaguaccaccaccacgaccccgacggcggcaagaugcccaaguggacccgcgucauccuccucaacuggugcgccugguuccuccgcaugaagcgccccggcgaggacaagguccgccccgccugccagcacaagcagcgccgcugcucccucgccuccgucgagauguccgccgucgcccccccccccgccuccaacggcaaccuccucuacaucggcuuccgcggccucgacggcguccacugcguccccacccccgacuccggcgucgucugcggccgcauggccugcucccccacccacgacgagcaccuccuccacggcggccagccccccgagggcgaccccgaccucgccaagauccucgaggagguccgcuacaucgccaaccgcuuccgcugccaggacgaguccgaggccgucugcuccgaguggaaguucgccgccugcgucgucgaccgccucugccucauggccuucuccgucuucaccaucaucugcaccaucggcauccucauguccgcccccaacuucgucgaggccgucuccaaggacuucgccuga

SEQ ID NO: 41325 - RNA, 1383 nt, Artificial Sequence
  derived and/or modified sequence opt2 from CHRM1__Homo_sapiens__XP_011543044
augaacaccuccgccccccccgccgucucccccaacaucaccguccucgcccccggcaagggccccuggcaggucgccuucaucggcaucaccaccggccuccucucccucgccaccgucaccggcaaccuccucguccucaucuccuucaaggucaacaccgagcucaagaccgucaacaacuacuuccuccucucccucgccugcgccgaccucaucaucggcaccuucuccaugaaccucuacaccaccuaccuccucaugggccacugggcccucggcacccucgccugcgaccucuggcucgcccucgacuacgucgccuccaacgccuccgucaugaaccuccuccucaucuccuucgaccgcuacuucuccgucacccgcccccucuccuaccgcgccaagcgcaccccccgccgcgccgcccucaugaucggccucgccuggcucgucuccuucguccucugggcccccgccauccucuucuggcaguaccucgucggcgagcgcaccguccucgccggccagugcuacauccaguuccucucccagcccaucaucaccuucggcaccgccauggccgccuucuaccuccccgucaccgucaugugcacccucuacuggcgcaucuaccgcgagaccgagaaccgcgcccgcgagcucgccgcccuccagggcuccgagacccccggcaagggcggcggcuccuccuccuccuccgagcgcucccagcccggcgccgagggcucccccgagaccccccccggccgcugcugccgcugcugccgcgccccccgccuccuccaggccuacuccuggaaggaggaggaggaggaggacgagggcuccauggagucccucaccuccuccgagggcgaggagcccggcuccgaggucgucaucaagaugcccauggucgaccccgaggcccaggcccccaccaagcagcccccccgcuccucccccaacaccgucaagcgccccaccaagaagggccgcgaccgcgccggcaagggccagaagccccgcggcaaggagcagcucgccaagcgcaagaccuucucccucgucaaggagaagaaggccgcccgcacccucuccgccauccuccucgccuucauccucaccuggacccccuacaacaucaugguccucgucuccaccuucugcaaggacugcguccccgagacccucugggagcucggcuacuggcucugcuacgucaacuccaccaucaaccccaugugcuacgcccucugcaacaaggccuuccgcgacaccuuccgccuccuccuccucugccgcugggacaagcgccgcuggcgcaagauccccaagcgccccggcuccguccaccgcacccccucccgccagugcuga

SEQ ID NO: 41326 - RNA, 1401 nt, Artificial Sequence
  derived and/or modified sequence opt2 from CHRM2__Homo_sapiens__XP_011514073
augaacaacuccaccaacuccuccaacaacucccucgcccucaccucccccuacaagaccuucgaggucgucuucaucguccucgucgccggcucccucucccucgucaccaucaucggcaacauccucgucauggucuccaucaaggucaaccgccaccuccagaccgucaacaacuacuuccucuucucccucgccugcgccgaccucaucaucggcgucuucuccaugaaccucuacacccucuacaccgucaucggcuacuggccccucggccccgucgucugcgaccucuggcucgcccucgacuacgucgucuccaacgccuccgucaugaaccuccucaucaucuccuucgaccgcuacuucugcgucaccaagccccucaccuaccccgucaagcgcaccaccaagauggccggcaugaugaucgccgccgccuggguccucuccuucauccucugggcccccgccauccucuucuggcaguucaucgucggcguccgcaccgucgaggacggcgagugcuacauccaguucuucuccaacgccgccgucaccuucggcaccgccaucgccgccuucuaccuccccgucaucaucaugaccguccucuacuggcacaucucccgcgccuccaagucccgcaucaagaaggacaagaaggagcccgucgccaaccaggaccccgucucccccucccucguccagggccgcaucgucaagcccaacaacaacaacaugcccuccuccgacgacggccucgagcacaacaagauccagaacggcaaggccccccgcgaccccgucaccgagaacugcguccagggcgaggagaaggaguccuccaacgacuccaccuccgucuccgccgucgccuccaacaugcgcgacgacgagaucacccaggacgagaacaccgucuccaccucccucggccacuccaaggacgagaacuccaagcagaccugcauccgcaucggcaccaagacccccaaguccgacuccugcacccccaccaacaccaccgucgaggucgucggcuccuccggccagaacggcgacgagaagcagaacaucgucgcccgcaagaucgucaagaugaccaagcagcccgccaagaagaagcccccccccucccgcgagaagaaggucacccgcaccauccucgccauccuccucgccuucaucaucaccugggcccccuacaacgucaugguccucaucaacaccuucugcgcccccugcauccccaacaccgucuggaccaucggcuacuggcucugcuacaucaacuccaccaucaaccccgccugcuacgcccucugcaacgccaccuucaagaagaccuucaagcaccuccucaugugccacuacaagaacaucggcgccacccgcuga

SEQ ID NO: 41327 - RNA, 1773 nt, Artificial Sequence
  derived and/or modified sequence opt2 from CHRM3__Homo_sapiens__NP_000731
augacccuccacaacaacuccaccaccuccccccucuuccccaacaucuccuccuccuggauccacucccccuccgacgccggccucccccccggcaccgucacccacuucggcuccuacaacgucucccgcgccgccggcaacuucuccucccccgacggcaccaccgacgacccccucggcggccacaccgucuggcaggucgucuucaucgccuuccucaccggcauccucgcccucgucaccaucaucggcaacauccucgucaucgucuccuucaaggucaacaagcagcucaagaccgucaacaacuacuuccuccucucccucgccugcgccgaccucaucaucggcgucaucuccaugaaccucuucaccaccuacaucaucaugaaccgcugggcccucggcaaccucgccugcgaccucuggcucgccaucgacuacgucgccuccaacgccuccgucaugaaccuccucgucaucuccuucgaccgcuacuucuccaucacccgcccccucaccuaccgcgccaagcgcaccaccaagcgcgccggcgucaugaucggccucgccugggucaucuccuucguccucugggcccccgccauccucuucuggcaguacuucgucggcaagcgcaccgucccccccggcgagugcuucauccaguuccucuccgagcccaccaucaccuucggcaccgccaucgccgccuucuacaugcccgucaccaucaugaccauccucuacuggcgcaucuacaaggagaccgagaagcgcaccaaggagcucgccggccuccaggccuccggcaccgaggccgagaccgagaacuucguccaccccaccggcuccucccgcuccugcuccuccuacgagcuccagcagcaguccaugaagcgcuccaaccgccgcaaguacggccgcugccacuucugguucaccaccaaguccuggaagcccuccuccgagcagauggaccaggaccacuccuccuccgacuccuggaacaacaacgacgccgccgccucccucgagaacuccgccuccuccgacgaggaggacaucggcuccgagacccgcgccaucuacuccaucguccucaagcuccccggccacuccaccauccucaacuccaccaagcuccccuccuccgacaaccuccagguccccgaggaggagcucggcauggucgaccucgagcgcaaggccgacaagcuccaggcccagaaguccgucgacgacggcggcuccuuccccaaguccuucuccaagcuccccauccagcucgaguccgccgucgacaccgccaagaccuccgacgucaacuccuccgucggcaaguccaccgccacccucccccucuccuucaaggaggccacccucgccaagcgcuucgcccucaagacccgcucccagaucaccaagcgcaagcgcaugucccucgucaaggagaagaaggccgcccagacccucuccgccauccuccucgccuucaucaucaccuggacccccuacaacaucaugguccucgucaacaccuucugcgacuccugcauccccaagaccuucuggaaccucggcuacuggcucugcuacaucaacuccaccgucaaccccgucugcuacgcccucugcaacaagaccuuccgcaccaccuucaagaugcuccuccucugccagugcgacaagaagaagcgccgcaagcagcaguaccagcagcgccaguccgucaucuuccacaagcgcgcccccgagcaggcccucuga

SEQ ID NO: 41328 - RNA, 1440 nt, Artificial Sequence
  derived and/or modified sequence opt2 from CHRM4__Homo_sapiens__NP_000732
auggccaacuucacccccgucaacggcuccuccggcaaccaguccguccgccucgucaccuccuccucccacaaccgcuacgagaccgucgagauggucuucaucgccaccgucaccggcucccucucccucgucaccgucgucggcaacauccucgucaugcucuccaucaaggucaaccgccagcuccagaccgucaacaacuacuuccucuucucccucgccugcgccgaccucaucaucggcgccuucuccaugaaccucuacaccgucuacaucaucaagggcuacuggccccucggcgccgucgucugcgaccucuggcucgcccucgacuacgucgucuccaacgccuccgucaugaaccuccucaucaucuccuucgaccgcuacuucugcgucaccaagccccucaccuaccccgcccgccgcaccaccaagauggccggccucaugaucgccgccgccuggguccucuccuucguccucugggcccccgccauccucuucuggcaguucgucgucggcaagcgcaccguccccgacaaccagugcuucauccaguuccucuccaaccccgccgucaccuucggcaccgccaucgccgccuucuaccuccccgucgucaucaugaccguccucuacauccacaucucccucgccucccgcucccgcguccacaagcaccgccccgagggccccaaggagaagaaggccaagacccucgccuuccucaaguccccccucaugaagcaguccgucaagaagcccccccccggcgaggccgcccgcgaggagcuccgcaacggcaagcucgaggaggcccccccccccgcccuccccccccccccccgccccgucgccgacaaggacaccuccaacgaguccuccuccggcuccgccacccagaacaccaaggagcgccccgccaccgagcucuccaccaccgaggccaccacccccgccaugcccgcccccccccuccagccccgcgcccucaaccccgccucccgcugguccaagauccagaucgucaccaagcagaccggcaacgagugcgucaccgccaucgagaucguccccgccacccccgccggcaugcgccccgccgccaacgucgcccgcaaguucgccuccaucgcccgcaaccagguccgcaagaagcgccagauggccgcccgcgagcgcaaggucacccgcaccaucuucgccauccuccucgccuucauccucaccuggacccccuacaacgucaugguccucgucaacaccuucugccaguccugcauccccgacaccgucugguccaucggcuacuggcucugcuacgucaacuccaccaucaaccccgccugcuacgcccucugcaacgccaccuucaagaagaccuuccgccaccuccuccucugccaguaccgcaacaucggcaccgcccgcuga

SEQ ID NO: 41329 - RNA, 1599 nt, Artificial Sequence
  derived and/or modified sequence opt2 from CHRM5__Homo_sapiens__XP_005254198
auggagggcgacuccuaccacaacgccaccaccgucaacggcacccccgucaaccaccagccccucgagcgccaccgccucugggaggucaucaccaucgccgccgucaccgccgucgucucccucaucaccaucgucggcaacguccucgucaugaucuccuucaaggucaacucccagcucaagaccgucaacaacuacuaccuccucucccucgccugcgccgaccucaucaucggcaucuucuccaugaaccucuacaccaccuacauccucaugggccgcugggcccucggcucccucgccugcgaccucuggcucgcccucgacuacgucgccuccaacgccuccgucaugaaccuccucgucaucuccuucgaccgcuacuucuccaucacccgcccccucaccuaccgcgccaagcgcacccccaagcgcgccggcaucaugaucggccucgccuggcucaucuccuucauccucugggcccccgccauccucugcuggcaguaccucgucggcaagcgcaccgucccccucgacgagugccagauccaguuccucuccgagcccaccaucaccuucggcaccgccaucgccgccuucuacauccccgucuccgucaugaccauccucuacugccgcaucuaccgcgagaccgagaagcgcaccaaggaccucgccgaccuccagggcuccgacuccgucaccaaggccgagaagcgcaagcccgcccaccgcgcccucuuccgcuccugccuccgcugcccccgccccacccucgcccagcgcgagcgcaaccaggccuccugguccuccucccgccgcuccaccuccaccaccggcaagcccucccaggccaccggccccuccgccaacugggccaaggccgagcagcucaccaccugcuccuccuaccccuccuccgaggacgaggacaagcccgccaccgaccccguccuccaggucgucuacaagucccagggcaaggagucccccggcgaggaguucuccgccgaggagaccgaggagaccuucgucaaggccgagaccgagaaguccgacuacgacacccccaacuaccuccucucccccgccgccgcccaccgccccaagucccagaagugcgucgccuacaaguuccgccucgucgucaaggccgacggcaaccaggagaccaacaacggcugccacaaggucaagaucaugcccugccccuuccccgucgccaaggagcccuccaccaagggccucaaccccaaccccucccaccagaugaccaagcgcaagcgcgucguccucgucaaggagcgcaaggccgcccagacccucuccgccauccuccucgccuucaucaucaccuggacccccuacaacaucaugguccucgucuccaccuucugcgacaagugcguccccgucacccucuggcaccucggcuacuggcucugcuacgucaacuccaccgucaaccccaucugcuacgcccucugcaaccgcaccuuccgcaagaccuucaagaugcuccuccucugccgcuggaagaagaagaaggucgaggagaagcucuacuggcagggcaacuccaagcuccccuga

SEQ ID NO: 41330 - RNA, 1353 nt, Artificial Sequence
  derived and/or modified sequence opt2 from CHRNA10__Homo_sapiens__NP_065135
augggccuccgcucccaccaccucucccucggccuccuccuccucuuccuccuccccgccgagugccucggcgccgagggccgccucgcccucaagcucuuccgcgaccucuucgccaacuacaccuccgcccuccgccccgucgccgacaccgaccagacccucaacgucacccucgaggucacccucucccagaucaucgacauggacgagcgcaaccagguccucacccucuaccucuggauccgccaggaguggaccgacgccuaccuccgcugggaccccaacgccuacggcggccucgacgccauccgcauccccuccucccucgucuggcgccccgacaucguccucuacaacaaggccgacgcccagccccccggcuccgccuccaccaacgucguccuccgccacgacggcgccguccgcugggacgcccccgccaucacccgcuccuccugccgcgucgacgucgccgccuuccccuucgacgcccagcacugcggccucaccuucggcuccuggacccacggcggccaccagcucgacguccgcccccgcggcgccgccgccucccucgccgacuucgucgagaacgucgaguggcgcguccucggcaugcccgcccgccgccgcguccucaccuacggcugcugcuccgagcccuaccccgacgucaccuucacccuccuccuccgccgccgcgccgccgccuacgucugcaaccuccuccuccccugcguccucaucucccuccucgccccccucgccuuccaccuccccgccgacuccggcgagaaggucucccucggcgucaccguccuccucgcccucaccgucuuccagcuccuccucgccgaguccaugccccccgccgaguccgucccccucaucggcaaguacuacauggccaccaugaccauggucaccuucuccaccgcccucaccauccucaucaugaaccuccacuacugcggccccuccguccgccccguccccgccugggcccgcgcccuccuccucggccaccucgcccgcggccucugcguccgcgagcgcggcgagcccugcggccagucccgcccccccgagcucucccccuccccccagucccccgagggcggcgccggcccccccgccggccccugccacgagccccgcugccucugccgccaggaggcccuccuccaccacgucgccaccaucgccaacaccuuccgcucccaccgcgccgcccagcgcugccacgaggacuggaagcgccucgcccgcgucauggaccgcuucuuccucgccaucuucuucuccauggcccucgucaugucccuccucguccucguccaggcccucuga

SEQ ID NO: 41331 - RNA, 1374 nt, Artificial Sequence
  derived and/or modified sequence opt2 from CHRNA1__Homo_sapiens__NP_000070
auggagcccuggccccuccuccuccucuucucccucugcuccgccggccucguccucggcuccgagcacgagacccgccucgucgccaagcucuucaaggacuacuccuccgucguccgccccgucgaggaccaccgccaggucgucgaggucaccgucggccuccagcucauccagcucaucaacgucgacgaggucaaccagaucgucaccaccaacguccgccucaagcagcagugggucgacuacaaccucaaguggaaccccgacgacuacggcggcgucaagaagauccacauccccuccgagaagaucuggcgccccgaccucguccucuacaacaacgccgacggcgacuucgccaucgucaaguucaccaagguccuccuccaguacaccggccacaucaccuggaccccccccgccaucuucaaguccuacugcgagaucaucgucacccacuuccccuucgacgagcagaacugcuccaugaagcucggcaccuggaccuacgacggcuccgucgucgccaucaaccccgaguccgaccagcccgaccucuccaacuucauggaguccggcgagugggucaucaaggagucccgcggcuggaagcacuccgucaccuacuccugcugccccgacacccccuaccucgacaucaccuaccacuucgucaugcagcgccucccccucuacuucaucgucaacgucaucauccccugccuccucuucuccuuccucaccggccucgucuucuaccuccccaccgacuccggcgagaagaugacccucuccaucuccguccuccucucccucaccgucuuccuccucgucaucgucgagcucauccccuccaccuccuccgccgucccccucaucggcaaguacaugcucuucaccauggucuucgucaucgccuccaucaucaucaccgucaucgucaucaacacccaccaccgcucccccuccacccacgucaugcccaacuggguccgcaaggucuucaucgacaccauccccaacaucauguucuucuccaccaugaagcgccccucccgcgagaagcaggacaagaagaucuucaccgaggacaucgacaucuccgacaucuccggcaagcccggccccccccccaugggcuuccacuccccccucaucaagcaccccgaggucaaguccgccaucgagggcaucaaguacaucgccgagaccaugaaguccgaccaggaguccaacaacgccgccgccgaguggaaguacgucgccauggucauggaccacauccuccucggcgucuucaugcucgucugcaucaucggcacccucgccgucuucgccggccgccucaucgagcucaaccagcagggcuga

SEQ ID NO: 41332 - RNA, 1590 nt, Artificial Sequence
  derived and/or modified sequence opt2 from CHRNA2__Homo_sapiens__NP_000733
augggccccuccugccccgucuuccucuccuucaccaagcucucccucugguggcuccuccucacccccgccggcggcgaggaggccaagcgcccccccccccgcgcccccggcgacccccucuccucccccucccccaccgcccucccccagggcggcucccacaccgagaccgaggaccgccucuucaagcaccucuuccgcggcuacaaccgcugggcccgccccguccccaacaccuccgacgucgucaucguccgcuucggccucuccaucgcccagcucaucgacgucgacgagaagaaccagaugaugaccaccaacgucuggcucaagcaggagugguccgacuacaagcuccgcuggaaccccaccgacuucggcaacaucaccucccuccgcguccccuccgagaugaucuggauccccgacaucguccucuacaacaacgccgacggcgaguucgccgucacccacaugaccaaggcccaccucuucuccaccggcaccguccacugggucccccccgccaucuacaaguccuccugcuccaucgacgucaccuucuuccccuucgaccagcagaacugcaagaugaaguucggcuccuggaccuacgacaaggccaagaucgaccucgagcagauggagcagaccgucgaccucaaggacuacugggaguccggcgagugggccaucgucaacgccaccggcaccuacaacuccaagaaguacgacugcugcgccgagaucuaccccgacgucaccuacgccuucgucauccgccgccucccccucuucuacaccaucaaccucaucauccccugccuccucaucuccugccucaccguccucgucuucuaccuccccuccgacugcggcgagaagaucacccucugcaucuccguccuccucucccucaccgucuuccuccuccucaucaccgagaucauccccuccaccucccucgucaucccccucaucggcgaguaccuccucuucaccaugaucuucgucacccucuccaucgucaucaccgucuucguccucaacguccaccaccgcucccccuccacccacaccaugccccacuggguccgcggcgcccuccucggcugcgucccccgcuggcuccucaugaaccgcccccccccccccgucgagcucugccacccccuccgccucaagcucucccccuccuaccacuggcucgaguccaacgucgacgccgaggagcgcgaggucgucgucgaggaggaggaccgcugggccugcgccggccacgucgcccccuccgucggcacccucugcucccacggccaccuccacuccggcgccuccggccccaaggccgaggcccuccuccaggagggcgagcuccuccucuccccccacaugcagaaggcccucgagggcguccacuacaucgccgaccaccuccgcuccgaggacgccgacuccuccgucaaggaggacuggaaguacgucgccauggucaucgaccgcaucuuccucuggcucuucaucaucgucugcuuccucggcaccaucggccucuuccucccccccuuccucgccggcaugaucuga

SEQ ID NO: 41333 - RNA, 1518 nt, Artificial Sequence
  derived and/or modified sequence opt2 from CHRNA3__Homo_sapiens__NP_000734
augggcuccggcccccucucccucccccucgcccucucccccccccgccuccuccuccuccuccuccucucccuccuccccgucgcccgcgccuccgaggccgagcaccgccucuucgagcgccucuucgaggacuacaacgagaucauccgccccgucgccaacgucuccgaccccgucaucauccacuucgaggucuccaugucccagcucgucaaggucgacgaggucaaccagaucauggagaccaaccucuggcucaagcagaucuggaacgacuacaagcucaaguggaaccccuccgacuacggcggcgccgaguucaugcgcguccccgcccagaagaucuggaagcccgacaucguccucuacaacaacgccgucggcgacuuccaggucgacgacaagaccaaggcccuccucaaguacaccggcgaggucaccuggaucccccccgccaucuucaaguccuccugcaagaucgacgucaccuacuuccccuucgacuaccagaacugcaccaugaaguucggcuccugguccuacgacaaggccaagaucgaccucguccucaucggcuccuccaugaaccucaaggacuacugggaguccggcgagugggccaucaucaaggcccccggcuacaagcacgacaucaaguacaacugcugcgaggagaucuaccccgacaucaccuacucccucuacauccgccgccucccccucuucuacaccaucaaccucaucauccccugccuccucaucuccuuccucaccguccucgucuucuaccuccccuccgacugcggcgagaaggucacccucugcaucuccguccuccucucccucaccgucuuccuccucgucaucaccgagaccauccccuccaccucccucgucaucccccucaucggcgaguaccuccucuucaccaugaucuucgucacccucuccaucgucaucaccgucuucguccucaacguccacuaccgcacccccaccacccacaccaugcccuccugggucaagaccgucuuccucaaccuccucccccgcgucauguucaugacccgccccaccuccaacgagggcaacgcccagaagccccgcccccucuacggcgccgagcucuccaaccucaacugcuucucccgcgccgaguccaagggcugcaaggagggcuaccccugccaggacggcaugugcggcuacugccaccaccgccgcaucaagaucuccaacuucuccgccaaccucacccgcuccuccuccuccgaguccgucgacgccguccucucccucuccgcccucucccccgagaucaaggaggccauccaguccgucaaguacaucgccgagaacaugaaggcccagaacgaggccaaggagauccaggacgacuggaaguacgucgccauggucaucgaccgcaucuuccucugggucuucacccucgucugcauccucggcaccgccggccucuuccuccagccccucauggcccgcgaggacgccuga

SEQ ID NO: 41334 - RNA, 1884 nt, Artificial Sequence
  derived and/or modified sequence opt2 from CHRNA4__Homo_sapiens__NP_000735
auggagcucggcggccccggcgccccccgccuccuccccccccuccuccuccuccucggcaccggccuccuccgcgccuccucccacgucgagacccgcgcccacgccgaggagcgccuccucaagaagcucuucuccggcuacaacaaguggucccgccccgucgccaacaucuccgacgucguccucguccgcuucggccucuccaucgcccagcucaucgacgucgacgagaagaaccagaugaugaccaccaacgucugggucaagcaggaguggcacgacuacaagcuccgcugggaccccgccgacuacgagaacgucaccuccauccgcauccccuccgagcucaucuggcgccccgacaucguccucuacaacaacgccgacggcgacuucgccgucacccaccucaccaaggcccaccucuuccacgacggccgcguccaguggaccccccccgccaucuacaaguccuccugcuccaucgacgucaccuucuuccccuucgaccagcagaacugcaccaugaaguucggcuccuggaccuacgacaaggccaagaucgaccucgucaacaugcacucccgcgucgaccagcucgacuucugggaguccggcgagugggucaucgucgacgccgucggcaccuacaacacccgcaaguacgagugcugcgccgagaucuaccccgacaucaccuacgccuucgucauccgccgccucccccucuucuacaccaucaaccucaucauccccugccuccucaucuccugccucaccguccucgucuucuaccuccccuccgagugcggcgagaagaucacccucugcaucuccguccuccucucccucaccgucuuccuccuccucaucaccgagaucauccccuccaccucccucgucaucccccucaucggcgaguaccuccucuucaccaugaucuucgucacccucuccaucgucaucaccgucuucguccucaacguccaccaccgcuccccccgcacccacaccaugcccaccuggguccgccgcgucuuccucgacaucgucccccgccuccuccucaugaagcgccccuccgucgucaaggacaacugccgccgccucaucgaguccaugcacaagauggccuccgccccccgcuucuggcccgagcccgagggcgagccccccgccaccuccggcacccagucccuccacccccccucccccuccuucugcgucccccucgacguccccgccgagcccggccccuccugcaagucccccuccgaccagcuccccccccagcagccccucgaggccgagaaggccuccccccaccccucccccggccccugccgccccccccacggcacccaggcccccggccucgccaaggcccgcucccucuccguccagcacauguccucccccggcgaggccgucgagggcggcguccgcugccgcucccgcuccauccaguacugcgucccccgcgacgacgccgcccccgaggccgacggccaggccgccggcgcccucgccucccgcaacacccacuccgccgagcuccccccccccgaccagcccucccccugcaagugcaccugcaagaaggagcccuccuccgucucccccuccgccaccgucaagacccgcuccaccaaggccccccccccccaccucccccucucccccgcccucacccgcgccgucgagggcguccaguacaucgccgaccaccucaaggccgaggacaccgacuucuccgucaaggaggacuggaaguacgucgccauggucaucgaccgcaucuuccucuggauguucaucaucgucugccuccucggcaccgucggccucuuccucccccccuggcucgccggcaugaucuga

SEQ ID NO: 41335 - RNA, 1407 nt, Artificial Sequence
  derived and/or modified sequence opt2 from CHRNA5__Homo_sapiens__NP_000736
auggccgcccgcggcuccggcccccgcgcccuccgccuccuccuccucguccagcucgucgccggccgcugcggccucgccggcgccgccggcggcgcccagcgcggccucuccgagcccuccuccaucgccaagcacgaggacucccuccucaaggaccucuuccaggacuacgagcgcuggguccgccccgucgagcaccucaacgacaagaucaagaucaaguucggccucgccaucucccagcucgucgacgucgacgagaagaaccagcucaugaccaccaacgucuggcucaagcaggaguggaucgacgucaagcuccgcuggaaccccgacgacuacggcggcaucaaggucauccgcguccccuccgacuccgucuggacccccgacaucguccucuucgacaacgccgacggccgcuucgagggcaccuccaccaagaccgucauccgcuacaacggcaccgucaccuggaccccccccgccaacuacaaguccuccugcaccaucgacgucaccuucuuccccuucgaccuccagaacugcuccaugaaguucggcuccuggaccuacgacggcucccaggucgacaucauccucgaggaccaggacgucgacaagcgcgacuucuucgacaacggcgagugggagaucgucuccgccaccggcuccaagggcaaccgcaccgacuccugcugcugguaccccuacgucaccuacuccuucgucaucaagcgccucccccucuucuacacccucuuccucaucauccccugcaucggccucuccuuccucaccguccucgucuucuaccuccccuccaacgagggcgagaagaucugccucugcaccuccguccucgucucccucaccgucuuccuccucgucaucgaggagaucauccccuccuccuccaaggucaucccccucaucggcgaguaccucgucuucaccaugaucuucgucacccucuccaucauggucaccgucuucgccaucaacauccaccaccgcuccuccuccacccacaacgccauggccccccucguccgcaagaucuuccuccacacccuccccaagcuccucugcaugcgcucccacgucgaccgcuacuucacccagaaggaggagaccgaguccggcuccggccccaaguccucccgcaacacccucgaggccgcccucgacuccauccgcuacaucacccgccacaucaugaaggagaacgacguccgcgaggucgucgaggacuggaaguucaucgcccagguccucgaccgcauguuccucuggaccuuccucuucgucuccaucgucggcucccucggccucuucguccccgucaucuacaagugggccaacauccucauccccguccacaucggcaacgccaacaaguga

SEQ ID NO: 41336 - RNA, 1440 nt, Artificial Sequence
  derived and/or modified sequence opt2 from CHRNA6__Homo_sapiens__NP_001186208
augcucaccuccaagggccagggcuuccuccacggcggccucugccucuggcucugcgucuucacccccuucuucaagggcugcgucggcugcgccaccgaggagcgccucuuccacaagcucuucucccacuacaaccaguucauccgccccgucgagaacgucuccgaccccgucaccguccacuucgaggucgccaucacccagcucgccaacgucaucuggaacgacuacaagcuccgcugggaccccauggaguacgacggcaucgagacccuccgcguccccgccgacaagaucuggaagcccgacaucguccucuacaacaacgccgucggcgacuuccaggucgagggcaagaccaaggcccuccucaaguacaacggcaugaucaccuggaccccccccgccaucuucaaguccuccugccccauggacaucaccuucuuccccuucgaccaccagaacugcucccucaaguucggcuccuggaccuacgacaaggccgagaucgaccuccucaucaucggcuccaaggucgacaugaacgacuucugggagaacuccgagugggagaucaucgacgccuccggcuacaagcacgacaucaaguacaacugcugcgaggagaucuacaccgacaucaccuacuccuucuacauccgccgccuccccauguucuacaccaucaaccucaucauccccugccucuucaucuccuuccucaccguccucgucuucuaccuccccuccgacugcggcgagaaggucacccucugcaucuccguccuccucucccucaccgucuuccuccucgucaucaccgagaccauccccuccaccucccucgucgucccccucgucggcgaguaccuccucuucaccaugaucuucgucacccucuccaucgucgucaccgucuucguccucaacauccacuaccgcacccccaccacccacaccaugccccgcugggucaagaccgucuuccucaagcuccucccccagguccuccucaugcgcuggccccucgacaagacccgcggcaccggcuccgacgccgucccccgcggccucgcccgccgccccgccaagggcaagcucgccucccacggcgagccccgccaccucaaggagugcuuccacugccacaaguccaacgagcucgccaccuccaagcgccgccucucccaccagccccuccagugggucgucgagaacuccgagcacucccccgaggucgaggacgucaucaacuccguccaguucaucgccgagaacaugaagucccacaacgagaccaaggaggucgaggacgacuggaaguacgucgccauggucgucgaccgcgucuuccucugggucuucaucaucgucugcgucuucggcaccgccggccucuuccuccagccccuccucggcaacaccggcaaguccuga

SEQ ID NO: 41337 - RNA, 1509 nt, Artificial Sequence
  derived and/or modified sequence opt2 from CHRNA7__Homo_sapiens__NP_000737
augcgcugcucccccggcggcgucuggcucgcccucgccgccucccuccuccacgucucccuccagggcgaguuccagcgcaagcucuacaaggagcucgucaagaacuacaacccccucgagcgccccgucgccaacgacucccagccccucaccgucuacuucucccucucccuccuccagaucauggacgucgacgagaagaaccagguccucaccaccaacaucuggcuccagauguccuggaccgaccacuaccuccaguggaacgucuccgaguaccccggcgucaagaccguccgcuuccccgacggccagaucuggaagcccgacauccuccucuacaacuccgccgacgagcgcuucgacgccaccuuccacaccaacguccucgucaacuccuccggccacugccaguaccucccccccggcaucuucaaguccuccugcuacaucgacguccgcugguuccccuucgacguccagcacugcaagcucaaguucggcuccugguccuacggcggcuggucccucgaccuccagaugcaggaggccgacaucuccggcuacauccccaacggcgagugggaccucgucggcauccccggcaagcgcuccgagcgcuucuacgagugcugcaaggagcccuaccccgacgucaccuucaccgucaccaugcgccgccgcacccucuacuacggccucaaccuccucauccccugcguccucaucuccgcccucgcccuccucgucuuccuccuccccgccgacuccggcgagaagaucucccucggcaucaccguccuccucucccucaccgucuucaugcuccucgucgccgagaucaugcccgccaccuccgacuccgucccccucaucgcccaguacuucgccuccaccaugaucaucgucggccucuccgucgucgucaccgucaucguccuccaguaccaccaccacgaccccgacggcggcaagaugcccaaguggacccgcgucauccuccucaacuggugcgccugguuccuccgcaugaagcgccccggcgaggacaagguccgccccgccugccagcacaagcagcgccgcugcucccucgccuccgucgagauguccgccgucgcccccccccccgccuccaacggcaaccuccucuacaucggcuuccgcggccucgacggcguccacugcguccccacccccgacuccggcgucgucugcggccgcauggccugcucccccacccacgacgagcaccuccuccacggcggccagccccccgagggcgaccccgaccucgccaagauccucgaggagguccgcuacaucgccaaccgcuuccgcugccaggacgaguccgaggccgucugcuccgaguggaaguucgccgccugcgucgucgaccgccucugccucauggccuucuccgucuucaccaucaucugcaccaucggcauccucauguccgcccccaacuucgucgaggccgucuccaaggacuucgccuga

SEQ ID NO: 41338 - RNA, 1506 nt, Artificial Sequence
  derived and/or modified sequence opt2 from CHRNB1__Homo_sapiens__NP_000738
augacccccggcgcccuccucaugcuccucggcgcccucggcgccccccucgcccccggcguccgcggcuccgaggccgagggccgccuccgcgagaagcucuucuccggcuacgacuccuccguccgccccgcccgcgaggucggcgaccgcguccgcgucuccgucggccucauccucgcccagcucaucucccucaacgagaaggacgaggagauguccaccaaggucuaccucgaccucgaguggaccgacuaccgccucuccugggaccccgccgagcacgacggcaucgacucccuccgcaucaccgccgaguccgucuggcuccccgacgucguccuccucaacaacaacgacggcaacuucgacgucgcccucgacaucuccgucgucgucuccuccgacggcuccguccgcuggcagccccccggcaucuaccgcuccuccugcuccauccaggucaccuacuuccccuucgacuggcagaacugcaccauggucuucuccuccuacuccuacgacuccuccgaggucucccuccagaccggccucggccccgacggccagggccaccaggagauccacauccacgagggcaccuucaucgagaacggccagugggagaucauccacaagcccucccgccucauccagccccccggcgacccccgcggcggccgcgagggccagcgccaggaggucaucuucuaccucaucauccgccgcaagccccucuucuaccucgucaacgucaucgcccccugcauccucaucacccuccucgccaucuucgucuucuaccucccccccgacgccggcgagaagaugggccucuccaucuucgcccuccucacccucaccgucuuccuccuccuccucgccgacaagguccccgagaccucccucuccguccccaucaucaucaaguaccucauguucaccaugguccucgucaccuucuccgucauccucuccgucgucguccucaaccuccaccaccgcuccccccacacccaccagaugccccucuggguccgccagaucuucauccacaagcucccccucuaccuccgccucaagcgccccaagcccgagcgcgaccucaugcccgagcccccccacugcuccucccccggcuccggcuggggccgcggcaccgacgaguacuucauccgcaagccccccuccgacuuccucuuccccaagcccaaccgcuuccagcccgagcucuccgcccccgaccuccgccgcuucaucgacggccccaaccgcgccgucgcccuccuccccgagcuccgcgaggucgucuccuccaucuccuacaucgcccgccagcuccaggagcaggaggaccacgacgcccucaaggaggacuggcaguucgucgccauggucgucgaccgccucuuccucuggaccuucaucaucuucaccuccgucggcacccucgucaucuuccucgacgccaccuaccaccuccccccccccgaccccuuccccuga

SEQ ID NO: 41339 - RNA, 1509 nt, Artificial Sequence
  derived and/or modified sequence opt2 from CHRNB2__Homo_sapiens__NP_000739
auggcccgccgcugcggccccgucgcccuccuccucggcuucggccuccuccgccucugcuccggcgucuggggcaccgacaccgaggagcgccucgucgagcaccuccucgaccccucccgcuacaacaagcucauccgccccgccaccaacggcuccgagcucgucaccguccagcucauggucucccucgcccagcucaucuccguccacgagcgcgagcagaucaugaccaccaacgucuggcucacccaggagugggaggacuaccgccucaccuggaagcccgaggaguucgacaacaugaagaagguccgccuccccuccaagcacaucuggcuccccgacgucguccucuacaacaacgccgacggcauguacgaggucuccuucuacuccaacgccgucgucuccuacgacggcuccaucuucuggcucccccccgccaucuacaaguccgccugcaagaucgaggucaagcacuuccccuucgaccagcagaacugcaccaugaaguuccgcuccuggaccuacgaccgcaccgagaucgaccucguccucaaguccgaggucgccucccucgacgacuucacccccuccggcgagugggacaucgucgcccuccccggccgccgcaacgagaaccccgacgacuccaccuacgucgacaucaccuacgacuucaucauccgccgcaagccccucuucuacaccaucaaccucaucauccccugcguccucaucaccucccucgccauccucgucuucuaccuccccuccgacugcggcgagaagaugacccucugcaucuccguccuccucgcccucaccgucuuccuccuccucaucuccaagaucgucccccccaccucccucgacgucccccucgucggcaaguaccucauguucaccaugguccucgucaccuucuccaucgucaccuccgucugcguccucaacguccaccaccgcucccccaccacccacaccauggcccccugggucaaggucgucuuccucgagaagcuccccgcccuccucuucaugcagcagccccgccaccacugcgcccgccagcgccuccgccuccgccgccgccagcgcgagcgcgagggcgccggcgcccucuucuuccgcgaggcccccggcgccgacuccugcaccugcuucgucaaccgcgccuccguccagggccucgccggcgccuucggcgccgagcccgcccccgucgccggccccggccgcuccggcgagcccugcggcugcggccuccgcgaggccgucgacggcguccgcuucaucgccgaccacaugcgcuccgaggacgacgaccaguccgucuccgaggacuggaaguacgucgccauggucaucgaccgccucuuccucuggaucuucgucuucgucugcgucuucggcaccaucggcauguuccuccagccccucuuccagaacuacaccaccaccaccuuccuccacuccgaccacuccgcccccuccuccaaguga

SEQ ID NO: 41340 - RNA, 1377 nt, Artificial Sequence
  derived and/or modified sequence opt2 from CHRNB3__Homo_sapiens__NP_000740
augcuccccgacuucaugcucguccucaucguccucggcauccccuccuccgccaccaccggcuucaacuccaucgccgagaacgaggacgcccuccuccgccaccucuuccagggcuaccagaaguggguccgccccguccuccacuccaacgacaccaucaaggucuacuucggccucaagaucucccagcucgucgacgucgacgagaagaaccagcucaugaccaccaacgucuggcucaagcaggaguggaccgaccacaagcuccgcuggaaccccgacgacuacggcggcauccacuccaucaagguccccuccgagucccucuggcuccccgacaucguccucuucgagaacgccgacggccgcuucgagggcucccucaugaccaaggucaucgucaaguccaacggcaccgucgucuggaccccccccgccuccuacaaguccuccugcaccauggacgucaccuucuuccccuucgaccgccagaacugcuccaugaaguucggcuccuggaccuacgacggcaccauggucgaccucauccucaucaacgagaacgucgaccgcaaggacuucuucgacaacggcgagugggagauccucaacgccaagggcaugaagggcaaccgccgcgacggcgucuacuccuaccccuucaucaccuacuccuucguccuccgccgccucccccucuucuacacccucuuccucaucauccccugccucggccucuccuuccucaccguccucgucuucuaccuccccuccgacgagggcgagaagcucucccucuccaccuccguccucgucucccucaccgucuuccuccucgucaucgaggagaucauccccuccuccuccaaggucaucccccucaucggcgaguaccuccucuucaucaugaucuucgucacccucuccaucaucgucaccgucuucgucaucaacguccaccaccgcuccuccuccaccuaccaccccauggcccccugggucaagcgccucuuccuccagaagcuccccaagcuccucugcaugaaggaccacgucgaccgcuacuccucccccgagaaggaggagucccagcccgucgucaagggcaagguccucgagaagaagaagcagaagcagcucuccgacggcgagaagguccucgucgccuuccucgagaaggccgccgacuccauccgcuacaucucccgccacgucaagaaggagcacuucaucucccaggucguccaggacuggaaguucgucgcccagguccucgaccgcaucuuccucuggcucuuccucaucgucuccgucaccggcuccguccucaucuucacccccgcccucaagauguggcuccacuccuaccacuga

SEQ ID NO: 41341 - RNA, 1497 nt, Artificial Sequence
  derived and/or modified sequence opt2 from CHRNB4__Homo_sapiens__NP_000741
augcgccgcgcccccucccucguccucuucuuccucgucgcccucugcggccgcggcaacugccgcgucgccaacgccgaggagaagcucauggacgaccuccucaacaagacccgcuacaacaaccucauccgccccgccaccuccuccucccagcucaucuccaucaagcuccagcucucccucgcccagcucaucuccgucaacgagcgcgagcagaucaugaccaccaacgucuggcucaagcaggaguggaccgacuaccgccucaccuggaacuccucccgcuacgagggcgucaacauccuccgcauccccgccaagcgcaucuggcuccccgacaucguccucuacaacaacgccgacggcaccuacgaggucuccgucuacaccaaccucaucguccgcuccaacggcuccguccucuggcucccccccgccaucuacaaguccgccugcaagaucgaggucaaguacuuccccuucgaccagcagaacugcacccucaaguuccgcuccuggaccuacgaccacaccgagaucgacaugguccucaugacccccaccgccuccauggacgacuucacccccuccggcgagugggacaucgucgcccuccccggccgccgcaccgucaacccccaggaccccuccuacgucgacgucaccuacgacuucaucaucaagcgcaagccccucuucuacaccaucaaccucaucauccccugcguccucaccacccuccucgccauccucgucuucuaccuccccuccgacugcggcgagaagaugacccucugcaucuccguccuccucgcccucaccuucuuccuccuccucaucuccaagaucgucccccccaccucccucgacgucccccucaucggcaaguaccucauguucaccaugguccucgucaccuucuccaucgucaccuccgucugcguccucaacguccaccaccgcucccccuccacccacaccauggcccccugggucaagcgcugcuuccuccacaagcuccccaccuuccucuucaugaagcgccccggccccgacuccucccccgcccgcgccuucccccccuccaaguccugcgucaccaagcccgaggccaccgccaccuccaccucccccuccaacuucuacggcaacuccauguacuucgucaaccccgccuccgccgccuccaagucccccgccggcuccacccccgucgccaucccccgcgacuucuggcuccgcuccuccggccgcuuccgccaggacguccaggaggcccucgagggcgucuccuucaucgcccagcacaugaagaacgacgacgaggaccaguccgucgucgaggacuggaaguacgucgccauggucgucgaccgccucuuccucugggucuucauguucgucugcguccucggcaccgucggccucuuccuccccccccucuuccagacccacgccgccuccgagggccccuacgccgcccagcgcgacuga

SEQ ID NO: 41342 - RNA, 1554 nt, Artificial Sequence
  derived and/or modified sequence opt2 from CHRND__Homo_sapiens__NP_000742
auggagggccccguccucacccucggccuccucgccgcccucgccgucugcggcuccuggggccucaacgaggaggagcgccucauccgccaccucuuccaggagaagggcuacaacaaggagcuccgccccgucgcccacaaggaggaguccgucgacgucgcccucgcccucacccucuccaaccucaucucccucaaggaggucgaggagacccucaccaccaacgucuggaucgagcacggcuggaccgacaaccgccucaaguggaacgccgaggaguucggcaacaucuccguccuccgccucccccccgacauggucuggcuccccgagaucguccucgagaacaacaacgacggcuccuuccagaucuccuacuccugcaacguccucgucuaccacuacggcuucgucuacuggcucccccccgccaucuuccgcuccuccugccccaucuccgucaccuacuuccccuucgacuggcagaacugcucccucaaguucuccucccucaaguacaccgccaaggagaucacccucucccucaagcaggacgccaaggagaaccgcaccuaccccgucgaguggaucaucaucgaccccgagggcuucaccgagaacggcgagugggagaucguccaccgccccgcccgcgucaacgucgacccccgcgccccccucgacucccccucccgccaggacaucaccuucuaccucaucauccgccgcaagccccucuucuacaucaucaacauccucguccccugcguccucaucuccuucauggucaaccucgucuucuaccuccccgccgacuccggcgagaagaccuccgucgccaucuccguccuccucgcccaguccgucuuccuccuccucaucuccaagcgccuccccgccaccuccauggccaucccccucaucggcaaguuccuccucuucggcaugguccucgucaccauggucgucgucaucugcgucaucguccucaacauccacuuccgcacccccuccacccacguccucuccgagggcgucaagaagcucuuccucgagacccuccccgagcuccuccacaugucccgccccgccgaggacggccccucccccggcgcccucguccgccgcuccuccucccucggcuacaucuccaaggccgaggaguacuuccuccucaagucccgcuccgaccucauguucgagaagcaguccgagcgccacggccucgcccgccgccucaccaccgcccgccgcccccccgccuccuccgagcaggcccagcaggagcucuucaacgagcucaagcccgccgucgacggcgccaacuucaucgucaaccacaugcgcgaccagaacaacuacaacgaggagaaggacuccuggaaccgcgucgcccgcaccgucgaccgccucugccucuucgucgucacccccgucauggucgucggcaccgccuggaucuuccuccagggcgucuacaaccagccccccccccagcccuuccccggcgaccccuacuccuacaacguccaggacaagcgcuucaucuga

SEQ ID NO: 41343 - RNA, 1482 nt, Artificial Sequence
  derived and/or modified sequence opt2 from CHRNE__Homo_sapiens__NP_000071
auggcccgcgccccccucggcguccuccuccuccucggccuccucggccgcggcgucggcaagaacgaggagcuccgccucuaccaccaccucuucaacaacuacgaccccggcucccgccccguccgcgagcccgaggacaccgucaccaucucccucaaggucacccucaccaaccucaucucccucaacgagaaggaggagacccucaccaccuccgucuggaucggcaucgacuggcaggacuaccgccucaacuacuccaaggacgacuucggcggcaucgagacccuccgcguccccuccgagcucgucuggcuccccgagaucguccucgagaacaacaucgacggccaguucggcgucgccuacgacgccaacguccucgucuacgagggcggcuccgucaccuggcucccccccgccaucuaccgcuccgucugcgccgucgaggucaccuacuuccccuucgacuggcagaacugcucccucaucuuccgcucccagaccuacaacgccgaggaggucgaguucaccuucgccgucgacaacgacggcaagaccaucaacaagaucgacaucgacaccgaggccuacaccgagaacggcgagugggccaucgacuucugccccggcgucauccgccgccaccacggcggcgccaccgacggccccggcgagaccgacgucaucuacucccucaucauccgccgcaagccccucuucuacgucaucaacaucaucguccccugcguccucaucuccggccucguccuccucgccuacuuccuccccgcccaggccggcggccagaagugcaccgucuccaucaacguccuccucgcccagaccgucuuccucuuccucaucgcccagaagauccccgagaccucccucuccgucccccuccucggccgcuuccucaucuucgucauggucgucgccacccucaucgucaugaacugcgucaucguccucaacgucucccagcgcacccccaccacccacgccauguccccccgccuccgccacguccuccucgagcuccucccccgccuccucggcuccccccccccccccgaggccccccgcgccgccucccccccccgccgcgccuccuccgucggccuccuccuccgcgccgaggagcucauccucaagaagccccgcuccgagcucgucuucgagggccagcgccaccgccagggcaccuggaccgccgccuucugccagucccucggcgccgccgcccccgagguccgcugcugcgucgacgccgucaacuucgucgccgaguccacccgcgaccaggaggccaccggcgaggaggucuccgacuggguccgcaugggcaacgcccucgacaacaucugcuucugggccgcccucguccucuucuccgucggcuccucccucaucuuccucggcgccuacuucaaccgcguccccgaccuccccuacgcccccugcauccagcccuga

SEQ ID NO: 41344 - RNA, 1554 nt, Artificial Sequence
  derived and/or modified sequence opt2 from CHRNG__Homo_sapiens__NP_005190
augcacggcggccagggcccccuccuccuccuccuccuccucgccgucugccucggcgcccagggccgcaaccaggaggagcgccuccucgccgaccucaugcagaacuacgaccccaaccuccgccccgccgagcgcgacuccgacgucgucaacgucucccucaagcucacccucaccaaccucaucucccucaacgagcgcgaggaggcccucaccaccaacgucuggaucgagaugcaguggugcgacuaccgccuccgcugggacccccgcgacuacgagggccucuggguccuccgcguccccuccaccauggucuggcgccccgacaucguccucgagaacaacgucgacggcgucuucgaggucgcccucuacugcaacguccucgucucccccgacggcugcaucuacuggcucccccccgccaucuuccgcuccgccugcuccaucuccgucaccuacuuccccuucgacuggcagaacugcucccucaucuuccagucccagaccuacuccaccaacgagaucgaccuccagcucucccaggaggacggccagaccaucgaguggaucuucaucgaccccgaggccuucaccgagaacggcgagugggccauccagcaccgccccgccaagaugcuccucgaccccgccgcccccgcccaggaggccggccaccagaaggucgucuucuaccuccucauccagcgcaagccccucuucuacgucaucaacaucaucgcccccugcguccucaucuccuccgucgccauccucauccacuuccuccccgccaaggccggcggccagaagugcaccgucgccaucaacguccuccucgcccagaccgucuuccucuuccucgucgccaagaagguccccgagaccucccaggccgucccccucaucuccaaguaccucaccuuccuccucgucgucaccauccucaucgucgucaacgccgucgucguccucaacgucucccuccgcuccccccacacccacuccauggcccgcggcguccgcaaggucuuccuccgccuccucccccagcuccuccgcaugcacguccgcccccucgcccccgccgccguccaggacacccagucccgccuccagaacggcuccuccggcugguccaucaccaccggcgaggaggucgcccucugccucccccgcuccgagcuccucuuccagcaguggcagcgccagggccucgucgccgccgcccucgagaagcucgagaagggccccgagcucggccucucccaguucugcggcucccucaagcaggccgcccccgccauccaggccugcgucgaggccugcaaccucaucgccugcgcccgccaccagcagucccacuucgacaacggcaacgaggagugguuccucgucggccgcguccucgaccgcgucugcuuccucgccaugcucucccucuucaucugcggcaccgccggcaucuuccucauggcccacuacaaccgcguccccgcccuccccuuccccggcgacccccgccccuaccuccccucccccgacuga

SEQ ID NO: 41345 - RNA, 1071 nt, Artificial Sequence
  derived and/or modified sequence opt2 from CHST10__Homo_sapiens__NP_004845
augcaccaccaguggcuccuccucgccgccugcuucugggucaucuucauguucauggucgccuccaaguucaucacccucaccuucaaggaccccgacgucuacuccgccaagcaggaguuccucuuccucaccaccaugcccgagguccgcaagcuccccgaggagaagcacauccccgaggagcucaagcccaccggcaaggagcuccccgacucccagcucguccagccccucgucuacauggagcgccucgagcucauccgcaacgucugccgcgacgacgcccucaagaaccucucccacacccccgucuccaaguucguccucgaccgcaucuucgucugcgacaagcacaagauccucuucugccagacccccaaggucggcaacacccaguggaagaagguccucaucguccucaacggcgccuucuccuccaucgaggagauccccgagaacgucguccacgaccacgagaagaacggccucccccgccucuccuccuucuccgacgccgagauccagaagcgccucaagaccuacuucaaguucuucaucguccgcgaccccuucgagcgccucaucuccgccuucaaggacaaguucguccacaacccccgcuucgagcccugguaccgccacgagaucgcccccggcaucauccgcaaguaccgccgcaaccgcaccgagacccgcggcauccaguucgaggacuucguccgcuaccucggcgaccccaaccaccgcuggcucgaccuccaguucggcgaccacaucauccacugggucaccuacgucgagcucugcgcccccugcgagaucauguacuccgucaucggccaccacgagacccucgaggacgacgcccccuacauccucaaggaggccggcaucgaccaccucgucuccuaccccaccaucccccccggcaucaccgucuacaaccgcaccaaggucgagcacuacuuccucggcaucuccaagcgcgacauccgccgccucuacgcccgcuucgagggcgacuucaagcucuucggcuaccagaagcccgacuuccuccucaacuga

SEQ ID NO: 41346 - RNA, 1044 nt, Artificial Sequence
  derived and/or modified sequence opt2 from CHST11__Homo_sapiens__NP_001167453
augaagcccgcccuccucgaggucaugcgcaugaaccgcaucugccgcaugguccucgccaccugccucggcuccuucauccucgucaucuucuacuuccagaucaugcgccgcaaccccuucggcgucgacaucugcugccgcaagggcucccgcuccccccuccaggagcucuacaaccccauccagcucgagcucuccaacaccgccguccuccaccagaugcgccgcgaccaggucaccgacaccugccgcgccaacuccgccaccucccgcaagcgccgcguccucacccccaacgaccucaagcaccucgucgucgacgaggaccacgagcucaucuacugcuacguccccaaggucgccugcaccaacuggaagcgccucaugaugguccucaccggccgcggcaaguacuccgaccccauggagauccccgccaacgaggcccacgucuccgccaaccucaagacccucaaccaguacuccauccccgagaucaaccaccgccucaaguccuacaugaaguuccucuucguccgcgagcccuucgagcgccucgucuccgccuaccgcaacaaguucacccagaaguacaacaucuccuuccacaagcgcuacggcaccaagaucaucaagcgccagcgcaagaacgccacccaggaggcccuccgcaagggcgacgacgucaaguucgaggaguucgucgccuaccucaucgacccccacacccagcgcgaggagcccuucaacgagcacuggcagaccgucuacucccucugccaccccugccacauccacuacgaccucgucggcaaguacgagacccucgaggaggacuccaacuacguccuccagcucgccggcgucggcuccuaccucaaguuccccaccuacgccaaguccacccgcaccaccgacgagaugaccaccgaguucuuccagaacaucuccuccgagcaccagacccagcucuacgaggucuacaagcucgacuuccucauguucaacuacuccguccccuccuaccucaagcucgaguga

SEQ ID NO: 41347 - RNA, 1245 nt, Artificial Sequence
  derived and/or modified sequence opt2 from CHST12__Homo_sapiens__NP_001230724
augaccaaggcccgccucuuccgccucuggcucguccucggcuccgucuucaugauccuccucaucaucgucuacugggacuccgccggcgccgcccacuucuaccuccacaccuccuucucccgcccccacaccggccccccccuccccacccccggccccgaccgcgaccgcgagcucaccgccgacuccgacgucgacgaguuccucgacaaguuccucuccgccggcgucaagcaguccgaccucccccgcaaggagaccgagcagccccccgcccccggcuccauggaggaguccguccgcggcuacgacugguccccccgcgacgcccgccgcucccccgaccagggccgccagcaggccgagcgccgcuccguccuccgcggcuucugcgccaacuccucccucgccuuccccaccaaggagcgcgccuucgacgacauccccaacuccgagcucucccaccucaucgucgacgaccgccacggcgccaucuacugcuacguccccaaggucgccugcaccaacuggaagcgcgucaugaucguccucuccggcucccuccuccaccgcggcgcccccuaccgcgacccccuccgcaucccccgcgagcacguccacaacgccuccgcccaccucaccuucaacaaguucuggcgccgcuacggcaagcucucccgccaccucaugaaggucaagcucaagaaguacaccaaguuccucuucguccgcgaccccuucguccgccucaucuccgccuuccgcuccaaguucgagcucgagaacgaggaguucuaccgcaaguucgccguccccaugcuccgccucuacgccaaccacaccucccuccccgccuccgcccgcgaggccuuccgcgccggccucaaggucuccuucgccaacuucauccaguaccuccucgacccccacaccgagaagcucgcccccuucaacgagcacuggcgccaggucuaccgccucugccaccccugccagaucgacuacgacuucgucggcaagcucgagacccucgacgaggacgccgcccagcuccuccagcuccuccaggucgaccgccagcuccgcuucccccccuccuaccgcaaccgcaccgccuccuccugggaggaggacugguucgccaagaucccccucgccuggcgccagcagcucuacaagcucuacgaggccgacuucguccucuucggcuaccccaagcccgagaaccuccuccgcgacuga

SEQ ID NO: 41348 - RNA, 1026 nt, Artificial Sequence
  derived and/or modified sequence opt2 from CHST13__Homo_sapiens__NP_690849
augggccgccgcugcugccgccgccgcguccucgccgccgccugccucggcgccgcccuccuccuccucugcgccgccccccgcucccuccgccccgccuucggcaaccgcgcccucggcuccuccuggcucggcggcgagaagcgcuccccccuccagaagcucuacgaccucgaccaggacccccgcuccacccucgccaagguccaccgccagcgccgcgaccuccucaacuccgccugcucccgccacucccgccgccagcgccuccuccagcccgaggaccuccgccacguccucgucgacgacgcccacggccuccucuacugcuacguccccaaggucgccugcaccaacuggaagcgcguccuccucgcccucuccggccaggcccgcggcgacccccgcgccaucuccgcccaggaggcccacgcccccggccgccuccccucccucgccgacuucucccccgccgagaucaaccgccgccuccgcgccuaccucgccuuccucuucguccgcgagcccuucgagcgccucgccuccgccuaccgcaacaagcucgcccgccccuacuccgccgccuuccagcgccgcuacggcgcccgcaucguccagcgccuccgcccccgcgcccuccccgacgcccgcgcccgcggccacgacguccgcuucgccgaguuccucgccuaccuccucgacccccgcacccgccgcgaggagcccuucaacgagcacugggagcgcgcccacgcccucugccaccccugccgccuccgcuacgacgucgucggcaaguucgagacccucgccgaggacgccgccuucguccucggccucgccggcgccuccgaccucuccuuccccggccccccccgcccccgcggcgccgccgccucccgcgaccucgccgcccgccucuuccgcgacaucucccccuucuaccagcgccgccucuucgaccucuacaagauggacuuccuccucuucaacuacuccgcccccuccuaccuccgccuccucuga

SEQ ID NO: 41349 - RNA, 1131 nt, Artificial Sequence
  derived and/or modified sequence opt2 from CHST14__Homo_sapiens__NP_569735
auguucccccgcccccucaccccccucgccgcccccaacggcgccgagccccucggccgcgcccuccgccgcgccccccucggccgcgcccgcgccggccucggcggccccccccuccuccuccccuccaugcucauguucgccgucaucgucgccuccuccggccuccuccucaugaucgagcgcggcauccucgccgagaugaagccccucccccuccacccccccggccgcgagggcaccgccuggcgcggcaaggcccccaagcccggcggccucucccuccgcgccggcgacgccgaccuccagguccgccaggacguccgcaaccgcacccuccgcgccgucugcggccagcccggcaugccccgcgaccccugggaccuccccgucggccagcgccgcacccuccuccgccacauccucgucuccgaccgcuaccgcuuccucuacugcuacguccccaaggucgccugcuccaacuggaagcgcgucaugaagguccucgccggcguccucgacuccgucgacguccgccucaagauggaccaccgcuccgaccucgucuuccucgccgaccuccgccccgaggagauccgcuaccgccuccagcacuacuucaaguuccucuucguccgcgagccccucgagcgccuccucuccgccuaccgcaacaaguucggcgagauccgcgaguaccagcagcgcuacggcgccgagaucguccgccgcuaccgcgccggcgccggccccucccccgccggcgacgacgucaccuuccccgaguuccuccgcuaccucgucgacgaggaccccgagcgcaugaacgagcacuggaugcccgucuaccaccucugccagcccugcgccguccacuacgacuucgucggcuccuacgagcgccucgaggccgacgccaaccagguccucgaguggguccgcgcccccccccacguccgcuuccccgcccgccaggccugguaccgccccgccucccccgagucccuccacuaccaccucugcuccgccccccgcgcccuccuccaggacguccuccccaaguacauccucgacuucucccucuucgccuacccccuccccaacgucaccaaggaggccugccagcaguga

SEQ ID NO: 41350 - RNA, 1521 nt, Artificial Sequence
  derived and/or modified sequence opt2 from CHST15__Homo_sapiens__NP_001257694
augcgccacugcaucaacugcugcauccagcuccuccccgacggcgcccacaagcagcaggucaacugccagggcggcccccaccacggccaccaggccugccccaccugcaagggcgagaacaagauccucuuccgcgucgacuccaagcagaugaaccuccucgccguccucgagguccgcaccgagggcaacgagaacuggggcggcuuccuccgcuucaagaagggcaagcgcugcucccucgucuucggccucaucaucaugacccucgucauggccuccuacauccucuccggcgcccaccaggagcuccucaucuccucccccuuccacuacggcggcuuccccuccaaccccucccucauggacuccgagaaccccuccgacaccaaggagcaccaccaccaguccuccgucaacaacaucuccuacaugaaggacuaccccuccaucaagcucaucaucaacuccaucaccacccgcaucgaguucaccacccgccagcuccccgaccucgaggaccucaagaagcaggagcuccacauguucuccgucauccccaacaaguuccuccccaacuccaagucccccugcugguacgaggaguucuccggccagaacaccaccgaccccuaccucaccaacuccuacguccucuacuccaagcgcuuccgcuccaccuucgacgcccuccgcaaggccuucuggggccaccucgcccacgcccacggcaagcacuuccgccuccgcugccucccccacuucuacaucaucggccagcccaagugcggcaccaccgaccucuacgaccgccuccgccuccaccccgaggucaaguucuccgccaucaaggagccccacugguggacccgcaagcgcuucggcaucguccgccuccgcgacggccuccgcgaccgcuaccccgucgaggacuaccucgaccucuucgaccucgccgcccaccagauccaccagggccuccaggccuccuccgccaaggagcaguccaagaugaacaccaucaucaucggcgaggccuccgccuccaccaugugggacaacaacgccuggaccuucuucuacgacaacuccaccgacggcgagccccccuuccucacccaggacuucauccacgccuuccagcccaacgcccgccucaucgucaugcuccgcgaccccgucgagcgccucuacuccgacuaccucuacuucgccuccuccaacaaguccgccgacgacuuccacgagaaggucaccgaggcccuccagcucuucgagaacugcaugcucgacuacucccuccgcgccugcgucuacaacaacacccucaacaacgccaugcccgucugcaccccccccccccgcaccccccgcgccggccccuggcagaaggagcucgucugcugcuacuacgccuccggcaucgucggccuccgcuucuccaucggcaccgagcgcuccguccucaugugcaagugcugcuccccccucuucauggacgucaaggccgagaacuga

SEQ ID NO: 41351 - RNA, 1236 nt, Artificial Sequence
  derived and/or modified sequence opt2 from CHST1__Homo_sapiens__NP_003645
augcagugcuccuggaaggccguccuccuccucgcccucgccuccaucgccauccaguacaccgccauccgcaccuucaccgccaaguccuuccacaccugccccggccucgccgaggccggccucgccgagcgccucugcgaggagucccccaccuucgccuacaaccucucccgcaagacccacauccucauccucgccaccacccgcuccggcuccuccuucgucggccagcucuucaaccagcaccucgacgucuucuaccucuucgagccccucuaccacguccagaacacccucaucccccgcuucacccagggcaagucccccgccgaccgccgcgucaugcucggcgccucccgcgaccuccuccgcucccucuacgacugcgaccucuacuuccucgagaacuacaucaagcccccccccgucaaccacaccaccgaccgcaucuuccgccgcggcgccucccgcguccucugcucccgccccgucugcgacccccccggccccgccgaccucguccucgaggagggcgacugcguccgcaagugcggccuccucaaccucaccgucgccgccgaggccugccgcgagcgcucccacgucgccaucaagaccguccgcguccccgaggucaacgaccuccgcgcccucgucgaggacccccgccucaaccucaaggucauccagcucguccgcgacccccgcggcauccucgccucccgcuccgagaccuuccgcgacaccuaccgccucuggcgccucugguacggcaccggccgcaagcccuacaaccucgacgucacccagcucaccaccgucugcgaggacuucuccaacuccgucuccaccggccucaugcgcccccccuggcucaagggcaaguacaugcucguccgcuacgaggaccucgcccgcaaccccaugaagaagaccgaggagaucuacggcuuccucggcaucccccucgacucccacgucgcccgcuggauccagaacaacacccgcggcgaccccacccucggcaagcacaaguacggcaccguccgcaacuccgccgccaccgccgagaaguggcgcuuccgccucuccuacgacaucgucgccuucgcccagaacgccugccagcagguccucgcccagcucggcuacaagaucgccgccuccgaggaggagcucaagaaccccuccgucucccucgucgaggagcgcgacuuccgccccuucuccuga

SEQ ID NO: 41352 - RNA, 1593 nt, Artificial Sequence
  derived and/or modified sequence opt2 from CHST2__Homo_sapiens__NP_004258
augucccgcuccccccagcgcgcccucccccccggcgcccucccccgccuccuccaggccgcccccgccgccgccccccgcgcccuccucccccaguggccccgccgccccggccgccgcuggcccgccuccccccucggcaugaaggucuuccgccgcaaggcccucguccucugcgccggcuacgcccuccuccucguccucaccaugcucaaccuccucgacuacaaguggcacaaggagccccuccagcagugcaaccccgacggcccccucggcgccgccgccggcgccgccggcggcuccuggggccgccccggccccccccccgccggccccccccgcgcccacgcccgccucgaccuccgcacccccuaccgcccccccgccgccgccgucggcgccgcccccgccgccgccgccggcauggccggcgucgccgccccccccggcaacggcacccgcggcaccggcggcgucggcgacaagcgccagcucgucuacgucuucaccaccuggcgcuccggcuccuccuucuucggcgagcucuucaaccagaaccccgaggucuucuuccucuacgagcccgucuggcacgucuggcagaagcucuaccccggcgacgccgucucccuccagggcgccgcccgcgacaugcucuccgcccucuaccgcugcgaccucuccgucuuccagcucuacucccccgccggcuccggcggccgcaaccucaccacccucggcaucuucggcgccgccaccaacaaggucgucugcuccuccccccucugccccgccuaccgcaaggaggucgucggccucgucgacgaccgcgucugcaagaagugccccccccagcgccucgcccgcuucgaggaggagugccgcaaguaccgcacccucgucaucaagggcguccgcgucuucgacgucgccguccucgccccccuccuccgcgaccccgcccucgaccucaaggucauccaccucguccgcgacccccgcgccgucgccuccucccgcauccgcucccgccacggccucauccgcgagucccuccaggucguccgcucccgcgacccccgcgcccaccgcaugcccuuccucgaggccgccggccacaagcucggcgccaagaaggagggcgucggcggccccgccgacuaccacgcccucggcgccauggaggucaucugcaacuccauggccaagacccuccagaccgcccuccagccccccgacuggcuccagggccacuaccucgucguccgcuacgaggaccucgucggcgaccccgucaagacccuccgccgcgucuacgacuucgucggccuccucgucucccccgagauggagcaguucgcccucaacaugaccuccggcuccggcuccuccuccaagcccuucgucgucuccgcccgcaacgccacccaggccgccaacgccuggcgcaccgcccucaccuuccagcagaucaagcaggucgaggaguucugcuaccagcccauggccguccucggcuacgagcgcgucaacucccccgaggaggucaaggaccucuccaagacccuccuccgcaagccccgccucuga

SEQ ID NO: 41353 - RNA, 1440 nt, Artificial Sequence
  derived and/or modified sequence opt2 from CHST3__Homo_sapiens__XP_006718138
auggagaagggccucacccucccccaggacugccgcgacuucguccacucccucaagaugcgcuccaaguacgcccucuuccucgucuucgucgucaucgucuucgucuucaucgagaaggagaacaagaucaucucccgcgucuccgacaagcucaagcagaucccccaggcccucgccgacgccaacuccaccgaccccgcccucauccucgccgagaacgccucccuccucucccucuccgagcucgacuccgccuucucccagcuccagucccgccuccgcaaccucucccuccagcucggcgucgagcccgccauggaggccgccggcgaggaggaggaggagcagcgcaaggaggaggagcccccccgccccgccgucgccggcccccgccgccacguccuccucauggccaccacccgcaccggcuccuccuucgucggcgaguucuucaaccagcagggcaacaucuucuaccucuucgagccccucuggcacaucgagcgcaccgucuccuucgagcccggcggcgccaacgccgccggcuccgcccucgucuaccgcgacguccucaagcagcucuuccucugcgaccucuacguccucgagcacuucaucaccccccuccccgaggaccaccucacccaguucauguuccgccgcggcuccucccgcucccucugcgaggaccccgucugcacccccuucgucaagaaggucuucgagaaguaccacugcaagaaccgccgcugcggcccccucaacgucacccucgccgccgaggccugccgccgcaaggagcacauggcccucaaggccguccgcauccgccagcucgaguuccuccagccccucgccgaggacccccgccucgaccuccgcgucauccagcucguccgcgacccccgcgccguccucgccucccgcauggucgccuucgccggcaaguacaagaccuggaagaaguggcucgacgacgagggccaggacggccuccgcgaggaggagguccagcgccuccgcggcaacugcgaguccauccgccucuccgccgagcucggccuccgccagcccgccuggcuccgcggccgcuacaugcucguccgcuacgaggacgucgcccgcggcccccuccagaaggcccgcgagauguaccgcuucgccggcaucccccucaccccccaggucgaggacuggauccagaagaacacccaggccgcccacgacggcuccggcaucuacuccacccagaagaacuccuccgagcaguucgagaaguggcgcuucuccaugcccuucaagcucgcccaggucguccaggccgccugcggccccgccaugcgccucuucggcuacaagcucgcccgcgacgccgccgcccucaccaaccgcuccgucucccuccucgaggagcgcggcaccuucugggucaccuga

SEQ ID NO: 41354 - RNA, 1161 nt, Artificial Sequence
  derived and/or modified sequence opt2 from CHST4__Homo_sapiens__NP_005760
augcuccuccccaagaagaugaagcuccuccucuuccucgucucccagauggccauccucgcccucuucuuccacauguacucccacaacaucuccucccucuccaugaaggcccagcccgagcgcaugcacguccucguccucuccuccuggcgcuccggcuccuccuucgucggccagcucuucggccagcaccccgacgucuucuaccucauggagcccgccuggcacgucuggaugaccuucaagcaguccaccgccuggaugcuccacauggccguccgcgaccucauccgcgccgucuuccucugcgacauguccgucuucgacgccuacauggagcccggcccccgccgccaguccucccucuuccagugggagaacucccgcgcccucugcuccgcccccgccugcgacaucaucccccaggacgagaucaucccccgcgcccacugccgccuccucugcucccagcagcccuucgaggucgucgagaaggccugccgcuccuacucccacgucguccucaaggagguccgcuucuucaaccuccagucccucuacccccuccucaaggaccccucccucaaccuccacaucguccaccucguccgcgacccccgcgccgucuuccgcucccgcgagcgcaccaagggcgaccucaugaucgacucccgcaucgucaugggccagcacgagcagaagcucaagaaggaggaccagcccuacuacgucaugcaggucaucugccagucccagcucgagaucuacaagaccauccagucccuccccaaggcccuccaggagcgcuaccuccucguccgcuacgaggaccucgcccgcgcccccgucgcccagaccucccgcauguacgaguucgucggccucgaguuccucccccaccuccagaccuggguccacaacaucacccgcggcaagggcaugggcgaccacgccuuccacaccaacgcccgcgacgcccucaacgucucccaggccuggcgcuggucccuccccuacgagaaggucucccgccuccagaaggccugcggcgacgccaugaaccuccucggcuaccgccacguccgcuccgagcaggagcagcgcaaccuccuccucgaccuccucuccaccuggaccguccccgagcagauccacuga

SEQ ID NO: 41355 - RNA, 1236 nt, Artificial Sequence
  derived and/or modified sequence opt2 from CHST5__Homo_sapiens__NP_078809
augggcaugcgcgcccgcguccccaaggucgcccacuccacccgccgcccccccgccgcccgcauguggcucccccgcuucuccuccaagaccgucaccguccuccuccucgcccagaccaccugccuccuccucuucaucaucucccgccccggccccuccucccccgccggcggcgaggaccgcguccacguccucguccucuccuccuggcgcuccggcuccuccuuccucggccagcucuucucccagcaccccgacgucuucuaccucauggagcccgccuggcacgucuggaccacccucucccagggcuccgccgccacccuccacauggccguccgcgaccucaugcgcuccaucuuccucugcgacauggacgucuucgacgccuacaugccccagucccgcaaccucuccgccuucuucaacugggccaccucccgcgcccucugcuccccccccgccugcuccgccuucccccgcggcaccaucuccaagcaggacgucugcaagacccucugcacccgccagcccuucucccucgcccgcgaggccugccgcuccuacucccacgucguccucaaggagguccgcuucuucaaccuccagguccucuacccccuccucuccgaccccgcccucaaccuccgcaucguccaccucguccgcgacccccgcgccguccuccgcucccgcgaggccgccggccccauccucgcccgcgacaacggcaucguccucggcaccaacggcaagugggucgaggccgacccccaccuccgccucauccgcgaggucugccgcucccacguccgcaucgccgaggccgccacccucaagcccccccccuuccuccgcggccgcuaccgccucguccgcuucgaggaccucgcccgcgagccccucgccgagauccgcgcccucuacgccuucaccggccucacccucaccccccagcucgaggccuggauccacaacaucacccacggcuccggcaucggcaagcccaucgaggccuuccacaccuccucccgcaacgcccgcaacgucucccaggccuggcgccacgcccuccccuucaccaagauccuccgcguccaggaggucugcgccggcgcccuccagcuccucggcuaccgccccgucuacuccgccgaccagcagcgcgaccucacccucgaccucguccucccccgcggccccgaccacuucuccugggccucccccgacuga

SEQ ID NO: 41356 - RNA, 1188 nt, Artificial Sequence
  derived and/or modified sequence opt2 from CHST6__Homo_sapiens__XP_011521387
auguggcucccccgcgucuccuccaccgccgucaccgcccuccuccucgcccagaccuuccuccuccucuuccucgucucccgccccggccccuccucccccgccggcggcgaggcccgcguccacguccucguccucuccuccuggcgcuccggcuccuccuucgucggccagcucuucaaccagcaccccgacgucuucuaccucauggagcccgccuggcacgucuggaccacccucucccagggcuccgccgccacccuccacauggccguccgcgaccucguccgcuccgucuuccucugcgacauggacgucuucgacgccuaccuccccuggcgccgcaaccucuccgaccucuuccagugggccgucucccgcgcccucugcuccccccccgccugcuccgccuucccccgcggcgccaucuccuccgaggccgucugcaagccccucugcgcccgccaguccuucacccucgcccgcgaggccugccgcuccuacucccacgucguccucaaggagguccgcuucuucaaccuccagguccucuacccccuccucuccgaccccgcccucaaccuccgcaucguccaccucguccgcgacccccgcgccguccuccgcucccgcgagcagaccgccaaggcccucgcccgcgacaacggcaucguccucggcaccaacggcaccugggucgaggccgaccccggccuccgcgucguccgcgaggucugccgcucccacguccgcaucgccgaggccgccacccucaagcccccccccuuccuccgcggccgcuaccgccucguccgcuucgaggaccucgcccgcgagccccucgccgagauccgcgcccucuacgccuucaccggccucucccucaccccccagcucgaggccuggauccacaacaucacccacggcuccggccccggcgcccgccgcgaggccuucaagaccuccucccgcaacgcccucaacgucucccaggccuggcgccacgcccuccccuucgccaagauccgccgcguccaggagcucugcgccggcgcccuccagcuccucggcuaccgccccgucuacuccgaggacgagcagcgcaaccucgcccucgaccucguccucccccgcggccucaacggcuucaccugggccuccuccaccgccucccacccccgcaacuga

SEQ ID NO: 41357 - RNA, 1275 nt, Artificial Sequence
  derived and/or modified sequence opt2 from CHST8__Homo_sapiens__XP_011525528
augacccuccgccccggcaccaugcgccucgccugcauguucuccuccauccuccucuucggcgccgccggccuccuccucuucaucucccuccaggaccccaccgagcucgccccccagcagguccccggcaucaaguucaacauccgcccccgccagccccaccacgaccucccccccggcggcucccaggacggcgaccucaaggagcccaccgagcgcgucacccgcgaccucuccuccggcgccccccgcggccgcaaccuccccgcccccgaccagccccagcccccccuccagcgcggcacccgccuccgccuccgccagcgccgccgccgccuccucaucaagaagaugcccgccgccgccaccauccccgccaacuccuccgacgcccccuucauccgccccggccccggcacccucgacggccgcugggucucccuccaccgcucccagcaggagcgcaagcgcgucaugcaggaggccugcgccaaguaccgcgccuccuccucccgccgcgccgucaccccccgccacgucucccgcaucuucgucgaggaccgccaccgcguccucuacugcgagguccccaaggccggcugcuccaacuggaagcgcguccucaugguccucgccggccucgccuccuccaccgccgacauccagcacaacaccguccacuacggcuccgcccucaagcgccucgacaccuucgaccgccagggcauccuccaccgccucuccaccuacaccaagaugcucuucguccgcgagcccuucgagcgccucgucuccgccuuccgcgacaaguucgagcaccccaacuccuacuaccaccccgucuucggcaaggccauccucgcccgcuaccgcgccaacgccucccgcgaggcccuccgcaccggcuccggcguccgcuuccccgaguucguccaguaccuccucgacguccaccgccccgucggcauggacauccacugggaccacgucucccgccucugcucccccugccucaucgacuacgacuucgucggcaaguucgaguccauggaggacgacgccaacuucuuccucucccucauccgcgccccccgcaaccucaccuucccccgcuucaaggaccgccacucccaggaggcccgcaccaccgcccgcaucgcccaccaguacuucgcccagcucuccgcccuccagcgccagcgcaccuacgacuucuacuacauggacuaccucauguucaacuacuccaagcccuucgccgaccucuacuga

SEQ ID NO: 41358 - RNA, 225 nt, Artificial Sequence
  derived and/or modified sequence opt2 from CHST9__Homo_sapiens__NP_001243245
augcagcccuccgagauggucaugaaccccaagcaggucuuccucuccguccucaucuucggcgucgccggccuccuccucuucauguaccuccaggucuggaucgaggagcagcacaccggccgcgucgagaagcgccgcgagcagaaggucaccuccggcuggggccccgucaaguaccuccgccccgucccccgcaucaagccccaggucucccacgccuga

SEQ ID NO: 41359 - RNA, 2409 nt, Artificial Sequence
  derived and/or modified sequence opt2 from CHSY1__Homo_sapiens__NP_055733
auggccgcccgcggccgccgcgccuggcucuccguccuccucggccucguccucggcuucguccucgccucccgccucguccucccccgcgccuccgagcucaagcgcgccggcccccgccgccgcgccucccccgagggcugccgcuccggccaggccgccgccucccaggccggcggcgcccgcggcgacgcccgcggcgcccagcucuggccccccggcuccgaccccgacggcggcccccgcgaccgcaacuuccucuucgucggcgucaugaccgcccagaaguaccuccagacccgcgccgucgccgccuaccgcaccugguccaagaccauccccggcaagguccaguucuucuccuccgagggcuccgacaccuccguccccauccccgucgucccccuccgcggcgucgacgacuccuaccccccccagaagaaguccuucaugaugcucaaguacaugcacgaccacuaccucgacaaguacgagugguucaugcgcgccgacgacgacgucuacaucaagggcgaccgccucgagaacuuccuccgcucccucaacuccuccgagccccucuuccucggccagaccggccucggcaccaccgaggagaugggcaagcucgcccucgagcccggcgagaacuucugcaugggcggccccggcgucaucaugucccgcgagguccuccgccgcauggucccccacaucggcaagugccuccgcgagauguacaccacccacgaggacgucgaggucggccgcugcguccgccgcuucgccggcguccagugcgucugguccuacgagaugcagcagcucuucuacgagaacuacgagcagaacaagaagggcuacauccgcgaccuccacaacuccaagauccaccaggccaucacccuccaccccaacaagaacccccccuaccaguaccgccuccacuccuacaugcucucccgcaagaucuccgagcuccgccaccgcaccauccagcuccaccgcgagaucguccucauguccaaguacuccaacaccgagauccacaaggaggaccuccagcucggcaucccccccuccuucaugcgcuuccagccccgccagcgcgaggagauccucgagugggaguuccucaccggcaaguaccucuacuccgccgucgacggccagcccccccgccgcggcauggacuccgcccagcgcgaggcccucgacgacaucgucaugcaggucauggagaugaucaacgccaacgccaagacccgcggccgcaucaucgacuucaaggagauccaguacggcuaccgccgcgucaaccccauguacggcgccgaguacauccucgaccuccuccuccucuacaagaagcacaagggcaagaagaugaccguccccguccgccgccacgccuaccuccagcagaccuucuccaagauccaguucgucgagcacgaggagcucgacgcccaggagcucgccaagcgcaucaaccaggaguccggcucccucuccuuccucuccaacucccucaagaagcucguccccuuccagcuccccggcuccaaguccgagcacaaggagcccaaggacaagaagaucaacauccucaucccccucuccggccgcuucgacauguucguccgcuucaugggcaacuucgagaagaccugccucauccccaaccagaacgucaagcucgucguccuccucuucaacuccgacuccaaccccgacaaggccaagcaggucgagcucaugcgcgacuaccgcaucaaguaccccaaggccgacaugcagauccuccccgucuccggcgaguucucccgcgcccucgcccucgaggucggcuccucccaguucaacaacgagucccuccucuucuucugcgacgucgaccucgucuucaccaccgaguuccuccagcgcugccgcgccaacaccguccucggccagcagaucuacuuccccaucaucuucucccaguacgaccccaagaucgucuacuccggcaagguccccuccgacaaccacuucgccuucacccagaagaccggcuucuggcgcaacuacggcuucggcaucaccugcaucuacaagggcgaccucguccgcgucggcggcuucgacgucuccauccagggcuggggccucgaggacgucgaccucuucaacaaggucguccaggccggccucaagaccuuccgcucccaggaggucggcgucguccacguccaccaccccgucuucugcgaccccaaccucgaccccaagcaguacaagaugugccucggcuccaaggccuccaccuacggcuccacccagcagcucgccgagauguggcucgagaagaacgaccccuccuacuccaaguccuccaacaacaacggcuccguccgcaccgccuga

SEQ ID NO: 41360 - RNA, 2649 nt, Artificial Sequence
  derived and/or modified sequence opt2 from CHSY3__Homo_sapiens__NP_787052
auggccguccgcucccgccgccccuggauguccgucgcccucggccucguccucggcuucaccgccgccuccuggcucaucgccccccgcgucgccgagcucuccgagcgcaagcgccgcggcuccucccucugcuccuacuacggccgcuccgccgccggcccccgcgccggcgcccagcagccccucccccagccccagucccgcccccgccaggagcagucccccccccccgcccgccaggaccuccagggccccccccuccccgaggccgcccccggcaucaccuccuuccgcuccucccccuggcagcagccccccccccuccagcagcgccgccgcggccgcgagcccgagggcgccaccggccuccccggcgcccccgccgccgagggcgagcccgaggaggaggacggcggcgccgccggccagcgccgcgacggccgccccggcuccucccacaacggcuccggcgacggcggcgccgccgcccccuccgcccgcccccgcgacuuccucuacgucggcgucaugaccgcccagaaguaccucggcucccgcgcccucgccgcccagcgcaccugggcccgcuucauccccggccgcgucgaguucuucuccucccagcagccccccaacgccggccagcccccccccccccuccccgucaucgcccuccccggcgucgacgacuccuaccccccccagaagaaguccuucaugaugaucaaguacaugcacgaccacuaccucgacaaguacgagugguucaugcgcgccgacgacgacgucuacaucaagggcgacaagcucgaggaguuccuccgcucccucaacuccuccaagccccucuaccucggccagaccggccucggcaacaucgaggagcucggcaagcucggccucgagcccggcgagaacuucugcaugggcggccccggcaugaucuucucccgcgagguccuccgccgcauggucccccacaucggcgagugccuccgcgagauguacaccacccacgaggacgucgaggucggccgcugcguccgccgcuucggcggcacccagugcgucugguccuacgagaugcagcagcucuuccacgagaacuacgagcacaaccgcaagggcuacauccaggaccuccacaacuccaagauccacgccgccaucacccuccaccccaacaagcgccccgccuaccaguaccgccuccacaacuacaugcucucccgcaagaucuccgagcuccgcuaccgcaccauccagcuccaccgcgaguccgcccucauguccaagcucuccaacaccgaggucuccaaggaggaccagcagcucggcgucauccccuccuucaaccacuuccagccccgcgagcgcaacgaggucaucgagugggaguuccucaccggcaagcuccucuacuccgccgccgagaaccagcccccccgccagucccucuccuccauccuccgcaccgcccucgacgacaccguccuccaggucauggagaugaucaacgagaacgccaagucccgcggccgccucaucgacuucaaggagauccaguacggcuaccgccgcgucaaccccaugcacggcgucgaguacauccucgaccuccuccuccucuacaagcgccacaagggccgcaagcucaccguccccguccgccgccacgccuaccuccagcagcucuucuccaagcccuucuuccgcgagaccgaggagcucgacgucaacucccucgucgaguccaucaacuccgagacccaguccuucuccuucaucuccaacucccucaagauccucuccuccuuccagggcgccaaggagaugggcggccacaacgagaagaagguccacauccucgucccccucaucggccgcuacgacaucuuccuccgcuucauggagaacuucgagaacaugugccucauccccaagcagaacgucaagcucgucaucauccucuucucccgcgacuccggccaggacuccuccaagcacaucgagcucaucaagggcuaccagaacaaguaccccaaggccgagaugacccucauccccaugaagggcgaguucucccgcggccucggccucgagauggccuccgcccaguucgacaacgacacccuccuccucuucugcgacgucgaccucaucuuccgcgaggacuuccuccagcgcugccgcgacaacaccauccagggccagcaggucuacuaccccaucaucuucucccaguacgaccccaaggucaccaacggcggcaacccccccaccgacgacuacuucaucuucuccaagaagaccggcuucuggcgcgacuacggcuacggcaucaccugcaucuacaaguccgaccuccucggcgccggcggcuucgacaccuccauccagggcuggggccucgaggacgucgaccucuacaacaaggucauccucuccggccuccgccccuuccgcucccaggaggucggcgucguccacaucuuccaccccguccacugcgaccccaaccucgaccccaagcaguacaagaugugccucggcuccaaggccuccaccuucgccuccaccaugcagcucgccgagcucuggcucgagaagcaccucggcguccgcuacaaccgcacccucuccuga

SEQ ID NO: 41361 - RNA, 2928 nt, Artificial Sequence
  derived and/or modified sequence opt2 from CHTF18__Homo_sapiens__NP_071375
auggaggacuacgagcaggagcucugcggcgucgaggacgacuuccacaaccaguucgccgccgagcucgagguccucgccgagcucgagggcgccuccacccccucccccuccggcgucccccucuucaccgccggccgccccccccgcaccuucgaggaggcccucgcccgcggcgacgccgccuccucccccgcccccgccgccuccgucggcuccucccagggcggcgcccgcaagcgccaggucgacgccgaccuccagcccgccggcucccucccccacgccccccgcaucaagcgcccccgccuccaggucgucaagcgccucaacuuccgcuccgaggagauggaggagccccccccccccgacuccucccccaccgacaucacccccccccccucccccgaggaccucgccgagcucuggggccacggcgucuccgaggccgccgccgacgucggccucacccgcgccucccccgccgcccgcaaccccguccuccgccgcccccccauccucgaggacuacguccacgucaccuccaccgagggcguccgcgccuaccucguccuccgcgccgaccccauggcccccggcguccagggcucccuccuccacguccccuggcgcggcggcggccagcucgaccuccucggcgucucccucgccucccucaagaagcaggucgacggcgagcgccgcgagcgccuccuccaggaggcccagaagcucuccgacacccuccacucccuccgcuccggcgaggaggaggccgcccagccccucggcgcccccgaggaggagcccaccgacggccaggacgccuccucccacugccucugggucgacgaguucgccccccgccacuacaccgagcuccucuccgacgacuucaccaaccgcugccuccucaaguggcucaagcucugggaccucgucgucuucggccacgagcgccccucccgcaagccccgccccuccgucgagcccgcccgcgucuccaaggaggccaccgcccccggcaaguggaagucccacgagcagguccucgaggagaugcucgaggccggccucgaccccucccagcgccccaagcagaaggucgcccuccucugcggcccccccggccucggcaagaccacccucgcccacgucaucgcccgccacgccggcuacuccgucgucgagaugaacgccuccgacgaccgcucccccgaggucuuccgcacccgcaucgaggccgccacccagauggaguccguccucggcgccggcggcaagcccaacugccucgucaucgacgagaucgacggcgcccccgucgccgccaucaacguccuccucuccauccucaaccgcaagggcccccaggaggucggcccccagggccccgccguccccuccggcggcggccgccgccgccgcgccgagggcggccuccucaugcgccccaucaucugcaucugcaacgaccaguucgcccccucccuccgccagcucaagcagcaggccuuccuccuccacuucccccccacccuccccucccgccucguccagcgccuccaggaggucucccuccgccagggcaugcgcgccgaccccggcguccucgccgcccucugcgagaagaccgacaacgacauccgcgccugcaucaacacccuccaguuccucuacucccgcggccagcgcgagcucuccguccgcgacguccaggccacccgcgucggccucaaggaccagcgccgcggccucuucuccgucuggcaggaggucuuccagcucccccgcgcccagcgccgccgcgucggccaggaccccgcccuccccgccgacacccuccuccucggcgacggcgacgccggcucccucaccuccgccucccagcgcuucuaccgcguccuccacgccgccgccuccgccggcgagcacgagaaggucguccagggccucuucgacaacuuccuccgccuccgccuccgcgacuccucccucggcgccgucugcgucgcccucgacuggcucgccuucgacgaccuccucgccggcgccgcccaccacucccaguccuuccagcuccuccgcuacccccccuuccuccccgucgccuuccacguccucuucgccuccucccacaccccccgcaucaccuuccccuccucccagcaggaggcccagaaccgcaugucccagaugcgcaaccucauccagacccucgucuccggcaucgcccccgccacccgcucccgcgccaccccccaggcccuccuccucgacgcccucugccuccuccucgacauccucgcccccaagcuccgccccgucuccacccagcucuacuccacccgcgagaagcagcagcucgccucccucgucggcaccaugcucgccuacucccucaccuaccgccaggagcgcacccccgacggccaguacaucuaccgccucgagcccaacgucgaggagcucugccgcuuccccgagcuccccgcccgcaagccccucaccuaccagaccaagcagcucaucgcccgcgagaucgaggucgagaagaugcgccgcgccgaggccuccgcccgcgucgagaacuccccccaggucgacggcuccccccccggccucgagggccuccucggcggcaucggcgagaagggcguccaccgccccgccccccgcaaccacgagcagcgccucgagcacaucaugcgccgcgccgcccgcgaggagcagcccgagaaggacuucuucggccgcgucgucguccgcuccaccgccguccccuccgccggcgacaccgcccccgagcaggacuccgucgagcgccgcaugggcaccgccgucggccgcuccgaggucugguuccgcuucaacgagggcgucuccaacgccguccgccgcucccucuacauccgcgaccuccucuga

SEQ ID NO: 41362 - RNA, 750 nt, Artificial Sequence
  derived and/or modified sequence opt2 from CHTOP__Homo_sapiens__NP_001193541
auggccgcccaguccgcccccaaggucguccucaaguccaccaccaagaugucccucaacgagcgcuucaccaacaugcucaagaacaagcagcccacccccgucaacauccgcgccuccaugcagcagcagcagcagcucgccuccgcccgcaaccgccgccucgcccagcagauggagaaccgccccuccguccaggccgcccucaagcucaagcagaagucccucaagcagcgccucggcaaguccaacauccaggcccgccucggccgccccaucggcgcccucgcccgcggcgccaucggcggccgcggccuccccaucauccagcgcggccucccccgcggcggccuccgcggcggccgcgccacccgcacccuccuccgcggcggcaugucccuccgcggccagaaccuccuccgcggcggccgcgccgucgccccccgcaugggccuccgccgcggcggcguccgcggccgcggcggccccggccgcggcggccucggccgcggcgccaugggccgcggcggcaucggcggccgcggccgcggcaugaucggccgcggccgcggcggcuucggcggccgcggccgcggccgcggccgcggccgcggcgcccucgcccgccccguccucaccaaggagcagcucgacaaccagcucgacgccuacauguccaagaccaagggccaccucgacgccgagcucgacgccuacauggcccagaccgaccccgagaccaacgacuga

SEQ ID NO: 41363 - RNA, 420 nt, Artificial Sequence
  derived and/or modified sequence opt2 from CHURC1__Homo_sapiens__NP_001190992
augcgccagcccuaccucuccucccgcgaggucuccuccucccgcaagcgcuggcgcaccuuccccgucgacugcgucgccaugugcggcgacugcgucgagaaggaguaccccaaccgcggcaacaccugccucgagaacggcuccuuccuccucaacuucaccggcugcgccgucugcuccaagcgcgacuucaugcucaucaccaacaagucccucaaggaggaggacggcgaggagaucgucaccuacgaccaccucugcaagaacugccaccacgucaucgcccgccacgaguacaccuucuccaucauggacgaguuccaggaguacaccaugcucugccuccucugcggcaaggccgaggacaccaucuccauccuccccgacgacccccgccagaugacccuccucuucuga

SEQ ID NO: 41364 - RNA, 1020 nt, Artificial Sequence
  derived and/or modified sequence opt2 from CIAO1__Homo_sapiens__NP_004795
augaaggacucccucguccuccucggccgcguccccgcccaccccgacucccgcugcugguuccucgccuggaaccccgccggcacccuccucgccuccugcggcggcgaccgccgcauccgcaucuggggcaccgagggcgacuccuggaucugcaaguccguccucuccgagggccaccagcgcaccguccgcaaggucgccuggucccccugcggcaacuaccucgccuccgccuccuucgacgccaccaccugcaucuggaagaagaaccaggacgacuucgagugcgucaccacccucgagggccacgagaacgaggucaaguccgucgccugggcccccuccggcaaccuccucgccaccugcucccgcgacaaguccgucugggucugggaggucgacgaggaggacgaguacgagugcgucuccguccucaacucccacacccaggacgucaagcacgucgucuggcaccccucccaggagcuccucgccuccgccuccuacgacgacaccgucaagcucuaccgcgaggaggaggacgacugggucugcugcgccacccucgagggccacgaguccaccgucuggucccucgccuucgaccccuccggccagcgccucgccuccugcuccgacgaccgcaccguccgcaucuggcgccaguaccuccccggcaacgagcagggcgucgccugcuccggcuccgaccccuccuggaagugcaucugcacccucuccggcuuccacucccgcaccaucuacgacaucgccuggugccagcucaccggcgcccucgccaccgccugcggcgacgacgccauccgcgucuuccaggaggaccccaacuccgacccccagcagcccaccuucucccucaccgcccaccuccaccaggcccacucccaggacgucaacugcgucgccuggaaccccaaggagcccggccuccucgccuccugcuccgacgacggcgaggucgccuucuggaaguaccagcgccccgagggccucuga

SEQ ID NO: 41365 - RNA, 939 nt, Artificial Sequence
  derived and/or modified sequence opt2 from CIAPIN1__Homo_sapiens__NP_064709
auggccgacuucggcaucuccgccggccaguucgucgccgucgucugggacaaguccucccccgucgaggcccucaagggccucgucgacaagcuccaggcccucaccggcaacgagggccgcgucuccgucgagaacaucaagcagcuccuccaguccgcccacaaggaguccuccuucgacaucauccucuccggccucguccccggcuccaccacccuccacuccgccgagauccucgccgagaucgcccgcauccuccgccccggcggcugccucuuccucaaggagcccgucgagaccgccgucgacaacaacuccaaggucaagaccgccuccaagcucugcuccgcccucacccucuccggccucgucgaggucaaggagcuccagcgcgagccccucacccccgaggagguccaguccguccgcgagcaccucggccacgaguccgacaaccuccucuucguccagaucaccggcaagaagcccaacuucgaggucggcuccucccgccagcucaagcucuccaucaccaagaaguccucccccuccgucaagcccgccgucgaccccgccgccgccaagcucuggacccucuccgccaacgacauggaggacgacuccauggaccucaucgacuccgacgagcuccucgaccccgaggaccucaagaagcccgaccccgccucccuccgcgccgccuccugcggcgagggcaagaagcgcaaggccugcaagaacugcaccugcggccucgccgaggagcucgagaaggagaagucccgcgagcagauguccucccagcccaaguccgccugcggcaacugcuaccucggcgacgccuuccgcugcgccuccugccccuaccucggcaugcccgccuucaagcccggcgagaagguccuccucuccgacuccaaccuccacgacgccuga

SEQ ID NO: 41366 - RNA, 576 nt, Artificial Sequence
  derived and/or modified sequence opt2 from CIB1__Homo_sapiens__NP_006375
augggcggcuccggcucccgccucuccaaggagcuccucgccgaguaccaggaccucaccuuccucaccaagcaggagauccuccucgcccaccgccgcuucugcgagcuccucccccaggagcagcgcuccgucgaguccucccuccgcgcccagguccccuucgagcagauccucucccuccccgagcucaaggccaaccccuucaaggagcgcaucugccgcgucuucuccaccucccccgccaaggacucccucuccuucgaggacuuccucgaccuccucuccgucuucuccgacaccgccacccccgacaucaagucccacuacgccuuccgcaucuucgacuucgacgacgacggcacccucaaccgcgaggaccucucccgccucgucaacugccucaccggcgagggcgaggacacccgccucuccgccuccgagaugaagcagcucaucgacaacauccucgaggaguccgacaucgaccgcgacggcaccaucaaccucuccgaguuccagcacgucaucucccgcucccccgacuucgccuccuccuucaagaucguccucuga

SEQ ID NO: 41367 - RNA, 564 nt, Artificial Sequence
  derived and/or modified sequence opt2 from CIB2__Homo_sapiens__NP_006374
augggcaacaagcagaccaucuucaccgaggagcagcucgacaacuaccaggacugcaccuucuucaacaagaaggacauccucaagcuccacucccgcuucuacgagcucgcccccaaccucguccccauggacuaccgcaagucccccaucguccacguccccaugucccucaucauccagaugcccgagcuccgcgagaaccccuucaaggagcgcaucgucgccgccuucuccgaggacggcgagggcaaccucaccuucaacgacuucgucgacauguucuccguccucugcgaguccgccccccgcgagcucaaggccaacuacgccuucaagaucuacgacuucaacaccgacaacuucaucugcaaggaggaccucgagcucacccucgcccgccucaccaaguccgagcucgacgaggaggaggucguccucgucugcgacaaggucaucgaggaggccgaccucgacggcgacggcaagcucggcuucgccgacuucgaggacaugaucgccaaggcccccgacuuccucuccaccuuccacauccgcaucuga

SEQ ID NO: 41368 - RNA, 4827 nt, Artificial Sequence
  derived and/or modified sequence opt2 from CIC__Homo_sapiens__NP_055940
auguacuccgcccaccgcccccucaugcccgccuccuccgccgccucccgcggccucggcauguucgucuggaccaacgucgagccccgcuccgucgccgucuuccccuggcacucccucguccccuuccucgcccccucccagcccgaccccuccguccagcccuccgaggcccagcagcccgccucccaccccgucgccuccaaccaguccaaggagcccgccgaguccgccgccgucgcccacgagcgcccccccggcggcaccggcuccgccgaccccgagcgcccccccggcgccaccugccccgagucccccggccccggccccccccacccccucggcgucgucgaguccggcaagggccccccccccaccaccgaggaggaggccuccggcccccccggcgagccccgccucgacuccgagaccgaguccgaccacgacgacgccuuccucuccaucaugucccccgagauccagcucccccucccccccggcaagcgccgcacccagucccucuccgcccuccccaaggagcgcgacuccuccuccgagaaggacggccgcucccccaacaagcgcgagaaggaccacauccgccgccccaugaacgccuucaugaucuucuccaagcgccaccgcgcccucguccaccagcgccaccccaaccaggacaaccgcaccgucuccaagauccucggcgaguggugguacgcccucggccccaaggagaagcagaaguaccacgaccucgccuuccaggucaaggaggcccacuucaaggcccaccccgacuggaaguggugcaacaaggaccgcaagaaguccuccuccgaggccaagcccaccucccucggccucgccggcggccacaaggagacccgcgagcgcuccauguccgagaccggcaccgccgccgcccccggcgucuccuccgagcuccucuccgucgccgcccagacccuccucuccuccgacaccaaggcccccggcuccuccuccugcggcgccgagcgccuccacaccgucggcggccccggcuccgcccgcccccgcgccuucucccacuccggcguccacucccucgacggcggcgaggucgacucccaggcccuccaggagcucacccagauggucuccggccccgccuccuacuccggccccaagcccuccacccaguacggcgcccccggccccuucgccgcccccggcgagggcggcgcccucgccgccaccggccgccccccccuccuccccacccgcgccucccgcucccagcgcgccgccuccgaggacaugaccuccgacgaggagcgcauggucaucugcgaggaggagggcgacgacgacgucaucgccgacgacggcuucggcaccaccgacaucgaccucaagugcaaggagcgcgucaccgacuccgaguccggcgacuccuccggcgaggaccccgagggcaacaagggcuucggccgcaaggucuucucccccgucauccgcuccuccuucacccacugccgccccccccucgaccccgagccccccggcccccccgacccccccgucgccuucggcaagggcuacggcuccgcccccuccuccuccgccuccucccccgccuccuccuccgccuccgccgccaccuccuucucccucggcuccggcaccuucaaggcccaggaguccggccagggcuccaccgccggcccccuccgcccccccccccccggcgccggcggccccgccacccccuccaaggccacccgcuuccuccccauggaccccgccaccuuccgccgcaagcgccccgaguccgucggcggccucgagccccccggccccuccgucaucgccgccccccccuccggcggcggcaacauccuccagacccucguccucccccccaacaaggaggagcaggagggcggcggcgcccgcguccccuccgcccccgcccccucccucgccuacggcgcccccgccgccccccucucccgccccgccgccaccauggucaccaacgucguccgccccgucuccuccacccccguccccaucgccuccaagcccuuccccaccuccggccgcgccgaggccucccccaacgacaccgccggcgcccgcaccgagaugggcaccggcucccgcguccccggcggcuccccccucggcgucucccucgucuacuccgacaagaaguccgccgccgccaccucccccgccccccaccucgucgccggcccccuccucggcaccgucggcaaggcccccgccaccgucaccaaccuccucgucggcacccccggcuacggcgcccccgccccccccgccguccaguucaucgcccagggcgcccccggcggcggcaccaccgccggcuccggcgccggcgccggcuccggccccaacggccccgucccccucggcauccuccagcccggcgcccucggcaaggccggcggcaucacccagguccaguacauccuccccacccucccccagcagcuccaggucgcccccgcccccgcccccgcccccggcaccaaggccgccgcccccuccggccccgcccccaccaccuccauccgcuucacccucccccccggcaccuccaccaacggcaagguccucgccgccaccgcccccacccccggcauccccauccuccaguccguccccuccgcccccccccccaaggcccaguccgucucccccguccaggcccccccccccggcggcuccgcccagcuccuccccggcaagguccucgucccccucgccgcccccuccauguccguccgcggcggcggcgccggccagccccucccccucgucuccccccccuucuccguccccguccagaacggcgcccagccccccuccaagaucauccagcucacccccguccccgucuccacccccuccggccucguccccccccucucccccgccacccuccccggccccaccucccagccccagaagguccuccuccccuccuccacccgcaucaccuacguccaguccgccggcggccacgcccucccccucggcaccucccccgccuccucccaggccggcaccgucaccuccuacggccccaccuccuccgucgcccucggcuucaccucccucggccccuccggccccgccuucguccagccccuccucuccgccggccaggccccccuccucgcccccggccaggucggcgucucccccguccccuccccccagcucccccccgccugcgccgcccccggcggccccgucaucaccgccuucuacuccggcucccccgcccccaccuccuccgccccccucgcccagcccucccaggccccccccucccucgucuacaccgucgccaccuccaccaccccccccgccgccaccauccuccccaagggcccccccgcccccgccaccgccacccccgcccccaccucccccuuccccuccgccaccgccggcuccaugaccuacucccucgucgcccccaaggcccagcgccccucccccaaggccccccagaaggucaaggccgccaucgccuccauccccgucggcuccuucgaggccggcgccuccggccgccccggccccgccccccgccagccccucgagcccggccccguccgcgagcccaccgcccccgaguccgagcucgagggccagcccaccccccccgccccccccccccuccccgagaccuggacccccaccgcccgcuccucccccccccuccccccccccgccgaggagcgcaccuccgccaagggccccgagaccauggccuccaaguuccccuccuccuccuccgacuggcgcguccccggccagggccucgagaaccgcggcgagccccccaccccccccucccccgcccccgcccccgccgucgcccccggcggcuccuccgaguccuccuccggccgcgccgccggcgacacccccgagcgcaaggaggccgccggcaccggcaagaaggucaagguccgcccccccccccucaagaagaccuucgacuccgucgacaaccgcguccucuccgaggucgacuucgaggagcgcuucgccgagcuccccgaguuccgccccgaggagguccuccccucccccacccuccagucccucgccaccuccccccgcgccauccucggcuccuaccgcaagaagcgcaagaacuccaccgaccucgacuccgcccccgaggaccccaccucccccaagcgcaagaugcgccgccgcuccuccugcuccuccgagcccaacacccccaaguccgccaagugcgagggcgacaucuucaccuucgaccgcaccggcaccgaggccgaggacguccucggcgagcucgaguacgacaagguccccuacuccucccuccgccgcacccucgaccagcgccgcgcccucgucaugcagcucuuccaggaccacggcuucuuccccuccgcccaggccaccgccgccuuccaggcccgcuacgccgacaucuuccccuccaaggucugccuccagcucaagauccgcgagguccgccagaagaucaugcaggccgccacccccaccgagcagccccccggcgccgaggccccccuccccguccccccccccaccggcaccgccgccgcccccgcccccacccccucccccgccggcggccccgaccccaccucccccuccuccgacuccggcaccgcccaggccgcccccccccucccccccccccccgaguccggccccggccagcccggcugggagggcgccccccagcccuccccccccccccccggccccuccaccgccgccaccggccgcuga

SEQ ID NO: 41369 - RNA, 660 nt, Artificial Sequence
  derived and/or modified sequence opt2 from CIDEB__Homo_sapiens__NP_001305736
auggaguaccucuccgcccucaaccccuccgaccuccuccgcuccgucuccaacaucuccuccgaguucggccgccgcgucuggaccuccgccccccccccccagcgccccuuccgcgucugcgaccacaagcgcaccauccgcaagggccucaccgccgccacccgccaggagcuccucgccaaggcccucgagacccuccuccucaacggcguccucacccucguccucgaggaggacggcaccgccgucgacuccgaggacuucuuccagcuccucgaggacgacaccugccucaugguccuccaguccggccaguccuggucccccacccgcuccggcguccucuccuacggccucggccgcgagcgccccaagcacuccaaggacaucgcccgcuucaccuucgacgucuacaagcagaacccccgcgaccucuucggcucccucaacgucaaggccaccuucuacggccucuacuccauguccugcgacuuccagggccucggccccaagaagguccuccgcgagcuccuccgcuggaccuccacccuccuccagggccucggccacaugcuccucggcaucuccuccacccuccgccacgccgucgagggcgccgagcaguggcagcagaagggccgccuccacuccuacuga

SEQ ID NO: 41370 - RNA, 747 nt, Artificial Sequence
  derived and/or modified sequence opt2 from CIDEC__Homo_sapiens__NP_001186480
auggaguacgccaugaagucccucucccuccucuaccccaagucccucucccgccacgucuccguccgcaccuccgucgucacccagcagcuccucuccgagcccucccccaaggccccccgcgcccgccccugccgcgucuccaccgccgaccgcuccguccgcaagggcaucauggccuacucccucgaggaccuccuccucaagacccgcaaccccgaggcccgcucccaggagguccgcgacacccucaugcucgccgacaagcccuucuuccucguccucgaggaggacggcaccaccgucgagaccgaggaguacuuccaggcccucgccggcgacaccgucuucaugguccuccagaagggccagaaguggcagccccccuccgagcagggcacccgccacccccucucccucucccacaagcccgccaagaagaucgacgucgcccgcgucaccuucgaccucuacaagcucaacccccaggacuucaucggcugccucaacgucaaggccaccuucuacgacaccuacucccucuccuacgaccuccacugcugcggcgccaagcgcaucaugaaggaggccuuccgcugggcccucuucuccaugcaggccaccggccacguccuccucggcaccuccugcuaccuccagcagcuccucgacgccaccgaggagggccagccccccaagggcaaggccuccucccucauccccaccugccucaagauccuccaguga

SEQ ID NO: 41371 - RNA, 3393 nt, Artificial Sequence
  derived and/or modified sequence opt2 from CIITA__Homo_sapiens__NP_000237
augcgcugccucgccccccgccccgccggcuccuaccucuccgagccccagggcuccucccagugcgccaccauggagcucggcccccucgagggcggcuaccucgagcuccucaacuccgacgccgacccccucugccucuaccacuucuacgaccagauggaccucgccggcgaggaggagaucgagcucuacuccgagcccgacaccgacaccaucaacugcgaccaguucucccgccuccucugcgacauggagggcgacgaggagacccgcgaggccuacgccaacaucgccgagcucgaccaguacgucuuccaggacucccagcucgagggccucuccaaggacaucuucaagcacaucggccccgacgaggucaucggcgaguccauggagaugcccgccgaggucggccagaagucccagaagcgccccuuccccgaggagcuccccgccgaccucaagcacuggaagcccgccgagccccccaccgucgucaccggcucccuccucgucggccccgucuccgacugcuccacccuccccugccucccccuccccgcccucuucaaccaggagcccgccuccggccagaugcgccucgagaagaccgaccagauccccaugcccuucuccuccuccucccucuccugccucaaccuccccgagggccccauccaguucguccccaccaucuccacccucccccacggccucuggcagaucuccgaggccggcaccggcgucuccuccaucuucaucuaccacggcgaggucccccaggccucccagguccccccccccuccggcuucaccguccacggccuccccaccucccccgaccgccccggcuccaccucccccuucgcccccuccgccaccgaccuccccuccaugcccgagcccgcccucaccucccgcgccaacaugaccgagcacaagaccucccccacccagugccccgccgccggcgaggucuccaacaagcuccccaaguggcccgagcccgucgagcaguucuaccgcucccuccaggacaccuacggcgccgagcccgccggccccgacggcauccucgucgaggucgaccucguccaggcccgccucgagcgcuccuccuccaagucccucgagcgcgagcucgccacccccgacugggccgagcgccagcucgcccagggcggccucgccgagguccuccucgccgccaaggagcaccgccgcccccgcgagacccgcgucaucgccguccucggcaaggccggccagggcaaguccuacugggccggcgccgucucccgcgccugggccugcggccgccucccccaguacgacuucgucuucuccguccccugccacugccucaaccgccccggcgacgccuacggccuccaggaccuccucuucucccucggcccccagccccucgucgccgccgacgaggucuucucccacauccucaagcgccccgaccgcguccuccucauccucgacggcuucgaggagcucgaggcccaggacggcuuccuccacuccaccugcggccccgcccccgccgagcccugcucccuccgcggccuccucgccggccucuuccagaagaagcuccuccgcggcugcacccuccuccucaccgcccgcccccgcggccgccucguccagucccucuccaaggccgacgcccucuucgagcucuccggcuucuccauggagcaggcccaggccuacgucaugcgcuacuucgaguccuccggcaugaccgagcaccaggaccgcgcccucacccuccuccgcgaccgcccccuccuccucucccacucccacucccccacccucugccgcgccgucugccagcucuccgaggcccuccucgagcucggcgaggacgccaagcuccccuccacccucaccggccucuacgucggccuccucggccgcgccgcccucgacuccccccccggcgcccucgccgagcucgccaagcucgccugggagcucggccgccgccaccaguccacccuccaggaggaccaguuccccuccgccgacguccgcaccugggccauggccaagggccucguccagcaccccccccgcgccgccgaguccgagcucgccuuccccuccuuccuccuccagugcuuccucggcgcccucuggcucgcccucuccggcgagaucaaggacaaggagcucccccaguaccucgcccucaccccccgcaagaagcgccccuacgacaacuggcucgagggcgucccccgcuuccucgccggccucaucuuccagccccccgcccgcugccucggcgcccuccucggccccuccgccgccgccuccgucgaccgcaagcagaagguccucgcccgcuaccucaagcgccuccagcccggcacccuccgcgcccgccagcuccucgagcuccuccacugcgcccacgaggccgaggaggccggcaucuggcagcacgucguccaggagcuccccggccgccucuccuuccucggcacccgccucaccccccccgacgcccacguccucggcaaggcccucgaggccgccggccaggacuucucccucgaccuccgcuccaccggcaucugccccuccggccucggcucccucgucggccucuccugcgucacccgcuuccgcgccgcccucuccgacaccgucgcccucugggagucccuccagcagcacggcgagaccaagcuccuccaggccgccgaggagaaguucaccaucgagcccuucaaggccaagucccucaaggacgucgaggaccucggcaagcucguccagacccagcgcacccgcuccuccuccgaggacaccgccggcgagcuccccgccguccgcgaccucaagaagcucgaguucgcccucggccccgucuccggcccccaggccuuccccaagcucguccgcauccucaccgccuucuccucccuccagcaccucgaccucgacgcccucuccgagaacaagaucggcgacgagggcgucucccagcucuccgccaccuucccccagcucaagucccucgagacccucaaccucucccagaacaacaucaccgaccucggcgccuacaagcucgccgaggcccuccccucccucgccgccucccuccuccgccucucccucuacaacaacugcaucugcgacgucggcgccgagucccucgcccgcguccuccccgacauggucucccuccgcgucauggacguccaguacaacaaguucaccgccgccggcgcccagcagcucgccgccucccuccgccgcugcccccacgucgagacccucgccauguggacccccaccauccccuucuccguccaggagcaccuccagcagcaggacucccgcaucucccuccgcuga

SEQ ID NO: 41372 - RNA, 3471 nt, Artificial Sequence
  derived and/or modified sequence opt2 from CILP2__Homo_sapiens__NP_694953
auggccucccuccucccccuccucugccucugcgucgucgccgcccaccucgccggcgcccgcgacgccacccccaccgaggagcccauggccaccgcccucggccucgagcgccgcuccgucuacaccggccagcccucccccgcccucgaggacugggaggaggccuccgaguggaccuccugguucaacgucgaccaccccggcggcgacggcgacuucgagucccucgccgccauccgcuucuacuacggccccgcccgcgucugcccccgcccccucgcccucgaggcccgcaccaccgacugggcccuccccuccgccgucggcgagcgcguccaccucaaccccacccgcggcuucuggugccucaaccgcgagcagccccgcggccgccgcugcuccaacuaccacguccgcuuccgcugcccccucgaggccuccuggggcgccuggggccccuggggccccugcuccggcuccugcggccccggccgccgccuccgccgccgccacugccccucccccgccggcgacgccugccccggccgcccccucgaggcccagaagugcguccgcccccgcugccccggcugcucccucgacaccugcgagugccccgaccacauccuccucggcuccgucgucacccccuccggccagccccuccucggcgcccgcgucucccuccgcgaccagcccggcaccgucgccaccuccgacgcccacggcaccuuccgcguccccggcgucugcgccgacucccgcgccaacauccgcgcccagauggacggcuucuccgccggcgaggcccaggcccaggccaacggcuccaucuccgucgucaccaucauccucgacaagcucgagaagcccuaccucgucaagcaccccgagucccgcguccgcgaggccggccagaacgucaccuucugcugcaaggccuccggcacccccaugcccaagaaguacuccugguuccacaacggcacccuccucgaccgccgcgcccacggcuacggcgcccaccucgagcuccgcggccuccgccccgaccaggccggcaucuaccacugcaaggccuggaacgaggccggcgccguccgcuccggcaccgcccgccucaccguccucgcccccggccagcccgccugcgacccccgcccccgcgaguaccucaucaagcuccccgaggacugcggccagcccggcuccggccccgccuaccucgacgucggccucugccccgacacccgcugccccucccucgccggcuccuccccccgcugcggcgacgccuccucccgcugcugcuccguccgccgccucgagcgccgcgagauccacugccccggcuacguccuccccgucaaggucgucgccgagugcggcugccagaagugccuccccccccgcggccucguccgcggccgcgucgucgccgccgacuccggcgagccccuccgcuucgcccgcauccuccucggccaggagcccaucggcuucaccgccuaccagggcgacuucaccaucgaggucccccccuccacccagcgccucgucgucaccuucgucgaccccuccggcgaguucauggacgccguccgcguccuccccuucgacccccgcggcgccggcgucuaccacgaggucaaggccaugcgcaagaaggcccccgucauccuccacaccucccaguccaacaccaucccccucggcgagcucgaggacgaggccccccucggcgagcucguccuccccuccggcgccuuccgccgcgccgacggcaagcccuacuccggccccgucgaggcccgcgucaccuucgucgacccccgcgaccucaccuccgccgccuccgcccccuccgaccuccgcuucgucgacuccgacggcgagcucgccccccuccgcaccuacggcauguucuccgucgaccuccgcgcccccggcuccgccgagcagcuccaggucggccccgucgccguccgcgucgccgccucccagauccacaugcccggccacgucgaggcccucaagcucuggucccucaaccccgagaccggccucugggaggaggaguccggcuuccgccgcgagggcuccuccggcccccgcguccgccgcgaggagcgcgucuuccucgucggcaacgucgagauccgcgagcgccgccucuucaaccucgacguccccgagcgccgccgcugcuucgucaagguccgcgccuacgccaacgacaaguucacccccuccgagcaggucgagggcgucgucgucacccucgucaaccucgagcccgcccccggcuucuccgccaacccccgcgccuggggccgcuucgacuccgccgucaccggccccaacggcgccugccuccccgccuucugcgacgccgaccgccccgacgccuacaccgcccucgucaccgccacccucggcggcgaggagcucgagcccgcccccucccucccccgcccccuccccgccaccgucggcgucacccagcccuaccucgaccgccucggcuaccgccgcaccgaccacgacgaccccgccuucaagcgcaacggcuuccgcaucaaccucgccaagccccgccccggcgaccccgccgaggccaacggccccgucuaccccuggcgcucccuccgcgagugccagggcgcccccgucaccgccucccacuuccgcuucgcccgcgucgaggccgacaaguacgaguacaacgucguccccuuccgcgagggcacccccgccuccuggaccggcgaccuccucgccugguggcccaacccccaggaguuccgcgccugcuuccucaaggucaagauccagggcccccaggaguacaugguccgcucccacaacgccggcggcucccacccccgcacccgcggccagcucuacggccuccgcgacgcccgcuccguccgcgaccccgagcgccccggcaccuccgccgccugcgucgaguucaagugcuccggcaugcucuucgaccagcgccaggucgaccgcacccucgucaccaucaugccccagggcuccugccgccgcgucgccgucaacggccuccuccgcgacuaccucacccgccaccccccccccguccccgccgaggaccccgccgccuucuccaugcucgccccccucgacccccucggccacaacuacggcgucuacaccgucaccgaccaguccccccgccucgccaaggagaucgccaucggccgcugcuucgacggcuccuccgacggcuucucccgcgagaugaaggccgacgccggcaccgccgucaccuuccagugccgcgagccccccgccggccgccccucccucuuccagcgccuccucgagucccccgccaccgcccucggcgacauccgccgcgagauguccgaggccgcccaggcccaggcccgcgccuccggcccccuccgcacccgccgcggccgcguccgccaguga

SEQ ID NO: 41373 - RNA, 3555 nt, Artificial Sequence
  derived and/or modified sequence opt2 from CILP__Homo_sapiens__NP_003604
auggucggcaccaaggccugggucuucuccuuccucguccucgaggucaccuccguccucggccgccagaccaugcucacccaguccguccgccgcguccagcccggcaagaagaaccccuccaucuucgccaagcccgccgacacccucgagucccccggcgaguggaccaccugguucaacaucgacuaccccggcggcaagggcgacuacgagcgccucgacgccauccgcuucuacuacggcgaccgcgucugcgcccgcccccuccgccucgaggcccgcaccaccgacuggacccccgccggcuccaccggccaggucguccacggcuccccccgcgagggcuucuggugccucaaccgcgagcagcgccccggccagaacugcuccaacuacaccguccgcuuccucugcccccccggcucccuccgccgcgacaccgagcgcaucuggucccccuggucccccugguccaagugcuccgccgccugcggccagaccggcguccagacccgcacccgcaucugccucgccgagauggucucccucugcuccgaggccuccgaggagggccagcacugcaugggccaggacugcaccgccugcgaccucaccugccccaugggccaggucaacgccgacugcgacgccugcaugugccaggacuucaugcuccacggcgccgucucccuccccggcggcgcccccgccuccggcgccgccaucuaccuccucaccaagacccccaagcuccucacccagaccgacuccgacggccgcuuccgcauccccggccucugccccgacggcaaguccauccucaagaucaccaaggucaaguucgcccccaucguccucaccaugcccaagaccucccucaaggccgccaccaucaaggccgaguucguccgcgccgagacccccuacauggucaugaaccccgagaccaaggcccgccgcgccggccaguccgucucccucugcugcaaggccaccggcaagccccgccccgacaaguacuucugguaccacaacgacacccuccucgaccccucccucuacaagcacgaguccaagcucguccuccgcaagcuccagcagcaccaggccggcgaguacuucugcaaggcccaguccgacgccggcgccgucaaguccaaggucgcccagcucaucgucaucgccuccgacgagacccccugcaaccccguccccgaguccuaccucauccgccucccccacgacugcuuccagaacgccaccaacuccuucuacuacgacgucggccgcugccccgucaagaccugcgccggccagcaggacaacggcauccgcugccgcgacgccguccagaacugcugcggcaucuccaagaccgaggagcgcgagauccagugcuccggcuacacccuccccaccaaggucgccaaggagugcuccugccagcgcugcaccgagacccgcuccaucguccgcggccgcgucuccgccgccgacaacggcgagcccaugcgcuucggccacgucuacaugggcaacucccgcgucuccaugaccggcuacaagggcaccuucacccuccacgucccccaggacaccgagcgccucguccucaccuucgucgaccgccuccagaaguucgucaacaccaccaagguccuccccuucaacaagaagggcuccgccgucuuccacgagaucaagaugcuccgccgcaaggagcccaucacccucgaggccauggagaccaacaucaucccccucggcgaggucgucggcgaggaccccauggccgagcucgagauccccucccgcuccuucuaccgccagaacggcgagcccuacaucggcaaggucaaggccuccgucaccuuccucgacccccgcaacaucuccaccgccaccgccgcccagaccgaccucaacuucaucaacgacgagggcgacaccuucccccuccgcaccuacggcauguucuccgucgacuuccgcgacgaggucaccuccgagccccucaacgccggcaaggucaagguccaccucgacuccacccaggucaagaugcccgagcacaucuccaccgucaagcucuggucccucaaccccgacaccggccucugggaggaggagggcgacuucaaguucgagaaccagcgccgcaacaagcgcgaggaccgcaccuuccucgucggcaaccucgagauccgcgagcgccgccucuucaaccucgacguccccgagucccgccgcugcuucgucaagguccgcgccuaccgcuccgagcgcuuccuccccuccgagcagauccagggcgucgucaucuccgucaucaaccucgagccccgcaccggcuuccucuccaacccccgcgccuggggccgcuucgacuccgucaucaccggccccaacggcgccugcguccccgccuucugcgacgaccagucccccgacgccuacuccgccuacguccucgccucccucgccggcgaggagcuccaggccgucgaguccucccccaaguucaaccccaacgccaucggcgucccccagcccuaccucaacaagcucaacuaccgccgcaccgaccacgaggacccccgcgucaagaagaccgccuuccagaucuccauggccaagccccgccccaacuccgccgaggaguccaacggccccaucuacgccuucgagaaccuccgcgccugcgaggaggccccccccuccgccgcccacuuccgcuucuaccagaucgagggcgaccgcuacgacuacaacaccguccccuucaacgaggacgaccccauguccuggaccgaggacuaccucgccugguggcccaagcccauggaguuccgcgccugcuacaucaaggucaagaucgucggcccccucgaggucaacguccgcucccgcaacaugggcggcacccaccgccagaccgucggcaagcucuacggcauccgcgacguccgcuccacccgcgaccgcgaccagcccaacgucuccgccgccugccucgaguucaagugcuccggcaugcucuacgaccaggaccgcgucgaccgcacccucgucaaggucaucccccagggcuccugccgccgcgccuccgucaaccccaugcuccacgaguaccucgucaaccaccucccccucgccgucaacaacgacaccuccgaguacaccaugcucgccccccucgacccccucggccacaacuacggcaucuacaccgucaccgaccaggacccccgcaccgccaaggagaucgcccucggccgcugcuucgacggcaccuccgacggcuccucccgcaucaugaaguccaacgucggcgucgcccucaccuucaacugcgucgagcgccaggucggccgccaguccgccuuccaguaccuccaguccacccccgcccagucccccgccgccggcaccguccagggccgcguccccucccgccgccagcagcgcgccucccgcggcggccagcgccagggcggcgucgucgccucccuccgcuucccccgcgucgcccagcagccccucaucaacuga

SEQ ID NO: 41374 - RNA, 639 nt, Artificial Sequence
  derived and/or modified sequence opt2 from CINP__Homo_sapiens__NP_116019
auggaggccaagacccucggcaccgucaccccccgcaagcccguccucuccgucuccgcccgcaagaucaaggacaacgccgccgacuggcacaaccucauccucaagugggagacccucaacgacgccggcuucaccaccgccaacaacaucgccaaccucaagaucucccuccucaacaaggacaagaucgagcucgacuccuccucccccgccuccaaggagaacgaggagaaggucugccucgaguacaacgaggagcucgagaagcucugcgaggagcuccaggccacccucgacggccucaccaagauccaggucaagauggagaagcucuccuccaccaccaagggcaucugcgagcucgagaacuaccacuacggcgaggaguccaagcgccccccccucuuccacaccuggcccaccacccacuucuacgaggucucccacaagcuccucgagauguaccgcaaggagcuccuccucaagcgcaccgucgccaaggagcucgcccacaccggcgaccccgaccucacccucuccuaccucuccauguggcuccaccagcccuacgucgaguccgacucccgccuccaccucgaguccaugcuccucgagaccggccaccgcgcccucuga

SEQ ID NO: 41375 - RNA, 1200 nt, Artificial Sequence
  derived and/or modified sequence opt2 from CIPC__Homo_sapiens__NP_219494
auggagcgcaagaaccccucccgcgaguccccccgccgccucuccgccaaggucggcaagggcaccgagaugaagaaggucgcccgccagcucggcauggccgccgccgaguccgacaaggacuccggcuucuccgacggcuccuccgagugccucuccuccgccgagcagauggaguccgaggacaugcucuccgcccucggcuggucccgcgaggaccgcccccgccagaacuccaagaccgccaagaacgccuuccccacccucucccccauggucgucaugaagaacguccucgucaagcagggcuccuccuccucccagcuccaguccuggaccguccagcccuccuucgaggucaucuccgcccagccccagcuccucuuccuccacccccccguccccucccccgucucccccugccacaccggcgagaagaaguccgacucccgcaacuaccuccccauccucaacuccuacaccaagaucgccccccaccccggcaagcgcggccucucccucggccccgaggagaagggcaccuccggcguccagaagaagaucugcaccgagcgccucggccccucccucuccuccuccgagcccaccaaggccggcgccguccccuccucccccuccacccccgccccccccuccgccaagcucgccgaggacuccgcccuccagggcguccccucccucgucgccggcggcuccccccagacccuccagcccgucuccuccucccacgucgccaaggcccccucccucaccuucgccucccccgccucccccgucugcgccuccgacuccacccuccacggccucgaguccaacuccccccucuccccccucuccgccaacuacuccuccccccucugggccgccgagcaccucugccgcucccccgacaucuucuccgagcagcgccaguccaagcaccgccgcuuccagaacacccucgucguccuccacaaguccggccuccucgagaucacccucaagaccaaggagcucauccgccagaaccaggccacccaggucgagcucgaccagcucaaggagcagacccagcucuucaucgaggccaccaagucccgcgccccccaggccugggccaagcuccaggccucccucacccccggcuccuccaacaccggcuccgaccucgaggccuucuccgaccaccccgccaucuga

SEQ ID NO: 41376 - RNA, 1353 nt, Artificial Sequence
  derived and/or modified sequence opt2 from CIR1__Homo_sapiens__NP_004873
augggcaaguccuucgccaacuucaugugcaagaaggacuuccaccccgccuccaaguccaacaucaagaaggucuggauggccgagcagaagaucuccuacgacaagaagaagcaggaggagcucaugcagcaguaccucaaggagcaggaguccuacgacaaccgccuccucaugggcgacgagcgcgucaagaacggccucaacuucauguacgaggccccccccggcgccaagaaggagaacaaggagaaggaggagaccgagggcgagaccgaguacaaguucgaguggcagaagggcgccccccgcgagaaguacgccaaggacgacaugaacauccgcgaccagcccuucggcauccagguccgcaacguccgcugcaucaagugccacaaguggggccacgucaacaccgaccgcgagugcccccucuucggccucuccggcaucaacgccuccuccguccccaccgacggcuccggccccuccaugcaccccuccgagcucaucgccgagaugcgcaacuccggcuucgcccucaagcgcaacguccucggccgcaaccucaccgccaacgaccccucccaggaguacgucgccuccgagggcgaggaggaccccgaggucgaguuccucaagucccucaccaccaagcagaagcagaagcuccuccgcaagcucgaccgccucgagaagaagaagaagaagaaggaccgcaagaagaagaaguuccagaagucccgcuccaagcacaagaagcacaaguccuccuccuccuccuccuccuccuccuccuccuccuccuccaccgagaccuccgaguccuccuccgaguccgaguccaacaacaaggagaagaagauccagcgcaagaagcgcaagaagaacaagugcuccggccacaacaacuccgacuccgaggagaaggacaaguccaagaagcgcaagcuccacgaggagcucuccuccucccaccacaaccgcgagaaggccaaggagaagccccgcuuccucaagcacgaguccucccgcgaggacuccaaguggucccacuccgacuccgacaagaagucccgcacccacaagcacucccccgagaagcgcggcuccgagcgcaaggagggcuccucccgcucccacggccgcgaggagcgcucccgccgcucccgcucccgcucccccggcuccuacaagcagcgcgagacccgcaagcgcgcccagcgcaaccccggcgaggagcagucccgccgcaacgacucccgcucccacggcaccgaccucuaccgcggcgagaagauguaccgcgagcaccccggcggcacccacaccaaggucacccagcgcgaguga

SEQ ID NO: 41377 - RNA, 507 nt, Artificial Sequence
  derived and/or modified sequence opt2 from CIRBP__Homo_sapiens__NP_001287744
auggccuccgacgagggcaagcucuucgucggcggccucuccuucgacaccaacgagcagucccucgagcaggucuucuccaaguacggccagaucuccgaggucgucgucgucaaggaccgcgagacccagcgcucccgcggcuucggcuucgucaccuucgagaacaucgacgacgccaaggacgccaugauggccaugaacggcaaguccgucgacggccgccagauccgcgucgaccaggccggcaaguccuccgacaaccgcucccgcggcuaccgcggcggcuccgccggcggccgcggcuucuuccgcggcggccgcggccgcggccgcggcuucucccgcggcggcggcgaccgcggcuacggcggcaaccgcuucgagucccgcuccggcggcuacggcggcucccgcgacuacuacuccucccgcucccaguccggcggcuacuccgaccgcuccuccggcggcuccuaccgcgacuccuacgacuccuacggcuga

SEQ ID NO: 41378 - RNA, 2061 nt, Artificial Sequence
  derived and/or modified sequence opt2 from CIRH1A__Homo_sapiens__NP_116219
augggcgaguucaagguccaccgcguccgcuucuucaacuacguccccuccggcauccgcugcgucgccuacaacaaccaguccaaccgccucgccgucucccgcaccgacggcaccgucgagaucuacaaccucuccgccaacuacuuccaggagaaguucuuccccggccacgagucccgcgccaccgaggcccucugcugggccgagggccagcgccucuucuccgccggccucaacggcgagaucauggaguacgaccuccaggcccucaacaucaaguacgccauggacgccuucggcggccccaucugguccauggccgccucccccuccggcucccagcuccucgucggcugcgaggacggcuccgucaagcucuuccagaucacccccgacaagauccaguucgagcgcaacuucgaccgccagaagucccgcauccucucccucuccuggcaccccuccggcacccacaucgccgccggcuccaucgacuacaucuccgucuucgacgucaaguccggcuccgccguccacaagaugaucgucgaccgccaguacaugggcgucuccaagcgcaagugcaucgucuggggcgucgccuuccucuccgacggcaccaucaucuccgucgacuccgccggcaagguccaguucugggacuccgccaccggcacccucgucaagucccaccucaucgccaacgccgacguccaguccaucgccgucgccgaccaggaggacuccuucgucgucggcaccgccgagggcaccgucuuccacuuccagcucguccccgucaccuccaacuccuccgagaagcaguggguccgcaccaagcccuuccagcaccacacccacgacguccgcaccgucgcccacucccccaccgcccucaucuccggcggcaccgacacccaccucgucuuccgcccccucauggagaaggucgaggucaagaacuacgacgccgcccuccgcaagaucaccuucccccaccgcugccucaucuccugcuccaagaagcgccagcuccuccucuuccaguucgcccaccaccucgagcucuggcgccucggcuccaccgucgccaccggcaagaacggcgacacccucccccucuccaagaacgccgaccaccuccuccaccucaagaccaagggccccgagaacaucaucugcuccugcaucucccccugcggcuccuggaucgccuacuccaccgucucccgcuucuuccucuaccgccucaacuacgagcacgacaacaucucccucaagcgcgucuccaagaugcccgccuuccuccgcuccgcccuccagauccucuucuccgaggacuccaccaagcucuucgucgccuccaaccagggcgcccuccacaucguccagcucuccggcggcuccuucaagcaccuccacgccuuccagccccaguccggcaccgucgaggccaugugccuccucgccgucucccccgacggcaacuggcucgccgccuccggcaccuccgccggcguccacgucuacaacgucaagcagcucaagcuccacugcaccguccccgccuacaacuuccccgucaccgccauggccaucgcccccaacaccaacaaccucgucaucgcccacuccgaccagcaggucuucgaguacuccauccccgacaagcaguacaccgacuggucccgcaccguccagaagcagggcuuccaccaccucuggcuccagcgcgacacccccaucacccacaucuccuuccaccccaagcgccccaugcacauccuccuccacgacgccuacauguucugcaucaucgacaagucccucccccuccccaacgacaagacccuccucuacaaccccuucccccccaccaacgaguccgacgucauccgccgccgcaccgcccacgccuucaagaucuccaagaucuacaagccccuccucuucauggaccuccucgacgagcgcacccucgucgccgucgagcgcccccucgacgacaucaucgcccagcuccccccccccaucaagaagaagaaguucggcaccuga

SEQ ID NO: 41379 - RNA, 327 nt, Artificial Sequence
  derived and/or modified sequence opt2 from CISD1__Homo_sapiens__NP_060934
augucccucaccuccuccuccuccguccgcgucgaguggaucgccgccgucaccaucgccgccggcaccgccgccaucggcuaccucgccuacaagcgcuucuacgucaaggaccaccgcaacaaggccaugaucaaccuccacauccagaaggacaaccccaagaucguccacgccuucgacauggaggaccucggcgacaaggccgucuacugccgcugcuggcgcuccaagaaguuccccuucugcgacggcgcccacaccaagcacaacgaggagaccggcgacaacgucggcccccucaucaucaagaagaaggagaccuga

SEQ ID NO: 41380 - RNA, 408 nt, Artificial Sequence
  derived and/or modified sequence opt2 from CISD2__Homo_sapiens__NP_001008389
augguccucgaguccgucgcccgcaucgucaagguccagcuccccgccuaccucaagcgccuccccguccccgaguccaucaccggcuucgcccgccucaccgucuccgaguggcuccgccuccuccccuuccucggcguccucgcccuccucggcuaccucgccguccgccccuuccuccccaagaagaagcagcagaaggacucccucaucaaccucaagauccagaaggagaaccccaaggucgucaacgagaucaacaucgaggaccucugccucaccaaggccgccuacugccgcugcuggcgcuccaagaccuuccccgccugcgacggcucccacaacaagcacaacgagcucaccggcgacaacgucggcccccucauccucaagaagaaggaggucuga

SEQ ID NO: 41381 - RNA, 828 nt, Artificial Sequence
  derived and/or modified sequence opt2 from CISH__Homo_sapiens__NP_037456
auguaccucgagcacaccucccacugcccccaccacgacgacgacaccgccauggacaccccccucccccgcccccgcccccuccucgccgucgagcgcaccggccagcgcccccucugggcccccucccucgagcuccccaagcccgucaugcagccccuccccgccggcgccuuccucgaggaggucgccgagggcacccccgcccagaccgaguccgagcccaagguccucgaccccgaggaggaccuccucugcaucgccaagaccuucuccuaccuccgcgaguccggcugguacuggggcuccaucaccgccuccgaggcccgccagcaccuccagaagaugcccgagggcaccuuccucguccgcgacuccacccaccccuccuaccucuucacccucuccgucaagaccacccgcggccccaccaacguccgcaucgaguacgccgacuccuccuuccgccucgacuccaacugccucucccgcccccgcauccucgccuuccccgacgucgucucccucguccagcacuacgucgccuccugcaccgccgacacccgcuccgacucccccgaccccgcccccacccccgcccuccccaugcccaaggaggacgcccccuccgaccccgcccuccccgcccccccccccgccaccgccguccaccucaagcucguccagcccuucguccgccgcuccuccgcccgcucccuccagcaccucugccgccucgucaucaaccgccucgucgccgacgucgacugccucccccucccccgccgcauggccgacuaccuccgccaguaccccuuccagcucuga

SEQ ID NO: 41382 - RNA, 660 nt, Artificial Sequence
  derived and/or modified sequence opt2 from CITED1__Homo_sapiens__NP_001138357
auggagcccuccgcccagcagcuccagcucgccgccucccuccccgccaaccucuccaacuucugccagggcuccgagaugcccaccaccucccgccccgcccucgacgucaagggcggcaccucccccgccaaggaggacgccaaccaggagauguccuccgucgccuacuccaaccucgccgucaaggaccgcaaggccgucgccauccuccacuaccccggcgucgccuccaacggcaccaaggccuccggcgcccccaccuccuccuccggcucccccaucggcucccccaccaccaccccccccaccaagccccccuccuucaaccuccaccccgccccccaccuccucgccuccaugcaccuccagaagcucaacucccaguaccagggcauggccgccgccacccccggccagcccggcgaggccggcccccuccagaacugggacuucggcgcccaggccggcggcgccgagucccucucccccuccgccggcgcccagucccccgccaucaucgacuccgaccccgucgacgaggagguccucaugucccucgucgucgagcucggccucgaccgcgccaacgagcuccccgagcucuggcucggccagaacgaguucgacuucaccgccgacuuccccuccuccugcuga

SEQ ID NO: 41383 - RNA, 813 nt, Artificial Sequence
  derived and/or modified sequence opt2 from CITED2__Homo_sapiens__NP_001161860
auggccgaccacaugauggccaugaaccacggccgcuuccccgacggcaccaacggccuccaccaccaccccgcccaccgcaugggcaugggccaguuccccuccccccaccaccaccagcagcagcagccccagcacgccuucaacgcccucaugggcgagcacauccacuacggcgccggcaacaugaacgccaccuccggcauccgccacgccaugggccccggcaccgucaacggcggccacccccccuccgcccucgcccccgccgcccgcuucaacaacucccaguucaugggcccccccgucgccucccagggcggcucccuccccgccuccaugcagcuccagaagcucaacaaccaguacuucaaccaccaccccuacccccacaaccacuacaugcccgaccuccaccccgccgccggccaccagaugaacggcaccaaccagcacuuccgcgacugcaaccccaagcacuccggcggcuccuccacccccggcggcuccggcggcuccuccacccccggcggcuccggcuccuccuccggcggcggcgccggcuccuccaacuccggcggcggcuccggcuccggcaacaugcccgccuccgucgcccacguccccgccgccaugcucccccccaacgucaucgacaccgacuucaucgacgaggagguccucaugucccucgucaucgagaugggccucgaccgcaucaaggagcuccccgagcucuggcucggccagaacgaguucgacuucaugaccgacuucgucugcaagcagcagcccucccgcgucuccugcuga

SEQ ID NO: 41384 - RNA, 6210 nt, Artificial Sequence
  derived and/or modified sequence opt2 from CIT__Homo_sapiens__NP_001193928
augcucaaguucaaguacggcgcccgcaacccccucgacgccggcgccgccgagcccaucgccucccgcgccucccgccucaaccucuucuuccagggcaagccccccuucaugacccagcagcagauguccccccucucccgcgagggcauccucgacgcccucuucguccucuucgaggagugcucccagcccgcccucaugaagaucaagcacgucuccaacuucguccgcaaguacuccgacaccaucgccgagcuccaggagcuccagcccuccgccaaggacuucgagguccgcucccucgucggcugcggccacuucgccgagguccaggucguccgcgagaaggccaccggcgacaucuacgccaugaaggucaugaagaagaaggcccuccucgcccaggagcaggucuccuucuucgaggaggagcgcaacauccucucccgcuccaccucccccuggaucccccagcuccaguacgccuuccaggacaagaaccaccucuaccucgucauggaguaccagcccggcggcgaccuccucucccuccucaaccgcuacgaggaccagcucgacgagaaccucauccaguucuaccucgccgagcucauccucgccguccacuccguccaccucaugggcuacguccaccgcgacaucaagcccgagaacauccucgucgaccgcaccggccacaucaagcucgucgacuucggcuccgccgccaagaugaacuccaacaagauggucaacgccaagcuccccaucggcacccccgacuacauggcccccgagguccucaccgucaugaacggcgacggcaagggcaccuacggccucgacugcgacuggugguccgucggcgucaucgccuacgagaugaucuacggccgcucccccuucgccgagggcaccuccgcccgcaccuucaacaacaucaugaacuuccagcgcuuccucaaguuccccgacgaccccaaggucuccuccgacuuccucgaccucauccagucccuccucugcggccagaaggagcgccucaaguucgagggccucugcugccaccccuucuucuccaagaucgacuggaacaacauccgcaacucccccccccccuucguccccacccucaaguccgacgacgacaccuccaacuucgacgagcccgagaagaacuccugggucuccuccucccccugccagcucucccccuccggcuucuccggcgaggagcuccccuucgucggcuucuccuacuccaaggcccucggcauccucggccgcuccgaguccgucgucuccggccucgacucccccgccaagaccuccuccauggagaagaagcuccucaucaaguccaaggagcuccaggacucccaggacaagugccacaagauggagcaggagaugacccgccuccaccgccgcgucuccgaggucgaggccguccucucccagaaggaggucgagcucaaggccuccgagacccagcgcucccuccucgagcaggaccucgccaccuacaucaccgagugcuccucccucaagcgcucccucgagcaggcccgcauggaggucucccaggaggacgacaaggcccuccagcuccuccacgacauccgcgagcagucccgcaagcuccaggagaucaaggagcaggaguaccaggcccaggucgaggagaugcgccucaugaugaaccagcucgaggaggaccucgucuccgcccgccgccgcuccgaccucuacgaguccgagcuccgcgagucccgccucgccgccgaggaguucaagcgcaaggccaccgagugccagcacaagcuccucaaggccaaggaccagggcaagcccgaggucggcgaguacgccaagcucgagaagaucaacgccgagcagcagcucaagauccaggagcuccaggagaagcucgagaaggccgucaaggccuccaccgaggccaccgagcuccuccagaacauccgccaggccaaggagcgcgccgagcgcgagcucgagaagcuccagaaccgcgaggacuccuccgagggcauccgcaagaagcucgucgaggccgaggagcgccgccacucccucgagaacaaggucaagcgccucgagaccauggagcgccgcgagaaccgccucaaggacgacauccagaccaagucccagcagauccagcagauggccgacaagauccucgagcucgaggagaagcaccgcgaggcccaggucuccgcccagcaccucgagguccaccucaagcagaaggagcagcacuacgaggagaagaucaagguccucgacaaccagaucaagaaggaccucgccgacaaggagacccucgagaacaugaugcagcgccacgaggaggaggcccacgagaagggcaagauccucuccgagcagaaggccaugaucaacgccauggacuccaagauccgcucccucgagcagcgcaucgucgagcucuccgaggccaacaagcucgccgccaacuccucccucuucacccagcgcaacaugaaggcccaggaggagaugaucuccgagcuccgccagcagaaguucuaccucgagacccaggccggcaagcucgaggcccagaaccgcaagcucgaggagcagcucgagaagaucucccaccaggaccacuccgacaagaaccgccuccucgagcucgagacccgccuccgcgaggucucccucgagcacgaggagcagaagcucgagcucaagcgccagcucaccgagcuccagcucucccuccaggagcgcgagucccagcucaccgcccuccaggccgcccgcgccgcccucgagucccagcuccgccaggccaagaccgagcucgaggagaccaccgccgaggccgaggaggagauccaggcccucaccgcccaccgcgacgagauccagcgcaaguucgacgcccuccgcaacuccugcaccgucaucaccgaccucgaggagcagcucaaccagcucaccgaggacaacgccgagcucaacaaccagaacuucuaccucuccaagcagcucgacgaggccuccggcgccaacgacgagaucguccagcuccgcuccgaggucgaccaccuccgccgcgagaucaccgagcgcgagaugcagcucaccucccagaagcagaccauggaggcccucaagaccaccugcaccaugcucgaggagcaggucauggaccucgaggcccucaacgacgagcuccucgagaaggagcgccagugggaggccuggcgcuccguccucggcgacgagaagucccaguucgagugccgcguccgcgagcuccagcgcaugcucgacaccgagaagcagucccgcgcccgcgccgaccagcgcaucaccgagucccgccaggucgucgagcucgccgucaaggagcacaaggccgagauccucgcccuccagcaggcccucaaggagcagaagcucaaggccgagucccucuccgacaagcucaacgaccucgagaagaagcacgccaugcucgagaugaacgcccgcucccuccagcagaagcucgagaccgagcgcgagcucaagcagcgccuccucgaggagcaggccaagcuccagcagcagauggaccuccagaagaaccacaucuuccgccucacccagggccuccaggaggcccucgaccgcgccgaccuccucaagaccgagcgcuccgaccucgaguaccagcucgagaacauccagguccucuacucccacgagaaggucaagauggagggcaccaucucccagcagaccaagcucaucgacuuccuccaggccaagauggaccagcccgccaagaagaagaagggccucuucucccgccgcaaggaggaccccgcccuccccacccaggucccccuccaguacaacgagcucaagcucgcccucgagaaggagaaggcccgcugcgccgagcucgaggaggcccuccagaagacccgcaucgagcuccgcuccgcccgcgaggaggccgcccaccgcaaggccaccgaccacccccaccccuccacccccgccaccgcccgccagcagaucgccauguccgccaucguccgcucccccgagcaccagcccuccgccaugucccuccucgccccccccuccucccgccgcaaggaguccuccacccccgaggaguucucccgccgccucaaggagcgcaugcaccacaacaucccccaccgcuucaacgucggccucaacaugcgcgccaccaagugcgccgucugccucgacaccguccacuucggccgccaggccuccaagugccucgagugccaggucaugugccaccccaagugcuccaccugccuccccgccaccugcggccuccccgccgaguacgccacccacuucaccgaggccuucugccgcgacaagaugaacucccccggccuccagaccaaggagcccuccuccucccuccaccucgagggcuggaugaaggucccccgcaacaacaagcgcggccagcagggcugggaccgcaaguacaucguccucgagggcuccaagguccucaucuacgacaacgaggcccgcgaggccggccagcgccccgucgaggaguucgagcucugccuccccgacggcgacgucuccauccacggcgccgucggcgccuccgagcucgccaacaccgccaaggccgacguccccuacauccucaagauggagucccacccccacaccaccugcuggcccggccgcacccucuaccuccucgcccccuccuuccccgacaagcagcgcugggucaccgcccucgaguccgucgucgccggcggccgcgucucccgcgagaaggccgaggccgacgccaagcuccucggcaacucccuccucaagcucgagggcgacgaccgccucgacaugaacugcacccuccccuucuccgaccaggucguccucgucggcaccgaggagggccucuacgcccucaacguccucaagaacucccucacccacguccccggcaucggcgccgucuuccagaucuacaucaucaaggaccucgagaagcuccucaugaucgccggcgaggagcgcgcccucugccucgucgacgucaagaaggucaagcagucccucgcccagucccaccuccccgcccagcccgacaucucccccaacaucuucgaggccgucaagggcugccaccucuucggcgccggcaagaucgagaacggccucugcaucugcgccgccaugcccuccaaggucgucauccuccgcuacaacgagaaccucuccaaguacugcauccgcaaggagaucgagaccuccgagcccugcuccugcauccacuucaccaacuacuccauccucaucggcaccaacaaguucuacgagaucgacaugaagcaguacacccucgaggaguuccucgacaagaacgaccacucccucgcccccgccgucuucgccgccuccuccaacuccuuccccgucuccaucguccaggucaacuccgccggccagcgcgaggaguaccuccucugcuuccacgaguucggcgucuucgucgacuccuacggccgccgcucccgcaccgacgaccucaaguggucccgccucccccucgccuucgccuaccgcgagcccuaccucuucgucacccacuucaacucccucgaggucaucgagauccaggcccgcuccuccgccggcacccccgcccgcgccuaccucgacauccccaacccccgcuaccucggccccgccaucuccuccggcgccaucuaccucgccuccuccuaccaggacaagcuccgcgucaucugcugcaagggcaaccucgucaaggaguccggcaccgagcaccaccgcggccccuccaccucccgcuccucccccaacaagcgcggcccccccaccuacaacgagcacaucaccaagcgcgucgccuccucccccgccccccccgagggccccucccacccccgcgagcccuccaccccccaccgcuaccgcgagggccgcaccgagcuccgccgcgacaagucccccggccgcccccucgagcgcgagaagucccccggccgcaugcucuccacccgccgcgagcgcucccccggccgccucuucgaggacuccucccgcggccgccuccccgccggcgccguccgcaccccccucucccaggucaacaaggucugggaccaguccuccgucuga

SEQ ID NO: 41385 - RNA, 2457 nt, Artificial Sequence
  derived and/or modified sequence opt2 from CIZ1__Homo_sapiens__NP_001124490
auguucucccagcagcagcagcagcagcuccagcagcagcagcagcagcuccagcagcuccagcagcagcagcuccagcagcagcagcuccagcagcagcagcuccuccagcuccagcagcuccuccagcagucccccccccaggccccccuccccauggccgucucccgcggccuccccccccagcagccccagcagccccuccucaaccuccagggcaccaacuccgccucccuccucaacggcuccaugcuccagcgcgcccuccuccuccagcagcuccagggcaaccuccgcggcuacggcauggccucccccggccucgccgcccccucccucacccccccccagcucgccacccccaaccuccagcaguucuucccccaggccacccgccagucccuccucggccccccccccgucggcguccccaugaaccccucccaguucaaccucuccggccgcaacccccagaagcaggcccgcaccuccuccuccaccacccccaaccgcaaggacuccuccucccagaccaugcccgucgaggacaaguccgacccccccgagggcuccgaggaggccgccgagccccgcauggacacccccgaggaccaggaccucccccccugccccgaggacaucgccaaggagaagcgcacccccgcccccgagcccgagcccugcgaggccuccgagcuccccgccaagcgccuccgcuccuccgaggagcccaccgagaaggagccccccggccagcuccaggucaaggcccagccccaggcccgcaugaccguccccaagcagacccagacccccgaccuccuccccgaggcccucgaggcccagguccucccccgcuuccagccccgcguccuccagguccaggcccagguccagucccagacccagccccgcauccccuccaccgacacccagguccagcccaagcuccagaagcaggcccagacccagaccucccccgagcaccucguccuccagcagaagcagguccagccccagcuccagcaggaggccgagccccagaagcagguccagccccagguccacacccaggcccagcccuccguccagccccaggagcacccccccgcccaggucuccguccagccccccgagcagacccacgagcagccccacacccagccccaggucucccuccucgcccccgagcagacccccgucgucguccacgucugcggccucgagaugccccccgacgccgucgaggccggcggcggcauggagaagacccuccccgagcccgucggcacccaggucuccauggaggagauccagaacgaguccgccugcggccucgacgucggcgagugcgagaaccgcgcccgcgagaugcccggcgucuggggcgccggcggcucccucaaggucaccauccuccaguccuccgacucccgcgccuucuccaccgucccccucacccccgucccccgccccuccgacuccgucuccuccacccccgccgccaccuccacccccuccaagcaggcccuccaguucuucugcuacaucugcaaggccuccugcuccucccagcaggaguuccaggaccacauguccgagccccagcaccagcagcgccucggcgagauccagcacaugucccaggccugccuccucucccuccuccccgucccccgcgacguccucgagaccgaggacgaggagccccccccccgccgcuggugcaacaccugccagcucuacuacaugggcgaccucauccagcaccgccgcacccaggaccacaagaucgccaagcagucccuccgccccuucugcaccgucugcaaccgcuacuucaagaccccccgcaaguucgucgagcacgucaagucccagggccacaaggacaaggccaaggagcucaagucccucgagaaggagaucgccggccaggacgaggaccacuucaucaccgucgacgccgucggcugcuucgagggcgacgaggaggaggaggaggacgacgaggacgaggaggagaucgaggucgaggaggagcucugcaagcagguccgcucccgcgacaucucccgcgaggaguggaagggcuccgagaccuacucccccaacaccgccuacggcgucgacuuccucguccccgucaugggcuacaucugccgcaucugccacaaguucuaccacuccaacuccggcgcccagcucucccacugcaagucccucggccacuucgagaaccuccagaaguacaaggccgccaagaaccccucccccaccacccgccccgucucccgccgcugcgccaucaacgcccgcaacgcccucaccgcccucuucaccuccuccggccgcccccccucccagcccaacacccaggacaagacccccuccaaggucaccgcccgccccucccagcccccccucccccgccgcuccacccgccucaagaccuga

SEQ ID NO: 41386 - RNA, 2052 nt, Artificial Sequence
  derived and/or modified sequence opt2 from CKAP2__Homo_sapiens__NP_001091995
auguccacccccgccgucccccaggaccuccagcucccccccucccagcgcgcccaguccgccuucaaggagcagcgccgccagaagcucaaggagcaccuccuccgccgcaagacccucuucgccuacaagcaggagaacgagaugcucuccuccucccgcgaccagcgcgucgucaccuccgaggaccagguccaggagggcaccaagguccucaagcucaagaccaagauggccgacaaggagaacaugaagcgccccgccgaguccaagaacaacaccgucgucggcaagcacugcaucccccucaagcccuccaacgagcucaccaacuccaccgucgucaucgacacccacaagcccaaggacuccaaccagaccccccaccuccuccucaccgaggacgacccccagucccagcacaugacccucucccaggccuuccaccucaagaacaacuccaagaagaagcagaugaccaccgagaagcagaagcaggacgccaacaugcccaagaagcccguccucggcuccuaccgcggccagaucguccaguccaagaucaacuccuuccgcaagccccuccaggucaaggacgaguccuccgccgccaccaagaagcucuccgccaccauccccaaggccaccaagccccagcccgucaacaccuccuccgucaccgucaaguccaaccgcuccuccaacaugaccgccaccaccaaguucgucuccaccaccucccagaacacccagcucguccgcccccccauccgcucccaccacuccaacacccgcgacaccgucaagcagggcaucucccgcaccuccgccaacgucaccauccgcaagggcccccacgagaaggagcuccuccaguccaagaccgcccucuccuccgucaagaccuccuccucccagggcaucauccgcaacaagacccucucccgcuccaucgccuccgaggucaucgcccgccccgccucccucuccaacgacaagcucauggagaaguccgagcccgucgaccagcgccgccacaccgccggcaaggccaucgucgacucccgcuccgcccagcccaaggagaccuccgaggagcgcaaggcccgccucuccgaguggaaggccggcaagggccgcguccucaagcgcccccccaacuccgucgucacccagcacgagcccgccggccagaacgagaagcccgucggcuccuucuggaccaccauggccgaggaggacgagcagcgccucuucaccgagaaggucaacaacaccuucuccgagugccucaaccucaucaacgagggcugccccaaggaggacauccucgucacccucaacgaccucaucaagaacauccccgacgccaagaagcucgucaaguacuggaucugccucgcccucaucgagcccaucaccucccccaucgagaacaucaucgccaucuacgagaaggccauccucgccggcgcccagcccaucgaggagaugcgccacaccaucgucgacauccucaccaugaagucccaggagaaggccaaccucggcgagaacauggagaaguccugcgccuccaaggaggaggucaaggaggucuccaucgaggacaccggcgucgacgucgaccccgagaagcucgagauggaguccaagcuccaccgcaaccuccucuuccaggacugcgagaaggagcaggacaacaagaccaaggaccccacccacgacgucaagacccccaacaccgagacccgcaccuccugccucaucaaguacaacgucuccaccacccccuaccuccaguccgucaagaagaagguccaguucgacggcaccaacuccgccuucaaggagcucaaguuccucacccccguccgccgcucccgccgccuccaggagaagaccuccaagcuccccgacaugcucaaggaccacuaccccugcgucuccucccucgagcagcucaccgagcucggccgcgagaccgacgccuucgucugccgccccaacgccgcccucugccgcgucuacuacgaggccgacaccaccuga

SEQ ID NO: 41387 - RNA, 2238 nt, Artificial Sequence
  derived and/or modified sequence opt2 from CKAP2L__Homo_sapiens__NP_689728
auggucggccccggccccaccgccgccgccgccgucgaggagcgccagcgcaagcuccaggaguaccucgccgccaagggcaagcucaagucccagaacaccaagcccuaccucaaguccaagaacaacugccagaaccagccccccuccaaguccaccauccgccccaagaacgacgucaccaaccacgucguccuccccgucaagcccaagcgcuccaucuccaucaagcuccagccccgcccccccaacaccgccggcucccagaagcccaagcucgagccccccaagcuccucggcaagcgccucaccuccgagugcgucuccuccaaccccuacuccaagcccuccuccaaguccuuccagcagugcgaggccggcuccuccaccaccggcgagcucucccgcaagcccgucggcucccucaacaucgagcagcucaagaccaccaagcagcagcucaccgaccagggcaacggcaagugcaucgacuucaugaacaacauccacgucgagaacgagucccucgacaacuuccucaaggagaccaacaaggagaaccuccucgacauccucaccgagcccgagcgcaagcccgaccccaagcucuacacccgcuccaagcccaagaccgacuccuacaaccagaccaagaacucccucguccccaagcaggcccucggcaaguccuccgucaacuccgccguccucaaggaccgcgucaacaagcaguucgucggcgagacccagucccgcaccuuccccgucaagucccagcagcucucccgcggcgccgaccucgcccgccccggcgucaagcccucccgcaccguccccucccacuucauccgcacccucuccaagguccaguccuccaagaagcccgucgucaagaacaucaaggacaucaaggucaaccgcucccaguacgagcgccccaacgagaccaagauccgcuccuaccccgucaccgagcagcgcgucaagcacaccaagccccgcaccuaccccucccuccuccagggcgaguacaacaaccgccaccccaacaucaagcaggaccagaaguccucccaggucugcaucccccagaccuccugcguccuccagaaguccaaggccaucucccagcgccccaaccucaccgucggccgcuucaacuccgccauccccuccacccccuccauccgccccaacggcaccuccggcaacaagcacaacaacaacggcuuccagcagaaggcccagacccucgacuccaagcucaagaaggccgucccccagaaccacuuccucaacaagaccgcccccaagacccaggccgacgucaccaccgucaacggcacccagaccaaccccaacaucaagaagaaggccaccgccgaggaccgccgcaagcagcucgaggaguggcagaaguccaagggcaagaccuacaagcgcccccccauggagcucaagaccaagcgcaaggucaucaaggagaugaacaucuccuucuggaaguccaucgagaaggaggaggaggagaagaaggcccagcucgagcucuccuccaagaucaacaacacccucaccgagugccucaaccucaucgagggcggcguccccuccaacgagauccucaacauccucuccuccauccccgaggccgagaaguucgccaaguucuggaucugcaaggccaagcuccucgccuccaagggcaccuucgacgucaucggccucuacgaggaggccaucaagaacggcgccacccccauccaggagcuccgcaaggucguccucaacauccuccaggacuccaaccgcaccaccgagggcaucaccuccgacucccucgucgccgagaccuccaucaccuccgucgaggagcucgccaagaagauggaguccgucaaguccugccucucccccaaggagcgcgagcaggucaccgccaccccccgcaucgccaaggccgagcagcacaacuaccccggcaucaagcuccagaucggccccaucccccgcaucaacggcaugcccgagguccaggacaugaaguucaucacccccguccgccgcuccucccgcaucgagcgcgccgucucccgcuaccccgagaugcuccaggagcacgaccucgucgucgccucccucgacgagcuccucgaggucgaggagaccaagugcuucaucuuccgccgcaacgaggcccuccccgucacccucggcuuccagacccccgaguccuga

SEQ ID NO: 41388 - RNA, 1809 nt, Artificial Sequence
  derived and/or modified sequence opt2 from CKAP4__Homo_sapiens__NP_006816
augcccuccgccaagcagcgcggcuccaagggcggccacggcgccgccucccccuccgagaagggcgcccaccccuccggcggcgccgacgacgucgccaagaagcccccccccgccccccagcagcccccccccccccccgccccccacccccagcagcacccccagcagcacccccagaaccaggcccacggcaagggcggccaccgcggcggcggcggcggcggcggcaaguccuccuccuccuccuccgccuccgccgccgccgccgccgccgccgccuccuccuccgccuccugcucccgccgccucggccgcgcccucaacuuccucuucuaccucgcccucgucgccgccgccgccuucuccggcuggugcguccaccacguccucgaggagguccagcagguccgccgcucccaccaggacuucucccgccagcgcgaggagcucggccagggccuccagggcgucgagcagaagguccagucccuccaggccaccuucggcaccuucgaguccauccuccgcuccucccagcacaagcaggaccucaccgagaaggccgucaagcagggcgaguccgaggucucccgcaucuccgagguccuccagaagcuccagaacgagauccucaaggaccucuccgacggcauccacgucgucaaggacgcccgcgagcgcgacuucaccucccucgagaacaccgucgaggagcgccucaccgagcucaccaaguccaucaacgacaacaucgccaucuucaccgagguccagaagcgcucccagaaggagaucaacgacaugaaggccaaggucgccucccucgaggaguccgagggcaacaagcaggaccucaaggcccucaaggaggccgucaaggagauccagaccuccgccaagucccgcgagugggacauggaggcccuccgcuccacccuccagaccauggaguccgacaucuacaccgagguccgcgagcucgucucccucaagcaggagcagcaggccuucaaggaggccgccgacaccgagcgccucgcccuccaggcccucaccgagaagcuccuccgcuccgaggaguccgucucccgccuccccgaggagauccgccgccucgaggaggagcuccgccagcucaaguccgacucccacggccccaaggaggacggcggcuuccgccacuccgaggccuucgaggcccuccagcagaagucccagggccucgacucccgccuccagcacgucgaggacggcguccucuccaugcaggucgccuccgcccgccagaccgagucccucgagucccuccucuccaagucccaggagcacgagcagcgccucgccgcccuccagggccgccucgagggccucggcuccuccgaggccgaccaggacggccucgccuccaccguccgcucccucggcgagacccagcucguccucuacggcgacgucgaggagcucaagcgcuccgucggcgagcuccccuccaccgucgagucccuccagaagguccaggagcagguccacacccuccucucccaggaccaggcccaggccgcccgccuccccccccaggacuuccucgaccgccucuccucccucgacaaccucaaggccuccgucucccaggucgaggccgaccucaagaugcuccgcaccgccgucgacucccucgucgccuacuccgucaagaucgagaccaacgagaacaaccucgaguccgccaagggccuccucgacgaccuccgcaacgaccucgaccgccucuucgucaaggucgagaagauccacgagaaggucuga

SEQ ID NO: 41389 - RNA, 6099 nt, Artificial Sequence
  derived and/or modified sequence opt2 from CKAP5__Homo_sapiens__NP_001008938
augggcgacgacuccgaguggcucaagcuccccgucgaccagaagugcgagcacaagcucuggaaggcccgccucuccggcuacgaggaggcccucaagaucuuccagaagaucaaggacgagaagucccccgagugguccaaguuccucggccucaucaagaaguucgucaccgacuccaacgccgucguccagcucaagggccucgaggccgcccucgucuacgucgagaacgcccacgucgccggcaagaccaccggcgaggucgucuccggcgucgucuccaaggucuucaaccagcccaaggccaaggccaaggagcucggcaucgagaucugccucauguacaucgagaucgagaagggcgaggccguccaggaggagcuccucaagggccucgacaacaagaaccccaagaucaucgucgccugcaucgagacccuccgcaaggcccucuccgaguucggcuccaagaucauccuccucaagcccaucaucaagguccuccccaagcucuucgagucccgcgagaaggccguccgcgacgaggccaagcucaucgccgucgagaucuaccgcuggauccgcgacgcccuccgccccccccuccagaacaucaacuccguccagcucaaggagcucgaggaggagugggucaagcuccccaccuccgccccccgccccacccgcuuccuccgcucccagcaggagcucgaggccaagcucgagcagcagcaguccgccggcggcgacgccgagggcggcggcgacgacggcgacgaggucccccagaucgacgccuacgagcuccucgaggccgucgagauccucuccaagcuccccaaggacuucuacgacaagaucgaggccaagaaguggcaggagcgcaaggaggcccucgaguccgucgagguccucaucaagaaccccaagcucgaggccggcgacuacgccgaccucgucaaggcccucaagaaggucgucggcaaggacaccaacgucaugcucgucgcccucgccgccaagugccucaccggccucgccgucggccuccgcaagaaguucggccaguacgccggccacgucguccccaccauccucgagaaguucaaggagaagaagccccaggucguccaggcccuccaggaggccaucgacgccaucuuccucaccaccacccuccagaacaucuccgaggacguccucgccgucauggacaacaagaaccccaccaucaagcagcagaccucccucuucaucgcccgcuccuuccgccacugcaccgccuccacccuccccaagucccuccucaagcccuucugcgccgcccuccucaagcacaucaacgacuccgcccccgagguccgcgacgccgccuucgaggcccucggcaccgcccucaaggucgucggcgagaaggccgucaaccccuuccucgccgacgucgacaagcucaagcucgacaagaucaaggagugcuccgagaaggucgagcucauccacggcaagaaggccggccucgccgccgacaagaaggaguucaagccccuccccggccgcaccgccgccuccggcgccgccggcgacaaggacaccaaggacaucuccgcccccaagcccggcccccucaagaaggcccccgccgccaaggccggcggcccccccaagaagggcaagcccgccgcccccggcggcgccggcaacaccggcaccaagaacaagaagggccucgagaccaaggagaucgucgagcccgagcucuccaucgaggucugcgaggagaaggccuccgccguccucccccccaccugcauccagcuccucgacuccuccaacuggaaggagcgccucgccugcauggaggaguuccagaaggccgucgagcucauggaccgcaccgagaugcccugccaggcccucguccgcaugcucgccaagaagcccggcuggaaggagaccaacuuccaggucaugcagaugaagcuccacaucgucgcccucaucgcccagaagggcaacuucuccaagaccuccgcccaggucguccucgacggccucgucgacaagaucggcgacgucaagugcggcaacaacgccaaggaggccaugaccgccaucgccgaggccugcaugcuccccuggaccgccgagcaggucgucuccauggccuucucccagaagaaccccaagaaccaguccgagacccucaacuggcucuccaacgccaucaaggaguucggcuucuccggccucaacgucaaggccuucaucuccaacgucaagaccgcccucgccgccaccaaccccgccguccgcaccgccgccaucacccuccucggcgucauguaccucuacgucggccccucccuccgcauguucuucgaggacgagaagcccgcccuccucucccagaucgacgccgaguucgagaagaugcagggccaguccccccccgcccccacccgcggcaucuccaagcacuccaccuccggcaccgacgagggcgaggacggcgacgagcccgacgacggcuccaacgacgucgucgaccuccucccccgcaccgagaucuccgacaagaucaccuccgagcucgucuccaagaucggcgacaagaacuggaagauccgcaaggagggccucgacgaggucgccggcaucaucaacgacgccaaguucauccagcccaacaucggcgagcuccccaccgcccucaagggccgccucaacgacuccaacaagauccucguccagcagacccucaacauccuccagcagcucgccgucgccaugggccccaacaucaagcagcacgucaagaaccucggcauccccaucaucaccguccucggcgacuccaagaacaacguccgcgccgccgcccucgccaccgucaacgccugggccgagcagaccggcaugaaggaguggcucgagggcgaggaccucuccgaggagcucaagaaggagaaccccuuccuccgccaggagcuccucggcuggcucgccgagaagcuccccacccuccgcuccacccccaccgaccucauccucugcgucccccaccucuacuccugccucgaggaccgcaacggcgacguccgcaagaaggcccaggacgcccuccccuucuucaugaugcaccucggcuacgagaagauggccaaggccaccggcaagcucaagcccaccuccaaggaccagguccucgccaugcucgagaaggccaaggucaacaugcccgccaagcccgccccccccaccaaggccaccuccaagcccaugggcggcuccgcccccgccaaguuccagcccgccuccgcccccgccgaggacugcaucuccuccuccaccgagcccaagcccgaccccaagaaggccaaggcccccggccucuccuccaaggccaaguccgcccagggcaagaagaugcccuccaagaccucccucaaggaggacgaggacaaguccggccccaucuucaucgucguccccaacggcaaggagcagcgcaugaaggacgagaagggccucaagguccucaaguggaacuucaccaccccccgcgacgaguacaucgagcagcucaagacccagauguccuccugcgucgccaaguggcuccaggacgagauguuccacuccgacuuccagcaccacaacaaggcccucgccgucauggucgaccaccucgaguccgagaaggagggcgucaucggcugccucgaccucauccucaaguggcucacccuccgcuucuucgacaccaacaccuccguccucaugaaggcccucgaguaccucaagcuccucuucacccuccucuccgaggaggaguaccaccucaccgagaacgaggccuccuccuucauccccuaccucgucgucaaggucggcgagcccaaggacgucauccgcaaggacguccgcgccauccucaaccgcaugugccucgucuaccccgccuccaagauguuccccuucaucauggagggcaccaaguccaagaacuccaagcagcgcgccgagugccucgaggagcucggcugccucgucgaguccuacggcaugaacgucugccagcccacccccggcaaggcccucaaggagaucgccguccacaucggcgaccgcgacaacgccguccgcaacgccgcccucaacaccaucgucaccgucuacaacguccacggcgaccaggucuucaagcucaucggcaaccucuccgagaaggacauguccaugcucgaggagcgcaucaagcgcuccgccaagcgccccuccgccgcccccaucaagcaggucgaggagaagccccagcgcgcccagaacaucuccuccaacgccaacaugcuccgcaagggccccgccgaggacauguccuccaagcucaaccaggcccgcuccauguccggccaccccgaggccgcccagaugguccgccgcgaguuccagcucgaccucgacgagaucgagaacgacaacggcaccguccgcugcgagaugcccgagcucguccagcacaagcucgacgacaucuucgagcccguccucauccccgagcccaagauccgcgccgucuccccccacuucgacgacaugcacuccaacaccgccuccaccaucaacuucaucaucucccaggucgccuccggcgacaucaacaccuccauccaggcccucacccagaucgacgagguccuccgccaggaggacaaggccgaggccauguccggccacaucgaccaguuccucaucgccaccuucaugcagcuccgccucaucuacaacacccacauggccgacgagaagcucgagaaggacgagaucaucaagcucuacuccugcaucaucggcaacaugaucucccucuuccagaucgagucccucgcccgcgaggccuccaccggcguccucaaggaccucaugcacggccucaucacccucaugcucgacucccgcaucgaggaccucgaggagggccagcaggucauccgcuccgucaaccuccucgucgucaagguccucgagaaguccgaccagaccaacauccucuccgcccuccucguccuccuccaggacucccuccucgccaccgccuccucccccaaguucuccgagcucgucaugaagugccucuggcgcaugguccgccuccuccccgacaccaucaacuccaucaaccucgaccgcauccuccucgacauccacaucuucaugaaggucuuccccaaggagaagcucaagcagugcaaguccgaguuccccauccgcacccucaagacccuccuccacacccucugcaagcucaagggccccaagauccucgaccaccucaccaugaucgacaacaagaacgaguccgagcucgaggcccaccucugccgcaugaugaagcacuccauggaccagaccggcuccaaguccgacaaggagaccgagaagggcgccucccgcaucgacgagaaguccuccaaggccaaggucaacgacuuccucgccgagaucuucaagaagaucggcuccaaggagaacaccaaggagggccucgccgagcucuacgaguacaagaagaaguacuccgacgccgacaucgagcccuuccucaagaacuccucccaguucuuccaguccuacgucgagcgcggccuccgcgucaucgagauggagcgcgagggcaagggccgcaucuccaccuccaccggcaucuccccccagauggaggucaccugcguccccacccccaccuccaccgucuccuccaucggcaacaccaacggcgaggaggucggccccuccgucuaccucgagcgccucaagauccuccgccagcgcugcggccucgacaacaccaagcaggacgaccgccccccccucaccucccuccucuccaagcccgccguccccaccgucgccuccuccaccgacaugcuccacuccaagcucucccagcuccgcgagucccgcgagcagcaccagcacuccgaccucgacuccaaccagacccacuccuccggcaccgucaccuccuccuccuccaccgccaacaucgacgaccucaagaagcgccucgagcgcaucaaguccucccgcaaguga

SEQ ID NO: 41390 - RNA, 1146 nt, Artificial Sequence
  derived and/or modified sequence opt2 from CKB__Homo_sapiens__NP_001814
augcccuucuccaacucccacaacgcccucaagcuccgcuuccccgccgaggacgaguuccccgaccucuccgcccacaacaaccacauggccaagguccucacccccgagcucuacgccgagcuccgcgccaaguccacccccuccggcuucacccucgacgacgucauccagaccggcgucgacaaccccggccaccccuacaucaugaccgucggcugcgucgccggcgacgaggaguccuacgaggucuucaaggaccucuucgaccccaucaucgaggaccgccacggcggcuacaagcccuccgacgagcacaagaccgaccucaaccccgacaaccuccagggcggcgacgaccucgaccccaacuacguccucuccucccgcguccgcaccggccgcuccauccgcggcuucugccuccccccccacugcucccgcggcgagcgccgcgccaucgagaagcucgccgucgaggcccucuccucccucgacggcgaccucgccggccgcuacuacgcccucaaguccaugaccgaggccgagcagcagcagcucaucgacgaccacuuccucuucgacaagcccgucuccccccuccuccucgccuccggcauggcccgcgacuggcccgacgcccgcggcaucuggcacaacgacaacaagaccuuccucgucugggucaacgaggaggaccaccuccgcgucaucuccaugcagaagggcggcaacaugaaggaggucuucacccgcuucugcaccggccucacccagaucgagacccucuucaaguccaaggacuacgaguucauguggaacccccaccucggcuacauccucaccugccccuccaaccucggcaccggccuccgcgccggcguccacaucaagcuccccaaccucggcaagcacgagaaguucuccgagguccucaagcgccuccgccuccagaagcgcggcaccggcggcgucgacaccgccgccgucggcggcgucuucgacgucuccaacgccgaccgccucggcuucuccgaggucgagcucguccagauggucgucgacggcgucaagcuccucaucgagauggagcagcgccucgagcagggccaggccaucgacgaccucaugcccgcccagaaguga

SEQ ID NO: 41391 - RNA, 342 nt, Artificial Sequence
  derived and/or modified sequence opt2 from CKLF__Homo_sapiens__NP_001035228
auggacaacguccagcccaagaucaagcaccgccccuucugcuucuccgucaagggccacgucaagaugcuccgccucgcccucaccgucaccuccaugaccuucuucaucaucgcccaggcccccgagcccuacaucgucaucaccggcuucgaggucaccgucauccucuucuucauccuccucuacguccuccgccucgaccgccucaugaaguggcucuucuggccccuccucgacaucaucaacucccucgucaccaccgucuucaugcucaucgucuccguccucgcccucauccccgagaccaccacccucaccgucggcggcggccucuucuga

SEQ ID NO: 41392 - RNA, 1146 nt, Artificial Sequence
  derived and/or modified sequence opt2 from CKM__Homo_sapiens__NP_001815
augcccuucggcaacacccacaacaaguucaagcucaacuacaagcccgaggaggaguaccccgaccucuccaagcacaacaaccacauggccaagguccucacccucgagcucuacaagaagcuccgcgacaaggagacccccuccggcuucaccgucgacgacgucauccagaccggcgucgacaaccccggccaccccuucaucaugaccgucggcugcgucgccggcgacgaggaguccuacgaggucuucaaggagcucuucgaccccaucaucuccgaccgccacggcggcuacaagcccaccgacaagcacaagaccgaccucaaccacgagaaccucaagggcggcgacgaccucgaccccaacuacguccucuccucccgcguccgcaccggccgcuccaucaagggcuacacccuccccccccacugcucccgcggcgagcgccgcgccgucgagaagcucuccgucgaggcccucaacucccucaccggcgaguucaagggcaaguacuacccccucaaguccaugaccgagaaggagcagcagcagcucaucgacgaccacuuccucuucgacaagcccgucuccccccuccuccucgccuccggcauggcccgcgacuggcccgacgcccgcggcaucuggcacaacgacaacaaguccuuccucgucugggucaacgaggaggaccaccuccgcgucaucuccauggagaagggcggcaacaugaaggaggucuuccgccgcuucugcgucggccuccagaagaucgaggagaucuucaagaaggccggccaccccuucauguggaaccagcaccucggcuacguccucaccugccccuccaaccucggcaccggccuccgcggcggcguccacgucaagcucgcccaccucuccaagcaccccaaguucgaggagauccucacccgccuccgccuccagaagcgcggcaccggcggcgucgacaccgccgccgucggcuccgucuucgacgucuccaacgccgaccgccucggcuccuccgaggucgagcagguccagcucgucgucgacggcgucaagcucauggucgagauggagaagaagcucgagaagggccaguccaucgacgacaugauccccgcccagaaguga

SEQ ID NO: 41393 - RNA, 777 nt, Artificial Sequence
  derived and/or modified sequence opt2 from CKMT1A__Homo_sapiens__XP_005254555
augcccgucaagguccgcaccggccgcuccauccgcggccucucccucccccccgccugcacccgcgccgagcgccgcgaggucgagcgcgucgucgucgacgcccucuccggccucaagggcgaccucgccggccgcuacuaccgccucuccgagaugaccgaggccgagcagcagcagcucaucgacgaccacuuccucuucgacaagcccgucuccccccuccucaccgccgccggcauggcccgcgacuggcccgacgcccgcggcaucuggcacaacaacgagaaguccuuccucaucugggucaacgaggaggaccacacccgcgucaucuccauggagaagggcggcaacaugaagcgcgucuucgagcgcuucugccgcggccucaaggaggucgagcgccucauccaggagcgcggcugggaguucauguggaacgagcgccucggcuacauccucaccugccccuccaaccucggcaccggccuccgcgccggcguccacaucaagcucccccuccucuccaaggacucccgcuuccccaagauccucgagaaccuccgccuccagaagcgcggcaccggcggcgucgacaccgccgccaccggcggcgucuucgacaucuccaaccucgaccgccucggcaaguccgaggucgagcucguccagcucgucaucgacggcgucaacuaccucaucgacugcgagcgccgccucgagcgcggccaggacauccgcauccccacccccgucauccacaccaagcacuga

SEQ ID NO: 41394 - RNA, 1347 nt, Artificial Sequence
  derived and/or modified sequence opt2 from CKMT1B__Homo_sapiens__XP_011519498
auggccggccccuucucccgccuccucuccgcccgccccggccuccgccuccucgcccucgccggcgccggcucccucgccgccggcuuccuccuccgccccgagcccguccgcgccgccuccgagcgccgccgccucuacccccccucccagaccuggcccaccggccagcuccccggcaacugcacccgcucccgccgccucugcccccccuccauggucaccggcuacccccuccccuccgccgaguaccccgaccuccgcaagcacaacaacugcauggccucccaccucacccccgccgucuacgcccgccucugcgacaagaccacccccaccggcuggacccucgaccagugcauccagaccggcgucgacaaccccggccaccccuucaucaagaccgucggcauggucgccggcgacgaggagaccuacgaggucuucgccgaccucuucgaccccgucauccaggagcgccacaacggcuacgacccccgcaccaugaagcacaccaccgaccucgacgccuccaagauccgcuccggcuacuucgacgagcgcuacguccucuccucccgcguccgcaccggccgcuccauccgcggccucucccucccccccgccugcacccgcgccgagcgccgcgaggucgagcgcgucgucgucgacgcccucuccggccucaagggcgaccucgccggccgcuacuaccgccucuccgagaugaccgaggccgagcagcagcagcucaucgacgaccacuuccucuucgacaagcccgucuccccccuccucaccgccgccggcauggcccgcgacuggcccgacgcccgcggcaucuggcacaacaacgagaaguccuuccucaucugggucaacgaggaggaccacacccgcgucaucuccauggagaagggcggcaacaugaagcgcgucuucgagcgcuucugccgcggccucaaggaggucgagcgccucauccaggagcgcggcugggaguucauguggaacgagcgccucggcuacauccucaccugccccuccaaccucggcaccggccuccgcgccggcguccacaucaagcucccccuccucuccaaggacucccgcuuccccaagauccucgagaaccuccgccuccagaagcgcggcaccggcggcgucgacaccgccgccaccggcggcgucuucgacaucuccaaccucgaccgccucggcaaguccgaggucgagcucguccagcucgucaucgacggcgucaacuaccucaucgacugcgagcgccgccucgagcgcggccaggacauccgcauccccacccccgucauccacaccaagcacuga

SEQ ID NO: 41395 - RNA, 1260 nt, Artificial Sequence
  derived and/or modified sequence opt2 from CKMT2__Homo_sapiens__NP_001093206
auggccuccaucuucuccaagcuccucaccggccgcaacgccucccuccucuucgccaccaugggcaccuccguccucaccaccggcuaccuccucaaccgccagaaggucugcgccgagguccgcgagcagccccgccucuucccccccuccgccgacuaccccgaccuccgcaagcacaacaacugcauggccgagugccucacccccgccaucuacgccaagcuccgcaacaaggucacccccaacggcuacacccucgaccagugcauccagaccggcgucgacaaccccggccaccccuucaucaagaccgucggcauggucgccggcgacgaggaguccuacgaggucuucgccgaccucuucgaccccgucaucaagcuccgccacaacggcuacgacccccgcgucaugaagcacaccaccgaccucgacgccuccaagaucacccagggccaguucgacgagcacuacguccucuccucccgcguccgcaccggccgcuccauccgcggccucucccucccccccgccugcacccgcgccgagcgccgcgaggucgagaacgucgccaucaccgcccucgagggccucaagggcgaccucgccggccgcuacuacaagcucuccgagaugaccgagcaggaccagcagcgccucaucgacgaccacuuccucuucgacaagcccgucuccccccuccucaccugcgccggcauggcccgcgacuggcccgacgcccgcggcaucuggcacaacuacgacaagaccuuccucaucuggaucaacgaggaggaccacacccgcgucaucuccauggagaagggcggcaacaugaagcgcgucuucgagcgcuucugccgcggccucaaggaggucgagcgccucauccaggagcgcggcugggaguucauguggaacgagcgccucggcuacauccucaccugccccuccaaccucggcaccggccuccgcgccggcguccacguccgcauccccaagcucuccaaggacccccgcuucuccaagauccucgagaaccuccgccuccagaagcgcggcaccggcggcgucgacaccgccgccgucgccgacgucuacgacaucuccaacaucgaccgcaucggccgcuccgaggucgagcucguccagaucgucaucgacggcgucaacuaccucgucgacugcgagaagaagcucgagcgcggccaggacaucaaggucccccccccccucccccaguucggcaagaaguga

SEQ ID NO: 41396 - RNA, 240 nt, Artificial Sequence
  derived and/or modified sequence opt2 from CKS1B__Homo_sapiens__NP_001817
augucccacaagcagaucuacuacuccgacaaguacgacgacgaggaguucgaguaccgccacgucaugcuccccaaggacaucgccaagcucguccccaagacccaccucauguccgaguccgaguggcgcaaccucggcguccagcagucccagggcuggguccacuacaugauccacgagcccgagccccacauccuccucuuccgccgcccccuccccaagaagcccaagaaguga

SEQ ID NO: 41397 - RNA, 240 nt, Artificial Sequence
  derived and/or modified sequence opt2 from CKS2__Homo_sapiens__NP_001818
auggcccacaagcagaucuacuacuccgacaaguacuucgacgagcacuacgaguaccgccacgucaugcucccccgcgagcucuccaagcagguccccaagacccaccucauguccgaggaggaguggcgccgccucggcguccagcagucccucggcuggguccacuacaugauccacgagcccgagccccacauccuccucuuccgccgcccccuccccaaggaccagcagaaguga

SEQ ID NO: 41398 - RNA, 4440 nt, Artificial Sequence
  derived and/or modified sequence opt2 from CLASP1__Homo_sapiens__NP_001135745
auggagccccgcauggaguccugccucgcccagguccuccagaaggacgucggcaagcgccuccaggucggccaggagcucaucgacuacuucuccgacaagcagaaguccgccgaccucgagcacgaccagaccaugcucgacaagcucgucgacggccucgccaccuccugggucaacuccuccaacuacaaggucguccuccucggcauggacauccucuccgcccucgucacccgccuccaggaccgcuucaaggcccagaucggcaccguccuccccucccucaucgaccgccucggcgacgccaaggacuccguccgcgagcaggaccagacccuccuccucaagaucauggaccaggccgccaacccccaguacgucugggaccgcaugcucggcggcuucaagcacaagaacuuccgcacccgcgagggcaucugccucugccucaucgccacccucaacgccuccggcgcccagacccucacccucuccaagaucgucccccacaucugcaaccuccucggcgaccccaacucccagguccgcgacgccgccaucaacucccucgucgagaucuaccgccacgucggcgagcgcguccgcgccgaccucuccaagaagggccucccccagucccgccucaacgucaucuucaccaaguucgacgagguccagaaguccggcaacaugauccaguccgccaacgacaagaacuucgacgacgaggacuccgucgacggcaaccgccccuccuccgccuccuccaccuccuccaaggccccccccuccucccgccgcaacgucggcaugggcaccacccgccgccucggcuccuccacccucggcuccaaguccuccgccgccaaggagggcgccggcgccgucgacgaggaggacuucaucaaggccuucgacgacguccccgucguccagaucuacuccucccgcgaccucgaggaguccaucaacaagauccgcgagauccucuccgacgacaagcacgacugggagcagcgcgucaacgcccucaagaagauccgcucccuccuccucgccggcgccgccgaguacgacaacuucuuccagcaccuccgccuccucgacggcgccuucaagcucuccgccaaggaccuccgcucccaggucguccgcgaggccugcaucacccucggccaccucuccuccguccucggcaacaaguucgaccacggcgccgaggccaucaugcccaccaucuucaaccucauccccaacuccgccaagaucauggccaccuccggcgucgucgccguccgccucaucauccgccacacccacaucccccgccucauccccgucaucaccuccaacugcaccuccaaguccgucgccguccgccgccgcugcuucgaguuccucgaccuccuccuccaggaguggcagacccacucccucgagcgccacaucuccguccucgccgagaccaucaagaagggcauccacgacgccgacuccgaggcccgcaucgaggcccgcaagugcuacuggggcuuccacucccacuucucccgcgaggccgagcaccucuaccacacccucgaguccuccuaccagaaggcccuccagucccaccucaagaacuccgacuccaucgucucccucccccaguccgaccgcuccuccuccuccucccaggagucccucaaccgcccccucuccgccaagcgcucccccaccggcuccaccaccucccgcgccuccaccgucuccaccaaguccgucuccaccaccggcucccuccagcgcucccgcuccgacaucgacgucaacgccgccgccuccgccaaguccaaggucuccuccuccuccggcaccacccccuucuccuccgccgccgcccucccccccggcuccuacgccucccucgacggcaccaccaccaaggccgagggccgcauccgcacccgccgccaguccuccggcuccgccaccaacgucgccuccacccccgacaaccgcggccgcucccgcgccaaggucgucucccagucccagcgcucccgcuccgccaaccccgccggcgccggcucccgcuccuccucccccggcaagcuccucggcuccggcuacggcggccucaccggcggcuccucccgcggcccccccgucacccccuccuccgagaagcgcuccaagaucccccgcucccagggcugcucccgcgagaccucccccaaccgcaucggccucgaccgcuucggccucggccagcccggccgcauccccggcuccgucaacgccaugcgcguccucuccaccuccaccgaccucgaggccgccgucgccgacgcccuccuccucggcgacucccgcuccaagaagaagcccguccgccgccgcuacgagcccuacggcauguacuccgacgacgacgccaacuccgacgccuccuccgucugcuccgagcgcuccuacggcucccgcaacggcggcaucccccacuaccuccgccagaccgaggacgucgccgagguccucaaccacugcgccuccuccaacugguccgagcgcaaggagggccuccucggccuccagaaccuccucaagucccagcgcacccucucccgcgucgagcucaagcgccucugcgagaucuucacccgcauguucgccgacccccacuccaagcgcgucuucuccauguuccucgagacccucgucgacuucaucaucauccacaaggacgaccuccaggacuggcucuucguccuccucacccagcuccucaagaagaugggcgccgaccuccucggcuccguccaggccaagguccagaaggcccucgacgucacccgcgacuccuuccccuucgaccagcaguucaacauccucaugcgcuucaucgucgaccagacccagacccccaaccucaaggucaaggucgccauccucaaguacaucgagucccucgcccgccagauggaccccaccgacuucgucaacuccuccgagacccgccucgccgucucccgcaucaucaccuggaccaccgagcccaaguccuccgacguccgcaaggccgcccagaucguccucaucucccucuucgagcucaacacccccgaguucaccaugcuccucggcgcccuccccaagaccuuccaggacggcgccaccaagcuccuccacaaccaccucaagaacuccuccaacaccuccgucggcucccccuccaacaccaucggccgcacccccucccgccacaccuccucccgcaccuccccccucaccucccccaccaacugcucccacggcggccucucccccuccaugcucgacuacgacaccgagaaccucaacuccgaggagaucuacuccucccuccgcggcgucaccgaggccaucgagaaguucuccuuccgcucccaggaggaccucaacgagcccaucaagcgcgacggcaagaaggagugcgacaucgucucccgcgacggcggcgccgccucccccgccaccgagggccgcggcggcuccgaggucgagggcggccgcaccgcccucgacaacaagaccucccuccucaacacccagcccccccgcgccuuccccggcccccgcgcccgcgacuacaaccccuaccccuacuccgacgccaucaacaccuacgacaagaccgcccucaaggaggccgucuucgacgacgacauggagcagcuccgcgacguccccaucgaccacuccgaccucgucgccgaccuccucaaggagcucuccaaccacaacgagcgcgucgaggagcgcaagggcgcccuccucgagcuccucaagaucacccgcgaggacucccucggcgucugggaggagcacuucaagaccauccuccuccuccuccucgagacccucggcgacaaggaccacuccauccgcgcccucgcccuccgcguccuccgcgagauccuccgcaaccagcccgcccgcuucaagaacuacgccgagcucaccaucaugaagacccucgaggcccacaaggacucccacaaggaggucguccgcgccgccgaggaggccgccuccacccucgccuccuccauccaccccgagcagugcaucaagguccucugccccaucauccagaccgccgacuaccccaucaaccucgccgccaucaagaugcagaccaaggucgucgagcgcaucgccaaggagucccuccuccagcuccucgucgacaucauccccggccuccuccagggcuacgacaacaccgaguccuccguccgcaaggccuccgucuucugccucgucgccaucuacuccgucaucggcgaggaccucaagccccaccucgcccagcucaccggcuccaagaugaagcuccucaaccucuacaucaagcgcgcccagaccaccaacuccaacuccuccuccuccuccgacgucuccacccacuccuga

SEQ ID NO: 41399 - RNA, 3885 nt, Artificial Sequence
  derived and/or modified sequence opt2 from CLASP2__Homo_sapiens__NP_001193973
auggccaugggcgacgacaaguccuucgacgacgaggaguccgucgacggcaaccgccccuccuccgccgccuccgccuucaagguccccgcccccaagaccuccggcaaccccgccaacuccgcccgcaagcccggcuccgccggcggccccaaggucggcggcgccuccaaggagggcggcgccggcgccgucgacgaggacgacuucaucaaggccuucaccgacguccccuccauccagaucuacuccucccgcgagcucgaggagacccucaacaagauccgcgagauccucuccgacgacaagcacgacugggaccagcgcgccaacgcccucaagaagauccgcucccuccucgucgccggcgccgcccaguacgacugcuucuuccagcaccuccgccuccucgacggcgcccucaagcucuccgccaaggaccuccgcucccaggucguccgcgaggccugcaucaccgucgcccaccucuccaccguccucggcaacaaguucgaccacggcgccgaggccaucguccccacccucuucaaccucguccccaacuccgccaaggucauggccaccuccggcugcgccgccauccgcuucaucauccgccacacccacgucccccgccucaucccccucaucaccuccaacugcaccuccaaguccguccccguccgccgccgcuccuucgaguuccucgaccuccuccuccaggaguggcagacccacucccucgagcgccacgccgccguccucgucgagaccaucaagaagggcauccacgacgccgacgccgaggcccgcgucgaggcccgcaagaccuacaugggccuccgcaaccacuuccccggcgaggccgagacccucuacaacucccucgagcccuccuaccagaagucccuccagaccuaccucaaguccuccggcuccgucgccucccucccccaguccgaccgcuccuccuccuccucccaggagucccucaaccgccccuucuccuccaagugguccaccgccaaccccuccaccgucgccggccgcgucuccgccggcuccuccaaggccuccucccuccccggcucccuccagcgcucccgcuccgacaucgacgucaacgccgccgccggcgccaaggcccaccacgccgccggccaguccguccgcuccggccgccucggcgccggcgcccucaacgccggcuccuacgccucccucgaggacaccuccgacaagcucgacggcaccgccuccgaggacggccgcguccgcgccaagcucuccgccccccucgccggcaugggcaacgccaaggccgacucccgcggccgcucccgcaccaagauggucucccagucccagcccggcucccgcuccggcucccccggccgcguccucaccaccaccgcccucuccaccgucuccuccggcguccagcgcguccucgucaacuccgccuccgcccagaagcgcuccaagaucccccgcucccagggcugcucccgcgaggccucccccucccgccucuccgucgcccgcuccucccgcaucccccgccccuccgucucccagggcugcucccgcgaggccucccgcgaguccucccgcgacaccucccccguccgcuccuuccagccccucgccucccgccaccacucccgcuccaccggcgcccucuacgcccccgaggucuacggcgccuccggccccggcuacggcaucucccaguccucccgccucuccuccuccgucuccgccaugcgcguccucaacaccggcuccgacgucgaggaggccgucgccgacgcccucaagaagcccgcccgccgccgcuacgaguccuacggcaugcacuccgacgacgacgccaacuccgacgccuccuccgccugcuccgagcgcuccuacuccucccgcaacggcuccauccccaccuacaugcgccagaccgaggacgucgccgagguccucaaccgcugcgccuccuccaacugguccgagcgcaaggagggccuccucggccuccagaaccuccucaagaaccagcgcacccucucccgcgucgagcucaagcgccucugcgagaucuucacccgcauguucgccgacccccacggcaagcgcgucuucuccauguuccucgagacccucgucgacuucauccagguccacaaggacgaccuccaggacuggcucuucguccuccucacccagcuccucaagaagaugggcgccgaccuccucggcuccguccaggccaagguccagaaggcccucgacgucacccgcgaguccuuccccaacgaccuccaguucaacauccucaugcgcuucaccgucgaccagacccagacccccucccucaaggucaaggucgccauccucaaguacaucgagacccucgccaagcagauggaccccggcgacuucaucaacuccuccgagacccgccucgccgucucccgcgucaucaccuggaccaccgagcccaaguccuccgacguccgcaaggccgcccaguccguccucaucucccucuucgagcucaacacccccgaguucaccaugcuccucggcgcccuccccaagaccuuccaggacggcgccaccaagcuccuccacaaccaccuccgcaacaccggcaacggcacccaguccuccaugggcuccccccucacccgccccaccccccgcucccccgccaacugguccuccccccucaccucccccaccaacaccucccagaacacccucucccccuccgccuucgacuacgacaccgagaacaugaacuccgaggacaucuacuccucccuccgcggcgucaccgaggccauccagaacuucuccuuccgcucccaggaggacaugaacgagccccucaagcgcgacuccaagaaggacgacggcgacuccaugugcggcggccccggcauguccgacccccgcgccggcggcgacgccaccgacuccucccagaccgcccucgacaacaaggccucccuccuccacuccaugcccacccacuccuccccccgcucccgcgacuacaaccccuacaacuacuccgacuccaucucccccuucaacaaguccgcccucaaggaggccauguucgacgacgacgccgaccaguuccccgacgaccucucccucgaccacuccgaccucgucgccgagcuccucaaggagcucuccaaccacaacgagcgcgucgaggagcgcaagaucgcccucuacgagcucaugaagcucacccaggaggaguccuucuccgucugggacgagcacuucaagaccauccuccuccuccuccucgagacccucggcgacaaggagcccaccauccgcgcccucgcccucaagguccuccgcgagauccuccgccaccagcccgcccgcuucaagaacuacgccgagcucaccgucaugaagacccucgaggcccacaaggacccccacaaggaggucguccgcuccgccgaggaggccgccuccguccucgccaccuccaucucccccgagcagugcaucaagguccucugccccaucauccagaccgccgacuaccccaucaaccucgccgccaucaagaugcagaccaaggucaucgagcgcgucuccaaggagacccucaaccuccuccuccccgagaucaugcccggccucauccagggcuacgacaacuccgaguccuccguccgcaaggccugcgucuucugccucgucgccguccacgccgucaucggcgacgagcucaagccccaccucucccagcucaccggcuccaagaugaagcuccucaaccucuacaucaagcgcgcccagaccggcuccggcggcgccgaccccaccaccgacgucuccggccaguccuga

SEQ ID NO: 41400 - RNA, 1851 nt, Artificial Sequence
  derived and/or modified sequence opt2 from CLCA2__Homo_sapiens__XP_011540750
augacccagcgcuccaucgccggccccaucugcaaccucaaguucgucacccuccucgucgcccucuccuccgagcuccccuuccucggcgccggcguccagcuccaggacaacggcuacaacggccuccucaucgccaucaacccccagguccccgagaaccagaaccucaucuccaacaucaaggagaugaucaccgaggccuccuucuaccucuucaacgccaccaagcgccgcgucuucuuccgcaacaucaagauccucauccccgccaccuggaaggccaacaacaacuccaagaucaagcaggaguccuacgagaaggccaacgucaucgucaccgacugguacggcgcccacggcgacgaccccuacacccuccaguaccgcggcugcggcaaggagggcaaguacauccacuucacccccaacuuccuccucaacgacaaccucaccgccggcuacggcucccgcggccgcgucuucguccacgagugggcccaccuccgcuggggcgucuucgacgaguacaacaacgacaagcccuucuacaucaacggccagaaccagaucaaggucacccgcugcuccuccgacaucaccggcaucuucgucugcgagaagggccccugcccccaggagaacugcaucaucuccaagcucuucaaggagggcugcaccuucaucuacaacuccacccagaacgccaccgccuccaucauguucaugcagucccucuccuccgucgucgaguucugcaacgccuccacccacaaccaggaggcccccaaccuccagaaccagaugugcucccuccgcuccgccugggacgucaucaccgacuccgccgacuuccaccacuccuuccccaugaacggcaccgagcucccccccccccccaccuucucccucguccaggccggcgacaaggucgucugccucguccucgacgucuccuccaagauggccgaggccgaccgccuccuccagcuccagcaggccgccgaguucuaccucaugcagaucgucgagauccacaccuucgucggcaucgccuccuucgacuccaagggcgagauccgcgcccagcuccaccagaucaacuccaacgacgaccgcaagcuccucgucuccuaccuccccaccaccgucuccgccaagaccgacaucuccaucugcuccggccucaagaagggcuucgaggucgucgagaagcucaacggcaaggccuacggcuccgucaugauccucgucaccuccggcgacgacaagcuccucggcaacugccuccccaccguccucuccuccggcuccaccauccacuccaucgcccucggcuccuccgccgcccccaaccucgaggagcucucccgccucaccggcggccucaaguucuucguccccgacaucuccaacuccaacuccaugaucgacgccuucucccgcaucuccuccggcaccggcgacaucuuccagcagcacauccagcucgaguccaccggcgagaacgucaagccccaccaccagcucaagaacaccgucaccgucgacaacaccgucggcaacgacaccauguuccucgucaccuggcaggccuccggcccccccgagaucauccucuucgaccccgacggccgcaaguacuacaccaacaacuucaucaccaaccucaccuuccgcaccgccucccucuggauccccggcaccgccaagcuccgccgcuucgccuucauccccgacggccgccucaaccucuccgucgucgacuucgacacccucgcccucuuccucuuccucaucuacugccucggccacaaggucaagggcaacaacaaggucuacuuccacuga

SEQ ID NO: 41401 - RNA, 2607 nt, Artificial Sequence
  derived and/or modified sequence opt2 from CLCA4__Homo_sapiens__XP_011539317
auggaggacauggucaccaccgccuccaccuaccucuucgaggccaccgagaagcgcuucuucuucaagaacgucuccauccucauccccgagaacuggaaggagaacccccaguacaagcgccccaagcacgagaaccacaagcacgccgacgucaucgucgccccccccacccuccccggccgcgacgagcccuacaccaagcaguucaccgagugcggcgagaagggcgaguacauccacuucacccccgaccuccuccucggcaagaagcagaacgaguacggcccccccggcaagcucuucguccacgagugggcccaccuccgcuggggcgucuucgacgaguacaacgaggaccagcccuucuaccgcgccaaguccaagaagaucgaggccacccgcugcuccgccggcaucuccggccgcaaccgcgucuacaagugccagggcggcuccugccucucccgcgccugccgcaucgacuccaccaccaagcucuacggcaaggacugccaguucuuccccgacaagguccagaccgagaaggccuccaucauguucaugcaguccaucgacuccgucgucgaguucugcaacgagaagacccacaaccaggaggcccccucccuccagaacaucaagugcaacuuccgcuccaccugggaggucaucuccaacuccgaggacuucaagaacaccauccccauggucacccccccccccccccccgucuucucccuccucaagaucucccagcgcaucgucugccucguccucgacaaguccggcuccaugggcggcaaggaccgccucaaccgcaugaaccaggccgccaagcacuuccuccuccagaccgucgagaacggcuccugggucggcaugguccacuucgacuccaccgccaccaucgucaacaagcucauccagaucaaguccuccgacgagcgcaacacccucauggccggccuccccaccuacccccucggcggcaccuccaucugcuccggcaucaaguacgccuuccaggucaucggcgagcuccacucccagcucgacggcuccgagguccuccuccucaccgacggcgaggacaacaccgccuccuccugcaucgacgaggucaagcaguccggcgccaucguccacuucaucgcccucggccgcgccgccgacgaggccgucaucgagauguccaagaucaccggcggcucccacuucuacgucuccgacgaggcccagaacaacggccucaucgacgccuucggcgcccucaccuccggcaacaccgaccucucccagaagucccuccagcucgaguccaagggccucacccucaacuccaacgccuggaugaacgacaccgucaucaucgacuccaccgucggcaaggacaccuucuuccucaucaccuggaacucccucccccccuccaucucccucugggaccccuccggcaccaucauggagaacuucaccgucgacgccaccuccaagauggccuaccucuccauccccggcaccgccaaggucggcaccugggccuacaaccuccaggccaaggccaaccccgagacccucaccaucaccgucaccucccgcgccgccaacuccuccgucccccccaucaccgucaacgccaagaugaacaaggacgucaacuccuuccccucccccaugaucgucuacgccgagauccuccagggcuacguccccguccucggcgccaacgucaccgccuucaucgagucccagaacggccacaccgagguccucgagcuccucgacaacggcgccggcgccgacuccuucaagaacgacggcgucuacucccgcuacuucaccgccuacaccgagaacggccgcuacucccucaagguccgcgcccacggcggcgccaacaccgcccgccucaagcuccgccccccccucaaccgcgccgccuacauccccggcugggucgucaacggcgagaucgaggccaaccccccccgccccgagaucgacgaggacacccagaccacccucgaggacuucucccgcaccgccuccggcggcgccuucgucgucucccagguccccucccucccccuccccgaccaguacccccccucccagaucaccgaccucgacgccaccguccacgaggacaagaucauccucaccuggaccgcccccggcgacaacuucgacgucggcaagguccagcgcuacaucauccgcaucuccgccuccauccucgaccuccgcgacuccuucgacgacgcccuccaggucaacaccaccgaccucucccccaaggaggccaacuccaaggaguccuucgccuucaagcccgagaacaucuccgaggagaacgccacccacaucuucaucgccaucaaguccaucgacaaguccaaccucaccuccaaggucuccaacaucgcccaggucacccucuucaucccccaggccaaccccgacgacaucgaccccacccccacccccacccccacccccacccccgacaagucccacaacuccggcgucaacaucuccacccucguccucuccgucaucggcuccgucgucaucgucaacuucauccucuccaccaccaucuga

SEQ ID NO: 41402 - RNA, 648 nt, Artificial Sequence
  derived and/or modified sequence opt2 from CLCF1__Homo_sapiens__NP_001159684
augcucgccugccucugcaccguccucuggcaccuccccgccguccccgcccucaaccgcaccggcgaccccggccccggccccuccauccagaagaccuacgaccucacccgcuaccucgagcaccagcuccgcucccucgccggcaccuaccucaacuaccucggcccccccuucaacgagcccgacuucaaccccccccgccucggcgccgagacccucccccgcgccaccgucgaccucgaggucuggcgcucccucaacgacaagcuccgccucacccagaacuacgaggccuacucccaccuccucugcuaccuccgcggccucaaccgccaggccgccaccgccgagcuccgccgcucccucgcccacuucugcaccucccuccagggccuccucggcuccaucgccggcgucauggccgcccucggcuacccccucccccagccccuccccggcaccgagcccaccuggacccccggccccgcccacuccgacuuccuccagaagauggacgacuucuggcuccucaaggagcuccagaccuggcucuggcgcuccgccaaggacuucaaccgccucaagaagaagaugcagccccccgccgccgccgucacccuccaccucggcgcccacggcuucuga

SEQ ID NO: 41403 - RNA, 429 nt, Artificial Sequence
  derived and/or modified sequence opt2 from CLC__Homo_sapiens__NP_001819
augucccuccuccccguccccuacaccgaggccgccucccucuccaccggcuccaccgucaccaucaagggccgcccccucgccugcuuccucaacgagcccuaccuccaggucgacuuccacaccgagaugaaggaggaguccgacaucgucuuccacuuccaggucugcuucggccgccgcgucgucaugaacucccgcgaguacggcgccuggaagcagcaggucgaguccaagaacaugcccuuccaggacggccaggaguucgagcucuccaucuccguccuccccgacaaguaccaggucauggucaacggccaguccuccuacaccuucgaccaccgcaucaagcccgaggccgucaagaugguccaggucuggcgcgacaucucccucaccaaguucaacgucuccuaccucaagcgcuga

SEQ ID NO: 41404 - RNA, 2967 nt, Artificial Sequence
  derived and/or modified sequence opt2 from CLCN1__Homo_sapiens__NP_000074
auggagcagucccgcucccagcagcgcggcggcgagcaguccugguggggcuccgacccccaguaccaguacaugcccuucgagcacugcaccuccuacggccuccccuccgagaacggcggccuccagcaccgccuccgcaaggacgccggcccccgccacaacguccaccccacccagaucuacggccaccacaaggagcaguucuccgaccgcgagcaggacaucggcaugcccaagaagaccggcuccuccuccaccgucgacuccaaggacgaggaccacuacuccaagugccaggacugcauccaccgccucggccaggucguccgccgcaagcucggcgaggacuggaucuuccucguccuccucggccuccucauggcccucgucuccugguccauggacuacgucuccgccaagucccuccaggccuacaagugguccuacgcccagaugcagcccucccucccccuccaguuccucgucugggucaccuucccccucguccucauccucuucuccgcccucuucugccaccucaucuccccccaggccgucggcuccggcauccccgagaugaagaccauccuccgcggcgucguccucaaggaguaccucaccaugaaggccuucgucgccaaggucgucgcccucaccgccggccucggcuccggcauccccgucggcaaggagggccccuucguccacaucgccuccaucugcgccgccguccucuccaaguucauguccgucuucugcggcgucuacgagcagcccuacuacuacuccgacauccucaccgucggcugcgccgucggcgucggcugcugcuucggcaccccccucggcggcguccucuucuccaucgaggucaccuccaccuacuucgccguccgcaacuacuggcgcggcuucuucgccgccaccuucuccgccuucgucuuccgcguccucgccgucuggaacaaggacgccgucaccaucaccgcccucuuccgcaccaacuuccgcauggacuuccccuucgaccucaaggagcuccccgccuucgccgccaucggcaucugcugcggccuccucggcgccgucuucgucuaccuccaccgccaggucaugcucggcguccgcaagcacaaggcccucucccaguuccucgccaagcaccgccuccucuaccccggcaucgucaccuucgucaucgccuccuucaccuucccccccggcaugggccaguucauggccggcgagcucaugccccgcgaggccaucuccacccucuucgacaacaacaccugggucaagcacgccggcgaccccgagucccucggccaguccgccgucuggauccacccccgcgucaacgucgucaucaucaucuuccucuucuucgucaugaaguucuggauguccaucgucgccaccaccaugcccauccccugcggcggcuucaugcccgucuucguccucggcgccgccuucggccgccucgucggcgagaucauggccaugcucuuccccgacggcauccucuucgacgacaucaucuacaagauccuccccggcggcuacgccgucaucggcgccgccgcccucaccggcgccgucucccacaccgucuccaccgccgucaucugcuucgagcucaccggccagaucgcccacauccuccccaugauggucgccgucauccucgccaacauggucgcccagucccuccagcccucccucuacgacuccaucauccaggucaagaagcuccccuaccuccccgaccucggcuggaaccagcucuccaaguacaccaucuucgucgaggacaucaugguccgcgacgucaaguucgucuccgccuccuacaccuacggcgagcuccgcacccuccuccagaccaccaccgucaagacccucccccucgucgacuccaaggacuccaugauccuccucggcuccgucgagcgcuccgagcuccaggcccuccuccagcgccaccucugccccgagcgccgccuccgcgccgcccaggagauggcccgcaagcucuccgagcuccccuacgacggcaaggcccgccucgccggcgagggccuccccggcgccccccccggccgccccgaguccuucgccuucgucgacgaggacgaggacgaggaccucuccggcaaguccgagcucccccccucccucgcccuccaccccuccaccaccgccccccucucccccgaggagcccaacggcccccuccccggccacaagcagcagcccgaggcccccgagcccgccggccagcgccccuccaucuuccagucccuccuccacugccuccucggccgcgcccgccccaccaagaagaagaccacccaggacuccaccgaccucgucgacaacaugucccccgaggagaucgaggccugggagcaggagcagcucucccagcccgucugcuucgacuccugcugcaucgaccagucccccuuccagcucgucgagcagaccacccuccacaagacccacacccucuucucccuccucggccuccaccucgccuacgucaccuccaugggcaagcuccgcggcguccucgcccucgaggagcuccagaaggccaucgagggccacaccaaguccggcguccagcuccgccccccccucgccuccuuccgcaacaccaccuccacccgcaaguccaccggcgccccccccuccuccgccgagaacuggaaccuccccgaggaccgccccggcgccaccggcaccggcgacgucaucgccgccucccccgagacccccguccccucccccucccccgagcccccccucucccucgcccccggcaaggucgagggcgagcucgaggagcucgagcucgucgagucccccggccucgaggaggagcucgccgacauccuccagggccccucccuccgcuccaccgacgaggaggacgaggacgagcucauccucuga

SEQ ID NO: 41405 - RNA, 2646 nt, Artificial Sequence
  derived and/or modified sequence opt2 from CLCN2__Homo_sapiens__NP_001164558
auggccgccgccgccgccgaggagggcauggagccccgcgcccuccaguacgagcagacccucauguacggccgcuacacccaggaccucggcgccuucgccaaggaggaggccgcccgcauccgccucggcggccccgagcccuggaagggcccccccuccucccgcgccgcccccgagcuccucgaguacggccgcucccgcugcgcccgcugccgcgucugcuccguccgcugccacaaguuccucgucucccgcgucggcgaggacuggaucuuccucguccuccucggccuccucauggcccucgucuccugggucauggacuacgccaucgccgccugccuccaggcccagcaguggaugucccgcggccucaacaccuccauccuccuccaguaccucgccugggucaccuaccccgucguccucaucaccuucuccgccggcuucacccagauccucgccccccaggccgucggcuccggcauccccgagaugaagaccauccuccgcggcgucguccucaaggaguaccucacccucaagaccuucaucgccaaggucaucggccucaccugcgcccucggcuccggcaugccccucggcaaggagggccccuucguccacaucgccuccaugugcgccgcccuccucuccaaguuccucucccucuucggcggcaucuacgagaacgagucccgcaacaccgagaugcucgccgccgccugcgccgucggcgucggcugcugcuucgccgcccccaucggcggcguccucuucuccaucgaggucaccuccaccuucuucgccguccgcaacuacuggcgcggcuucuucgccgccaccuucuccgccuucaucuuccgcguccucgccgucuggaaccgcgacgaggagaccaucaccgcccucuucaagacccgcuuccgccucgacuuccccuucgaccuccaggagcuccccgccuucgccgucaucggcaucgccuccggcuucggcggcgcccucuucgucuaccucaaccgcaagaucguccaggucaugcgcaagcagaagaccaucaaccgcuuccucaugcgcaagcgccuccucuuccccgcccucgucacccuccucaucuccacccucaccuucccccccggcuucggccaguucauggccggccagcucucccagaaggagacccucgucacccucuucgacaaccgcaccuggguccgccagggccucgucgaggagcucgagccccccuccaccucccaggccuggaaccccccccgcgccaacgucuuccucacccucgucaucuucauccucaugaaguucuggauguccgcccucgccaccaccauccccguccccugcggcgccuucaugcccgucuucgucaucgacggcauccacaccgacuccuccaccuaccgcaucguccccggcggcuacgccgucgucggcgccgccgcccucgccggcgccgucacccacaccgucuccaccgccgucaucgucuucgagcucaccggccagaucgcccacauccuccccgucaugaucgccgucauccucgccaacgccgucgcccagucccuccagcccucccucuacgacuccaucauccgcaucaagaagcuccccuaccuccccgagcucggcuggggccgccaccagcaguaccgcguccgcgucgaggacaucaugguccgcgacgucccccacgucgcccucuccugcaccuuccgcgaccuccgccucgcccuccaccgcaccaagggccgcaugcucgcccucgucgagucccccgaguccaugauccuccucggcuccaucgagcgcucccaggucgucgcccuccucggcgcccagcucucccccgcccgccgccgccagcacaugcaggagcgccgcgccacccagaccuccccccucuccgaccaggagggcccccccacccccgaggccuccgucugcuuccaggucaacaccgaggacuccgccuuccccgccgcccgcggcgagacccacaagccccucaagcccgcccucaagcgcggccccuccgucacccgcaaccucggcgagucccccaccggcuccgccgaguccgccggcaucgcccuccgcucccucuucugcggcucccccccccccgaggccgccuccgagaagcucgaguccugcgagaagcgcaagcucaagcgcguccgcaucucccucgccuccgacgccgaccucgagggcgagaugucccccgaggagauccucgagugggaggagcagcagcucgacgagcccgucaacuucuccgacugcaagaucgaccccgcccccuuccagcucgucgagcgcaccucccuccacaagacccacaccaucuucucccuccucggcgucgaccacgccuacgucaccuccaucggccgccucaucggcaucgucacccucaaggagcuccgcaaggccaucgagggcuccgucaccgcccagggcgucaagguccgccccccccucgccuccuuccgcgacuccgccaccuccuccuccgacaccgagaccaccgagguccacgcccucuggggcccccacucccgccacggccucccccgcgagggcucccccuccgacuccgacgacaagugccaguga

SEQ ID NO: 41406 - RNA, 2376 nt, Artificial Sequence
  derived and/or modified sequence opt2 from CLCN3__Homo_sapiens__NP_001230301
auggaguccgagcagcucuuccaccgcggcuacuaccgcaacuccuacaacuccaucaccuccgccuccuccgacgaggagcuccucgacggcgccggcgucaucauggacuuccagaccuccgaggacgacaaccuccucgacggcgacaccgccgucggcacccacuacaccaugaccaacggcggcuccaucaacuccuccacccaccuccucgaccuccucgacgagcccauccccggcgucggcaccuacgacgacuuccacaccaucgacuggguccgcgagaagugcaaggaccgcgagcgccaccgccgcaucaacuccaagaagaaggaguccgccugggagaugaccaagucccucuacgacgccugguccggcuggcucgucgucacccucaccggccucgccuccggcgcccucgccggccucaucgacaucgccgccgacuggaugaccgaccucaaggagggcaucugccucuccgcccucugguacaaccacgagcagugcugcuggggcuccaacgagaccaccuucgaggagcgcgacaagugcccccaguggaagaccugggccgagcucaucaucggccaggccgagggccccggcuccuacaucaugaacuacaucauguacaucuucugggcccucuccuucgccuuccucgccgucucccucgucaaggucuucgcccccuacgccugcggcuccggcauccccgagaucaagaccauccucuccggcuucaucauccgcggcuaccucggcaaguggacccucaugaucaagaccaucacccucguccucgccgucgccuccggccucucccucggcaaggagggcccccucguccacgucgccugcugcugcggcaacaucuucuccuaccucuuccccaaguacuccaccaacgaggccaagaagcgcgaggucuccuacuacuucccccucaagacccucuggcgcuccuucuucgccgcccucgucgccgccuucguccuccgcuccaucaaccccuucggcaacucccgccucguccucuucuacgucgaguaccacacccccugguaccucuucgagcucuuccccuucauccuccucggcgucuucggcggccucuggggcgccuucuucauccgcgccaacaucgccuggugccgccgccgcaaguccaccaaguucggcaaguaccccguccucgaggucaucaucgucgccgccaucaccgccgucaucgccuuccccaaccccuacacccgccucaacaccuccgagcucaucaaggagcucuucaccgacugcggcccccucgaguccuccucccucugcgacuaccgcaacgacaugaacgccuccaagaucgucgacgacauccccgaccgccccgccggcaucggcgucuacuccgccaucuggcagcucugccucgcccucaucuucaagaucaucaugaccgucuucaccuucggcaucaagguccccuccggccucuucauccccuccauggccaucggcgccaucgccggccgcaucgucggcaucgccgucgagcagcucgccuacuaccaccacgacugguucaucuucaaggaguggugcgaggucggcgccgacugcaucacccccggccucuacgccauggucggcgccgccgccugccucggcggcgucacccgcaugaccgucucccucgucgucaucgucuucgagcucaccggcggccucgaguacaucgucccccucauggccgccgucaugaccuccaagugggucggcgacgccuucggccgcgagggcaucuacgaggcccacauccgccucaacggcuaccccuuccucgacgccaaggaggaguucacccacaccacccucgccgccgacgucaugcgcccccgccgcaacgaccccccccucgccguccucacccaggacaacaugaccgucgacgacaucgagaacaugaucaacgagaccuccuacaacggcuuccccgucaucauguccaaggagucccagcgccucgucggcuucgcccuccgccgcgaccucaccaucgccaucgaguccgcccgcaagaagcaggagggcaucgucggcuccucccgcgucugcuucgcccagcacacccccucccuccccgccgaguccccccgcccccucaagcuccgcuccauccucgacaugucccccuucaccgucaccgaccacacccccauggagaucgucgucgacaucuuccgcaagcucggccuccgccagugccucgucacccacaacggccgccuccucggcaucaucaccaagaaggacauccuccgccacauggcccagaccgccaaccaggaccccgccuccaucauguucaacuga

SEQ ID NO: 41407 - RNA, 2001 nt, Artificial Sequence
  derived and/or modified sequence opt2 from CLCN4__Homo_sapiens__NP_001243873
augaccgaccucaaggagggcgucugccucuccgccuucugguacucccacgagcagugcugcuggaccuccaacgagaccaccuucgaggaccgcgacaagugcccccucuggcagaagugguccgagcuccucgucaaccaguccgagggcgccuccgccuacauccucaacuaccucauguacauccucugggcccuccucuucgccuuccucgccgucucccucguccgcgucuucgcccccuacgccugcggcuccggcauccccgagaucaagaccauccucuccggcuucaucauccgcggcuaccucggcaaguggacccuccucaucaagaccgucacccucguccucgucgucuccuccggccucucccucggcaaggagggcccccucguccacgucgccugcugcugcggcaacuucuucuccucccucuucuccaaguacuccaagaacgagggcaagcgccgcgagguccucuccgccgccgccgccgccggcgucuccgucgccuucggcgcccccaucggcggcguccucuucucccucgaggaggucuccuacuacuucccccucaagacccucuggcgcuccuucuucgccgcccucgucgccgccuucacccuccgcuccaucaaccccuucggcaacucccgccucguccucuucuacgucgaguaccacacccccugguacauggccgagcucuuccccuucauccuccucggcgucuucggcggccucuggggcacccucuucauccgcugcaacaucgccuggugccgccgccgcaagaccacccgccucggcaaguaccccguccucgaggucaucgucgucaccgccaucaccgccaucaucgccuaccccaaccccuacacccgccaguccaccuccgagcucaucuccgagcucuucaacgacugcggcgcccucgaguccucccagcucugcgacuacaucaacgaccccaacaugacccgccccgucgacgacauccccgaccgccccgccggcgucggcgucuacaccgccauguggcagcucgcccucgcccucaucuucaagaucgucgucaccaucuucaccuucggcaugaagauccccuccggccucuucauccccuccauggccgucggcgccaucgccggccgcauggucggcaucggcgucgagcagcucgccuaccaccaccacgacuggaucaucuuccgcaacuggugccgccccggcgccgacugcgucacccccggccucuacgccauggucggcgccgccgccugccucggcggcgucacccgcaugaccgucucccucgucgucaucauguucgagcucaccggcggccucgaguacaucgucccccucauggccgccgccgucaccuccaagugggucgccgacgccuucggcaaggagggcaucuacgaggcccacauccaccucaacggcuaccccuuccucgacgucaaggacgaguucacccaccgcacccucgccaccgacgucaugcgcccccgccgcggcgagcccccccucuccguccucacccaggacuccaugaccgucgaggacgucgagacccucaucaaggagaccgacuacaacggcuuccccgucgucgucucccgcgacuccgagcgccucaucggcuucgcccagcgccgcgagcucauccucgccaucaagaacgcccgccagcgccaggagggcaucgucuccaacuccaucauguacuucaccgaggagccccccgagcuccccgccaacuccccccacccccucaagcuccgccgcauccucaaccucucccccuucaccgucaccgaccacacccccauggagaccgucgucgacaucuuccgcaagcucggccuccgccagugccucgucacccgcuccggccgccuccucggcaucaucaccaagaaggacguccuccgccacauggcccagauggccaaccaggaccccgaguccaucauguucaacuga

SEQ ID NO: 41408 - RNA, 2451 nt, Artificial Sequence
  derived and/or modified sequence opt2 from CLCN5__Homo_sapiens__NP_001121370
auggccauguggcagggcgccauggacaaccgcggcuuccagcagggcuccuucuccuccuuccagaacuccuccuccgacgaggaccucauggacauccccgccaccgccauggacuucuccaugcgcgacgacguccccccccucgaccgcgaggucggcgaggacaaguccuacaacggcggcggcaucggcuccuccaaccgcaucauggacuuccucgaggagcccauccccggcgucggcaccuacgacgacuucaacaccaucgacuggguccgcgagaagucccgcgaccgcgaccgccaccgcgagaucaccaacaaguccaaggaguccaccugggcccucauccacuccgucuccgacgccuucuccggcuggcuccucaugcuccucaucggccuccucuccggcucccucgccggccucaucgacaucuccgcccacuggaugaccgaccucaaggagggcaucugcaccggcggcuucugguucaaccacgagcacugcugcuggaacuccgagcacgucaccuucgaggagcgcgacaagugccccgaguggaacuccuggucccagcucaucaucuccaccgacgagggcgccuucgccuacaucgucaacuacuucauguacguccucugggcccuccucuucgccuuccucgccgucucccucgucaaggucuucgcccccuacgccugcggcuccggcauccccgagaucaagaccauccucuccggcuucaucauccgcggcuaccucggcaaguggacccucgucaucaagaccaucacccucguccucgccgucuccuccggccucucccucggcaaggagggcccccucguccacgucgccugcugcugcggcaacauccucugccacugcuucaacaaguaccgcaagaacgaggccaagcgccgcgagguccucuccgccgccgccgccgccggcgucuccgucgccuucggcgcccccaucggcggcguccucuucucccucgaggaggucuccuacuacuucccccucaagacccucuggcgcuccuucuucgccgcccucgucgccgccuucacccuccgcuccaucaaccccuucggcaacucccgccucguccucuucuacgucgaguuccacacccccuggcaccucuucgagcucguccccuucauccuccucggcaucuucggcggccucuggggcgcccucuucauccgcaccaacaucgccuggugccgcaagcgcaagaccacccagcucggcaaguaccccgucaucgagguccucgucgucaccgccaucaccgccauccucgccuuccccaacgaguacacccgcauguccaccuccgagcucaucuccgagcucuucaacgacugcggccuccucgacuccuccaagcucugcgacuacgagaaccgcuucaacaccuccaagggcggcgagcuccccgaccgccccgccggcgucggcgucuacuccgccauguggcagcucgcccucacccucauccucaagaucgucaucaccaucuucaccuucggcaugaagauccccuccggccucuucauccccuccauggccgucggcgccaucgccggccgccuccucggcgucggcauggagcagcucgccuacuaccaccaggaguggaccgucuucaacuccuggugcucccagggcgccgacugcaucacccccggccucuacgccauggucggcgccgccgccugccucggcggcgucacccgcaugaccgucucccucgucgucaucauguucgagcucaccggcggccucgaguacaucgucccccucauggccgccgccaugaccuccaagugggucgccgacgcccucggccgcgagggcaucuacgacgcccacauccgccucaacggcuaccccuuccucgaggccaaggaggaguucgcccacaagacccucgccauggacgucaugaagccccgccgcaacgacccccuccucaccguccucacccaggacuccaugaccgucgaggacgucgagaccaucaucuccgagaccaccuacuccggcuuccccgucgucgucucccgcgagucccagcgccucgucggcuucguccuccgccgcgaccucaucaucuccaucgagaacgcccgcaagaagcaggacggcgucgucuccaccuccaucaucuacuucaccgagcacucccccccccucccccccuacaccccccccacccucaagcuccgcaacauccucgaccucucccccuucaccgucaccgaccucacccccauggagaucgucgucgacaucuuccgcaagcucggccuccgccagugccucgucacccacaacggccgccuccucggcaucaucaccaagaaggacguccucaagcacaucgcccagauggccaaccaggaccccgacuccauccucuucaacuga

SEQ ID NO: 41409 - RNA, 2610 nt, Artificial Sequence
  derived and/or modified sequence opt2 from CLCN6__Homo_sapiens__NP_001277
auggccggcugccgcggcucccucugcugcugcugccgcuggugcugcugcugcggcgagcgcgagacccgcacccccgaggagcucaccauccucggcgagacccaggaggaggaggacgagauccucccccgcaaggacuacgagucccucgacuacgaccgcugcaucaacgaccccuaccucgagguccucgagaccauggacaacaagaagggccgccgcuacgaggccgucaaguggauggucgucuucgccaucggcgucugcaccggccucgucggccucuucgucgacuucuucguccgccucuucacccagcucaaguucggcgucguccagaccuccgucgaggagugcucccagaagggcugccucgcccucucccuccucgagcuccucggcuucaaccucaccuucgucuuccucgccucccuccucguccucaucgagcccgucgccgccggcuccggcauccccgaggucaagugcuaccucaacggcgucaagguccccggcaucguccgccuccgcacccuccucugcaagguccucggcguccucuucuccgucgccggcggccucuucgucggcaaggagggccccaugauccacuccggcuccgucgucggcgccggccucccccaguuccaguccaucucccuccgcaagauccaguucaacuuccccuacuuccgcuccgaccgcgacaagcgcgacuucgucuccgccggcgccgccgccggcgucgccgccgccuucggcgcccccaucggcggcacccucuucucccucgaggagggcuccuccuucuggaaccagggccucaccuggaagguccucuucugcuccauguccgccaccuucacccucaacuucuuccgcuccggcauccaguucggcuccuggggcuccuuccagcuccccggccuccucaacuucggcgaguucaagugcuccgacuccgacaagaagugccaccucuggaccgccauggaccucggcuucuucgucgucaugggcgucaucggcggccuccucggcgccaccuucaacugccucaacaagcgccucgccaaguaccgcaugcgcaacguccaccccaagcccaagcucguccgcguccucgagucccuccucgucucccucgucaccaccgucgucgucuucgucgccuccaugguccucggcgagugccgccagauguccuccuccucccagaucggcaacgacuccuuccagcuccaggucaccgaggacgucaacuccuccaucaagaccuucuucugccccaacgacaccuacaacgacauggccacccucuucuucaacccccaggaguccgccauccuccagcucuuccaccaggacggcaccuucucccccgucacccucgcccucuucuucguccucuacuuccuccucgccugcuggaccuacggcaucuccguccccuccggccucuucguccccucccuccucugcggcgccgccuucggccgccucgucgccaacguccucaaguccuacaucggccucggccacaucuacuccggcaccuucgcccucaucggcgccgccgccuuccucggcggcgucguccgcaugaccaucucccucaccgucauccucaucgaguccaccaacgagaucaccuacggccuccccaucauggucacccucauggucgccaaguggaccggcgacuucuucaacaagggcaucuacgacauccacgucggccuccgcggcgucccccuccucgagugggagaccgaggucgagauggacaagcuccgcgccuccgacaucauggagcccaaccucaccuacgucuacccccacacccgcauccagucccucgucuccauccuccgcaccaccguccaccacgccuuccccgucgucaccgagaaccgcggcaacgagaaggaguucaugaagggcaaccagcucaucuccaacaacaucaaguucaagaaguccuccauccucacccgcgccggcgagcagcgcaagcgcucccaguccaugaaguccuaccccuccuccgagcuccgcaacaugugcgacgagcacaucgccuccgaggagcccgccgagaaggaggaccuccuccagcagaugcucgagcgccgcuacacccccuaccccaaccucuaccccgaccagucccccuccgaggacuggaccauggaggagcgcuuccgcccccucaccuuccacggccucauccuccgcucccagcucgucacccuccucguccgcggcgucugcuacuccgagucccaguccuccgccucccagccccgccucuccuacgccgagauggccgaggacuacccccgcuaccccgacauccacgaccucgaccucacccuccucaacccccgcaugaucgucgacgucacccccuacaugaaccccucccccuucaccgucucccccaacacccacgucucccaggucuucaaccucuuccgcaccaugggccuccgccaccuccccgucgucaacgccgucggcgagaucgucggcaucaucacccgccacaaccucaccuacgaguuccuccaggcccgccuccgccagcacuaccagaccaucuga

SEQ ID NO: 41410 - RNA, 2346 nt, Artificial Sequence
  derived and/or modified sequence opt2 from CLCN7__Homo_sapiens__NP_001107803
auggccaacgucuccaagaaggucuccugguccggccgcgaccgcgacgacgaggaggccgccccccuccuccgccgcaccgcccgccccggcggcggcaccccccuccucaacggcgccggccccggcgccgcccgccaggacauggaccccccccaccccuuccccaaggagaucccccacaacgagaagcuccucucccucaaguacgagucccucgacuacgacaacuccgagaaccagcucuuccucgaggaggagcgccgcaucaaccacaccgccuuccgcaccgucgagaucaagcgcugggucaucugcgcccucaucggcauccucaccggccucgucgccugcuucaucgacaucgucgucgagaaccucgccggccucaaguaccgcgucaucaagggcaacaucgacaaguucaccgagaagggcggccucuccuucucccuccuccucugggccacccucaacgccgccuucguccucgucggcuccgucaucgucgccuucaucgagcccgucgccgccggcuccggcaucccccagaucaagugcuuccucaacggcgucaagaucccccacgucguccgccucaagacccucgucaucaaggucuccggcgucauccucuccgucgucggcggccucgccgucggcaaggagggccccaugauccacuccggcuccgucaucgccgccggcaucucccagggccgcuccaccucccucaagcgcgacuucaagaucuucgaguacuuccgccgcgacaccgagaagcgcgacuucgucuccgccggcgccgccgccggcgucuccgccgccuucggcgcccccgucggcggcguccucuucucccucgaggagggcgccuccuucuggaaccaguuccucaccuggcgcaucuucuucgccuccaugaucuccaccuucacccucaacuucguccucuccaucuaccacggcaacaugugggaccucuccucccccggccucaucaacuucggccgcuucgacuccgagaagauggccuacaccauccacgagauccccgucuucaucgccaugggcgucgucggcggcguccucggcgccgucuucaacgcccucaacuacuggcucaccauguuccgcauccgcuacauccaccgccccugccuccaggucaucgaggccguccucgucgccgccgucaccgccaccgucgccuucguccucaucuacuccucccgcgacugccagccccuccagggcggcuccauguccuacccccuccagcucuucugcgccgacggcgaguacaacuccauggccgccgccuucuucaacacccccgagaaguccgucgucucccucuuccacgacccccccggcuccuacaacccccucacccucggccucuucacccucgucuacuucuuccucgccugcuggaccuacggccucaccgucuccgccggcgucuucauccccucccuccucaucggcgccgccuggggccgccucuucggcaucucccucuccuaccucaccggcgccgccaucugggccgaccccggcaaguacgcccucaugggcgccgccgcccagcucggcggcaucguccgcaugacccucucccucaccgucaucaugauggaggccaccuccaacgucaccuacggcuuccccaucaugcucguccucaugaccgccaagaucgucggcgacgucuucaucgagggccucuacgacaugcacauccagcuccaguccguccccuuccuccacugggaggcccccgucaccucccacucccucaccgcccgcgaggucauguccacccccgucaccugccuccgccgccgcgagaaggucggcgucaucgucgacguccucuccgacaccgccuccaaccacaacggcuuccccgucgucgagcacgccgacgacacccagcccgcccgccuccagggccucauccuccgcucccagcucaucguccuccucaagcacaaggucuucgucgagcgcuccaaccucggccucguccagcgccgccuccgccucaaggacuuccgcgacgccuacccccgcuucccccccauccaguccauccacgucucccaggacgagcgcgagugcaccauggaccucuccgaguucaugaaccccucccccuacaccgucccccaggaggccucccucccccgcgucuucaagcucuuccgcgcccucggccuccgccaccucgucgucgucgacaaccgcaaccaggucgucggccucgucacccgcaaggaccucgcccgcuaccgccucggcaagcgcggccucgaggagcucucccucgcccagaccuga

SEQ ID NO: 41411 - RNA, 1905 nt, Artificial Sequence
  derived and/or modified sequence opt2 from CLCNKB__Homo_sapiens__XP_011538921
augacccucggcguccucauggcccucgucuccugcgccauggaccucgccgucgaguccgucguccgcgcccaccaguggcucuaccgcgagaucggcgacucccaccuccuccgcuaccucuccuggaccgucuaccccgucgcccucgucuccuucuccuccggcuucucccaguccaucacccccuccuccggcggcuccggcauccccgaggucaagaccaugcucgccggcgucguccucgaggacuaccucgacaucaagaacuucggcgccaaggucgucggccucuccugcacccucgccugcggcuccacccucuuccucggcaaggucggccccuucguccaccucuccgucaugauggccgccuaccucggccgcguccgcaccaccaccaucggcgagcccgagaacaaguccaagcagaacgagaugcucgucgccgccgccgccgucggcgucgccaccgucuucgccgcccccuucuccggcguccucuucuccaucgaggucauguccucccacuucuccgucugggacuacuggcgcggcuucuucgccgccaccugcggcgccuucauguuccgccuccucgccgucuucaacuccgagcaggagaccaucaccucccucuacaagaccuccuuccgcgucgacguccccuucgaccuccccgagaucuucuucuucgucgcccucggcggccucugcggcauccucggcuccgccuaccucuucugccagcgcaucuucuucggcuucauccgcaacaaccgcuucuccuccaagcuccucgccaccuccaagcccgucuacuccgcccucgccacccucguccucgccuccaucaccuacccccccuccgccggccgcuuccucgccucccgccucuccaugaagcagcaccucgacucccucuucgacaaccacuccugggcccucaugacccagaacuccuccccccccuggcccgaggagcucgacccccagcaccucuggugggagugguaccacccccgcuucaccaucuucggcacccucgccuucuuccucgucaugaaguucuggaugcucauccucgccaccaccauccccaugcccgccggcuacuucaugcccaucuucgucuacggcgccgccaucggccgccucuucggcgagacccucuccuucaucuuccccgagggcaucgucgccggcggcaucaccaaccccaucaugcccggcggcuacgcccucgccggcgccgccgccuucuccggcgccgucacccacaccaucuccaccgcccuccucgccuucgaggucaccggccagaucguccacgcccuccccguccucauggccguccucgccgccaacgccaucgcccaguccugccagcccuccuucuacgacggcaccgucaucgucaagaagcuccccuaccucccccgcauccucggccgcaacaucggcucccaccgcguccgcgucgagcacuucaugaaccacuccaucaccacccucgccaaggacaugccccucgaggaggucgucaaggucgucaccuccaccgacgucgccaaguacccccucgucgaguccaccgagucccagauccucgucggcaucguccgccgcgcccagcucguccaggcccucaaggccgagccccccuccugggcccccggccaccagcagugccuccaggacauccucgccgccggcugccccaccgagcccgucacccucaagcucucccccgagaccucccuccacgaggcccacaaccucuucgagcuccucaaccuccacucccucuucgucaccucccgcggccgcgccgucggcugcgucuccugggucgagaugaagaaggccaucuccaaccucaccaacccccccgcccccaaguga

SEQ ID NO: 41412 - RNA, 624 nt, Artificial Sequence
  derived and/or modified sequence opt2 from CLDN10__Homo_sapiens__NP_001153572
augucccgcgcccagaucugggcccucgucuccggcgucggcggcuucggcgcccucgucgccgccaccaccuccaacgaguggaaggucaccacccgcgccuccuccgucaucaccgccaccugggucuaccagggccucuggaugaacugcgccggcuacauccaggccugccgcggccucaugaucgccgccgucucccucggcuucuucggcuccaucuucgcccucuucggcaugaagugcaccaaggucggcggcuccgacaaggccaaggccaagaucgccugccucgccggcaucgucuucauccucuccggccucugcuccaugaccggcugcucccucuacgccaacaagaucaccaccgaguucuucgacccccucuucgucgagcagaaguacgagcucggcgccgcccucuucaucggcugggccggcgccucccucugcaucaucggcggcgucaucuucugcuucuccaucuccgacaacaacaagaccccccgcuacaccuacaacggcgccaccuccgucauguccucccgcaccaaguaccacggcggcgaggacuucaagaccaccaaccccuccaagcaguucgacaagaacgccuacgucuga

SEQ ID NO: 41413 - RNA, 624 nt, Artificial Sequence
  derived and/or modified sequence opt2 from CLDN11__Homo_sapiens__NP_005593
auggucgccaccugccuccaggucgucggcuucgucaccuccuucgucggcuggaucggcgucaucgucaccaccuccaccaacgacugggucgucaccugcggcuacaccauccccaccugccgcaagcucgacgagcucggcuccaagggccucugggccgacugcgucauggccaccggccucuaccacugcaagccccucgucgacauccucauccuccccggcuacguccaggccugccgcgcccucaugaucgccgccuccguccucggccuccccgccauccuccuccuccucaccguccuccccugcauccgcaugggccaggagcccggcgucgccaaguaccgccgcgcccagcucgccggcguccuccucauccuccucgcccucugcgcccucgucgccaccaucugguuccccgucugcgcccaccgcgagaccaccaucgucuccuucggcuacucccucuacgccggcuggaucggcgccguccucugccucgucggcggcugcgucauccucugcugcgccggcgacgcccaggccuucggcgagaaccgcuucuacuacaccgccggcuccuccucccccacccacgccaaguccgcccacgucuga

SEQ ID NO: 41414 - RNA, 720 nt, Artificial Sequence
  derived and/or modified sequence opt2 from CLDN14__Homo_sapiens__NP_036262
auggccuccaccgccguccagcuccucggcuuccuccucuccuuccucggcauggucggcacccucaucaccaccauccucccccacuggcgccgcaccgcccacgucggcaccaacauccucaccgccgucuccuaccucaagggccucuggauggagugcgucuggcacuccaccggcaucuaccagugccagaucuaccgcucccuccucgcccucccccaggaccuccaggccgcccgcgcccucauggucaucuccugccuccucuccggcaucgccugcgccugcgccgucaucggcaugaagugcacccgcugcgccaagggcacccccgccaagaccaccuucgccauccucggcggcacccucuucauccucgccggccuccucugcauggucgccgucuccuggaccaccaacgacgucguccagaacuucuacaacccccuccuccccuccggcaugaaguucgagaucggccaggcccucuaccucggcuucaucuccuccucccucucccucaucggcggcacccuccucugccucuccugccaggacgaggcccccuaccgccccuaccaggcccccccccgcgccaccaccaccaccgccaacaccgcccccgccuaccagccccccgccgccuacaaggacaaccgcgcccccuccgucaccuccgccacccacuccggcuaccgccucaacgacuacgucuga

SEQ ID NO: 41415 - RNA, 687 nt, Artificial Sequence
  derived and/or modified sequence opt2 from CLDN15__Homo_sapiens__NP_001172009
auguccauggccgucgagaccuucggcuucuucauggccaccgucggccuccucaugcucggcgucacccuccccaacuccuacuggcgcgucuccaccguccacggcaacgucaucaccaccaacaccaucuucgagaaccucugguucuccugcgccaccgacucccucggcgucuacaacugcugggaguuccccuccaugcucgcccucuccggcuacauccaggccugccgcgcccucaugaucaccgccauccuccucggcuuccucggccuccuccucggcaucgccggccuccgcugcaccaacaucggcggccucgagcucucccgcaaggccaagcucgccgccaccgccggcgcccuccacauccucgccggcaucugcggcauggucgccaucuccugguacgccuucaacaucacccgcgacuucuucgacccccucuaccccggcaccaaguacgagcucggccccgcccucuaccucggcugguccgccucccucaucuccauccucggcggccucugccucugcuccgccugcugcugcggcuccgacgaggaccccgccgccuccgcccgccgccccuaccaggcccccgucuccgucaugcccgucgccaccuccgaccaggagggcgacuccuccuucggcaaguacggccgcaacgccuacgucuga

SEQ ID NO: 41416 - RNA, 918 nt, Artificial Sequence
  derived and/or modified sequence opt2 from CLDN16__Homo_sapiens__NP_006571
augaccucccgcaccccccuccucgucaccgccugccucuacuacuccuacugcaacucccgccaccuccagcagggcguccgcaaguccaagcgccccgucuucucccacugccagguccccgagacccagaagaccgacacccgccaccucuccggcgcccgcgccggcgucugccccugcugccaccccgacggccuccucgccaccaugcgcgaccuccuccaguacaucgccugcuucuucgccuucuucuccgccggcuuccucaucgucgccaccuggaccgacugcuggauggucaacgccgacgacucccucgaggucuccaccaagugccgcggccucuggugggagugcgucaccaacgccuucgacggcauccgcaccugcgacgaguacgacuccauccucgccgagcacccccucaagcucgucgucacccgcgcccucaugaucaccgccgacauccucgccggcuucggcuuccucacccuccuccucggccucgacugcgucaaguuccuccccgacgagcccuacaucaagguccgcaucugcuucgucgccggcgccacccuccucaucgccggcacccccggcaucaucggcuccgucugguacgccgucgacgucuacgucgagcgcuccacccucguccuccacaacaucuuccucggcauccaguacaaguucggcugguccugcuggcucggcauggccggcucccucggcugcuuccucgccggcgccguccucaccugcugccucuaccucuucaaggacgucggccccgagcgcaacuaccccuacucccuccgcaaggccuacuccgccgccggcgucuccauggccaaguccuacuccgccccccgcaccgagaccgccaagauguacgccgucgacacccgcgucuga

SEQ ID NO: 41417 - RNA, 786 nt, Artificial Sequence
  derived and/or modified sequence opt2 from CLDN18__Homo_sapiens__NP_001002026
auggccgucaccgccugccagggccucggcuucgucgucucccucaucggcaucgccggcaucaucgccgccaccugcauggaccagugguccacccaggaccucuacaacaaccccgucaccgccgucuucaacuaccagggccucuggcgcuccugcguccgcgaguccuccggcuucaccgagugccgcggcuacuucacccuccucggccuccccgccaugcuccaggccguccgcgcccucaugaucgucggcaucguccucggcgccaucggccuccucgucuccaucuucgcccucaagugcauccgcaucggcuccauggaggacuccgccaaggccaacaugacccucaccuccggcaucauguucaucgucuccggccucugcgccaucgccggcgucuccgucuucgccaacaugcucgucaccaacuucuggauguccaccgccaacauguacaccggcaugggcggcaugguccagaccguccagacccgcuacaccuucggcgccgcccucuucgucggcugggucgccggcggccucacccucaucggcggcgucaugaugugcaucgccugccgcggccucgcccccgaggagaccaacuacaaggccgucuccuaccacgccuccggccacuccgucgccuacaagcccggcggcuucaaggccuccaccggcuucggcuccaacaccaagaacaagaagaucuacgacggcggcgcccgcaccgaggacgagguccaguccuaccccuccaagcacgacuacgucuga

SEQ ID NO: 41418 - RNA, 636 nt, Artificial Sequence
  derived and/or modified sequence opt2 from CLDN1__Homo_sapiens__NP_066924
auggccaacgccggccuccagcuccucggcuucauccucgccuuccucggcuggaucggcgccaucgucuccaccgcccucccccaguggcgcaucuacuccuacgccggcgacaacaucgucaccgcccaggccauguacgagggccucuggauguccugcgucucccaguccaccggccagauccagugcaaggucuucgacucccuccucaaccucuccuccacccuccaggccacccgcgcccucauggucgucggcauccuccucggcgucaucgccaucuucgucgccaccgucggcaugaagugcaugaagugccucgaggacgacgagguccagaagaugcgcauggccgucaucggcggcgccaucuuccuccucgccggccucgccauccucgucgccaccgccugguacggcaaccgcaucguccaggaguucuacgaccccaugacccccgucaacgcccgcuacgaguucggccaggcccucuucaccggcugggccgccgccucccucugccuccucggcggcgcccuccucugcugcuccugcccccgcaagaccaccuccuaccccaccccccgccccuaccccaagcccgcccccuccuccggcaaggacuacgucuga

SEQ ID NO: 41419 - RNA, 879 nt, Artificial Sequence
  derived and/or modified sequence opt2 from CLDN23__Homo_sapiens__NP_919260
augcgcacccccgucgucaugacccucggcaugguccucgcccccugcggccuccuccucaaccucaccggcacccucgcccccggcuggcgccucgucaagggcuuccucaaccagcccgucgacgucgagcucuaccagggccucugggacaugugccgcgagcaguccucccgcgagcgcgagugcggccagaccgaccaguggggcuacuucgaggcccagcccguccucgucgcccgcgcccucauggucaccucccucgccgccaccguccucggccuccuccucgccucccucggcguccgcugcuggcaggacgagcccaacuucguccucgccggccucuccggcgucguccucuucgucgccggccuccucggccucauccccgucuccugguacaaccacuuccucggcgaccgcgacguccuccccgcccccgccucccccgucaccguccaggucuccuacucccucguccucggcuaccucggcuccugccuccuccuccucggcggcuucucccucgcccucuccuucgcccccuggugcgacgagcgcugccgccgccgccgcaagggccccuccgccggcccccgccgcuccuccgucuccaccauccaggucgaguggcccgagcccgaccucgcccccgccaucaaguacuacuccgacggccagcaccgccccccccccgcccagcaccgcaagcccaagcccaagcccaaggucggcuuccccaugccccgcccccgccccaaggccuacaccaacuccgucgacguccucgacggcgagggcugggagucccaggacgcccccuccugcuccacccaccccugcgacuccucccuccccugcgacuccgaccucuga

SEQ ID NO: 41420 - RNA, 693 nt, Artificial Sequence
  derived and/or modified sequence opt2 from CLDN2__Homo_sapiens__NP_001164566
auggccucccucggccuccagcucgucggcuacauccucggccuccucggccuccucggcacccucgucgccaugcuccuccccuccuggaagaccuccuccuacgucggcgccuccaucgucaccgccgucggcuucuccaagggccucuggauggagugcgccacccacuccaccggcaucacccagugcgacaucuacuccacccuccucggccuccccgccgacauccaggccgcccaggccaugauggucaccuccuccgccaucuccucccucgccugcaucaucuccgucgucggcaugcgcugcaccgucuucugccaggagucccgcgccaaggaccgcgucgccgucgccggcggcgucuucuucauccucggcggccuccucggcuucauccccgucgccuggaaccuccacggcauccuccgcgacuucuacuccccccucguccccgacuccaugaaguucgagaucggcgaggcccucuaccucggcaucaucuccucccucuucucccucaucgccggcaucauccucugcuucuccugcuccucccagcgcaaccgcuccaacuacuacgacgccuaccaggcccagccccucgccacccgcuccuccccccgccccggccagccccccaaggucaaguccgaguucaacuccuacucccucaccggcuacgucuga

SEQ ID NO: 41421 - RNA, 912 nt, Artificial Sequence
  derived and/or modified sequence opt2 from CLDN5__Homo_sapiens__NP_001124333
augacccgcgcccgcaucggcugcuucggccccggcggccgcgcccgcggcaccgaguccgcccccgagcccuccaagcgcgucccccccggccgcuccuggcagacccaggagguccgccagacccgcggcgccaacggccucggcccccgcgccggcuccgccggcgccaaggcccccggccccgcccagggcgccgcccagcacggccucggcggcuccgccggccuccgcguccgcgucuccccccucgccaugggcuccgccgcccucgagauccucggccucguccucugccucgucggcuggggcggccucauccucgccugcggccuccccauguggcaggucaccgccuuccucgaccacaacaucgucaccgcccagaccaccuggaagggccucuggauguccugcgucguccaguccaccggccacaugcagugcaaggucuacgacuccguccucgcccucuccaccgagguccaggccgcccgcgcccucaccgucuccgccguccuccucgccuucgucgcccucuucgucacccucgccggcgcccagugcaccaccugcgucgcccccggccccgccaaggcccgcgucgcccucaccggcggcguccucuaccucuucugcggccuccucgcccucgucccccucugcugguucgccaacaucgucguccgcgaguucuacgaccccuccguccccgucucccagaaguacgagcucggcgccgcccucuacaucggcugggccgccaccgcccuccucauggucggcggcugccuccucugcugcggcgccugggucugcaccggccgccccgaccucuccuuccccgucaaguacuccgccccccgccgccccaccgccaccggcgacuacgacaagaagaacuacgucuga

SEQ ID NO: 41422 - RNA, 663 nt, Artificial Sequence
  derived and/or modified sequence opt2 from CLDN6__Homo_sapiens__NP_067018
auggccuccgccggcaugcagauccucggcgucguccucacccuccucggcugggucaacggccucgucuccugcgcccuccccauguggaaggucaccgccuucaucggcaacuccaucgucgucgcccaggucgucugggagggccucuggauguccugcgucguccaguccaccggccagaugcagugcaaggucuacgacucccuccucgcccucccccaggaccuccaggccgcccgcgcccucugcgucaucgcccuccucgucgcccucuucggccuccucgucuaccucgccggcgccaagugcaccaccugcgucgaggagaaggacuccaaggcccgccucguccucaccuccggcaucgucuucgucaucuccggcguccucacccucauccccgucugcuggaccgcccacgccaucauccgcgacuucuacaacccccucgucgccgaggcccagaagcgcgagcucggcgccucccucuaccucggcugggccgccuccggccuccuccuccucggcggcggccuccucugcugcaccugccccuccggcggcucccagggccccucccacuacauggcccgcuacuccaccuccgcccccgccaucucccgcggccccuccgaguaccccaccaagaacuacgucuga

SEQ ID NO: 41423 - RNA, 438 nt, Artificial Sequence
  derived and/or modified sequence opt2 from CLDN7__Homo_sapiens__NP_001171952
auggccaacuccggccuccagcuccucggcuucuccauggcccuccucggcugggucggccucgucgccugcaccgccaucccccaguggcagauguccuccuacgccggcgacaacaucaucaccgcccaggccauguacaagggccucuggauggacugcgucacccaguccaccggcaugauguccugcaagauguacgacuccguccucgcccucuccgccgcccuccaggccacccgcgcccucauggucgucucccucguccucggcuuccucgccauguucgucgccaccaugggcaugaagugcacccgcugcggcggcgacgacaaggucaagaaggcccgcaucgccaugggcggcggcaucaucuucaucgucgccggcaugucccucgcccuccccucccuccucgccggccagggccuccccuga

SEQ ID NO: 41424 - RNA, 678 nt, Artificial Sequence
  derived and/or modified sequence opt2 from CLDN8__Homo_sapiens__NP_955360
auggccacccacgcccucgagaucgccggccucuuccucggcggcgucggcauggucggcaccgucgccgucaccgucaugccccaguggcgcgucuccgccuucaucgagaacaacaucgucgucuucgagaacuucugggagggccucuggaugaacugcguccgccaggccaacauccgcaugcagugcaagaucuacgacucccuccucgcccucucccccgaccuccaggccgcccgcggccucaugugcgccgccuccgucauguccuuccucgccuucaugauggccauccucggcaugaagugcacccgcugcaccggcgacaacgagaaggucaaggcccacauccuccucaccgccggcaucaucuucaucaucaccggcauggucguccucauccccgucuccugggucgccaacgccaucauccgcgacuucuacaacuccaucgucaacgucgcccagaagcgcgagcucggcgaggcccucuaccucggcuggaccaccgcccucguccucaucgucggcggcgcccucuucugcugcgucuucugcugcaacgagaaguccuccuccuaccgcuacuccauccccucccaccgcaccacccagaaguccuaccacaccggcaagaagucccccuccgucuacucccgcucccaguacgucuga

SEQ ID NO: 41425 - RNA, 654 nt, Artificial Sequence
  derived and/or modified sequence opt2 from CLDN9__Homo_sapiens__NP_066192
auggccuccaccggccucgagcuccucggcaugacccucgccguccucggcuggcucggcacccucgucuccugcgcccucccccucuggaaggucaccgccuucaucggcaacuccaucgucgucgcccaggucgucugggagggccucuggauguccugcgucguccaguccaccggccagaugcagugcaaggucuacgacucccuccucgcccucccccaggaccuccaggccgcccgcgcccucugcgucaucgcccuccuccucgcccuccucggccuccucgucgccaucaccggcgcccagugcaccaccugcgucgaggacgagggcgccaaggcccgcaucguccucaccgccggcgucauccuccuccucgccggcauccucguccucauccccgucugcuggaccgcccacgccaucauccaggacuucuacaacccccucgucgccgaggcccucaagcgcgagcucggcgccucccucuaccucggcugggccgccgccgcccuccucaugcucggcggcggccuccucugcugcaccugcccccccccccaggucgagcgcccccgcggcccccgccucggcuacuccauccccucccgcuccggcgccuccggccucgacaagcgcgacuacgucuga

SEQ ID NO: 41426 - RNA, 879 nt, Artificial Sequence
  derived and/or modified sequence opt2 from CLEC10A__Homo_sapiens__NP_006335
augacccgcaccuacgagaacuuccaguaccucgagaacaaggucaagguccagggcuucaagaacggcccccucccccuccagucccuccuccagcgccucugcuccggccccugccaccuccuccucucccucggccucggccuccuccuccucgucaucaucugcgucgucggcuuccagaacuccaaguuccagcgcgaccucgucacccuccgcaccgacuucuccaacuucaccuccaacaccgucgccgagauccaggcccucaccucccagggcuccucccucgaggagaccaucgccucccucaaggccgaggucgagggcuucaagcaggagcgccaggccguccacuccgagaugcuccuccgcguccagcagcucguccaggaccucaagaagcucaccugccaggucgccacccucaacaacaacggcgaggaggccuccaccgagggcaccugcugccccgucaacugggucgagcaccaggacuccugcuacugguucucccacuccggcauguccugggccgaggccgagaaguacugccagcucaagaacgcccaccucgucgucaucaacucccgcgaggagcagaacuucguccagaaguaccucggcuccgccuacaccuggaugggccucuccgaccccgagggcgccuggaagugggucgacggcaccgacuacgccaccggcuuccagaacuggaagcccggccagcccgacgacuggcagggccacggccucggcggcggcgaggacugcgcccacuuccaccccgacggccgcuggaacgacgacgucugccagcgccccuaccacugggucugcgaggccggccucggccagaccucccaggagucccacuga

SEQ ID NO: 41427 - RNA, 972 nt, Artificial Sequence
  derived and/or modified sequence opt2 from CLEC11A__Homo_sapiens__NP_002966
augcaggccgccuggcuccucggcgcccucgucgucccccagcuccucggcuucggccacggcgcccgcggcgccgagcgcgagugggagggcggcuggggcggcgcccaggaggaggagcgcgagcgcgaggcccucaugcucaagcaccuccaggaggcccucggccuccccgccggccgcggcgacgagaaccccgccggcaccgucgagggcaaggaggacugggagauggaggaggaccagggcgaggaggaggaggaggaggccacccccacccccuccuccggccccucccccucccccacccccgaggacaucgucaccuacauccucggccgccucgccggccucgacgccggccuccaccagcuccacguccgccuccacgcccucgacacccgcgucgucgagcucacccagggccuccgccagcuccgcaacgccgccggcgacacccgcgacgccguccaggcccuccaggaggcccagggccgcgccgagcgcgagcacggccgccucgagggcugccucaagggccuccgccucggccacaagugcuuccuccucucccgcgacuucgaggcccaggccgccgcccaggcccgcugcaccgcccgcggcggcucccucgcccagcccgccgaccgccagcagauggaggcccucacccgcuaccuccgcgccgcccucgcccccuacaacuggcccgucuggcucggcguccacgaccgccgcgccgagggccucuaccucuucgagaacggccagcgcgucuccuucuucgccuggcaccgcuccccccgccccgagcucggcgcccagcccuccgccuccccccacccccucucccccgaccagcccaacggcggcacccucgagaacugcgucgcccaggccuccgacgacggcuccuggugggaccacgacugccagcgccgccucuacuacgucugcgaguuccccuucuga

SEQ ID NO: 41428 - RNA, 828 nt, Artificial Sequence
  derived and/or modified sequence opt2 from CLEC12A__Homo_sapiens__NP_001193939
auguggaucgacuucuucaccuacuccuccauguccgaggaggucaccuacgccgaccuccaguuccagaacuccuccgagauggagaagauccccgagaucggcaaguucggcgagaaggccccccccgcccccucccacgucuggcgccccgccgcccucuuccucacccuccucugccuccuccuccucaucggccucggcguccucgccuccauguuccacgucacccucaagaucgagaugaagaagaugaacaagcuccagaacaucuccgaggagcuccagcgcaacaucucccuccagcucauguccaacaugaacaucuccaacaagauccgcaaccucuccaccacccuccagaccaucgccaccaagcucugccgcgagcucuacuccaaggagcaggagcacaagugcaagcccugcccccgccgcuggaucuggcacaaggacuccugcuacuuccucuccgacgacguccagaccuggcaggaguccaagauggccugcgccgcccagaacgccucccuccucaagaucaacaacaagaacgcccucgaguucaucaagucccagucccgcuccuacgacuacuggcucggccucucccccgaggaggacuccacccgcggcaugcgcgucgacaacaucaucaacuccuccgccugggucauccgcaacgcccccgaccucaacaacauguacugcggcuacaucaaccgccucuacguccaguacuaccacugcaccuacaagaagcgcaugaucugcgagaagauggccaaccccguccagcucggcuccaccuacuuccgcgaggccuga

SEQ ID NO: 41429 - RNA, 1473 nt, Artificial Sequence
  derived and/or modified sequence opt2 from CLEC14A__Homo_sapiens__NP_778230
augcgccccgccuucgcccucugccuccucuggcaggcccucuggcccggccccggcggcggcgagcaccccaccgccgaccgcgccggcugcuccgccuccggcgccugcuacucccuccaccacgccaccaugaagcgccaggccgccgaggaggccugcauccuccgcggcggcgcccucuccaccguccgcgccggcgccgagcuccgcgccguccucgcccuccuccgcgccggccccggccccggcggcggcuccaaggaccuccucuucugggucgcccucgagcgccgccgcucccacugcacccucgagaacgagccccuccgcggcuucuccuggcucuccuccgaccccggcggccucgaguccgacacccuccagugggucgaggagccccagcgcuccugcaccgcccgccgcugcgccguccuccaggccaccggcggcgucgagcccgccggcuggaaggagaugcgcugccaccuccgcgccaacggcuaccucugcaaguaccaguucgagguccucugccccgccccccgccccggcgccgccuccaaccucuccuaccgcgcccccuuccagcuccacuccgccgcccucgacuucuccccccccggcaccgaggucuccgcccucugccgcggccagcuccccaucuccgucaccugcaucgccgacgagaucggcgcccgcugggacaagcucuccggcgacguccucugccccugccccggccgcuaccuccgcgccggcaagugcgccgagcuccccaacugccucgacgaccucggcggcuucgccugcgagugcgccaccggcuucgagcucggcaaggacggccgcuccugcgucaccuccggcgagggccagcccacccucggcggcaccggcguccccacccgccgcccccccgccaccgccaccucccccgucccccagcgcaccuggcccauccgcgucgacgagaagcucggcgagaccccccucguccccgagcaggacaacuccgucaccuccauccccgagaucccccgcuggggcucccaguccaccauguccacccuccagaugucccuccaggccgaguccaaggccaccaucacccccuccggcuccgucaucuccaaguucaacuccaccaccuccuccgccaccccccaggccuucgacuccuccuccgccgucgucuucaucuucgucuccaccgccgucgucguccucgucauccucaccaugaccguccucggccucgucaagcucugcuuccacgagucccccuccucccagccccgcaaggaguccaugggcccccccggccucgaguccgaccccgagcccgccgcccucggcuccuccuccgcccacugcaccaacaacggcgucaaggucggcgacugcgaccuccgcgaccgcgccgagggcgcccuccucgccgaguccccccucggcuccuccgacgccuga

SEQ ID NO: 41430 - RNA, 2721 nt, Artificial Sequence
  derived and/or modified sequence opt2 from CLEC16A__Homo_sapiens__NP_001230332
auguucggccgcucccgcuccugggucggcggcggccacggcaagaccucccgcaacauccacucccucgaccaccucaaguaccucuaccacguccucaccaagaacaccaccgucaccgagcagaaccgcaaccuccucgucgagaccauccgcuccaucaccgagauccucaucuggggcgaccagaacgacuccuccgucuucgacuucuuccucgagaagaacauguucgucuucuuccucaacauccuccgccagaaguccggccgcuacgucugcguccagcuccuccagacccucaacauccucuucgagaacaucucccacgagaccucccucuacuaccuccucuccaacaacuacgucaacuccaucaucguccacaaguucgacuucuccgacgaggagaucauggccuacuacaucuccuuccucaagacccucucccucaagcucaacaaccacaccguccacuucuucuacaacgagcacaccaacgacuucgcccucuacaccgaggccaucaaguucuucaaccaccccgaguccaugguccgcaucgccguccgcaccaucacccucaacgucuacaaggucgacaaccaggccaugcuccacuacauccgcgacaagaccgccguccccuacuucuccaaccucgucugguucaucggcucccacgucaucgagcucgacgacugcguccagaccgacgaggagcaccgcaaccgcggcaagcucuccgaccucgucgccgagcaccucgaccaccuccacuaccucaacgacauccucaucaucaacugcgaguuccucaacgacguccucaccgaccaccuccucaaccgccucuuccucccccucuacgucuacucccucgagaaccaggacaagggcggcgagcgccccaagaucucccuccccgucucccucuaccuccucucccaggucuuccucaucauccaccacgccccccucgucaacucccucgccgaggucauccucaacggcgaccucuccgagauguacgccaagaccgagcaggacauccagcgcuccuccgccaagcccuccauccgcugcuucaucaagcccaccgagacccucgagcgcucccucgagaugaacaagcacaagggcaagcgccgcguccagaagcgccccaacuacaagaacgucggcgaggaggaggacgaggagaagggccccaccgaggacgcccaggaggacgccgagaaggccaaggagaucgagauggucaucauggagcgcuccaagcucuccgagcucgccgccuccaccuccguccaggagcagaacaccaccgacgaggagaaguccgccgccgccaccugcuccgaguccacccaguggucccgccccuuccucgacauggucuaccacgcccucgacucccccgacgacgacuaccacgcccucuucguccucugccuccucuacgccaugucccacaacaagggcauggaccccgagaagcucgagcgcauccagcuccccguccccaacgccgccgagaagaccaccuacaaccacccccucgccgagcgccucauccgcaucaugaacaacgccgcccagcccgacggcaagauccgccucgccacccucgagcucuccugccuccuccucaagcagcagguccucauguccgccggcugcaucaugaaggacguccaccucgccugccucgagggcgcccgcgaggaguccguccaccucguccgccacuucuacaagggcgaggacaucuuccucgacauguucgaggacgaguaccgcuccaugaccaugaagcccaugaacgucgaguaccucaugauggacgccuccauccuccucccccccaccggcaccccccucaccggcaucgacuucgucaagcgccuccccugcggcgacgucgagaagacccgccgcgccauccgcgucuucuucaugcuccgcucccucucccuccagcuccgcggcgagcccgagacccagcucccccucacccgcgaggaggaccucaucaagaccgacgacguccucgaccucaacaacuccgaccucaucgccugcaccgucaucaccaaggacggcggcaugguccagcgcuuccucgccgucgacaucuaccagaugucccucgucgagcccgacgucucccgccucggcuggggcgucgucaaguucgccggccuccuccaggacaugcaggucaccggcgucgaggacgacucccgcgcccucaacaucaccauccacaagcccgccuccuccccccacuccaagcccuuccccauccuccaggccaccuucaucuucuccgaccacauccgcugcaucaucgccaagcagcgccucgccaagggccgcauccaggcccgccgcaugaagaugcagcgcaucgccgcccuccucgaccuccccauccagcccaccaccgagguccucggcuucggccucggcuccuccaccuccacccagcaccuccccuuccgcuucuacgaccagggccgccgcggcuccuccgaccccaccguccagcgcuccgucuucgccuccgucgacaagguccccggcgagcccgccccccgccccgccccccagcucguccaccacggcggccgcucccgcuccuucucccucuggucccucugcgagcuccccuuccucucccagaagccccgccgccucgccgcccccgccuccuga

SEQ ID NO: 41431 - RNA, 591 nt, Artificial Sequence
  derived and/or modified sequence opt2 from CLEC1B__Homo_sapiens__NP_001092901
augcaggacgaggacggcuacaucacccucaacaucaagacccgcaagcccgcccucaucuccgccgucaugcagcgcaacuaccuccagggcgagaacgagaaccgcaccggcacccuccagcagcucgccaagcgcuucugccaguacgucgucaagcaguccgagcucaagggcaccuucaagggccacaagugcucccccugcgacaccaacuggcgcuacuacggcgacuccugcuacggcuucuuccgccacaaccucaccugggaggaguccaagcaguacugcaccgacaugaacgccacccuccucaagaucgacaaccgcaacaucgucgaguacaucaaggcccgcacccaccucauccgcugggucggccucucccgccagaaguccaacgaggucuggaagugggaggacggcuccgucaucuccgagaacauguucgaguuccucgaggacggcaagggcaacaugaacugcgccuacuuccacaacggcaagaugcaccccaccuucugcgagaacaagcacuaccucaugugcgagcgcaaggccggcaugaccaaggucgaccagcuccccuga

SEQ ID NO: 41432 - RNA, 525 nt, Artificial Sequence
  derived and/or modified sequence opt2 from CLEC2A__Homo_sapiens__NP_001124183
augaucaaccccgagcuccgcgacggccgcgccgacggcuucauccaccgcaucguccccaagcucauccagaacuggaagaucggccucaugugcuuccucuccaucaucaucaccaccgucugcaucaucaugaucgccaccugguccaagcacgccaagcccgucgccugcuccggcgacuggcucggcguccgcgacaagugcuucuacuucuccgacgacacccgcaacuggaccgccuccaagaucuucugcucccuccagaaggccgagcucgcccagaucgacacccaggaggacauggaguuccucaagcgcuacgccggcaccgacaugcacuggaucggccucucccgcaagcagggcgacuccuggaaguggaccaacggcaccaccuucaacggcugguucgagaucaucggcaacggcuccuucgccuuccucuccgccgacggcguccacuccucccgcggcuucaucgacaucaaguggaucugcuccaagcccaaguacuuccucuga

SEQ ID NO: 41433 - RNA, 450 nt, Artificial Sequence
  derived and/or modified sequence opt2 from CLEC2B__Homo_sapiens__NP_005118
augaugaccaagcacaagaagugcuucaucaucgucggcguccucaucaccaccaacaucaucacccucaucgucaagcucacccgcgacucccagucccucugccccuacgacuggaucggcuuccagaacaagugcuacuacuucuccaaggaggagggcgacuggaacuccuccaaguacaacugcuccacccagcacgccgaccucaccaucaucgacaacaucgaggagaugaacuuccuccgccgcuacaagugcuccuccgaccacuggaucggccucaagauggccaagaaccgcaccggccagugggucgacggcgccaccuucaccaaguccuucggcaugcgcggcuccgagggcugcgccuaccucuccgacgacggcgccgccaccgcccgcugcuacaccgagcgcaaguggaucugccgcaagcgcauccacuga

SEQ ID NO: 41434 - RNA, 585 nt, Artificial Sequence
  derived and/or modified sequence opt2 from CLEC2D__Homo_sapiens__NP_001004419
augcacgacuccaacaacgucgagaaggacaucacccccuccgagcuccccgccaaccccggcugccuccacuccaaggagcacuccaucaaggccacccucaucuggcgccucuucuuccucaucauguuccucaccaucaucgucugcggcauggucgccgcccucuccgccauccgcgccaacugccaccaggagcccuccgucugccuccaggccgccugccccgaguccuggaucggcuuccagcgcaagugcuucuacuucuccgacgacaccaagaacuggaccuccucccagcgcuucugcgacucccaggacgccgaccucgcccaggucgaguccuuccaggagcucaacuuccuccuccgcuacaagggccccuccgaccacuggaucggccucucccgcgagcagggccagcccuggaaguggaucaacggcaccgaguggacccgccagcucgucaugaaggaggacggcgccaaccucuacgucgccaaggucucccaggucccccgcaugaacccccgccccgucauggucuccuaccccggcucccgccgcgucugccucuucgaguga

SEQ ID NO: 41435 - RNA, 645 nt, Artificial Sequence
  derived and/or modified sequence opt2 from CLEC2L__Homo_sapiens__NP_001073980
auggagcccgcccgcgagccccccucccgcgcccgccccccccccccccucgccgcccgccccgcccccgcccccgccgccccccgcccccgcucccccgccgaggccgaggcccgcggccccgagggccuccuccgccgcuccggcuccggcuacgagggcuccaccuccuggaaggccgcccucgaggacaccaccacccgccuccuccucggcgccaucgccguccuccucuucgccauccucgucgucauguccauccucgccuccaagggcugcaucaagugcgaggcccccugccccgaggacuggcuccucuacggccgcaagugcuacuucuucuccgaggagccccgcgacuggaacaccggccgccaguacugccacacccacgaggccguccucgccgucauccagucccagaaggagcucgaguucauguucaaguucacccgccgcgagcccuggaucggccuccgccgcgucggcgacgaguuccacugggucaacggcgaccccuucgaccccgacaccuucaccaucgccggccccggcgagugcgucuucgucgagcccacccgccucgucuccaccgagugccucaugacccgccccugggucugcuccaagauggccuacaccuga

SEQ ID NO: 41436 - RNA, 609 nt, Artificial Sequence
  derived and/or modified sequence opt2 from CLEC3B__Homo_sapiens__NP_003269
auggagcucuggggcgccuaccuccuccucugccucuucucccuccucacccaggucaccaccgagccccccacccagaagcccaagaagaucgucaacgccaagaaggacgucgucaacaccaagauguucgaggagcucaagucccgccucgacacccucgcccaggaggucgcccuccucaaggagcagcaggcccuccagaccgucugccucaagggcaccaagguccacaugaagugcuuccucgccuucacccagaccaagaccuuccacgaggccuccgaggacugcaucucccgcggcggcacccucggcaccccccagaccggcuccgagaacgacgcccucuacgaguaccuccgccaguccgucggcaacgaggccgagaucuggcucggccucaacgacauggccgccgagggcaccugggucgacaugaccggcgcccgcaucgccuacaagaacugggagaccgagaucaccgcccagcccgacggcggcaagaccgagaacugcgccguccucuccggcgccgccaacggcaagugguucgacaagcgcugccgcgaccagcuccccuacaucugccaguucggcaucgucuga

SEQ ID NO: 41437 - RNA, 714 nt, Artificial Sequence
  derived and/or modified sequence opt2 from CLEC4A__Homo_sapiens__NP_057268
augaccuccgagaucaccuacgccgagguccgcuucaagaacgaguucaaguccuccggcaucaacaccgccuccuccgccgccuccaaggagcgcaccgccccccacaaguccaacaccggcuuccccaagcuccucugcgccucccuccucaucuucuuccuccuccucgccaucuccuucuucaucgccuucgucaucuucuuccagaaguacucccagcuccucgagaagaagaccaccaaggagcucguccacaccacccucgagugcgucaagaagaacaugcccgucgaggagaccgccugguccugcugccccaagaacuggaaguccuucuccuccaacugcuacuucaucuccaccgaguccgccuccuggcaggacuccgagaaggacugcgcccgcauggaggcccaccuccucgucaucaacacccaggaggagcaggacuucaucuuccagaaccuccaggaggaguccgccuacuucgucggccucuccgaccccgagggccagcgccacuggcagugggucgaccagacccccuacaacgaguccuccaccuucuggcacccccgcgagcccuccgaccccaacgagcgcugcgucguccucaacuuccgcaagucccccaagcgcuggggcuggaacgacgucaacugccucggcccccagcgcuccgucugcgagaugaugaagauccaccucuga

SEQ ID NO: 41438 - RNA, 642 nt, Artificial Sequence
  derived and/or modified sequence opt2 from CLEC4C__Homo_sapiens__NP_569708
augguccccgaggaggagccccaggaccgcgagaagggccucuggugguuccagcucaaggucugguccauggccgucgucuccauccuccuccucuccgucugcuucaccgucuccuccgucgucccccacaacuucauguacuccaagaccgucaagcgccucuccaagcuccgcgaguaccagcaguaccaccccucccucaccugcgucauggagggcaaggacaucgaggacugguccugcugccccacccccuggaccuccuuccaguccuccugcuacuucaucuccaccggcaugcaguccuggaccaagucccagaagaacugcuccgucaugggcgccgaccucgucgucaucaacacccgcgaggagcaggacuucaucauccagaaccucaagcgcaacuccuccuacuuccucggccucuccgaccccggcggccgccgccacuggcagugggucgaccagacccccuacaacgagaacgucaccuucuggcacuccggcgagcccaacaaccucgacgagcgcugcgccaucaucaacuuccgcuccuccgaggaguggggcuggaacgacauccacugccacgucccccagaaguccaucugcaagaugaagaagaucuacaucuga

SEQ ID NO: 41439 - RNA, 648 nt, Artificial Sequence
  derived and/or modified sequence opt2 from CLEC4D__Homo_sapiens__NP_525126
augggccucgagaagccccaguccaagcucgagggcggcaugcacccccagcucauccccuccgucaucgccgucgucuucauccuccuccucuccgucugcuucaucgccuccugccucgucacccaccacaacuucucccgcugcaagcgcggcaccggcguccacaagcucgagcaccacgccaagcucaagugcaucaaggagaaguccgagcucaaguccgccgagggcuccaccuggaacugcugccccaucgacuggcgcgccuuccaguccaacugcuacuucccccucaccgacaacaagaccugggccgaguccgagcgcaacugcuccggcaugggcgcccaccucaugaccaucuccaccgaggccgagcagaacuucaucauccaguuccucgaccgccgccucuccuacuuccucggccuccgcgacgagaacgccaagggccaguggcgcugggucgaccagacccccuucaacccccgccgcgucuucuggcacaagaacgagcccgacaacucccagggcgagaacugcgucguccucgucuacaaccaggacaagugggccuggaacgacguccccugcaacuucgaggccucccgcaucugcaagauccccggcaccacccucaacuga

SEQ ID NO: 41440 - RNA, 660 nt, Artificial Sequence
  derived and/or modified sequence opt2 from CLEC4E__Homo_sapiens__NP_055173
augaacuccuccaaguccuccgagacccagugcaccgagcgcggcugcuucuccucccagauguuccucuggaccgucgccggcauccccauccucuuccucuccgccugcuucaucacccgcugcgucgucaccuuccgcaucuuccagaccugcgacgagaagaaguuccagcuccccgagaacuucaccgagcucuccugcuacaacuacggcuccggcuccgucaagaacugcugcccccucaacugggaguacuuccaguccuccugcuacuucuucuccaccgacaccaucuccugggcccucucccucaagaacugcuccgccaugggcgcccaccucgucgucaucaacucccaggaggagcaggaguuccucuccuacaagaagcccaagaugcgcgaguucuucaucggccucuccgaccaggucgucgagggccaguggcagugggucgacggcaccccccucaccaagucccucuccuucugggacgucggcgagcccaacaacaucgccacccucgaggacugcgccaccaugcgcgacuccuccaacccccgccagaacuggaacgacgucaccugcuuccucaacuacuuccgcaucugcgagauggucggcaucaacccccucaacaagggcaagucccucuga

SEQ ID NO: 41441 - RNA, 846 nt, Artificial Sequence
  derived and/or modified sequence opt2 from CLEC4G__Homo_sapiens__NP_001231785
auggacaccacccgcuaccgccccuggggccgcuggguccacuggucccgccgcccccucuuccucgcccucgccguccucgucaccaccguccucugggccgucauccucuccauccuccucuccaaggccuccaccgagcgcgccgcccuccucgacggccacgaccuccuccgcaccaacgccuccaagcagaccgccgcccucggcgcccucaaggaggaggucggcgacugccacuccugcugcuccggcacccaggcccagcuccagaccacccgcgccgagcucggcgaggcccaggccaagcucauggagcaggaguccgcccuccgcgagcuccgcgagcgcgucacccagggccucgccgaggccggccgcggccgcgaggacguccgcaccgagcucuuccgcgcccucgaggccguccgccuccagaacaacuccugcgagcccugccccaccuccuggcucuccuucgagggcuccugcuacuucuucuccguccccaagaccaccugggccgccgcccaggaccacugcgccgacgccuccgcccaccucgucaucgucggcggccucgacgagcagggcuuccucacccgcaacacccgcggccgcggcuacuggcucggccuccgcgccguccgccaccucggcaagguccagggcuaccagugggucgacggcgucucccucuccuucucccacuggaaccagggcgagcccaacgacgccuggggccgcgagaacugcgucaugaugcuccacaccggccucuggaacgacgcccccugcgacuccgagaaggacggcuggaucugcgagaagcgccacaacugcuga

SEQ ID NO: 41442 - RNA, 1047 nt, Artificial Sequence
  derived and/or modified sequence opt2 from CLEC4M__Homo_sapiens__NP_001138376
auguccgacuccaaggagccccgcguccagcagcucggccuccucggcugccucggccacggcgcccucguccuccagcuccucuccuucaugcuccucgccggcguccucgucgccauccucguccaggucuccaagguccccuccucccucucccaggagcaguccgagcaggacgccaucuaccagaaccucacccagcucaaggccgccgucggcgagcucuccgagaaguccaagcuccaggagaucuaccaggagcucacccagcucaaggccgccgucggcgagcuccccgagaaguccaagcuccaggagaucuaccaggagcucacccgccucaaggccgccgucggcgagcuccccgagaaguccaagcuccaggagaucuaccaggagcucacccgccucaaggccgccgucggcgagcuccccgagaaguccaagcuccaggagaucuaccaggagcucaccgagcucaaggccgccgucggcgagcuccccgagaaguccaagcuccaggagaucuaccaggagcucacccagcucaaggccgccgucggcgagcuccccgaccaguccaagcagcagcagaucuaccaggagcucaccgaccucaagaccgccuucgagcgccucugccgccacugccccaaggacuggaccuucuuccagggcaacugcuacuucauguccaacucccagcgcaacuggcacgacuccgucaccgccugccaggagguccgcgcccagcucgucgucaucaagaccgccgaggagcagaacuuccuccagcuccagaccucccgcuccaaccgcuucuccuggaugggccucuccgaccucaaccaggagggcaccuggcagugggucgacggcuccccccucucccccuccuuccagcgcuacuggaacuccggcgagcccaacaacuccggcaacgaggacugcgccgaguucuccggcuccggcuggaacgacaaccgcugcgacgucgacaacuacuggaucugcaagaagcccgccgccugcuuccgcgacgaguga

SEQ ID NO: 41443 - RNA, 567 nt, Artificial Sequence
  derived and/or modified sequence opt2 from CLEC5A__Homo_sapiens__NP_037384
augaacuggcacaugaucaucuccggccucaucgucgucguccucaaggucgucggcaugacccucuuccuccucuacuucccccagaucuucaacaaguccaacgacggcuucaccaccacccgcuccuacggcaccgucucccagaucuucggcuccuccucccccucccccaacggcuucaucaccacccgcuccuacggcaccgucugccccaaggacugggaguucuaccaggcccgcugcuucuuccucuccaccuccgaguccuccuggaacgagucccgcgacuucugcaagggcaagggcuccacccucgccaucgucaacacccccgagaagcucaaguuccuccaggacaucaccgacgccgagaaguacuucaucggccucaucuaccaccgcgaggagaagcgcuggcgcuggaucaacaacuccgucuucaacggcaacgucaccaaccagaaccagaacuucaacugcgccaccaucggccucaccaagaccuucgacgccgccuccugcgacaucuccuaccgccgcaucugcgagaagaacgccaaguga

SEQ ID NO: 41444 - RNA, 630 nt, Artificial Sequence
  derived and/or modified sequence opt2 from CLEC6A__Homo_sapiens__NP_001007034
augaugcaggagcagcagccccaguccaccgagaagcgcggcuggcucucccuccgccucugguccgucgccggcaucuccaucgcccuccucuccgccugcuucaucgucuccugcgucgucaccuaccacuucaccuacggcgagaccggcaagcgccucuccgagcuccacuccuaccacuccucccucaccugcuucuccgagggcaccaagguccccgccuggggcugcugccccgccuccuggaaguccuucggcuccuccugcuacuucaucuccuccgaggagaaggucugguccaaguccgagcagaacugcgucgagaugggcgcccaccucgucgucuucaacaccgaggccgagcagaacuucaucguccagcagcucaacgaguccuucuccuacuuccucggccucuccgacccccagggcaacaacaacuggcaguggaucgacaagacccccuacgagaagaacguccgcuucuggcaccucggcgagcccaaccacuccgccgagcagugcgccuccaucgucuucuggaagcccaccggcuggggcuggaacgacgucaucugcgagacccgccgcaacuccaucugcgagaugaacaagaucuaccucuga

SEQ ID NO: 41445 - RNA, 606 nt, Artificial Sequence
  derived and/or modified sequence opt2 from CLEC7A__Homo_sapiens__NP_072092
auggaguaccaccccgaccucgagaaccucgacgaggacggcuacacccagcuccacuucgacucccaguccaacacccgcaucgccgucgucuccgagaagggcuccugcgccgccuccccccccuggcgccucaucgccgucauccucggcauccucugccucgucauccucgucaucgccgucguccucggcaccaugggcguccucuccucccccugcccccccaacuggaucaucuacgagaaguccugcuaccucuucuccaugucccucaacuccugggacggcuccaagcgccagugcuggcagcucggcuccaaccuccucaagaucgacuccuccaacgagcucggcuucaucgucaagcaggucuccucccagcccgacaacuccuucuggaucggccucucccgcccccagaccgagguccccuggcucugggaggacggcuccaccuucuccuccaaccucuuccagauccgcaccaccgccacccaggagaaccccucccccaacugcgucuggauccacgucuccgucaucuacgaccagcucugcuccguccccuccuacuccaucugcgagaagaaguucuccauguga

SEQ ID NO: 41446 - RNA, 726 nt, Artificial Sequence
  derived and/or modified sequence opt2 from CLEC9A__Homo_sapiens__NP_997228
augcacgaggaggagaucuacaccucccuccagugggacucccccgcccccgacaccuaccagaagugccucuccuccaacaagugcuccggcgccugcugccucgucauggucaucuccugcgucuucugcaugggccuccucaccgccuccaucuuccucggcgucaagcuccuccaggucuccaccaucgccaugcagcagcaggagaagcucauccagcaggagcgcgcccuccucaacuucaccgaguggaagcgcuccugcgcccuccagaugaaguacugccaggccuucaugcagaacucccucuccuccgcccacaacuccucccccugccccaacaacuggauccagaaccgcgaguccugcuacuacgucuccgagaucugguccaucuggcacaccucccaggagaacugccucaaggagggcuccacccuccuccagaucgaguccaaggaggagauggacuucaucaccggcucccuccgcaagaucaagggcuccuacgacuacugggucggccucucccaggacggccacuccggccgcuggcucuggcaggacggcuccucccccucccccggccuccuccccgccgagcgcucccaguccgccaaccaggucugcggcuacgucaaguccaacucccuccucuccuccaacugcuccaccuggaaguacuucaucugcgagaaguacgcccuccgcuccuccgucuga

SEQ ID NO: 41447 - RNA, 576 nt, Artificial Sequence
  derived and/or modified sequence opt2 from CLECL1__Homo_sapiens__NP_001240679
auggucuccaacuucuuccacgucauccaggucuucgagaaguccgccacccucaucuccaagaccgagcacaucggcuucgucaucuacuccuggcgcaaguccaccacccaccucggcucccgccgcaaguucgccaucuccaucuaccucuccgaggucucccuccagaaguacgacugccccuucuccggcaccuccuucgucgucuucucccucuuccucaucugcgccauggccggcgacgucgucuacgccgacaucaagaccguccgcaccuccccccucgagcucgccuucccccuccagcgcuccgucuccuucaacuucuccaccguccacaaguccugccccgccaaggacuggaagguccacaagggcaagugcuacuggaucgccgagaccaagaaguccuggaacaagucccagaacgacugcgccaucaacaacuccuaccucauggucauccaggacaucaccgccaugcucaucaccuuccuccucuaccuccagauggccuuccuccagugcgucuacaucuccgacgucuccgucuaccccaacuucuuccucuga

SEQ ID NO: 41448 - RNA, 1833 nt, Artificial Sequence
  derived and/or modified sequence opt2 from CLGN__Homo_sapiens__NP_004353
augcacuuccaggccuucuggcucugccucggccuccucuucaucuccaucaacgccgaguucauggacgacgacgucgagaccgaggacuucgaggagaacuccgaggagaucgacgucaacgaguccgagcucuccuccgagaucaaguacaagaccccccagcccaucggcgaggucuacuucgccgagaccuucgacuccggccgccucgccggcuggguccucuccaaggccaagaaggacgacauggacgaggagaucuccaucuacgacggccgcugggagaucgaggagcucaaggagaaccagguccccggcgaccgcggccucguccucaagucccgcgccaagcaccacgccaucuccgccguccucgccaagcccuucaucuucgccgacaagccccucaucguccaguacgaggucaacuuccaggacggcaucgacugcggcggcgccuacaucaagcuccucgccgacaccgacgaccucauccucgagaacuucuacgacaagaccuccuacaucaucauguucggccccgacaagugcggcgaggacuacaagcuccacuucaucuuccgccacaagcaccccaagaccggcgucuucgaggagaagcacgccaagccccccgacgucgaccucaagaaguucuucaccgaccgcaagacccaccucuacacccucgucaugaaccccgacgacaccuucgagguccucgucgaccagaccgucgucaacaagggcucccuccucgaggacgucgucccccccaucaagccccccaaggagaucgaggaccccaacgacaagaagcccgaggagugggacgagcgcgccaagauccccgaccccuccgccgucaagcccgaggacugggacgaguccgagcccgcccagaucgaggacuccuccgucgucaagcccgccggcuggcucgacgacgagcccaaguucauccccgaccccaacgccgagaagcccgacgacuggaacgaggacaccgacggcgagugggaggccccccagauccucaaccccgccugccgcaucggcugcggcgaguggaagccccccaugaucgacaaccccaaguacaagggcgucuggcgccccccccucgucgacaaccccaacuaccagggcaucugguccccccgcaagauccccaaccccgacuacuucgaggacgaccaccccuuccuccucaccuccuucuccgcccucggccucgagcucugguccaugaccuccgacaucuacuucgacaacuucaucaucugcuccgagaaggaggucgccgaccacugggccgccgacggcuggcgcuggaagaucaugaucgccaacgccaacaagcccggcguccucaagcagcucauggccgccgccgagggccaccccuggcucuggcucaucuaccucgucaccgccggcguccccaucgcccucaucaccuccuucugcuggccccgcaaggucaagaagaagcacaaggacaccgaguacaagaagaccgacaucugcaucccccagaccaagggcguccucgagcaggaggagaaggaggagaaggccgcccucgagaagcccauggaccucgaggaggagaagaagcagaacgacggcgagaugcucgagaaggaggaggaguccgagcccgaggagaaguccgaggaggagaucgagaucaucgagggccaggaggaguccaaccaguccaacaaguccggcuccgaggacgagaugaaggaggccgacgaguccaccggcuccggcgacggccccaucaaguccguccgcaagcgccgcguccgcaaggacuga

SEQ ID NO: 41449 - RNA, 726 nt, Artificial Sequence
  derived and/or modified sequence opt2 from CLIC1__Homo_sapiens__NP_001279
auggccgaggagcagccccaggucgagcucuucgucaaggccggcuccgacggcgccaagaucggcaacugccccuucucccagcgccucuucaugguccucuggcucaagggcgucaccuucaacgucaccaccgucgacaccaagcgccgcaccgagaccguccagaagcucugccccggcggccagcuccccuuccuccucuacggcaccgagguccacaccgacaccaacaagaucgaggaguuccucgaggccguccucugccccccccgcuaccccaagcucgccgcccucaaccccgaguccaacaccgccggccucgacaucuucgccaaguucuccgccuacaucaagaacuccaaccccgcccucaacgacaaccucgagaagggccuccucaaggcccucaagguccucgacaacuaccucaccuccccccuccccgaggaggucgacgagaccuccgccgaggacgagggcgucucccagcgcaaguuccucgacggcaacgagcucacccucgccgacugcaaccuccuccccaagcuccacaucguccaggucgucugcaagaaguaccgcggcuucaccauccccgaggccuuccgcggcguccaccgcuaccucuccaacgccuacgcccgcgaggaguucgccuccaccugccccgacgacgaggagaucgagcucgccuacgagcaggucgccaaggcccucaaguga

SEQ ID NO: 41450 - RNA, 711 nt, Artificial Sequence
  derived and/or modified sequence opt2 from CLIC3__Homo_sapiens__NP_004660
auggccgagaccaagcuccagcucuucgucaaggccuccgaggacggcgaguccgucggccacugccccuccugccagcgccucuucaugguccuccuccucaagggcguccccuucacccucaccaccgucgacacccgccgcucccccgacguccucaaggacuucgcccccggcucccagcuccccauccuccucuacgacuccgacgccaagaccgacacccuccagaucgaggacuuccucgaggagacccucggcccccccgacuuccccucccucgccccccgcuaccgcgaguccaacaccgccggcaacgacgucuuccacaaguucuccgccuucaucaagaaccccguccccgcccaggacgaggcccucuaccagcagcuccuccgcgcccucgcccgccucgacuccuaccuccgcgccccccucgagcacgagcucgccggcgagccccagcuccgcgagucccgccgccgcuuccucgacggcgaccgccucacccucgccgacugcucccuccuccccaagcuccacaucgucgacaccgucugcgcccacuuccgccaggcccccauccccgccgagcuccgcggcguccgccgcuaccucgacuccgccaugcaggagaaggaguucaaguacaccugcccccacuccgccgagauccucgccgccuaccgccccgccguccacccccgcuga

SEQ ID NO: 41451 - RNA, 1233 nt, Artificial Sequence
  derived and/or modified sequence opt2 from CLIC5__Homo_sapiens__NP_001107558
augaacgacgaggacuacuccaccaucuacgacaccauccagaacgagcgcaccuacgagguccccgaccagcccgaggagaacgaguccccccacuacgacgacguccacgaguaccuccgccccgagaacgaccucuacgccacccagcucaacacccacgaguacgacuucgucuccgucuacaccaucaagggcgaggagaccucccucgccuccguccaguccgaggaccgcggcuaccuccuccccgacgagaucuacuccgagcuccaggaggcccaccccggcgagccccaggaggaccgcggcaucuccauggagggccucuacuccuccacccaggaccagcagcucugcgccgccgagcuccaggagaacggcuccgucaugaaggaggaccuccccucccccuccuccuucaccauccagcacuccaaggccuucuccaccaccaaguacuccugcuacuccgacgccgagggccucgaggagaaggagggcgcccacaugaaccccgagaucuaccucuucgucaaggccggcaucgacggcgaguccaucggcaacugccccuucucccagcgccucuucaugauccucuggcucaagggcgucgucuucaacgucaccaccgucgaccucaagcgcaagcccgccgaccuccacaaccucgcccccggcacccacccccccuuccucaccuucaacggcgacgucaagaccgacgucaacaagaucgaggaguuccucgaggagacccucacccccgagaaguaccccaagcucgccgccaagcaccgcgaguccaacaccgccggcaucgacaucuucuccaaguucuccgccuacaucaagaacaccaagcagcagaacaacgccgcccucgagcgcggccucaccaaggcccucaagaagcucgacgacuaccucaacaccccccuccccgaggagaucgacgccaacaccugcggcgaggacaagggcucccgccgcaaguuccucgacggcgacgagcucacccucgccgacugcaaccuccuccccaagcuccacgucgucaagaucgucgccaagaaguaccgcaacuacgacauccccgccgagaugaccggccucuggcgcuaccucaagaacgccuacgcccgcgacgaguucaccaacaccugcgccgccgacuccgagaucgagcucgccuacgccgacgucgccaagcgccucucccgcuccuga

SEQ ID NO: 41452 - RNA, 2061 nt, Artificial Sequence
  derived and/or modified sequence opt2 from CLIC6__Homo_sapiens__NP_444507
auggccgaggccgccgagcccgagggcgucgcccccggcccccagggcccccccgagguccccgccccccucgccgagcgccccggcgagcccggcgccgccggcggcgaggccgagggccccgagggcuccgagggcgccgaggaggccccccgcggcgccgccgccgucaaggaggccggcggcggcggccccgaccgcggccccgaggccgaggcccgcggcacccgcggcgcccacggcgagaccgaggccgaggagggcgcccccgagggcgccgaggucccccagggcggcgaggagaccuccggcgcccagcaggucgagggcgccucccccggccgcggcgcccagggcgagccccgcggcgaggcccagcgcgagcccgaggacuccgccgcccccgagcgccaggaggaggccgagcagcgccccgagguccccgagggcuccgccuccggcgaggccggcgacuccgucgacgccgagggcccccucggcgacaacaucgaggccgagggccccgccggcgacuccgucgaggccgagggccgcgucggcgacuccgucgacgccgagggccccgccggcgacuccgucgacgccgagggcccccucggcgacaacauccaggccgagggccccgccggcgacuccgucgacgccgagggccgcgucggcgacuccgucgacgccgagggccccgccggcgacuccgucgacgccgagggccgcgucggcgacuccgucgaggccggcgaccccgccggcgacggcgucgaggccggcguccccgccggcgacuccgucgaggccgagggccccgccggcgacuccauggacgccgagggccccgccggccgcgcccgccgcgucuccggcgagccccagcaguccggcgacggcucccucuccccccaggccgaggccaucgaggucgccgccggcgaguccgccggccgcucccccggcgagcucgccugggacgccgccgaggaggccgagguccccggcgucaagggcuccgaggaggccgcccccggcgacgcccgcgccgacgccggcgaggaccgcgucggcgacggcccccagcaggagcccggcgaggacgaggagcgccgcgagcgcucccccgagggcccccgcgaggaggaggccgccggcggcgaggaggagucccccgacuccuccccccacggcgaggccucccgcggcgccgccgagcccgaggcccagcucuccaaccaccucgccgaggagggccccgccgagggcuccggcgaggccgcccgcgucaacggccgccgcgaggacggcgaggccuccgagccccgcgcccucggccaggagcacgacaucacccucuucgucaaggccggcuacgacggcgaguccaucggcaacugccccuucucccagcgccucuucaugauccucuggcucaagggcgucaucuucaacgucaccaccgucgaccucaagcgcaagcccgccgaccuccagaaccucgcccccggcaccaacccccccuucaugaccuucgacggcgaggucaagaccgacgucaacaagaucgaggaguuccucgaggagaagcucgcccccccccgcuaccccaagcucggcacccagcaccccgaguccaacuccgccggcaacgacgucuucgccaaguucuccgccuucaucaagaacaccaagaaggacgccaacgagauccacgagaagaaccuccucaaggcccuccgcaagcucgacaacuaccucaacuccccccuccccgacgagaucgacgccuacuccaccgaggacgucaccgucuccggccgcaaguuccucgacggcgacgagcucacccucgccgacugcaaccuccuccccaagcuccacaucaucaagaucgucgccaagaaguaccgcgacuucgaguuccccuccgagaugaccggcaucuggcgcuaccucaacaacgccuacgcccgcgacgaguucaccaacaccugccccgccgaccaggagaucgagcacgccuacuccgacgucgccaagcgcaugaaguga

SEQ ID NO: 41453 - RNA, 1932 nt, Artificial Sequence
  derived and/or modified sequence opt2 from CLINT1__Homo_sapiens__NP_001182484
augcucaacauguggaagguccgcgagcucgucgacaaggccaccaacgucgucaugaacuacuccgagaucgaguccaagguccgcgaggccaccaacgacgaccccuggggccccuccggccagcucaugggcgagaucgccaaggccaccuucauguacgagcaguuccccgagcucaugaacaugcucuggucccgcaugcucaaggacaacaagaagaacuggcgccgcgucuacaagucccuccuccuccucgccuaccucauccgcaacggcuccgagcgcgucgucaccuccgcccgcgagcacaucuacgaccuccgcucccucgagaacuaccacuucgucgacgagcacggcaaggaccagggcaucaacauccgccagaaggucaaggagcucgucgaguucgcccaggacgacgaccgccuccgcgaggagcgcaagaaggccaagaagaacaaggacaaguacgucggcgucuccuccgacuccgucggcggcuuccgcuacuccgagcgcuacgaccccgagcccaaguccaagugggacgaggagugggacaagaacaaguccgccuuccccuucuccgacaagcucggcgagcucuccgacaagaucggcuccaccaucgacgacaccaucuccaaguuccgccgcaaggaccgcgaggacucccccgagcgcugcuccgacuccgacgaggagaagaaggcccgccgcggccgcucccccaagggcgaguucaaggacgaggaggagaccgucaccaccaagcacauccacaucacccaggccaccgagaccaccaccacccgccacaagcgcaccgccaaccccuccaagaccaucgaccucggcgccgccgcccacuacaccggcgacaaggccucccccgaccagaacgccuccacccacaccccccaguccuccgucaagaccuccguccccuccuccaaguccuccggcgaccucgucgaccucuucgacggcaccucccaguccaccggcggcuccgccgaccucuucggcggcuucgccgacuucggcuccgccgccgccuccggcuccuuccccucccaggucaccgccaccuccggcaacggcgacuucggcgacugguccgccuucaaccaggcccccuccggccccgucgccuccuccggcgaguucuucggcuccgccucccagcccgccgucgagcucgucuccggcucccaguccgcccucggccccccccccgccgccuccaacuccuccgaccucuucgaccucaugggcuccucccaggccaccaugaccuccucccaguccaugaacuucuccaugauguccaccaacaccgucggccucggccuccccaugucccgcucccagccccuccagaacgucuccaccguccuccagaagcccaacccccucuacaaccagaacaccgacaugguccagaaguccgucuccaagacccuccccuccaccugguccgaccccuccgucaacaucucccucgacaaccuccuccccggcaugcagcccuccaagccccagcagcccucccucaacaccaugauccagcagcagaacaugcagcagcccaugaacgucaugacccaguccuucggcgccgucaaccucuccucccccuccaacaugcuccccguccgcccccagaccaacgcccucaucggcggccccaugcccauguccaugcccaacgucaugaccggcaccaugggcauggccccccucggcaacacccccaugaugaaccaguccaugaugggcaugaacaugaacaucggcauguccgccgccggcaugggccucaccggcaccaugggcaugggcaugcccaacaucgccaugaccuccggcaccguccagcccaagcaggacgccuucgccaacuucgccaacuucuccaaguga

SEQ ID NO: 41454 - RNA, 4317 nt, Artificial Sequence
  derived and/or modified sequence opt2 from CLIP1__Homo_sapiens__NP_001234926
auguccaugcucaagcccuccggccucaaggcccccaccaagauccucaagcccggcuccaccgcccucaagacccccaccgccgucgucgcccccgucgagaagaccaucuccuccgagaaggccuccuccacccccuccuccgagacccaggaggaguucgucgacgacuuccgcgucggcgagcgcgucugggucaacggcaacaagcccggcuucauccaguuccucggcgagacccaguucgcccccggccagugggccggcaucguccucgacgagcccaucggcaagaacgacggcuccgucgccggcguccgcuacuuccagugcgagccccucaagggcaucuucacccgccccuccaagcucacccgcaagguccaggccgaggacgaggccaacggccuccagaccacccccgccucccgcgccaccuccccccucugcaccuccaccgccuccauggucuccuccucccccuccacccccuccaacaucccccagaagcccucccagcccgccgccaaggagcccuccgccaccccccccaucuccaaccucaccaagaccgccuccgaguccaucuccaaccucuccgaggccggcuccaucaagaagggcgagcgcgagcucaagaucggcgaccgcguccucgucggcggcaccaaggccggcgucguccgcuuccucggcgagaccgacuucgccaagggcgaguggugcggcgucgagcucgacgagccccucggcaagaacgacggcgccgucgccggcacccgcuacuuccagugccagcccaaguacggccucuucgcccccguccacaaggucaccaagaucggcuuccccuccaccacccccgccaaggccaaggccaacgccguccgccgcgucauggccaccaccuccgccucccucaagcgcucccccuccgccuccucccucuccuccauguccuccgucgccuccuccgucuccucccgccccucccgcaccggccuccucaccgagaccuccucccgcuacgcccgcaagaucuccggcaccaccgcccuccaggaggcccucaaggagaagcagcagcacaucgagcagcuccucgccgagcgcgaccucgagcgcgccgaggucgccaaggccaccucccacgucggcgagaucgagcaggagcucgcccucgcccgcgacggccacgaccagcacguccucgagcucgaggccaagauggaccagcuccgcaccauggucgaggccgccgaccgcgagaaggucgagcuccucaaccagcucgaggaggagaagcgcaaggucgaggaccuccaguuccgcgucgaggaggaguccaucaccaagggcgaccucgagcagaagucccagaucuccgaggaccccgagaacacccagaccaagcucgagcacgcccgcaucaaggagcucgagcagucccuccucuucgagaagaccaaggccgacaagcuccagcgcgagcucgaggacacccgcgucgccaccgucuccgagaagucccgcaucauggagcucgagaaggaccucgcccuccgcguccaggaggucgccgagcuccgccgccgccucgaguccaacaagcccgccggcgacgucgacaugucccucucccuccuccaggagaucuccucccuccaggagaagcucgaggucacccgcaccgaccaccagcgcgagaucaccucccucaaggagcacuucggcgcccgcgaggagacccaccagaaggagaucaaggcccucuacaccgccaccgagaagcucuccaaggagaacgagucccucaaguccaagcucgagcacgccaacaaggagaacuccgacgucaucgcccucuggaaguccaagcucgagaccgccaucgccucccaccagcaggccauggaggagcucaaggucuccuucuccaagggccucggcaccgagaccgccgaguucgccgagcucaagacccagaucgagaagaugcgccucgacuaccagcacgagaucgagaaccuccagaaccagcaggacuccgagcgcgccgcccacgccaaggagauggaggcccuccgcgccaagcucaugaaggucaucaaggagaaggagaacucccucgaggccauccgcuccaagcucgacaaggccgaggaccagcaccucgucgagauggaggacacccucaacaagcuccaggaggccgagaucaaggucaaggagcucgagguccuccaggccaagugcaacgagcagaccaaggucaucgacaacuucaccucccagcucaaggccaccgaggagaagcuccucgaccucgacgcccuccgcaaggccuccuccgagggcaaguccgagaugaagaagcuccgccagcagcucgaggccgccgagaagcagaucaagcaccucgagaucgagaagaacgccgaguccuccaaggccuccuccaucacccgcgagcuccagggccgcgagcucaagcucaccaaccuccaggagaaccucuccgaggucucccaggucaaggagacccucgagaaggagcuccagauccucaaggagaaguucgccgaggccuccgaggaggccgucuccguccagcgcuccaugcaggagaccgucaacaagcuccaccagaaggaggagcaguucaacaugcucuccuccgaccucgagaagcuccgcgagaaccucgccgacauggaggccaaguuccgcgagaaggacgagcgcgaggagcagcucaucaaggccaaggagaagcucgagaacgacaucgccgagaucaugaagauguccggcgacaacuccucccagcucaccaagaugaacgacgagcuccgccucaaggagcgcgacgucgaggagcuccagcucaagcucaccaaggccaacgagaacgccuccuuccuccagaaguccaucgaggacaugaccgucaaggccgagcagucccagcaggaggccgccaagaagcacgaggaggagaagaaggagcucgagcgcaagcucuccgaccucgagaagaagauggagaccucccacaaccagugccaggagcucaaggcccgcuacgagcgcgccaccuccgagaccaagaccaagcacgaggagauccuccagaaccuccagaagacccuccucgacaccgaggacaagcucaagggcgcccgcgaggagaacuccggccuccuccaggagcucgaggagcuccgcaagcaggccgacaaggccaaggccgcccagaccgccgaggacgccaugcagaucauggagcagaugaccaaggagaagaccgagacccucgccucccucgaggacaccaagcagaccaacgccaagcuccagaacgagcucgacacccucaaggagaacaaccucaagaacgucgaggagcucaacaaguccaaggagcuccucaccgucgagaaccagaagauggaggaguuccgcaaggagaucgagacccucaagcaggccgccgcccagaagucccagcagcucuccgcccuccaggaggagaacgucaagcucgccgaggagcucggccgcucccgcgacgaggucaccucccaccagaagcucgaggaggagcgcuccguccucaacaaccagcuccucgagaugaagaagcgcgaguccaaguucaucaaggacgccgacgaggagaaggccucccuccagaaguccaucuccaucaccuccgcccuccucaccgagaaggacgccgagcucgagaagcuccgcaacgaggucaccguccuccgcggcgagaacgccuccgccaagucccuccacuccgucguccagacccucgaguccgacaaggucaagcucgagcucaaggucaagaaccucgagcuccagcucaaggagaacaagcgccagcucuccuccuccuccggcaacaccgacacccaggccgacgaggacgagcgcgcccaggagucccagaucgacuuccucaacuccgucaucgucgaccuccagcgcaagaaccaggaccucaagaugaaggucgagaugauguccgaggccgcccucaacggcaacggcgacgaccucaacaacuacgacuccgacgaccaggagaagcaguccaagaagaagccccgccucuucugcgacaucugcgacugcuucgaccuccacgacaccgaggacugccccacccaggcccagauguccgaggaccccccccacuccacccaccacggcucccgcggcgaggagcgccccuacugcgagaucugcgagauguucggccacugggccaccaacugcaacgacgacgagaccuucuga

SEQ ID NO: 41455 - RNA, 3141 nt, Artificial Sequence
  derived and/or modified sequence opt2 from CLIP2__Homo_sapiens__NP_003379
augcagaagcccuccggccucaagccccccggccgcggcggcaagcacuccucccccaugggccgcaccuccaccggcuccgccuccuccuccgccgccgucgccgccuccuccaaggagggcuccccccuccacaagcaguccuccggccccuccuccucccccgccgccgccgccgcccccgagaagcccggccccaaggccgccgaggucggcgacgacuuccucggcgacuucgucgucggcgagcgcgucugggucaacggcgucaagcccggcgucguccaguaccucggcgagacccaguucgcccccggccagugggccggcgucguccucgacgaccccgucggcaagaacgacggcgccgucggcggcguccgcuacuucgagugccccgcccuccagggcaucuucacccgccccuccaagcucacccgccagcccaccgccgagggcuccggcuccgacgcccacuccgucgagucccucaccgcccagaaccucucccuccacuccggcaccgccacccccccccucaccucccgcgucaucccccuccgcgaguccguccucaacuccuccgucaagaccggcaacgaguccggcuccaaccucuccgacuccggcuccgucaagcgcggcgagaaggaccuccgccucggcgaccgcguccucgucggcggcaccaagaccggcgucguccgcuacgucggcgagaccgacuucgccaagggcgaguggugcggcgucgagcucgacgagccccucggcaagaacgacggcgccgucgccggcacccgcuacuuccagugcccccccaaguucggccucuucgcccccauccacaaggucauccgcaucggcuuccccuccaccucccccgccaaggccaagaagaccaagcgcauggccaugggcgucuccgcccucacccacucccccuccuccuccuccaucuccuccgucuccuccgucgccuccuccgucggcggccgccccucccgcuccggccuccucaccgagaccuccucccgcuacgcccgcaagaucuccggcaccaccgcccuccaggaggcccucaaggagaagcagcagcacaucgagcagcuccucgccgagcgcgaccucgagcgcgccgaggucgccaaggccaccucccacaucugcgaggucgagaaggagaucgcccuccucaaggcccagcacgagcaguacgucgccgaggccgaggagaagcuccagcgcgcccgccuccucgucgaguccguccgcaaggagaaggucgaccucuccaaccagcucgaggaggagcgccgcaaggucgaggaccuccaguuccgcgucgaggaggaguccaucaccaagggcgaccucgagacccagacccagcucgagcacgcccgcaucggcgagcucgagcagucccuccuccucgagaaggcccaggccgagcgccuccuccgcgagcucgccgacaaccgccucaccaccgucgccgagaagucccgcguccuccagcucgaggaggagcucacccuccgccgcggcgagaucgaggagcuccagcagugccuccuccacuccggcccccccccccccgaccaccccgacgccgccgagauccuccgccuccgcgagcgccuccucuccgccuccaaggagcaccagcgcgaguccggcguccuccgcgacaaguacgagaaggcccucaaggccuaccaggccgaggucgacaagcuccgcgccgccaacgagaaguacgcccaggaggucgccggccucaaggacaagguccagcaggccaccuccgagaacaugggccucauggacaacuggaaguccaagcucgacucccucgccuccgaccaccagaagucccucgaggaccucaaggccacccucaacuccggccccggcgcccagcagaaggagaucggcgagcucaaggccgucauggagggcaucaagauggagcaccagcucgagcucggcaaccuccaggccaagcacgaccucgagaccgccaugcacgucaaggagaaggaggcccuccgcgagaagcuccaggaggcccaggaggagcucgccggccuccagcgccacuggcgcgcccagcucgagguccaggccucccagcaccgccucgagcuccaggaggcccaggaccagcgccgcgacgccgagcuccgcguccacgagcucgagaagcucgacgucgaguaccgcggccaggcccaggccaucgaguuccucaaggagcagaucucccucgccgagaagaagaugcucgacuacgagcgccuccagcgcgccgaggcccagggcaagcaggaggucgagucccuccgcgagaagcuccucgucgccgagaaccgccuccaggccgucgaggcccucugcuccucccagcacacccacaugaucgaguccaacgacaucuccgaggagaccauccgcaccaaggagaccgucgagggccuccaggacaagcucaacaagcgcgacaaggaggucaccgcccucaccucccagaccgagaugcuccgcgcccaggucuccgcccucgaguccaagugcaaguccggcgagaagaaggucgacgcccuccucaaggagaagcgccgccucgaggccgagcucgagaccgucucccgcaagacccacgacgccuccggccagcucguccucaucucccaggagcuccuccgcaaggagcgcucccucaacgagcuccgcguccuccuccucgaggccaaccgccacucccccggccccgagcgcgaccucucccgcgagguccacaaggccgaguggcgcaucaaggagcagaagcucaaggacgacauccgcggccuccgcgagaagcucaccggccucgacaaggagaagucccucuccgaccagcgccgcuacucccucaucgaccccuccuccgcccccgagcuccuccgccuccagcaccagcucauguccaccgaggacgcccuccgcgacgcccucgaccaggcccagcaggucgagaagcucauggaggccaugcgcuccugccccgacaaggcccagaccaucggcaacuccggcuccgccaacggcauccaccagcaggacaaggcccagaagcaggaggacaagcacuga

SEQ ID NO: 41456 - RNA, 1581 nt, Artificial Sequence
  derived and/or modified sequence opt2 from CLK1__Homo_sapiens__NP_001155879
auggccgccggccgccgccccgccuccgcccucuggcccgagcgccgcggcuccccccuccgcggcgaccuccucggcuuccagaacguccgcgagcccuccuccugcggcgagacccucuccggcaugcgccacuccaagcgcaccuacugccccgacugggacgacaaggacugggacuacggcaaguggcgcuccuccuccucccacaagcgccgcaagcgcucccacuccuccgcccaggagaacaagcgcugcaaguacaaccacuccaagaugugcgacucccacuaccucgagucccgcuccaucaacgagaaggacuaccacucccgccgcuacaucgacgaguaccgcaacgacuacacccagggcugcgagcccggccaccgccagcgcgaccacgagucccgcuaccagaaccacuccuccaaguccuccggccgcuccggccgcuccuccuacaaguccaagcaccgcauccaccacuccaccucccaccgccgcucccacggcaagucccaccgccgcaagcgcacccgcuccgucgaggacgacgaggagggccaccucaucugccaguccggcgacguccucuccgcccgcuacgagaucgucgacacccucggcgagggcgccuucggcaaggucgucgagugcaucgaccacaaggccggcggccgccacgucgccgucaagaucgucaagaacgucgaccgcuacugcgaggccgcccgcuccgagauccagguccucgagcaccucaacaccaccgaccccaacuccaccuuccgcugcguccagaugcucgagugguucgagcaccacggccacaucugcaucgucuucgagcuccucggccucuccaccuacgacuucaucaaggagaacggcuuccuccccuuccgccucgaccacauccgcaagauggccuaccagaucugcaaguccgucaacuuccuccacuccaacaagcucacccacaccgaccucaagcccgagaacauccucuucguccaguccgacuacaccgaggccuacaaccccaagaucaagcgcgacgagcgcacccucaucaaccccgacaucaaggucgucgacuucggcuccgccaccuacgacgacgagcaccacuccacccucgucuccacccgccacuaccgcgcccccgaggucauccucgcccucggcuggucccagcccugcgacgucugguccaucggcugcauccucaucgaguacuaccucggcuucaccgucuuccccacccacgacuccaaggagcaccucgccaugauggagcgcauccucggcccccuccccaagcacaugauccagaagacccgcaagcgcaaguacuuccaccacgaccgccucgacugggacgagcacuccuccgccggccgcuacgucucccgccgcugcaagccccucaaggaguucaugcucucccaggacgucgagcacgagcgccucuucgaccucauccagaagaugcucgaguacgaccccgccaagcgcaucacccuccgcgaggcccucaagcaccccuucuucgaccuccucaagaaguccaucuga

SEQ ID NO: 41457 - RNA, 1500 nt, Artificial Sequence
  derived and/or modified sequence opt2 from CLK2__Homo_sapiens__NP_001281267
augccccacccccgccgcuaccacuccuccgagcgcggcucccgcggcuccuaccgcgagcacuaccgcucccgcaagcacaagcgccgccgcucccgcuccugguccuccuccuccgaccgcacccgccgccgccgccgcgaggacuccuaccacguccgcucccgcuccuccuacgacgaccgcuccuccgaccgccgcgucuacgaccgccgcuacugcggcuccuaccgccgcaacgacuacucccgcgaccgcggcgacgccuacuacgacaccgacuaccgccacuccuacgaguaccagcgcgagaacuccuccuaccgcucccagcgcuccucccgccgcaagcaccgccgccgccgccgccgcucccgcaccuucucccgcuccuccucccagcacuccucccgccgcgccaaguccgucgaggacgacgccgagggccaccucaucuaccacgucggcgacuggcuccaggagcgcuacgagaucgucuccacccucggcgagggcaccuucggccgcgucguccagugcgucgaccaccgccgcggcggcgcccgcgucgcccucaagaucaucaagaacgucgagaaguacaaggaggccgcccgccucgagaucaacguccucgagaagaucaacgagaaggaccccgacaacaagaaccucugcguccagauguucgacugguucgacuaccacggccacaugugcaucuccuucgagcuccucggccucuccaccuucgacuuccucaaggacaacaacuaccuccccuaccccauccaccagguccgccacauggccuuccagcucugccaggccgucaaguuccuccacgacaacaagcucacccacaccgaccucaagcccgagaacauccucuucgucaacuccgacuacgagcucaccuacaaccucgagaagaagcgcgacgagcgcuccgucaaguccaccgccguccgcgucgucgacuucggcuccgccaccuucgaccacgagcaccacuccaccaucgucuccacccgccacuaccgcgcccccgaggucauccucgagcucggcuggucccagcccugcgacgucugguccaucggcugcaucaucuucgaguacuacgucggcuucacccucuuccagacccacgacaaccgcgagcaccucgccaugauggagcgcauccucggccccauccccucccgcaugauccgcaagacccgcaagcagaaguacuucuaccgcggccgccucgacugggacgagaacaccuccgccggccgcuacguccgcgagaacugcaagccccuccgccgcuaccucaccuccgaggccgaggagcaccaccagcucuucgaccucaucgaguccaugcucgaguacgagcccgccaagcgccucacccucggcgaggcccuccagcaccccuucuucgcccgccuccgcgccgagccccccaacaagcucugggacuccucccgcgacaucucccgcuga

SEQ ID NO: 41458 - RNA, 366 nt, Artificial Sequence
  derived and/or modified sequence opt2 from CLLU1__Homo_sapiens__NP_001020404
auguucaacaagugcuccuuccacuccuccaucuaccgccccgccgccgacaacuccgccuccucccucugcgccaucaucugcuuccucaaccucgucaucgagugcgaccucgagaccaacuccgagaucaacaagcucaucaucuaccucuucucccagaacaaccgcauccgcuucuccaagcuccuccucaagauccucuucuacaucuccaucuucuccuaccccgagcucaugugcgagcaguacgucaccuucaucaagcccggcauccacuacggccaggucuccaagaagcacaucaucuacuccaccuuccucuccaagaacuucaaguuccagcuccuccgcgucugcugguga

SEQ ID NO: 41459 - RNA, 3009 nt, Artificial Sequence
  derived and/or modified sequence opt2 from CLMN__Homo_sapiens__NP_079010
auggccgcccacgagugggacugguuccagcgcgaggagcucaucggccagaucuccgacauccgcguccagaaccuccaggucgagcgcgagaacguccagaagcgcaccuucacccgcuggaucaaccuccaccucgagaagugcaaccccccccucgaggucaaggaccucuucgucgacauccaggacggcaagauccucauggcccuccucgagguccucuccggccgcaaccuccuccacgaguacaaguccuccucccaccgcaucuuccgccucaacaacaucgccaaggcccucaaguuccucgaggacuccaacgucaagcucgucuccaucgacgccgccgagaucgccgacggcaaccccucccucguccucggccucaucuggaacaucauccucuucuuccagaucaaggagcucaccggcaaccucucccgcaacucccccuccuccucccucucccccggcuccggcggcaccgacuccgacuccuccuucccccccacccccaccgccgagcgcuccgucgccaucuccgucaaggaccagcgcaaggccaucaaggcccuccucgccuggguccagcgcaagacccgcaaguacggcgucgccguccaggacuucgccggcuccuggcgcuccggccucgccuuccucgccgucaucaaggccaucgaccccucccucgucgacaugaagcaggcccucgagaacuccacccgcgagaaccucgagaaggccuucuccaucgcccaggacgcccuccacaucccccgccuccucgagcccgaggacaucauggucgacacccccgacgagcaguccaucaugaccuacgucgcccaguuccucgagcgcuuccccgagcucgaggccgaggacaucuucgacuccgacaaggagguccccaucgaguccaccuucguccgcaucaaggagacccccuccgagcaggaguccaaggucuucguccucaccgagaacggcgagcgcaccuacaccgucaaccacgagaccucccaccccccccccuccaaggucuucgucugcgacaagcccgaguccaugaaggaguuccgccucgacggcgucuccucccacgcccucuccgacuccuccaccgaguucaugcaccagaucaucgaccagguccuccagggcggccccggcaagaccuccgacaucuccgagcccucccccgaguccuccauccucuccucccgcaaggagaacggccgcuccaacucccuccccaucaagaagaccguccacuucgaggccgacaccuacaaggaccccuucugcuccaagaaccucucccucugcuucgagggcuccccccgcgucgccaaggagucccuccgccaggacggccacguccucgccgucgaggucgccgaggagaaggagcagaagcaggaguccuccaagauccccgaguccuccuccgacaaggucgccggcgacaucuuccucgucgagggcaccaacaacaacucccaguccuccuccugcaacggcgcccucgaguccaccgcccgccacgacgaggagucccacucccucuccccccccggcgagaacaccgucauggccgacuccuuccagaucaaggucaaccucaugaccgucgaggcccucgaggagggcgacuacuucgaggccaucccccucaaggccuccaaguucaacuccgaccucaucgacuucgccuccaccucccaggccuucaacaagguccccuccccccacgagaccaagcccgacgaggacgccgaggccuucgagaaccacgccgagaagcucggcaagcgcuccaucaaguccgcccacaagaagaaggacucccccgagccccaggucaagauggacaagcacgagccccaccaggacuccggcgaggaggccgagggcugccccuccgcccccgaggagacccccgucgacaagaagcccgagguccacgagaaggccaagcgcaaguccacccgcccccacuacgaggaggagggcgaggacgacgaccuccagggcgucggcgaggagcucuccuccuccccccccuccuccugcgucucccucgagacccucggcucccacuccgaggagggccucgacuucaagcccucccccccccucuccaaggucuccgucaucccccacgaccucuucuacuucccccacuacgaggucccccucgccgccguccucgaggccuacgucgaggaccccgaggaccucaagaacgaggagauggaccucgaggagcccgagggcuacaugcccgaccucgacucccgcgaggaggaggccgacggcucccaguccuccuccuccuccuccguccccggcgagucccuccccuccgccuccgaccagguccucuaccucucccgcggcggcgucggcaccacccccgccuccgagcccgccccccucgccccccacgaggaccaccagcagcgcgagaccaaggagaacgaccccauggacucccaccagucccaggagucccccaaccucgagaacaucgccaacccccucgaggagaacgucaccaaggaguccaucuccuccaagaagaaggagaagcgcaagcacgucgaccacgucgaguccucccucuucgucgcccccggcuccguccaguccuccgacgaccucgaggaggacuccuccgacuacuccauccccucccgcaccucccacuccgacuccuccaucuaccuccgccgccacacccaccgcuccuccgaguccgaccacuucuccuacguccagcuccgcaacgccgccgaccucgacgaccgccgcaaccgcauccucacccgcaaggccaacuccuccggcgaggccaugucccucggcucccacuccccccaguccgacucccucacccagcucguccagcagcccgacaugauguacuucauccucuuccucuggcuccucgucuacugccuccuccucuucccccagcucgacgucucccgccucuga

SEQ ID NO: 41460 - RNA, 1122 nt, Artificial Sequence
  derived and/or modified sequence opt2 from CLMP__Homo_sapiens__NP_079045
augucccuccuccuccuccuccuccucgucuccuacuacgucggcacccucggcacccacaccgagaucaagcgcgucgccgaggagaaggucacccuccccugccaccaccagcucggccuccccgagaaggacacccucgacaucgaguggcuccucaccgacaacgagggcaaccagaaggucgucaucaccuacuccucccgccacgucuacaacaaccucaccgaggagcagaagggccgcgucgccuucgccuccaacuuccucgccggcgacgccucccuccagaucgagccccucaagcccuccgacgagggccgcuacaccugcaaggucaagaacuccggccgcuacgucuggucccacgucauccucaagguccucguccgccccuccaagcccaagugcgagcucgagggcgagcucaccgagggcuccgaccucacccuccagugcgaguccuccuccggcaccgagcccaucgucuacuacuggcagcgcauccgcgagaaggagggcgaggacgagcgccucccccccaagucccgcaucgacuacaaccaccccggccgcguccuccuccagaaccucaccauguccuacuccggccucuaccagugcaccgccggcaacgaggccggcaaggaguccugcgucguccgcgucaccguccaguacguccaguccaucggcauggucgccggcgccgucaccggcaucgucgccggcgcccuccucaucuuccuccucgucuggcuccucauccgccgcaaggacaaggagcgcuacgaggaggaggagcgccccaacgagauccgcgaggacgccgaggcccccaaggcccgccucgucaagcccuccuccuccuccuccggcucccgcuccucccgcuccggcuccuccuccacccgcuccaccgccaacuccgccucccgcucccagcgcacccucuccaccgacgccgccccccagcccggccucgccacccaggccuacucccucgucggccccgagguccgcggcuccgagcccaagaagguccaccacgccaaccucaccaaggccgagaccacccccuccaugauccccucccagucccgcgccuuccagaccgucuga

SEQ ID NO: 41461 - RNA, 1317 nt, Artificial Sequence
  derived and/or modified sequence opt2 from CLN3__Homo_sapiens__NP_000077
augggcggcugcgccggcucccgccgccgcuucuccgacuccgagggcgaggagaccguccccgagccccgccucccccuccucgaccaccagggcgcccacuggaagaacgccgucggcuucuggcuccucggccucugcaacaacuucuccuacgucgucaugcucuccgccgcccacgacauccucucccacaagcgcaccuccggcaaccagucccacgucgaccccggccccacccccaucccccacaacuccuccucccgcuucgacugcaacuccgucuccaccgccgccguccuccucgccgacauccuccccacccucgucaucaagcuccucgccccccucggccuccaccuccuccccuacuccccccgcguccucgucuccggcaucugcgccgccggcuccuucguccucgucgccuucucccacuccgucggcaccucccucugcggcgucgucuucgccuccaucuccuccggccucggcgaggucaccuuccucucccucaccgccuucuacccccgcgccgucaucuccuggugguccuccggcaccggcggcgccggccuccucggcgcccucuccuaccucggccucacccaggccggccucuccccccagcagacccuccucuccaugcucggcauccccgcccuccuccucgccuccuacuuccuccuccucaccucccccgaggcccaggaccccggcggcgaggaggaggccgaguccgccgcccgccagccccucauccgcaccgaggcccccgaguccaagcccggcuccuccuccucccucucccuccgcgagcgcuggaccgucuucaagggccuccucugguacaucgucccccucgucgucgucuacuucgccgaguacuucaucaaccagggccucuucgagcuccucuucuucuggaacaccucccucucccacgcccagcaguaccgcugguaccagaugcucuaccaggccggcgucuucgccucccgcuccucccuccgcugcugccgcauccgcuucaccugggcccucgcccuccuccagugccucaaccucgucuuccuccucgccgacgucugguucggcuuccuccccuccaucuaccucgucuuccucaucauccucuacgagggccuccucggcggcgccgccuacgucaacaccuuccacaacaucgcccucgagaccuccgacgagcaccgcgaguucgccauggccgccaccugcaucuccgacacccucggcaucucccucuccggccuccucgcccucccccuccacgacuuccucugccagcucuccuga

SEQ ID NO: 41462 - RNA, 1224 nt, Artificial Sequence
  derived and/or modified sequence opt2 from CLN5__Homo_sapiens__NP_006484
augcgccgcaaccuccgccucggccccuccuccggcgccgacgcccagggccagggcgccccccgccccggccucgccgccccccgcaugcuccucccccccgccucccaggccucccgcggcuccggcuccaccggcugcucccucauggcccaggaggucgacaccgcccagggcgccgagaugcgccgcggcgccggcgccgcccgcggccgcgccuccuggugcugggcccucgcccuccucuggcucgccgucguccccggcuggucccgcgucuccggcauccccucccgccgccacuggcccguccccuacaagcgcuucgacuuccgccccaagcccgaccccuacugccaggccaaguacaccuucugccccaccggcucccccauccccgucauggagggcgacgacgacaucgaggucuuccgccuccaggcccccgucugggaguucaaguacggcgaccuccucggccaccucaagaucaugcacgacgccaucggcuuccgcuccacccucaccggcaagaacuacaccauggagugguacgagcucuuccagcucggcaacugcaccuucccccaccuccgccccgagauggacgcccccuucuggugcaaccagggcgccgccugcuucuucgagggcaucgacgacguccacuggaaggagaacggcacccucguccaggucgccaccaucuccggcaacauguucaaccagauggccaagugggucaagcaggacaacgagaccggcaucuacuacgagaccuggaacgucaaggccucccccgagaagggcgccgagaccugguucgacuccuacgacugcuccaaguucguccuccgcaccuucaacaagcucgccgaguucggcgccgaguucaagaacaucgagaccaacuacacccgcaucuuccucuacuccggcgagcccaccuaccucggcaacgagaccuccgucuucggccccaccggcaacaagacccucggccucgccaucaagcgcuucuacuaccccuucaagccccaccuccccaccaaggaguuccuccucucccuccuccagaucuucgacgccgucaucguccacaagcaguucuaccucuucuacaacuucgaguacugguuccuccccaugaaguuccccuucaucaagaucaccuacgaggagaucccccuccccauccgcaacaagacccucuccggccucuga

SEQ ID NO: 41463 - RNA, 936 nt, Artificial Sequence
  derived and/or modified sequence opt2 from CLN6__Homo_sapiens__NP_060352
auggaggccacccgccgccgccagcaccucggcgccaccggcggccccggcgcccagcucggcgccuccuuccuccaggcccgccacggcuccgucuccgccgacgaggccgcccgcaccgcccccuuccaccucgaccucugguucuacuucacccuccagaacuggguccucgacuucggccgccccaucgccaugcucgucuucccccucgagugguucccccucaacaagcccuccgucggcgacuacuuccacauggccuacaacgucaucacccccuuccuccuccucaagcucaucgagcgcuccccccgcacccucccccgcuccaucaccuacgucuccaucaucaucuucaucaugggcgccuccauccaccucgucggcgacuccgucaaccaccgccuccucuucuccggcuaccagcaccaccucuccguccgcgagaaccccaucaucaagaaccucaagcccgagacccucaucgacuccuucgagcuccucuacuacuacgacgaguaccucggccacugcaugugguacauccccuucuuccucauccucuucauguacuucuccggcugcuucaccgccuccaaggccgagucccucauccccggccccgcccuccuccucgucgcccccuccggccucuacuacugguaccucgucaccgagggccagaucuucauccucuucaucuucaccuucuucgccaugcucgcccucguccuccaccagaagcgcaagcgccucuuccucgacuccaacggccucuuccucuucuccuccuucgcccucacccuccuccucgucgcccucugggucgccuggcucuggaacgaccccguccuccgcaagaaguaccccggcgucaucuacguccccgagcccugggccuucuacacccuccacgucuccucccgccacuga

SEQ ID NO: 41464 - RNA, 861 nt, Artificial Sequence
  derived and/or modified sequence opt2 from CLN8__Homo_sapiens__NP_061764
augaaccccgccuccgacggcggcaccuccgaguccaucuucgaccucgacuacgccuccuggggcauccgcuccacccucauggucgccggcuucgucuucuaccucggcgucuucgucgucugccaccagcucuccuccucccucaacgccaccuaccgcucccucgucgcccgcgagaaggucuucugggaccucgccgccacccgcgccgucuucggcguccaguccaccgccgccggccucugggcccuccucggcgaccccguccuccacgccgacaaggcccgcggccagcagaacuggugcugguuccacaucaccaccgccaccggcuucuucugcuucgagaacgucgccguccaccucuccaaccucaucuuccgcaccuucgaccucuuccucgucauccaccaccucuucgccuuccucggcuuccucggcugccucgucaaccuccaggccggccacuaccucgccaugaccacccuccuccucgagauguccacccccuucaccugcgucuccuggaugcuccucaaggccggcugguccgagucccucuucuggaagcucaaccaguggcucaugauccacauguuccacugccgcaugguccucaccuaccacauguggugggucugcuucuggcacugggacggccucgucuccucccucuaccucccccaccucacccucuuccucgucggccucgcccuccucacccucaucaucaaccccuacuggacccacaagaagacccagcagcuccucaaccccgucgacuggaacuucgcccagcccgaggccaagucccgccccgagggcaacggccagcuccuccgcaagaagcgccccuga

SEQ ID NO: 41465 - RNA, 1287 nt, Artificial Sequence
  derived and/or modified sequence opt2 from CLNK__Homo_sapiens__NP_443196
augaaccgccagggcaaccgcaagaccaccaaggagggcuccaacgaccucaaguuccagaacuucucccuccccaagaaccgcuccuggccccgcaucaacuccgccaccggccaguaccagcgcaugaacaagccccuccucgacugggagcgcaacuucgccgccguccucgacggcgccaagggccacuccgacgacgacuacgacgaccccgagcuccgcauggaggagaccuggcaguccaucaagauccuccccgcccgccccaucaaggaguccgaguacgccgacacccacuacuucaaggucgccauggacaccccccucccccucgacacccgcaccuccaucuccaucggccagcccaccuggaacacccagacccgccucgagcgcgucgacaagcccaucuccaaggacguccgcucccagaacaucaagggcgacgccuccguccgcaagaacaagaucccccucccccccccccgcccccucaucacccuccccaagaaguaccagccccucccccccgagcccgaguccucccgccccccccucucccagcgccacaccuuccccgagguccagcgcaugcccucccagaucucccuccgcgaccucuccgagguccucgaggccgagaaggucccccacaaccagcgcaagcccgaguccacccaccuccucgagaaccagaacacccaggagaucccccucgccaucuccuccuccuccuucaccaccuccaaccacuccguccagaaccgcgaccaccgcggcggcaugcagcccugcuccccccagcgcugccagccccccgccuccugcuccccccacgagaacauccuccccuacaaguacaccuccuggcgcccccccuuccccaagcgcuccgaccgcaaggacguccagcacaacgagugguacaucggcgaguacucccgccaggccgucgaggaggccuucaugaaggagaacaaggacggcuccuuccucguccgcgacugcuccaccaaguccaaggaggagcccuacguccucgccgucuucuacgagaacaaggucuacaacgucaagauccgcuuccucgagcgcaaccagcaguucgcccucggcaccggccuccgcggcgacgagaaguucgacuccgucgaggacaucaucgagcacuacaagaacuuccccaucauccucaucgacggcaaggacaagaccggcguccaccgcaagcagugccaccucacccagccccucccccucacccgccaccuccucccccucuga

SEQ ID NO: 41466 - RNA, 714 nt, Artificial Sequence
  derived and/or modified sequence opt2 from CLNS1A__Homo_sapiens__NP_001284
auguccuuccucaaguccuuccccccccccggccccgccgagggccuccuccgccagcagcccgacaccgaggccguccucaacggcaagggccucggcaccggcacccucuacaucgccgagucccgccucuccuggcucgacggcuccggccucggcuucucccucgaguaccccaccaucucccuccacgcccucucccgcgaccgcuccgacugccucggcgagcaccucuacgucauggucaacgccaaguucgaggaggaguccaaggagcccgucgccgacgaggaggaggaggacuccgacgacgacgucgagcccaucaccgaguuccgcuucguccccuccgacaaguccgcccucgaggccauguucaccgccaugugcgagugccaggcccuccaccccgaccccgaggacgaggacuccgacgacuacgacggcgaggaguacgacgucgaggcccacgagcagggccagggcgacauccccaccuucuacaccuacgaggagggccucucccaccucaccgccgagggccaggccacccucgagcgccucgagggcaugcucucccaguccgucuccucccaguacaacauggccggcguccgcaccgaggacuccauccgcgacuacgaggacggcauggaggucgacaccacccccaccgucgccggccaguucgaggacgccgacgucgaccacuga

SEQ ID NO: 41467 - RNA, 2541 nt, Artificial Sequence
  derived and/or modified sequence opt2 from CLOCK__Homo_sapiens__NP_004889
augcucuucaccgucuccugcuccaagauguccuccaucgucgaccgcgacgacuccuccaucuucgacggccucgucgaggaggacgacaaggacaaggccaagcgcgucucccgcaacaaguccgagaagaagcgccgcgaccaguucaacguccucaucaaggagcucggcuccaugcuccccggcaacgcccgcaagauggacaaguccaccguccuccagaaguccaucgacuuccuccgcaagcacaaggagaucaccgcccaguccgacgccuccgagauccgccaggacuggaagcccaccuuccucuccaacgaggaguucacccagcucaugcucgaggcccucgacggcuucuuccucgccaucaugaccgacggcuccaucaucuacgucuccgaguccgucaccucccuccucgagcaccuccccuccgaccucgucgaccaguccaucuucaacuucauccccgagggcgagcacuccgaggucuacaagauccucuccacccaccuccucgaguccgacucccucacccccgaguaccucaaguccaagaaccagcucgaguucugcugccacaugcuccgcggcaccaucgaccccaaggagcccuccaccuacgaguacgucaaguucaucggcaacuucaagucccucaacuccgucuccuccuccgcccacaacggcuucgagggcaccauccagcgcacccaccgccccuccuacgaggaccgcgucugcuucgucgccaccguccgccucgccaccccccaguucaucaaggagaugugcaccgucgaggagcccaacgaggaguucaccucccgccacucccucgaguggaaguuccucuuccucgaccaccgcgccccccccaucaucggcuaccuccccuucgagguccucggcaccuccggcuacgacuacuaccacgucgacgaccucgagaaccucgccaagugccacgagcaccucaugcaguacggcaagggcaaguccugcuacuaccgcuuccucaccaagggccagcaguggaucuggcuccagacccacuacuacaucaccuaccaccaguggaacucccgccccgaguucaucgucugcacccacaccgucgucuccuacgccgagguccgcgccgagcgccgccgcgagcucggcaucgaggagucccuccccgagaccgccgccgacaagucccaggacuccggcuccgacaaccgcaucaacaccgucucccucaaggaggcccucgagcgcuucgaccacucccccacccccuccgccuccucccgcuccucccgcaaguccucccacaccgccgucuccgaccccuccuccacccccaccaagauccccaccgacaccuccacccccccccgccagcaccuccccgcccacgagaagaugguccagcgccgcuccuccuucuccucccaguccaucaacucccaguccgucggcuccucccucacccagcccgucaugucccaggccaccaaccuccccaucccccagggcaugucccaguuccaguucuccgcccagcucggcgccaugcagcaccucaaggaccagcucgagcagcgcacccgcaugaucgaggccaacauccaccgccagcaggaggagcuccgcaagauccaggagcagcuccagaugguccacggccagggccuccagauguuccuccagcaguccaaccccggccucaacuucggcuccguccagcucuccuccggcaacuccuccaacauccagcagcucgcccccaucaacaugcagggccaggucguccccaccaaccagauccaguccggcaugaacaccggccacaucggcaccacccagcacaugauccagcagcagacccuccaguccaccuccacccagucccagcagaacguccucuccggccacucccagcagaccucccuccccucccagacccaguccacccucaccgccccccucuacaacaccauggucaucucccagcccgccgccggcuccaugguccagauccccuccuccaugccccagaacuccacccaguccgccgccgucaccaccuucacccaggaccgccagauccgcuucucccagggccagcagcucgucaccaagcucgucaccgcccccgucgccugcggcgccgucaugguccccuccaccaugcucaugggccaggucgucaccgccuaccccaccuucgccacccagcagcagcagucccagacccucuccgucacccagcagcagcagcagcaguccucccaggagcagcagcucaccuccguccagcagcccucccaggcccagcucacccagcccccccagcaguuccuccagaccucccgccuccuccacggcaaccccuccacccagcucauccucuccgccgccuucccccuccagcaguccaccuucccccagucccaccaccagcagcaccagucccagcagcagcagcagcucucccgccaccgcaccgacucccuccccgaccccuccaagguccagccccaguga

SEQ ID NO: 41468 - RNA, 1086 nt, Artificial Sequence
  derived and/or modified sequence opt2 from CLP1__Homo_sapiens__NP_001136069
augggcgaggaggccaacgacgacaagaagcccaccaccaaguucgagcucgagcgcgagaccgagcuccgcuucgaggucgaggccucccaguccguccagcucgagcuccucaccggcauggccgagaucuucggcaccgagcucacccgcaacaagaaguucaccuucgacgccggcgccaaggucgccgucuucaccuggcacggcugcuccguccagcucuccggccgcaccgaggucgccuacgucuccaaggacacccccaugcuccucuaccucaacacccacaccgcccucgagcagaugcgccgccaggccgagaaggaggaggagcgcggcccccgcgucauggucgucggccccaccgacgucggcaaguccaccgucugccgccuccuccucaacuacgccaucaccucccgccucgccgacgucuucaaccagcgcugcgaggucaaccgccgcgccuccgucuccggcugcgucaucaacaccugcggcugggucaagggcuccggcuaccaggcccucguccacgccgccuccgccuucgaggucgacgucgucgucguccucgaccaggagcgccucuacaacgagcucaagcgcgaccucccccacuucguccgcaccguccuccuccccaaguccggcggcgucgucgagcgcuccaaggacuuccgccgcgagugccgcgacgagcgcauccgcgaguacuucuacggcuuccgcggcugcuucuacccccacgccuucaacgucaaguucuccgacgucaagaucuacaaggucggcgcccccaccauccccgacuccugccucccccucggcaugucccaggaggacaaccagcucaagcucguccccgucacccccggccgcgacaugguccaccaccuccucuccgucuccaccgccgagggcaccgaggagaaccucuccgagaccuccgucgccggcuucaucgucgucaccuccgucgaccucgagcaccaggucuucaccguccucucccccgccccccgcccccuccccaagaacuuccuccucaucauggacauccgcuucauggaccucaaguga

SEQ ID NO: 41469 - RNA, 834 nt, Artificial Sequence
  derived and/or modified sequence opt2 from CLPP__Homo_sapiens__NP_006003
auguggcccggcauccucgucggcggcgcccgcgucgccuccugccgcuaccccgcccucggcccccgccucgccgcccacuuccccgcccagcgccccccccagcgcacccuccagaacggccucgcccuccagcgcugccuccacgccaccgccacccgcgcccucccccucauccccaucgucgucgagcagaccggccgcggcgagcgcgccuacgacaucuacucccgccuccuccgcgagcgcaucgucugcgucaugggccccaucgacgacuccgucgccucccucgucaucgcccagcuccucuuccuccaguccgaguccaacaagaagcccauccacauguacaucaacucccccggcggcgucgucaccgccggccucgccaucuacgacaccaugcaguacauccucaaccccaucugcaccuggugcgucggccaggccgccuccaugggcucccuccuccucgccgccggcacccccggcaugcgccacucccuccccaacucccgcaucaugauccaccagcccuccggcggcgcccgcggccaggccaccgacaucgccauccaggccgaggagaucaugaagcucaagaagcagcucuacaacaucuacgccaagcacaccaagcagucccuccaggucaucgaguccgccauggagcgcgaccgcuacaugucccccauggaggcccaggaguucggcauccucgacaagguccucguccaccccccccaggacggcgaggacgagcccacccucguccagaaggagcccgucgaggccgcccccgccgccgagcccguccccgccuccaccuga

SEQ ID NO: 41470 - RNA, 216 nt, Artificial Sequence
  derived and/or modified sequence opt2 from CLPS__Homo_sapiens__NP_001239527
auggagaagauccucauccuccuccucgucgcccucuccgucgccuacgccgcccccggcccccgcggcaucaucaucaaccucacccucuacggcaucuacuacaagugccccugcgagcgcggccucaccugcgagggcgacaagaccaucgucggcuccaucaccaacaccaacuucggcaucugccacgacgccggccgcuccaagcaguga

SEQ ID NO: 41471 - RNA, 1968 nt, Artificial Sequence
  derived and/or modified sequence opt2 from CLPTM1__Homo_sapiens__NP_001269104
augucccgcaaggcccacaucaccgagaaggucaccuccaacggcuccaucggccgcgacccccccgccgagacccagccccagaacccccccgcccagcccgcccccaacgccuggcaggucaucaagggcguccucuuccgcaucuucaucaucugggccaucuccuccugguuccgccgcggccccgccccccaggaccaggccggccccggcggcgccccccgcgucgccucccgcaaccucuuccccaaggacacccucaugaaccuccacgucuacaucuccgagcacgagcacuucaccgacuucaacgccaccuccgcccucuucugggagcagcacgaccucgucuacggcgacuggaccuccggcgagaacuccgacggcugcuacgagcacuucgccgagcucgacaucccccaguccguccagcagaacggcuccaucuacauccacgucuacuucaccaaguccggcuuccaccccgacccccgccagaaggcccucuaccgccgccucgccaccguccacaugucccgcaugaucaacaaguacaagcgccgccgcuuccagaagaccaagaaccuccucaccggcgagaccgaggccgaccccgagaugaucaagcgcgccgaggacuacggccccgucgaggucaucucccacuggcaccccaacaucaccaucaacaucgucgacgaccacacccccugggucaagggcuccgucccccccccccucgaccaguacgucaaguucgacgccgucuccggcgacuacuaccccaucaucuacuucaacgacuacuggaaccuccagaaggacuacuaccccaucaacgagucccucgccucccucccccuccgcgucuccuucugcccccucucccucuggcgcuggcagcucuacgccgcccaguccaccaagucccccuggaacuuccucggcgacgagcucuacgagcaguccgacgaggagcaggacuccgucaaggucgcccuccucgagaccaaccccuaccuccucgcccucaccaucaucgucuccaucguccacuccgucuucgaguuccucgccuucaagaacgacauccaguucuggaacucccgccagucccucgagggccucuccguccgcuccgucuucuucggcgucuuccaguccuucgucguccuccucuacauccucgacaacgagaccaacuucgucguccaggucuccgucuucaucggcguccucaucgaccucuggaagaucaccaaggucauggacguccgccucgaccgcgagcaccgcgucgccggcaucuucccccgccucuccuucaaggacaaguccaccuacaucgaguccuccaccaaggucuacgacgacauggccuuccgcuaccucuccuggauccucuucccccuccucggcugcuacgccgucuacucccuccucuaccucgagcacaagggcugguacuccuggguccucuccaugcucuacggcuuccuccucaccuucggcuucaucaccaugaccccccagcucuucaucaacuacaagcucaaguccgucgcccaccuccccuggcgcaugcucaccuacaaggcccucaacaccuucaucgacgaccucuucgccuucgucaucaagaugcccgucauguaccgcaucggcugccuccgcgacgacgucgucuucuucaucuaccucuaccagcgcuggaucuaccgcgucgaccccacccgcgucaacgaguucggcauguccggcgaggaccccaccgccgccgcccccgucgccgagguccccaccgccgccggcgcccucacccccacccccgcccccaccaccaccaccgccacccgcgaggaggccuccaccucccuccccaccaagcccacccagggcgccuccuccgccuccgagccccaggaggccccccccaagcccgccgaggacaagaagaaggacuga

SEQ ID NO: 41472 - RNA, 1617 nt, Artificial Sequence
  derived and/or modified sequence opt2 from CLPTM1L__Homo_sapiens__NP_110409
augugguccggccgcuccuccuucaccucccucgucgucggcgucuucgucgucuacgucguccacaccugcugggucauguacggcaucgucuacacccgccccugcuccggcgacgccaacugcauccagcccuaccucgcccgccgccccaagcuccagcucuccgucuacaccaccacccgcucccaccucggcgccgagaacaacaucgaccucguccucaacgucgaggacuucgacgucgaguccaaguucgagcgcaccgucaacgucuccguccccaagaagacccgcaacaacggcacccucuacgccuacaucuuccuccaccacgccggcguccuccccuggcacgacggcaagcagguccaccucgucuccccccucaccaccuacaugguccccaagcccgaggagaucaaccuccucaccggcgaguccgacacccagcagaucgaggccgagaagaagcccaccuccgcccucgacgagcccgucucccacuggcgcccccgccucgcccucaacgucauggccgacaacuucgucuucgacggcuccucccuccccgccgacguccaccgcuacaugaagaugauccagcucggcaagaccguccacuaccuccccauccucuucaucgaccagcucuccaaccgcgucaaggaccucauggucaucaaccgcuccaccaccgagcucccccucaccgucuccuacgacaaggucucccucggccgccuccgcuucuggauccacaugcaggacgccgucuacucccuccagcaguucggcuucuccgagaaggacgccgacgaggucaagggcaucuucgucgacaccaaccucuacuuccucgcccucaccuucuucgucgccgccuuccaccuccucuucgacuuccucgccuucaagaacgacaucuccuucuggaagaagaagaaguccaugaucggcauguccaccaaggccguccucuggcgcugcuucuccaccgucgucaucuuccucuuccuccucgacgagcagaccucccuccucguccucguccccgccggcgucggcgccgccaucgagcucuggaaggucaagaaggcccucaagaugaccaucuucuggcgcggccucaugcccgaguuccaguucggcaccuacuccgaguccgagcgcaagaccgaggaguacgacacccaggccaugaaguaccucuccuaccuccucuacccccucugcgucggcggcgccgucuacucccuccucaacaucaaguacaaguccugguacuccuggcucaucaacuccuucgucaacggcgucuacgccuucggcuuccucuucaugcucccccagcucuucgucaacuacaagcucaaguccgucgcccaccuccccuggaaggccuucaccuacaaggccuucaacaccuucaucgacgacgucuucgccuucaucaucaccaugcccaccucccaccgccucgccugcuuccgcgacgacgucgucuuccucgucuaccucuaccagcgcuggcucuaccccgucgacaagcgccgcgucaacgaguucggcgaguccuacgaggagaaggccacccgcgccccccacaccgacuga

SEQ ID NO: 41473 - RNA, 738 nt, Artificial Sequence
  derived and/or modified sequence opt2 from CLRN1__Homo_sapiens__NP_001182723
augcccucccagcagaagaagaucaucuucugcauggccggcgucuucuccuucgccugcgcccucggcgucgucaccgcccucggcaccccccucuggaucaaggccaccguccucugcaagaccggcgcccuccucgucaacgccuccggccaggagcucgacaaguucaugggcgagaugcaguacggccucuuccacggcgagggcguccgccagugcggccucggcgcccgccccuuccgcuucuccuucuuccccgaccuccucaaggccauccccgucuccauccacgucaacgucauccucuucuccgccauccucaucguccucaccauggucggcaccgccuucuucauguacaacgccuucggcaagcccuucgagacccuccacggcccccucggccucuaccuccucuccuucaucuccgucgcccucuggcuccccgccacccgccaccaggcccagggcuccugcggcugccucgucaugauccucuucgccuccgaggucaagauccaccaccucuccgagaagaucgccaacuacaaggagggcaccuacgucuacaagacccaguccgagaaguacaccaccuccuucugggucaucuucuucugcuucuucguccacuuccucaacggccuccucauccgccucgccggcuuccaguuccccuucgccaaguccaaggacgccgagaccaccaacgucgccgccgaccucauguacuga

SEQ ID NO: 41474 - RNA, 3999 nt, Artificial Sequence
  derived and/or modified sequence opt2 from CLSPN__Homo_sapiens__XP_011540241
augaccggcgaggucggcuccgagguccaccucgagaucaacgaccccaacgucaucucccaggaggaggccgacucccccuccgacuccggccagggcuccuacgagaccaucggcccccucuccgagggcgacuccgacgaggagaucuucgucuccaagaagcucaagaaccgcaagguccuccaggacuccgacuccgagaccgaggacaccaacgccucccccgagaagaccaccuacgacuccgccgaggaggagaacaaggagaaccucuacgccggcaagaacaccaagaucaagcgcaucuacaagaccgucgccgacuccgacgaguccuacauggagaagucccucuaccaggagaaccucgaggcccaggucaagcccugccucgagcucucccuccaguccggcaacuccaccgacuucaccaccgaccgcaaguccuccaagaagcacauccacgacaaggagggcaccgccggcaaggccaaggucaaguccaagcgccgccucgagaaggaggagcgcaagauggagaagauccgccagcucaagaagaaggagaccaagaaccaggaggacgacgucgagcagcccuucaacgacuccggcugccuccucgucgacaaggaccucuucgagaccggccucgaggacgagaacaacuccccccucgaggacgaggagucccucgaguccauccgcgccgccgucaagaacaaggucaagaagcacaagaagaaggagcccucccucgaguccggcguccacuccuucgaggagggcuccgagcucuccaagggcaccacccgcaaggagcgcaaggccgcccgccucuccaaggaggcccucaagcagcuccacuccgagacccagcgccucauccgcgaguccgcccucaaccuccccuaccacaugcccgagaacaagaccauccacgacuucuucaagcgcaagccccgccccaccugccacggcaacgccauggcccuccucaaguccuccaaguaccaguccucccaccacaaggagaucaucgacaccgccaacaccaccgagaugaacuccgaccaccacuccaagggcuccgagcagaccaccggcgccgagaacgaggucgagaccaacgcccuccccgucgucuccaaggagacccagaucaucaccggcuccgacgaguccugccgcaaggaccucgucaagaacgaggagcucgagauccaggagaagcagaagcaguccgacauccgccccucccccggcgacuccuccguccuccagcaggaguccaacuuccucggcaacaaccacuccgaggagugccaggucggcggccucgucgccuucgagccccacgcccucgagggcgagggcccccagaaccccgaggagaccgacgagaaggucgaggagcccgagcagcagaacaaguccuccgccgucggcccccccgagaagguccgccgcuucacccucgaccgccucaagcagcucggcgucgacgucuccaucaagccccgccucggcgccgacgaggacuccuucgucauccucgagcccgagaccaaccgcgagcucgaggcccucaagcagcgcuucuggaagcacgccaaccccgccgccaagccccgcgccggccagaccgucaacgucaacgucaucgucaaggacaugggcaccgacggcaaggaggagcucaaggccgacgucguccccgucacccucgcccccaagaagcucgacggcgccucccacaccaagcccggcgagaagcuccagguccucaaggccaagcuccaggaggccaugaagcuccgccgcuucgaggagcgccagaagcgccaggcccucuucaagcucgacaacgaggacggcuucgaggaggaggaggaggaggaggaggagaugaccgacgaguccgaggaggacggcgaggagaaggucgagaaggaggagaaggaggaggagcucgaggaggaggaggagaaggaggaggaggaggaggaggagggcaaccaggagaccgccgaguuccuccucuccuccgaggagaucgagaccaaggacgagaaggagauggacaaggagaacaacgacggcuccuccgagaucggcaaggccgucggcuuccucuccguccccaagucccucuccuccgacuccacccuccuccucuucaaggacuccuccuccaagaugggcuacuuccccaccgaggagaaguccgagaccgacgagaacuccggcaagcagcccuccaagcucgacgaggacgacuccugcucccuccucaccaaggaguccucccacaacuccuccuucgagcucaucggcuccaccauccccuccuaccagcccugcaaccgccagaccggccgcggcaccuccuucuuccccaccgccggcggcuuccgcucccccucccccggccucuuccgcgccucccucgucuccuccgccuccaaguccuccggcaagcucuccgagcccucccuccccaucgaggacucccaggaccucuacaacgccucccccgagcccaagacccucuuccucggcgccggcgacuuccaguucugccucgaggacgacacccagucccagcuccucgacgccgacggcuuccucaacguccgcaaccaccgcaaccaguaccaggcccucaagccccgccucccccucgccuccauggacgagaacgccauggacgccaacauggacgagcuccucgaccucugcaccggcaaguucaccucccaggccgagaagcaccucccccgcaaguccgacaagaaggagaacauggaggagcuccucaaccucugcuccggcaaguucaccucccaggacgccuccacccccgccuccuccgagcucaacaagcaggagaaggaguccuccaugggcgaccccauggaggaggcccucgcccucugcuccggcuccuuccccaccgacaaggaggaggaggacgaggaggaggaguucggcgacuuccgccucgucuccaacgacaacgaguucgacuccgacgaggacgagcacuccgacuccggcaacgaccucgcccucgaggaccacgaggacgacgacgaggaggagcuccucaagcgcuccgagaagcucaagcgccagaugcgccuccgcaaguaccucgaggacgaggccgaggucuccggcuccgacgucggcuccgaggacgaguacgacggcgaggagaucgacgaguacgaggaggacgucaucgacgagguccuccccuccgacgaggagcuccagucccagaucaagaagauccacaugaagaccaugcucgacgacgacaagcgccagcuccgccucuaccaggagcgcuaccucgccgacggcgaccuccacuccgacggccccggccgcaugcgcaaguuccgcuggaagaacaucgacgacgccucccagauggaccucuuccaccgcgacuccgacgacgaccagaccgaggagcagcucgacgaguccgaggcccgcuggcgcaaggagcgcaucgagcgcgagcaguggcuccgcgacauggcccagcagggcaagaucaccgccgaggaggaggaggagaucggcgaggacucccaguucaugauccucgccaagaaggucaccgccaaggcccuccagaagaacgccucccgccccauggucauccaggaguccaagucccuccuccgcaaccccuucgaggccauccgccccggcuccgcccagcaggucaagaccggcucccuccucaaccagcccaaggccguccuccagaagcucgccgcccucuccgaccacaaccccuccgccccccgcaacucccgcaacuucgucuuccacacccucucccccgucaaggccgaggccgccaaggaguccuccaagucccagaagauccccgagaaggacuccgacuggcucaccugguccggcgcccccauccccggcuucuuccgccucuccuucgacccccacggcuga

SEQ ID NO: 41475 - RNA, 2889 nt, Artificial Sequence
  derived and/or modified sequence opt2 from CLSTN1__Homo_sapiens__NP_001289812
augcuccgccgccccgcccccgcccucgcccccgccgcccgccuccuccucgccggccuccucugcggcggcggcgucugggccgcccgcgucaacaagcacaagcccuggcucgagcccaccuaccacggcaucgucaccgagaacgacaacaccguccuccucgaccccccccucaucgcccucgacaaggacgccccccuccgcuucgccgaguccuucgaggucaccgucaccaaggagggcgagaucugcggcuucaagauccacggccagaacguccccuucgacgccgucgucgucgacaaguccaccggcgagggcgucauccgcuccaaggagaagcucgacugcgagcuccagaaggacuacuccuucaccauccaggccuacgacugcggcaagggccccgacggcaccaacgucaagaagucccacaaggccaccguccacauccaggucaacgacgucaacgaguacgcccccgucuucaaggagaaguccuacaaggccaccgucaucgagggcaagcaguacgacuccauccuccgcgucgaggccgucgacgccgacugcuccccccaguucucccagaucugcuccuacgagaucaucacccccgacguccccuucaccgucgacaaggacggcuacaucaagaacaccgagaagcucaacuacggcaaggagcaccaguacaagcucaccgucaccgccuacgacugcggcaagaagcgcgccaccgaggacguccucgucaagaucuccaucaagcccaccugcacccccggcuggcagggcuggaacaaccgcaucgaguacgagcccggcaccggcgcccucgccgucuuccccaacauccaccucgagaccugcgacgagcccgucgccuccguccaggccaccgucgagcucgagaccucccacaucggcaagggcugcgaccgcgacaccuacuccgagaagucccuccaccgccucugcggcgccgccgccggcaccgccgagcuccuccccucccccuccggcucccucaacuggaccaugggccuccccaccgacaacggccacgacuccgaccaggucuucgaguucaacggcacccaggccguccgcauccccgacggcgucgucuccgucucccccaaggagcccuucaccaucuccgucuggaugcgccacggccccuucggccgcaagaaggagaccauccucugcuccuccgacaagaccgacaugaaccgccaccacuacucccucuacguccacggcugccgccucaucuuccucuuccgccaggaccccuccgaggagaagaaguaccgccccgccgaguuccacuggaagcucaaccaggucugcgacgaggaguggcaccacuacguccucaacgucgaguuccccuccgucacccucuacgucgacggcaccucccacgagcccuucuccgucaccgaggacuacccccuccaccccuccaagaucgagacccagcucgucgucggcgccugcuggcagggcggcgaccuccacaugacccaguucuuccgcggcaaccucgccggccucacccuccgcuccggcaagcucgccgacaagaaggucaucgacugccucuacaccugcaaggagggccucgaccuccagguccucgaggacuccggccgcggcguccagauccaggcccaccccucccagcucguccucacccucgagggcgaggaccucggcgagcucgacaaggccaugcagcacaucuccuaccucaacucccgccaguuccccacccccggcauccgccgccucaagaucaccuccaccaucaagugcuucaacgaggccaccugcaucuccgucccccccgucgacggcuacgucaugguccuccagcccgaggagcccaagaucucccucuccggcguccaccacuucgcccgcgccgccuccgaguucgaguccuccgagggcgucuuccucuuccccgagcuccgcaucaucuccaccaucacccgcgaggucgagcccgagggcgacggcgccgaggaccccaccguccaggagucccucgucuccgaggagaucguccacgaccucgacaccugcgaggucaccgucgagggcgaggagcucaaccacgagcaggagucccucgaggucgacauggcccgccuccagcagaagggcaucgaggucuccuccuccgagcucggcaugaccuucaccggcgucgacaccauggccuccuacgaggagguccuccaccuccuccgcuaccgcaacuggcacgcccgcucccuccucgaccgcaaguucaagcucaucugcuccgagcucaacggccgcuacaucuccaacgaguucaaggucgaggucaacgucauccacaccgccaaccccauggagcacgccaaccacauggccgcccagccccaguucguccaccccgagcaccgcuccuucgucgaccucuccggccacaaccucgccaacccccaccccuucgccgucguccccuccaccgccaccgucgucaucgucgucugcgucuccuuccucgucuucaugaucauccucggcgucuuccgcauccgcgccgcccaccgccgcaccaugcgcgaccaggacaccggcaaggagaacgagauggacugggacgacuccgcccucaccaucaccgucaaccccauggagaccuacgaggaccagcacuccuccgaggaggaggaggaggaggaggaggaggaggaguccgaggacggcgaggaggaggacgacaucaccuccgccgaguccgaguccuccgaggaggaggagggcgagcagggcgacccccagaacgccacccgccagcagcagcucgagugggacgacuccacccucuccuacuga

SEQ ID NO: 41476 - RNA, 2868 nt, Artificial Sequence
  derived and/or modified sequence opt2 from CLSTN2__Homo_sapiens__NP_071414
augcuccccggccgccucugcugggucccccuccuccucgcccucggcgucggcuccggcuccggcggcggcggcgacucccgccagcgccgccuccucgccgccaaggucaacaagcacaagcccuggaucgagaccuccuaccacggcgucaucaccgagaacaacgacaccgucauccucgaccccccccucgucgcccucgacaaggacgcccccguccccuucgccggcgagaucugcgccuucaagauccacggccaggagcuccccuucgaggccgucguccucaacaagaccuccggcgagggccgccuccgcgccaagucccccaucgacugcgagcuccagaaggaguacaccuucaucauccaggccuacgacugcggcgccggcccccacgagaccgccuggaagaagucccacaaggccgucguccacauccaggucaaggacgucaacgaguucgcccccaccuucaaggagcccgccuacaaggccgucgucaccgagggcaagaucuacgacuccauccuccaggucgaggccaucgacgaggacugcuccccccaguacucccagaucugcaacuacgagaucgucaccaccgacguccccuucgccaucgaccgcaacggcaacauccgcaacaccgagaagcucuccuacgacaagcagcaccaguacgagauccucgucaccgccuacgacugcggccagaagcccgccgcccaggacacccucguccaggucgacgucaagcccgucugcaagcccggcuggcaggacuggaccaagcgcaucgaguaccagcccggcuccggcuccaugccccucuuccccuccauccaccucgagaccugcgacggcgccgucuccucccuccagaucgucaccgagcuccagaccaacuacaucggcaagggcugcgaccgcgagaccuacuccgagaagucccuccagaagcucugcggcgccuccuccggcaucaucgaccuccuccccucccccuccgccgccaccaacuggaccgccggccuccucgucgacuccuccgagaugaucuucaaguucgacggccgccagggcgccaagguccccgacggcaucguccccaagaaccucaccgaccaguucaccaucaccauguggaugaagcacggccccucccccggcguccgcgccgagaaggagaccauccucugcaacuccgacaagaccgagaugaaccgccaccacuacgcccucuacguccacaacugccgccucgucuuccuccuccgcaaggacuucgaccaggccgacaccuuccgccccgccgaguuccacuggaagcucgaccagaucugcgacaaggaguggcacuacuacgucaucaacgucgaguuccccgucgucacccucuacauggacggcgccaccuacgagcccuaccucgucaccaacgacuggcccauccaccccucccacaucgccaugcagcucaccgucggcgccugcuggcagggcggcgaggucaccaagccccaguucgcccaguucuuccacggcucccucgccucccucaccauccgccccggcaagauggagucccagaaggucaucuccugccuccaggccugcaaggagggccucgacaucaacucccucgagucccucggccagggcaucaaguaccacuucaaccccucccaguccauccucgucauggagggcgacgacaucggcaacaucaaccgcgcccuccagaaggucuccuacaucaacucccgccaguuccccaccgccggcguccgccgccucaaggucuccuccaagguccagugcuucggcgaggacgucugcaucuccauccccgaggucgacgccuacgucaugguccuccaggccaucgagccccgcaucacccuccgcggcaccgaccacuucuggcgccccgccgcccaguucgaguccgcccgcggcgucacccucuuccccgacaucaagaucgucuccaccuucgccaagaccgaggcccccggcgacgucaagaccaccgaccccaaguccgagguccucgaggagaugcuccacaaccucgacuucugcgacauccucgucaucggcggcgaccucgacccccgccaggagugccucgagcucaaccacuccgagcuccaccagcgccaccucgacgccaccaacuccaccgccggcuacuccaucuacggcgucggcuccaugucccgcuacgagcagguccuccaccacauccgcuaccgcaacuggcgccccgccucccucgaggcccgccgcuuccgcaucaagugcuccgagcucaacggccgcuacaccuccaacgaguucaaccucgaggucuccauccuccacgaggaccaggucuccgacaaggagcacgucaaccaccucaucguccagccccccuuccuccaguccguccaccaccccgagucccgcuccuccauccagcacuccuccgucguccccuccaucgccaccgucgucaucaucaucuccgucugcaugcucgucuucgucgucgccaugggcgucuaccgcguccgcaucgcccaccagcacuucauccaggagaccgaggccgccaaggaguccgagauggacugggacgacuccgcccucaccaucaccgucaaccccauggagaagcacgagggccccggccacggcgaggacgagaccgagggcgaggaggaggaggaggccgaggaggagauguccuccuccuccggcuccgacgacuccgaggaggaggaggaggaggagggcaugggccgcggccgccacggccagaacggcgcccgccaggcccagcucgagugggacgacuccacccuccccuacuga

SEQ ID NO: 41477 - RNA, 711 nt, Artificial Sequence
  derived and/or modified sequence opt2 from CLTA__Homo_sapiens__NP_001070145
auggccgagcucgaccccuucggcgcccccgccggcgcccccggcggccccgcccucggcaacggcgucgccggcgccggcgaggaggaccccgccgccgccuuccucgcccagcaggaguccgagaucgccggcaucgagaacgacgaggccuucgccauccucgacggcggcgcccccggcccccagccccacggcgagccccccggcggccccgacgccgucgacggcgucaugaacggcgaguacuaccaggaguccaacggccccaccgacuccuacgccgccaucucccaggucgaccgccuccaguccgagcccgaguccauccgcaaguggcgcgaggagcagauggagcgccucgaggcccucgacgccaacucccgcaagcaggaggccgaguggaaggagaaggccaucaaggagcucgaggagugguacgcccgccaggacgagcagcuccagaagaccaaggccaacaaccgcgucgccgacgaggccuucuacaagcagcccuucgccgacgucaucggcuacgucgccgccgaggaggccuucgucaacgacaucgacgaguccucccccggcaccgagugggagcgcgucgcccgccucugcgacuucaaccccaaguccuccaagcaggccaaggacgucucccgcaugcgcuccguccucaucucccucaagcaggccccccucguccacuga

SEQ ID NO: 41478 - RNA, 5028 nt, Artificial Sequence
  derived and/or modified sequence opt2 from CLTC__Homo_sapiens__NP_004850
auggcccagauccuccccauccgcuuccaggagcaccuccagcuccagaaccucggcaucaaccccgccaacaucggcuucuccacccucaccauggaguccgacaaguucaucugcauccgcgagaaggucggcgagcaggcccaggucgucaucaucgacaugaacgaccccuccaaccccauccgccgccccaucuccgccgacuccgccaucaugaaccccgccuccaaggucaucgcccucaaggccggcaagacccuccagaucuucaacaucgagaugaaguccaagaugaaggcccacaccaugaccgacgacgucaccuucuggaaguggaucucccucaacaccgucgcccucgucaccgacaacgccgucuaccacugguccauggagggcgagucccagcccgucaagauguucgaccgccacuccucccucgccggcugccagaucaucaacuaccgcaccgacgccaagcagaaguggcuccuccucaccggcaucuccgcccagcagaaccgcgucgucggcgccaugcagcucuacuccgucgaccgcaaggucucccagcccaucgagggccacgccgccuccuucgcccaguucaagauggagggcaacgccgaggaguccacccucuucugcuucgccguccgcggccaggccggcggcaagcuccacaucaucgaggucggcaccccccccaccggcaaccagcccuuccccaagaaggccgucgacgucuucuucccccccgaggcccagaacgacuuccccgucgccaugcagaucuccgagaagcacgacgucgucuuccucaucaccaaguacggcuacauccaccucuacgaccucgagaccggcaccugcaucuacaugaaccgcaucuccggcgagaccaucuucgucaccgccccccacgaggccaccgccggcaucaucggcgucaaccgcaagggccagguccucuccgucugcgucgaggaggagaacaucauccccuacaucaccaacguccuccagaaccccgaccucgcccuccgcauggccguccgcaacaaccucgccggcgccgaggagcucuucgcccgcaaguucaacgcccucuucgcccagggcaacuacuccgaggccgccaaggucgccgccaacgcccccaagggcauccuccgcacccccgacaccauccgccgcuuccaguccguccccgcccagcccggccagaccuccccccuccuccaguacuucggcauccuccucgaccagggccagcucaacaaguacgagucccucgagcucugccgccccguccuccagcagggccgcaagcagcuccucgagaaguggcucaaggaggacaagcucgagugcuccgaggagcucggcgaccucgucaaguccgucgaccccacccucgcccucuccgucuaccuccgcgccaacguccccaacaaggucauccagugcuucgccgagaccggccagguccagaagaucguccucuacgccaagaaggucggcuacacccccgacuggaucuuccuccuccgcaacgucaugcgcaucucccccgaccagggccagcaguucgcccagaugcucguccaggacgaggagccccucgccgacaucacccagaucgucgacgucuucauggaguacaaccucauccagcagugcaccgccuuccuccucgacgcccucaagaacaaccgccccuccgagggcccccuccagacccgccuccucgagaugaaccucaugcacgccccccaggucgccgacgccauccucggcaaccagauguucacccacuacgaccgcgcccacaucgcccagcucugcgagaaggccggccuccuccagcgcgcccucgagcacuucaccgaccucuacgacaucaagcgcgccgucguccacacccaccuccucaaccccgaguggcucgucaacuacuucggcucccucuccgucgaggacucccucgagugccuccgcgccaugcucuccgccaacauccgccagaaccuccagaucugcguccaggucgccuccaaguaccacgagcagcucuccacccagucccucaucgagcucuucgaguccuucaaguccuucgagggccucuucuacuuccucggcuccaucgucaacuucucccaggaccccgacguccacuucaaguacauccaggccgccugcaagaccggccagaucaaggaggucgagcgcaucugccgcgaguccaacugcuacgaccccgagcgcgucaagaacuuccucaaggaggccaagcucaccgaccagcucccccucaucaucgucugcgaccgcuucgacuucguccacgaccucguccucuaccucuaccgcaacaaccuccagaaguacaucgagaucuacguccagaaggucaaccccucccgccuccccgucgucaucggcggccuccucgacgucgacugcuccgaggacgucaucaagaaccucauccucgucguccgcggccaguucuccaccgacgagcucgucgccgaggucgagaagcgcaaccgccucaagcuccuccuccccuggcucgaggcccgcauccacgagggcugcgaggagcccgccacccacaacgcccucgccaagaucuacaucgacuccaacaacaaccccgagcgcuuccuccgcgagaaccccuacuacgacucccgcgucgucggcaaguacugcgagaagcgcgacccccaccucgccugcgucgccuacgagcgcggccagugcgaccucgagcucaucaacgucugcaacgagaacucccucuucaagucccucucccgcuaccucguccgccgcaaggaccccgagcucuggggcuccguccuccucgaguccaaccccuaccgccgcccccucaucgaccaggucguccagaccgcccucuccgagacccaggaccccgaggaggucuccgucaccgucaaggccuucaugaccgccgaccuccccaacgagcucaucgagcuccucgagaagaucguccucgacaacuccgucuucuccgagcaccgcaaccuccagaaccuccucauccucaccgccaucaaggccgaccgcacccgcgucauggaguacaucaaccgccucgacaacuacgacgcccccgacaucgccaacaucgccaucuccaacgagcucuucgaggaggccuucgccaucuuccgcaaguucgacgucaacaccuccgccguccagguccucaucgagcacaucggcaaccucgaccgcgccuacgaguucgccgagcgcugcaacgagcccgccgucuggucccagcucgccaaggcccagcuccagaagggcauggucaaggaggccaucgacuccuacaucaaggccgacgaccccuccuccuacauggaggucguccaggccgccaacaccuccggcaacugggaggagcucgucaaguaccuccagauggcccgcaagaaggcccgcgaguccuacgucgagaccgagcucaucuucgcccucgccaagaccaaccgccucgccgagcucgaggaguucaucaacggccccaacaacgcccacauccagcaggucggcgaccgcugcuacgacgagaagauguacgacgccgccaagcuccucuacaacaacgucuccaacuucggccgccucgccuccacccucguccaccucggcgaguaccaggccgccgucgacggcgcccgcaaggccaacuccacccgcaccuggaaggaggucugcuucgccugcgucgacggcaaggaguuccgccucgcccagaugugcggccuccacaucgucguccacgccgacgagcucgaggagcucaucaacuacuaccaggaccgcggcuacuucgaggagcucaucaccaugcucgaggccgcccucggccucgagcgcgcccacaugggcauguucaccgagcucgccauccucuacuccaaguucaagccccagaagaugcgcgagcaccucgagcucuucuggucccgcgucaacauccccaagguccuccgcgccgccgagcaggcccaccucugggccgagcucgucuuccucuacgacaaguacgaggaguacgacaacgccaucaucaccaugaugaaccaccccaccgacgccuggaaggagggccaguucaaggacaucaucaccaaggucgccaacgucgagcucuacuaccgcgccauccaguucuaccucgaguucaagccccuccuccucaacgaccuccucaugguccucuccccccgccucgaccacacccgcgccgucaacuacuucuccaaggucaagcagcucccccucgucaagcccuaccuccgcuccguccagaaccacaacaacaaguccgucaacgagucccucaacaaccucuucaucaccgaggaggacuaccaggcccuccgcaccuccaucgacgccuacgacaacuucgacaacaucucccucgcccagcgccucgagaagcacgagcucaucgaguuccgccgcaucgccgccuaccucuucaagggcaacaaccgcuggaagcaguccgucgagcucugcaagaaggacucccucuacaaggacgccaugcaguacgccuccgaguccaaggacaccgagcucgccgaggagcuccuccagugguuccuccaggaggagaagcgcgagugcuucggcgccugccucuucaccugcuacgaccuccuccgccccgacgucguccucgagaccgccuggcgccacaacaucauggacuucgccaugcccuacuucauccaggucaugaaggaguaccucaccaaggucgacaagcucgacgccuccgagucccuccgcaaggaggaggagcaggccaccgagacccagcccaucgucuacggccagccccagcucaugcucaccgccggccccuccgucgccguccccccccaggcccccuucggcuacggcuacaccgccccccccuacggccagccccagcccggcuucggcuacuccauguga

SEQ ID NO: 41479 - RNA, 4752 nt, Artificial Sequence
  derived and/or modified sequence opt2 from CLTCL1__Homo_sapiens__NP_001826
auggcccagauccuccccguccgcuuccaggagcacuuccagcuccagaaccucggcaucaaccccgccaacaucggcuucuccacccucaccauggaguccgacaaguucaucugcauccgcgagaaggucggcgagcaggcccaggucaccaucaucgacauguccgaccccauggcccccauccgccgccccaucuccgccgaguccgccaucaugaaccccgccuccaaggucaucgcccucaaggccggcaagacccuccagaucuucaacaucgagaugaaguccaagaugaaggcccacaccauggccgaggaggucaucuucuggaagugggucuccgucaacaccgucgcccucgucaccgagaccgccgucuaccacugguccauggagggcgacucccagcccaugaagauguucgaccgccacaccucccucgucggcugccaggucauccacuaccgcaccgacgaguaccagaaguggcuccuccucgucggcaucuccgcccagcagaaccgcgucgucggcgccaugcagcucuacuccgucgaccgcaaggucucccagcccaucgagggccacgccgccgccuucgccgaguucaagauggagggcaacgccaagcccgccacccucuucugcuucgccguccgcaaccccaccggcggcaagcuccacaucaucgaggucggccagcccgccgccggcaaccagcccuucgucaagaaggccgucgacgucuucuucccccccgaggcccagaacgacuuccccgucgccaugcagaucggcgccaagcacggcgucaucuaccucaucaccaaguacggcuaccuccaccucuacgaccucgaguccggcgucugcaucugcaugaaccgcaucuccgccgacaccaucuucgucaccgccccccacaagcccaccuccggcaucaucggcgucaacaagaagggccagguccucuccgucugcgucgaggaggacaacaucgucaacuacgccaccaacguccuccagaaccccgaccucggccuccgccucgccguccgcuccaaccucgccggcgccgagaagcucuucguccgcaaguucaacacccucuucgcccagggcuccuacgccgaggccgccaaggucgccgccuccgcccccaagggcauccuccgcacccgcgagaccguccagaaguuccaguccauccccgcccaguccggccaggccuccccccuccuccaguacuucggcauccuccucgaccagggccagcucaacaagcucgagucccucgagcucugccaccucguccuccagcagggccgcaagcagcuccucgagaaguggcucaaggaggacaagcucgagugcuccgaggagcucggcgaccucgucaagaccaccgaccccaugcucgcccucuccgucuaccuccgcgccaacguccccuccaaggucauccagugcuucgccgagaccggccaguuccagaagaucguccucuacgccaagaaggucggcuacacccccgacuggaucuuccuccuccgcggcgucaugaagaucucccccgagcagggccuccaguucucccgcaugcucguccaggacgaggagccccucgccaacaucucccagaucgucgacaucuucauggagaacucccucauccagcagugcaccuccuuccuccucgacgcccucaagaacaaccgccccgccgagggccuccuccagaccuggcuccucgagaugaaccucguccacgccccccaggucgccgacgccauccucggcaacaagauguucacccacuacgaccgcgcccacaucgcccagcucugcgagaaggccggccuccuccagcaggcccucgagcacuacaccgaccucuacgacaucaagcgcgccgucguccacacccaccuccucaaccccgaguggcucgucaacuucuucggcucccucuccgucgaggacuccgucgagugccuccacgccaugcucuccgccaacauccgccagaaccuccagcucugcguccaggucgccuccaaguaccacgagcagcucggcacccaggcccucgucgagcucuucgaguccuucaaguccuacaagggccucuucuacuuccucggcuccaucgucaacuucucccaggaccccgacguccaccucaaguacauccaggccgccugcaagaccggccagaucaaggaggucgagcgcaucugccgcgaguccuccugcuacaaccccgagcgcgucaagaacuuccucaaggaggccaagcucaccgaccagcucccccucaucaucgucugcgaccgcuucggcuucguccacgaccucguccucuaccucuaccgcaacaaccuccagcgcuacaucgagaucuacguccagaaggucaaccccucccgcacccccgccgucaucggcggccuccucgacgucgacugcuccgaggaggucaucaagcaccucaucauggccguccgcggccaguucuccaccgacgagcucgucgccgaggucgagaagcgcaaccgccucaagcuccuccuccccuggcucgagucccagauccaggagggcugcgaggagcccgccacccacaacgcccucgccaagaucuacaucgacuccaacaacucccccgagugcuuccuccgcgagaacgccuacuacgacuccuccgucgucggccgcuacugcgagaagcgcgacccccaccucgccugcgucgccuacgagcgcggccagugcgaccucgagcucaucaaggucugcaacgagaacucccucuucaaguccgaggcccgcuaccucgucugccgcaaggaccccgagcucugggcccacguccucgaggagaccaaccccucccgccgccagcucaucgaccaggucguccagaccgcccucuccgagacccgcgaccccgaggagaucuccgucaccgucaaggccuucaugaccgccgaccuccccaacgagcucaucgagcuccucgagaagaucguccucgacaacuccgucuucuccgagcaccgcaaccuccagaaccuccucauccucaccgccaucaaggccgaccgcacccgcgucauggaguacaucucccgccucgacaacuacgacgcccucgacaucgccuccaucgccgucuccuccgcccucuacgaggaggccuucaccgucuuccacaaguucgacaugaacgccuccgccauccagguccucaucgagcacaucggcaaccucgaccgcgccuacgaguucgccgagcgcugcaacgagcccgccgucuggucccagcucgcccaggcccagcuccagaaggaccucgucaaggaggccaucaacuccuacauccgcggcgacgaccccuccuccuaccucgaggucguccaguccgccucccgcuccaacaacugggaggaccucgucaaguuccuccagauggcccgcaagaagggccgcgaguccuacaucgagaccgagcucaucuucgcccucgccaagaccucccgcgucuccgagcucgaggacuucaucaacggccccaacaacgcccacauccagcaggucggcgaccgcugcuacgaggagggcauguacgaggccgccaagcuccucuacuccaacgucuccaacuucgcccgccucgccuccacccucguccaccucggcgaguaccaggccgccgucgacaacucccgcaaggccuccuccacccgcaccuggaaggaggucugcuucgccugcauggacggccaggaguuccgcuucgcccagcucugcggccuccacaucgucauccacgccgacgagcucgaggagcucaugugcuacuaccaggaccgcggcuacuucgaggagcucauccuccuccucgaggccgcccucggccucgagcgcgcccacaugggcauguucaccgagcucgccauccucuacuccaaguucaagccccagaagaugcucgagcaccucgagcucuucuggucccgcgucaacauccccaagguccuccgcgccgccgagcaggcccaccucugggccgagcucgucuuccucuacgacaaguacgaggaguacgacaacgccguccucaccaugaugucccaccccaccgaggccuggaaggagggccaguucaaggacaucaucaccaaggucgccaacgucgagcucugcuaccgcgcccuccaguucuaccucgacuacaagccccuccucaucaacgaccuccuccucguccucuccccccgccucgaccacaccuggaccgucuccuucuucuccaaggccggccagcucccccucgucaagcccuaccuccgcuccguccagucccacaacaacaaguccgucaacgaggcccucaaccaccuccucaccgaggaggaggacuaccaggacgccaugcagcacgccgccgagucccgcgacgccgagcucgcccagaagcuccuccagugguuccucgaggagggcaagcgcgagugcuucgccgccugccucuucaccugcuacgaccuccuccgccccgacaugguccucgagcucgccuggcgccacaaccucgucgaccucgccaugcccuacuucauccaggucaugcgcgaguaccucuccaaggucgacaagcucgacgcccucgagucccuccgcaagcaggaggagcacgucaccgagcccgccccccucgucuucgacuucgacggccacgaguga

SEQ ID NO: 41480 - RNA, 1242 nt, Artificial Sequence
  derived and/or modified sequence opt2 from CLUAP1__Homo_sapiens__NP_055856
auguccuuccgcgaccuccgcaacuucaccgagaugaugcgcgcccucggcuacccccgccacaucuccauggagaacuuccgcacccccaacuucggccucgucuccgagguccuccucuggcucgucaagcgcuacgagccccagaccgacaucccccccgacgucgacaccgagcaggaccgcgucuucuucaucaaggccaucgcccaguucauggccaccaaggcccacaucaagcucaacaccaagaagcucuaccaggccgacggcuacgccgucaaggagcuccucaagaucaccuccguccucuacaacgccaugaagaccaagggcauggagggcuccgagaucgucgaggaggacgucaacaaguucaaguucgaccucggcuccaagaucgccgaccucaaggccgcccgccagcucgccuccgagaucaccuccaagggcgccucccucuacgaccuccucggcauggaggucgagcuccgcgagaugcgcaccgaggccaucgcccgcccccucgagaucaacgagaccgagaaggucaugcgcaucgccaucaaggagauccucacccagguccagaagaccaaggaccuccucaacaacgucgccuccgacgaggccaaccucgaggccaagaucgagaagcgcaagcucgagcucgagcgcaaccgcaagcgccucgagacccuccaguccguccgccccugcuucauggacgaguacgagaagaccgaggaggagcuccagaagcaguacgacaccuaccucgagaaguuccagaaccucaccuaccucgagcagcagcucgaggaccaccaccgcauggagcaggagcgcuucgaggaggccaagaacacccucugccucauccagaacaagcucaaggaggaggagaagcgccuccucaaguccggcuccaacgacgacuccgacaucgacauccaggaggacgacgaguccgacuccgagcucgaggagcgccgccuccccaagccccagaccgccauggagaugcucaugcagggccgccccggcaagcgcaucgucggcaccaugcagggcggcgacuccgacgacaacgaggacuccgaggaguccgagaucgacauggaggacgacgacgacgaggacgacgaccucgaggacgaguccaucucccucucccccaccaagcccaaccgccgcguccgcaaguccgagccccucgacgaguccgacaacgacuucuga

SEQ ID NO: 41481 - RNA, 1350 nt, Artificial Sequence
  derived and/or modified sequence opt2 from CLU__Homo_sapiens__NP_001822
augaugaagacccuccuccucuucgucggccuccuccucaccugggaguccggccagguccucggcgaccagaccgucuccgacaacgagcuccaggagauguccaaccagggcuccaaguacgucaacaaggagauccagaacgccgucaacggcgucaagcagaucaagacccucaucgagaagaccaacgaggagcgcaagacccuccucuccaaccucgaggaggccaagaagaagaaggaggacgcccucaacgagacccgcgaguccgagaccaagcucaaggagcuccccggcgucugcaacgagaccaugauggcccucugggaggagugcaagcccugccucaagcagaccugcaugaaguucuacgcccgcgucugccgcuccggcuccggccucgucggccgccagcucgaggaguuccucaaccaguccucccccuucuacuucuggaugaacggcgaccgcaucgacucccuccucgagaacgaccgccagcagacccacaugcucgacgucaugcaggaccacuucucccgcgccuccuccaucaucgacgagcucuuccaggaccgcuucuucacccgcgagccccaggacaccuaccacuaccuccccuucucccucccccaccgccgcccccacuucuucuuccccaagucccgcaucguccgcucccucaugcccuucucccccuacgagccccucaacuuccacgccauguuccagcccuuccucgagaugauccacgaggcccagcaggccauggacauccacuuccacucccccgccuuccagcacccccccaccgaguucauccgcgagggcgacgacgaccgcaccgucugccgcgagauccgccacaacuccaccggcugccuccgcaugaaggaccagugcgacaagugccgcgagauccucuccgucgacugcuccaccaacaaccccucccaggccaagcuccgccgcgagcucgacgagucccuccaggucgccgagcgccucacccgcaaguacaacgagcuccucaaguccuaccaguggaagaugcucaacaccuccucccuccucgagcagcucaacgagcaguucaacugggucucccgccucgccaaccucacccagggcgaggaccaguacuaccuccgcgucaccaccgucgccucccacaccuccgacuccgacguccccuccggcgucaccgaggucgucgucaagcucuucgacuccgaccccaucaccgucaccguccccgucgaggucucccgcaagaaccccaaguucauggagaccgucgccgagaaggcccuccaggaguaccgcaagaagcaccgcgaggaguga

SEQ ID NO: 41482 - RNA, 1557 nt, Artificial Sequence
  derived and/or modified sequence opt2 from CLUL1__Homo_sapiens__NP_001275965
augcgcaccugggacuaccgcuggucccucgcccucgucgcccagaccggcguccacugcugcaaccucuccucccuccagccccuccccccccgcuucaagcgcuucuccugccucucccucuccuccggcugggacuacuccaacuccggcaacaugaagcccccccuccucgucuucaucgucugccuccucuggcucaaggacucccacugcgcccccaccuggaaggacaagaccgccaucuccgagaaccucaaguccuucuccgaggucggcgagaucgacgccgacgaggaggucaagaaggcccucaccggcaucaagcagaugaagaucaugauggagcgcaaggagaaggagcacaccaaccucauguccacccucaagaagugccgcgaggagaagcaggaggcccucaagcuccucaacgagguccaggagcaccucgaggaggaggagcgccucugccgcgagucccucgccgacuccuggggcgagugccgcuccugccucgagaacaacugcaugcgcaucuacaccaccugccagcccuccugguccuccgucaagaacaagaucgagcgcuucuuccgcaagaucuaccaguuccucuuccccuuccacgaggacaacgagaaggaccuccccaucuccgagaagcucaucgaggaggacgcccagcucacccagauggaggacgucuucucccagcucaccgucgacgucaacucccucuucaaccgcuccuucaacgucuuccgccagaugcagcaggaguucgaccagaccuuccagucccacuucaucuccgacaccgaccucaccgagcccuacuucuuccccgccuucuccaaggagcccaugaccaaggccgaccucgagcagugcugggacauccccaacuucuuccagcucuucugcaacuucuccgucuccaucuacgaguccgucuccgagaccaucaccaagaugcucaaggccaucgaggaccuccccaagcaggacaaggcccccgaccacggcggccucaucuccaagaugcuccccggccaggaccgcggccucugcggcgagcucgaccagaaccucucccgcugcuucaaguuccacgagaagugccagaagugccaggcccaccucuccgaggacugccccgacguccccgcccuccacaccgagcucgacgaggccauccgccucgucaacgucuccaaccagcaguacggccagauccuccagaugacccgcaagcaccucgaggacaccgccuaccucgucgagaagaugcgcggccaguucggcugggucuccgagcucgccaaccaggcccccgagaccgagaucaucuucaacuccauccaggucgucccccgcauccacgagggcaacaucuccaagcaggacgagaccaugaugaccgaccucuccauccuccccuccuccaacuucacccucaagaucccccucgaggaguccgccgaguccuccaacuucaucggcuacgucgucgccaaggcccuccagcacuucaaggagcacuucaagaccugguga

SEQ ID NO: 41483 - RNA, 1065 nt, Artificial Sequence
  derived and/or modified sequence opt2 from CLVS1__Homo_sapiens__NP_775790
augggccccgucucccuccuccccaaguaccagaagcucaacaccuggaacggcgaccucgccaagaugacccaccuccaggccggccucucccccgagaccaucgagaaggcccgccucgagcucaacgagaaccccgacguccuccaccaggacauccagcagguccgcgacaugaucaucacccgccccgacaucggcuuccuccgcaccgacgacgccuucauccuccgcuuccuccgcgcccgcaaguuccaccaggccgacgccuuccgccuccucgcccaguacuuccaguaccgccagcucaaccucgacauguucaagaacuucaaggccgacgaccccggcaucaagcgcgcccucaucgacggcuuccccggcguccucgagaaccgcgaccacuacggccgcaagauccuccuccucuucgccgccaacugggaccagucccgcaacuccuucaccgacauccuccgcgccauccuccucucccucgagguccucaucgaggaccccgagcuccagaucaacggcuucauccucaucaucgacugguccaacuucuccuucaagcaggccuccaagcucacccccuccauccucaagcucgccaucgagggccuccaggacuccuuccccgcccgcuucggcggcguccacuucgucaaccagcccugguacauccacgcccucuacacccucaucaagcccuuccucaaggacaagacccgcaagcgcaucuuccuccacggcaacaaccucaacucccuccaccagcucauccaccccgaguuccuccccuccgaguucggcggcacccucccccccuacgacaugggcaccugggcccgcacccuccucggccccgacuacuccgacgagaacgacuacacccacaccuccuacaacgccaugcacgucaagcacaccuccuccaaccucgagcgcgagugcucccccaagcucaugaagcgcucccaguccgucgucgaggccggcacccucaagcacgaggagaagggcgagaacgagaacacccagccccuccucgcccucgacuga

SEQ ID NO: 41484 - RNA, 1023 nt, Artificial Sequence
  derived and/or modified sequence opt2 from CLYBL__Homo_sapiens__NP_996531
auggcccuccgccuccuccgccgcgccgcccgcggcgccgccgccgccgcccuccuccgccucaaggccucccucgccgccgacaucccccgccucggcuacuccuccuccucccaccacaaguacaucccccgccgcgccguccucuacguccccggcaacgacgagaagaagaucaagaagauccccucccucaacgucgacugcgccguccucgacugcgaggacggcgucgccgccaacaagaagaacgaggcccgccuccgcaucgucaagacccucgaggacaucgaccucggccccaccgagaagugcguccgcgucaacuccgucuccuccggccucgccgaggaggaccucgagacccuccuccagucccgcguccuccccuccucccucaugcuccccaaggucgagucccccgaggagauccagugguucgccgacaaguucuccuuccaccucaagggccgcaagcucgagcagcccaugaaccucauccccuucgucgagaccgccaugggccuccucaacuucaaggccgucugcgaggagacccucaaggucggcccccaggucggccucuuccucgacgccgucgucuucggcggcgaggacuuccgcgccuccaucggcgccaccuccuccaaggagacccucgacauccucuacgcccgccagaagaucgucgucaucgccaaggccuucggccuccaggccaucgaccucgucuacaucgacuuccgcgacggcgccggccuccuccgccagucccgcgagggcgccgccaugggcuucaccggcaagcaggucauccaccccaaccagaucgccgucguccaggagcaguucucccccucccccgagaagaucaagugggccgaggagcucaucgccgccuucaaggagcaccagcagcucggcaagggcgccuucaccuuccagggcuccaugaucgacaugccccuccucaagcaggcccagaacaccgucacccucgccaccuccaucaaggagaaguga

SEQ ID NO: 41485 - RNA, 744 nt, Artificial Sequence
  derived and/or modified sequence opt2 from CMA1__Homo_sapiens__NP_001827
augcuccuccucccccucccccuccuccucuuccuccucugcucccgcgccgaggccggcgagaucaucggcggcaccgagugcaagccccacucccgccccuacauggccuaccucgagaucgucaccuccaacggccccuccaaguucugcggcggcuuccucauccgccgcaacuucguccucaccgccgcccacugcgccggccgcuccaucaccgucacccucggcgcccacaacaucaccgaggaggaggacaccuggcagaagcucgaggucaucaagcaguuccgccaccccaaguacaacaccuccacccuccaccacgacaucaugcuccucaagcucaaggagaaggccucccucacccucgccgucggcacccuccccuuccccucccaguucaacuucgucccccccggccgcaugugccgcgucgccggcuggggccgcaccggcguccucaagcccggcuccgacacccuccaggaggucaagcuccgccucauggacccccaggccugcucccacuuccgcgacuucgaccacaaccuccagcucugcgucggcaacccccgcaagaccaaguccgccuucaagggcgacuccggcggcccccuccucugcgccggcgucgcccagggcaucgucuccuacggccgcuccgacgccaagccccccgccgucuucacccgcaucucccacuaccgccccuggaucaaccagauccuccaggccaacuga

SEQ ID NO: 41486 - RNA, 1305 nt, Artificial Sequence
  derived and/or modified sequence opt2 from CMAS__Homo_sapiens__NP_061156
auggacuccgucgagaagggcgccgccaccuccgucuccaacccccgcggccgccccucccgcggccgcccccccaagcuccagcgcaacucccgcggcggccagggccgcggcgucgagaagcccccccaccucgccgcccucauccucgcccgcggcggcuccaagggcaucccccucaagaacaucaagcaccucgccggcgucccccucaucggcuggguccuccgcgccgcccucgacuccggcgccuuccaguccgucugggucuccaccgaccacgacgagaucgagaacgucgccaagcaguucggcgcccagguccaccgccgcuccuccgaggucuccaaggacuccuccaccucccucgacgccaucaucgaguuccucaacuaccacaacgaggucgacaucgucggcaacauccaggccaccucccccugccuccaccccaccgaccuccagaaggucgccgagaugauccgcgaggagggcuacgacuccgucuucuccgucguccgccgccaccaguuccgcugguccgagauccagaagggcguccgcgaggucaccgagccccucaaccucaaccccgccaagcgcccccgccgccaggacugggacggcgagcucuacgagaacggcuccuucuacuucgccaagcgccaccucaucgagaugggcuaccuccagggcggcaagauggccuacuacgagaugcgcgccgagcacuccgucgacaucgacgucgacaucgacuggcccaucgccgagcagcgcguccuccgcuacggcuacuucggcaaggagaagcucaaggagaucaagcuccucgucugcaacaucgacggcugccucaccaacggccacaucuacgucuccggcgaccagaaggagaucaucuccuacgacgucaaggacgccaucggcaucucccuccucaagaaguccggcaucgagguccgccucaucuccgagcgcgccugcuccaagcagacccucuccucccucaagcucgacugcaagauggaggucuccgucuccgacaagcucgccgucgucgacgaguggcgcaaggagaugggccucugcuggaaggaggucgccuaccucggcaacgaggucuccgacgaggagugccucaagcgcgucggccucuccggcgcccccgccgacgccugcuccaccgcccagaaggccgucggcuacaucugcaagugcaacggcggccgcggcgccauccgcgaguucgccgagcacaucugccuccucauggagaaggucaacaacuccugccagaaguga

SEQ ID NO: 41487 - RNA, 321 nt, Artificial Sequence
  derived and/or modified sequence opt2 from CMC1__Homo_sapiens__NP_872329
auggcccucgaccccgccgaccagcaccuccgccacgucgagaaggacguccucauccccaagaucaugcgcgagaaggccaaggagcgcugcuccgagcagguccaggacuucaccaagugcugcaagaacuccggcguccucauggucgucaagugccgcaaggagaacuccgcccucaaggagugccucaccgccuacuacaacgaccccgccuucuacgaggagugcaagauggaguaccucaaggagcgcgaggaguuccgcaagaccggcauccccaccaagaagcgccuccagaagcuccccaccuccauguga

SEQ ID NO: 41488 - RNA, 240 nt, Artificial Sequence
  derived and/or modified sequence opt2 from CMC2__Homo_sapiens__NP_064573
augcaccccgaccucuccccccaccuccacaccgaggagugcaacguccucaucaaccuccucaaggagugccacaagaaccacaacauccucaaguucuucggcuacugcaacgacgucgaccgcgagcuccgcaagugccucaagaacgaguacgucgagaaccgcaccaagucccgcgagcacggcaucgccaugcgcaagaagcucuucaacccccccgaggaguccgagaaguga

SEQ ID NO: 41489 - RNA, 207 nt, Artificial Sequence
  derived and/or modified sequence opt2 from CMC4__Homo_sapiens__NP_001018024
augccccagaaggaccccugccagaagcaggccugcgagauccagaagugccuccaggccaacuccuacauggaguccaagugccaggccgucauccaggagcuccgcaagugcugcgcccaguaccccaagggccgcuccgucgucugcuccggcuucgagaaggaggaggaggagaaccucacccgcaaguccgccuccaaguga

SEQ ID NO: 41490 - RNA, 2040 nt, Artificial Sequence
  derived and/or modified sequence opt2 from CMIP__Homo_sapiens__NP_085132
augggccaggccgccgagcccaccggcuacauggagaacuccgucuccuacuccgccaucgaggacguccagcuccucuccugggagaacgcccccaaguacugccuccagcucaccauccccggcggcaccguccuccuccaggccgccaacuccuaccuccgcgaccagugguuccacucccuccaguggaagaagaagaucuacaaguacaagaagguccucuccaaccccucccgcugggaggucguccucaaggagauccgcacccucgucgacauggcccucaccuccccccuccaggacgacuccaucaaccaggccccccucgagaucgucuccaagcuccucuccgagaacaccaaccucaccacccaggagcacgagaacaucaucgucgccaucgccccccuccucgagaacaaccaccccccccccgaccucugcgaguucuucugcaagcacugccgcgagcgcccccgcuccauggucgucaucgaggucuucacccccgucguccagcgcauccucaagcacaacauggacuucggcaagugcccccgccuccgccucuucacccaggaguacauccucgcccucaacgagcucaacgccggcauggaggucgucaagaaguucauccaguccaugcacggccccaccggccacugcccccacccccgcguccuccccaaccucgucgccgucugccucgccgccaucuacuccugcuacgaggaguucaucaacucccgcgacaacucccccucccucaaggagauccgcaacggcugccagcagcccugcgaccgcaagcccacccucccccuccgccuccuccaccccucccccgaccucgucucccaggaggccacccucuccgaggcccgccucaaguccgucgucgucgccuccuccgagauccacgucgaggucgagcgcaccuccaccgccaagcccgcccucaccgccuccgccggcaacgacuccgagcccaaccucaucgacugccucauggucucccccgccugcuccaccauguccaucgagcucggcccccaggccgaccgcacccucggcugcuacgucgagauccucaagcuccucuccgacuacgacgacuggcgccccucccucgccucccuccuccagcccauccccuuccccaaggaggcccucgcccacgagaaguucaccaaggagcucaaguacgucauccagcgcuucgccgaggacccccgccaggagguccacuccugccuccucuccguccgcgccggcaaggacggcugguuccagcucuacucccccggcggcgucgccugcgacgacgacggcgagcucuucgccuccaugguccacauccucaugggcuccugcuacaagaccaagaaguuccuccucucccucgccgagaacaagcucggccccugcaugcuccucgcccuccgcggcaaccagaccauggucgagauccucugccucaugcucgaguacaacaucaucgacaacaacgacacccagcuccagaucaucuccacccucgaguccaccgacgucggcaagcgcauguacgagcagcucugcgaccgccagcgcgagcucaaggagcuccagcgcaagggcggccccacccgccucacccuccccuccaaguccaccgacgccgaccucgcccgccuccucuccuccggcuccuucggcaaccucgagaaccucucccucgccuucaccaacgucaccuccgccugcgccgagcaccucaucaagcuccccucccucaagcagcucaaccucugguccacccaguucggcgacgccggccuccgccuccucuccgagcaccucaccaugcuccagguccucaaccucugcgagacccccgucaccgacgccggccuccucgcccucuccuccaugaagucccucugcucccucaacaugaacuccaccaagcucuccgccgacaccuacgaggaccucaaggccaagcuccccaaccucaaggaggucgacguccgcuacaccgaggccugguga

SEQ ID NO: 41491 - RNA, 1122 nt, Artificial Sequence
  derived and/or modified sequence opt2 from CMKLR1__Homo_sapiens__NP_001135815
augcgcauggaggacgaggacuacaacaccuccaucuccuacggcgacgaguaccccgacuaccucgacuccaucgucguccucgaggaccucuccccccucgaggcccgcgucacccgcaucuuccucgucgucgucuacuccaucgucugcuuccucggcauccucggcaacggccucgucaucaucaucgccaccuucaagaugaagaagaccgucaacauggucugguuccucaaccucgccgucgccgacuuccucuucaacgucuuccuccccauccacaucaccuacgccgccauggacuaccacugggucuucggcaccgccaugugcaagaucuccaacuuccuccucauccacaacauguucaccuccgucuuccuccucaccaucaucuccuccgaccgcugcaucuccguccuccuccccgucuggucccagaaccaccgcuccguccgccucgccuacauggccugcauggucaucuggguccucgccuucuuccucuccucccccucccucgucuuccgcgacaccgccaaccuccacggcaagaucuccugcuucaacaacuucucccucuccacccccggcuccuccuccuggcccacccacucccagauggaccccgucggcuacucccgccacauggucgucaccgucacccgcuuccucugcggcuuccucguccccguccucaucaucaccgccugcuaccucaccaucgucugcaagcuccagcgcaaccgccucgccaagaccaagaagcccuucaagaucaucgucaccaucaucaucaccuucuuccucugcuggugccccuaccacacccucaaccuccucgagcuccaccacaccgccaugcccggcuccgucuucucccucggccucccccucgccaccgcccucgccaucgccaacuccugcaugaaccccauccucuacgucuucaugggccaggacuucaagaaguucaaggucgcccucuucucccgccucgucaacgcccucuccgaggacaccggccacuccuccuaccccucccaccgcuccuucaccaagauguccuccaugaacgagcgcaccuccaugaacgagcgcgagaccggcaugcucuga

SEQ ID NO: 41492 - RNA, 1230 nt, Artificial Sequence
  derived and/or modified sequence opt2 from CMPK2__Homo_sapiens__NP_001243406
auggccuucgcccgccgccuccuccgcggcccccucuccggcccccuccucggccgccgcggcgucugcgccggcgccauggcccccccccgccgcuucguccucgagcuccccgacugcacccucgcccacuucgcccucggcgccgacgcccccggcgacgccgacgcccccgacccccgccucgccgcccuccucggcccccccgagcgcuccuacucccucugcguccccgucacccccgacgccggcugcggcgcccgcguccgcgccgcccgccuccaccagcgccuccuccaccagcuccgccgcggccccuuccagcgcugccagcuccuccgccuccucugcuacugccccggcggccaggccggcggcgcccagcagggcuuccuccuccgcgacccccucgacgaccccgacacccgccaggcccuccucgagcuccucggcgccugccaggaggccccccgcccccaccucggcgaguucgaggccgacccccgcggccagcucuggcagcgccucugggagguccaggacggccgccgccuccaggucggcugcgcccaggucguccccguccccgagcccccccuccaccccgucguccccgaccuccccuccuccgucgucuuccccgaccgcgaggccgcccgcgccguccucgaggagugcaccuccuucauccccgaggcccgcgccguccucgaccucgucgaccagugccccaagcagauccagaagggcaaguuccaggucgucgccaucgagggccucgacgccaccggcaagaccaccgucacccaguccgucgccgacucccucaaggccguccuccucaaguccccccccuccugcaucggccaguggcgcaagaucuucgacgacgagcccaccaucauccgccgcgccuucuacucccucggcaacuacaucgucgccuccgagaucgccaaggaguccgccaagucccccgucaucgucgaccgcuacuggcacuccaccgccaccuacgccaucgccaccgaggucuccggcggccuccagcaccucccccccgcccaccaccccgucuaccaguggcccgaggaccuccucaagcccgaccucauccuccuccucaccgucucccccgaggagcgccuccagcgccuccagggccgcggcauggagaagacccgcgaggaggccgagcucgaggccaacuccgucuuccgccagaaguga

SEQ ID NO: 41493 - RNA, 786 nt, Artificial Sequence
  derived and/or modified sequence opt2 from CMSS1__Homo_sapiens__NP_001161396
augcacggcgaggccuccgacggcgagggcgagggcgacaccgaggucaugcagcaggagaccguccccguccccguccccuccgagaagaccaagcagcccaaggagugcuuccucauccagcccaaggagcgcaaggagaacaccaccaagacccgcaagcgccgcaagaagaagaucaccgacguccucgccaaguccgagcccaagcccggccuccccgaggaccuccagaagcucaugaaggacuacuacuccucccgccgccucgucaucgagcucgaggagcucaaccuccccgacuccugcuuccucaaggccaacgaccucacccacucccucuccuccuaccucaaggagaucugccccaagugggucaagcuccgcaagaaccacuccgagaagaaguccguccucaugcucaucaucugcuccuccgccguccgcgcccucgagcucauccgcuccaugaccgccuuccgcggcgacggcaaggucaucaagcucuucgccaagcacaucaagguccaggcccaggucaagcuccucgagaagcgcgucguccaccucggcgucggcacccccggccgcaucaaggagcucgucaagcagggcggccucaaccucuccccccucaaguuccucgucuucgacuggaacuggcgcgaccagaagcuccgccgcaugauggacauccccgagauccgcaaggaggucuucgagcuccucgagaugggcguccucucccucugcaaguccgagucccucaagcucggccucuucuga

SEQ ID NO: 41494 - RNA, 549 nt, Artificial Sequence
  derived and/or modified sequence opt2 from CMTM3__Homo_sapiens__NP_853531
auguggccccccgaccccgaccccgaccccgaccccgagcccgccggcggcucccgccccggccccgccguccccggccuccgcgcccuccuccccgcccgcgccuuccucugcucccucaagggccgccuccuccucgccgaguccggccucuccuucaucaccuucaucugcuacgucgccuccuccgccuccgccuuccucaccgccccccuccucgaguuccuccucgcccucuacuuccucuucgccgacgccaugcagcucaacgacaaguggcagggccucugcuggcccaugauggacuuccuccgcugcgucaccgccgcccucaucuacuucgccaucuccaucaccgccaucgccaaguacuccgacggcgccuccaaggccgccggcgucuucggcuucuucgccaccaucgucuucgccaccgacuucuaccucaucuucaacgacgucgccaaguuccucaagcagggcgacuccgccgacgagaccaccgcccacaagaccgaggaggagaacuccgacuccgacuccgacuga

SEQ ID NO: 41495 - RNA, 378 nt, Artificial Sequence
  derived and/or modified sequence opt2 from CMTM5__Homo_sapiens__NP_001032365
augcucuccgcccgcgaccgccgcgaccgccaccccgaggagggcgucgucgccgagcuccagggcuucgccgucgacaaggccuuccucaccucccacaagggcauccuccucgagaccgagcucgcccucacccucaucaucuucaucugcuucaccgccuccaucuccgccuacauggccgccgcccuccucgaguucuucaucacccucgccuuccucuuccucuacgccacccaguacuaccagcgcuucgaccgcaucaacuggcccugccucgucuucggcaucauccucgucuccaucuucgccuacgacgccuucaagaucuaccgcaccgagauggcccccggcgccucccagggcgaccagcaguga

SEQ ID NO: 41496 - RNA, 528 nt, Artificial Sequence
  derived and/or modified sequence opt2 from CMTM7__Homo_sapiens__NP_612419
augucccacggcgccggccucguccgcaccaccugcuccuccggcuccgcccucggccccggcgccggcgccgcccagcccuccgccuccccccucgagggccuccucgaccucuccuacccccgcacccacgccgcccuccucaaggucgcccagauggucacccuccucaucgccuucaucugcguccgcuccucccucuggaccaacuacuccgccuacuccuacuucgaggucgucaccaucugcgaccucaucaugauccucgccuucuaccucguccaccucuuccgcuucuaccgcguccucaccugcaucuccuggccccucuccgagcuccuccacuaccucaucggcacccuccuccuccucaucgccuccaucgucgccgccuccaaguccuacaaccaguccggccucgucgccggcgccaucuucggcuucauggccaccuuccucugcauggccuccaucuggcucuccuacaagaucuccugcgucacccaguccaccgacgccgccgucuga

SEQ ID NO: 41497 - RNA, 522 nt, Artificial Sequence
  derived and/or modified sequence opt2 from CMTM8__Homo_sapiens__NP_849199
auggaggagccccagcgcgcccgcucccacaccgucaccaccaccgccuccuccuucgccgagaacuucuccaccuccuccuccuccuucgccuacgaccgcgaguuccuccgcacccuccccggcuuccucaucgucgccgagaucguccucggccuccucgucuggacccucaucgccggcaccgaguacuuccgcguccccgccuucggcugggucauguucgucgccgucuucuacuggguccucaccgucuucuuccucaucaucuacaucaccaugaccuacacccgcaucccccagguccccuggaccaccgucggccucugcuucaacggcuccgccuucguccucuaccucuccgccgccgucgucgacgccuccuccgucucccccgagcgcgacucccacaacuucaacuccugggccgccuccuccuucuucgccuuccucgucaccaucugcuacgccggcaacaccuacuucuccuucaucgccuggcgcucccgcaccauccaguga

SEQ ID NO: 41498 - RNA, 2508 nt, Artificial Sequence
  derived and/or modified sequence opt2 from CMTR1__Homo_sapiens__NP_055865
augaagcgccgcaccgaccccgagugcaccgcccccaucaagaagcagaagaagcgcgucgccgagcucgcccucucccucuccuccaccuccgacgacgagccccccuccuccgucucccacggcgccaaggccuccaccaccucccucuccggcuccgacuccgagaccgagggcaagcagcacuccuccgacuccuucgacgacgccuucaaggccgacucccucgucgagggcaccuccucccgcuacuccauguacaacuccgucucccagaagcucauggccaagaugggcuuccgcgagggcgagggccucggcaaguacucccagggccgcaaggacaucgucgaggccuccucccagaagggccgccgcggccucggccucacccuccgcggcuucgaccaggagcucaacgucgacuggcgcgacgagcccgagcccuccgccugcgagcaggucuccugguuccccgagugcaccaccgagauccccgacacccaggagauguccgacuggauggucgucggcaagcgcaagaugaucaucgaggacgagaccgaguucugcggcgaggagcuccuccacuccguccuccagugcaaguccgucuucgacguccucgacggcgaggagaugcgccgcgcccgcacccgcgccaaccccuacgagaugauccgcggcgucuucuuccucaaccgcgccgccaugaagauggccaacauggacuucgucuucgaccgcauguucaccaacccccgcgacuccuacggcaagccccucgucaaggaccgcgaggccgagcuccucuacuucgccgacgucugcgccggccccggcggcuucuccgaguacguccucuggcgcaagaaguggcacgccaagggcuucggcaugacccucaagggccccaacgacuucaagcucgaggacuucuacuccgccuccuccgagcucuucgagcccuacuacggcgagggcggcaucgacggcgacggcgacaucacccgccccgagaacaucuccgccuuccgcaacuucguccucgacaacaccgaccgcaagggcguccacuuccucauggccgacggcggcuucuccgucgagggccaggagaaccuccaggagauccucuccaagcagcuccuccucugccaguuccucauggcccucuccaucguccgcaccggcggccacuucaucugcaagaccuucgaccucuucacccccuucuccgucggccucgucuaccuccucuacugcugcuucgagcgcgucugccucuucaagcccaucaccucccgccccgccaacuccgagcgcuacgucgucugcaagggccucaaggucggcaucgacgacguccgcgacuaccucuucgccgucaacaucaagcucaaccagcuccgcaacaccgacuccgacgucaaccucgucgucccccucgaggucaucaagggcgaccacgaguucaccgacuacaugauccgcuccaacgagucccacugcucccuccagaucaaggcccucgccaagauccacgccuucguccaggacaccacccucuccgagccccgccaggccgagauccgcaaggagugccuccgccucuggggcauccccgaccaggcccgcgucgcccccuccuccuccgaccccaaguccaaguucuucgagcucauccagggcaccgagaucgacaucuucuccuacaagcccacccuccucaccuccaagacccucgagaagauccgccccgucuucgacuaccgcugcauggucuccggcuccgagcagaaguuccucaucggccucggcaagucccagaucuacaccugggacggccgccaguccgaccgcuggaucaagcucgaccucaagaccgagcucccccgcgacacccuccucuccgucgagaucguccacgagcucaagggcgagggcaaggcccagcgcaagaucuccgccauccacauccucgacguccucguccucaacggcaccgacguccgcgagcagcacuucaaccagcgcauccagcucgccgagaaguucgucaaggccgucuccaagcccucccgccccgacaugaaccccauccgcgucaaggaggucuaccgccucgaggagauggagaagaucuucguccgccucgagaugaagaucaucaagggcuccuccggcacccccaagcucuccuacaccggccgcgacgaccgccacuucguccccaugggccucuacaucguccgcaccgucaacgagcccuggaccaugggcuucuccaaguccuucaagaagaaguucuucuacaacaagaagaccaaggacuccaccuucgaccuccccgccgacuccaucgcccccuuccacaucugcuacuacggccgccucuucugggaguggggcgacggcauccgcguccacgacucccagaagccccaggaccaggacaagcucuccaaggaggacguccucuccuucauccagaugcaccgcgccuga

SEQ ID NO: 41499 - RNA, 2313 nt, Artificial Sequence
  derived and/or modified sequence opt2 from CMTR2__Homo_sapiens__NP_060818
auguccaagugccgcaagacccccguccagcagcucgccucccccgccuccuucucccccgacauccucgccgacaucuucgagcucuucgccaagaacuucuccuacggcaagccccucaacaacgaguggcagcuccccgaccccuccgagaucuucaccugcgaccacaccgagcucaacgccuuccucgaccucaagaacucccucaacgaggucaagaaccuccucuccgacaagaagcucgacgaguggcacgagcacaccgccuucaccaacaaggccggcaagaucaucucccacguccgcaaguccgucaacgccgagcucugcacccaggccuggugcaaguuccacgagauccucugcuccuucccccucaucccccaggaggccuuccagaacggcaagcucaacucccuccaccucugcgaggcccccggcgccuucaucgccucccucaaccacuaccucaagucccaccgcuuccccugccacugguccugggucgccaacacccucaaccccuaccacgaggccaacgacgaccucaugaugaucauggacgaccgccucaucgccaacacccuccacuggugguacuucggccccgacaacaccggcgacaucaugacccucaaguuccucaccggccuccagaacuucaucuccuccauggccaccguccaccucgucaccgccgacggcuccuucgacugccagggcaaccccggcgagcaggaggcccucgucuccucccuccacuacugcgaggucgucaccgcccucaccacccucggcaacggcggcuccuucguccucaagauguucaccauguucgagcacugcuccaucaaccucauguaccuccucaacugcugcuucgaccagguccacgucuucaagcccgccaccuccaaggccggcaacuccgaggucuacgucgucugccuccacuacaagggccgcgaggccauccacccccuccucuccaagaugacccucaacuucggcaccgagaugaagcgcaaggcccucuucccccaccacgucauccccgacuccuuccucaagcgccacgaggagugcugcgucuucuuccacaaguaccagcucgagaccaucuccgagaacauccgccucuucgagugcaugggcaaggccgagcaggagaagcucaacaaccuccgcgacugcgccauccaguacuucaugcagaaguuccagcucaagcaccucucccgcaacaacuggcucgucaagaaguccuccaucggcugcuccaccaacaccaagugguucggccagcgcaacaaguacuucaagaccuacaacgagcgcaagaugcucgaggcccucuccuggaaggacaaggucgccaagggcuacuucaacuccugggccgaggagcacggcgucuaccaccccggccaguccuccauccucgagggcaccgccuccaaccucgagugccaccucuggcacauccucgagggcaagaagcuccccaaggucaagugcucccccuucugcaacggcgagauccucaagacccucaacgaggccaucgagaagucccucggcggcgccuucaaccucgacuccaaguuccgccccaagcagcaguacuccugcuccugccacgucuucuccgaggagcucaucuucuccgagcucugcucccucaccgagugccuccaggacgagcaggucgucguccccuccaaccagaucaagugccuccucgucggcuucuccacccuccgcaacaucaagaugcacaucccccucgagguccgccuccucgaguccgccgagcucaccaccuucuccugcucccuccuccacgacggcgaccccaccuaccagcgccucuuccucgacugccuccuccacucccuccgcgagcuccacaccggcgacgucaugauccuccccguccucuccugcuucacccgcuucauggccggccucaucuucguccuccacuccugcuuccgcuucaucaccuucgucugccccaccuccuccgacccccuccgcaccugcgccguccuccucugcgucggcuaccaggaccuccccaaccccgucuuccgcuaccuccaguccgucaacgagcuccucuccacccuccucaacuccgacuccccccagcagguccuccaguucguccccauggagguccuccucaagggcgcccuccucgacuuccucugggaccucaacgccgccaucgccaagcgccaccuccacuucaucauccagcgcgagcgcgaggagaucaucaacucccuccagcuccagaacuga

SEQ ID NO: 41500 - RNA, 12210 nt, Artificial Sequence
  derived and/or modified sequence opt2 from CMYA5__Homo_sapiens__NP_705838
auggccucccgcgacuccaaccacgccggcgaguccuuccucggcuccgacggcgacgaggaggccacccgcgagcucgagaccgaggaggaguccgagggcgaggaggacgagaccgccgccgaguccgaggaggagcccgacucccgccucuccgaccaggacgaggagggcaagaucaagcaggaguacaucaucuccgaccccuccuucuccauggucaccguccagcgcgaggacuccggcaucaccugggagaccaacuccucccgcuccuccacccccugggccuccgaggagucccagaccuccggcgucugcucccgcgagggcuccaccgucaacuccccccccggcaacgucuccuucaucgucgacgaggucaagaagguccgcaagcgcacccacaaguccaagcacggcucccccucccuccgccgcaagggcaaccgcaagcgcaacuccuucgagucccaggacguccccaccaacaagaagggcuccccccucaccuccgccucccagguccucaccaccgagaaggagaaguccuacaccggcaucuacgacaaggcccgcaagaagaagaccaccuccaacaccccccccaucaccggcgccaucuacaaggagcacaagccccucguccuccgccccgucuacaucggcaccguccaguacaagaucaagauguucaacuccgucaaggaggagcucaucccccuccaguucuacggcacccuccccaagggcuacgucaucaaggagauccacuaccgcaagggcaaggacgccuccaucucccucgagcccgaccucgacaacuccggcuccaacaccgucuccaagacccgcaagcucgucgcccaguccaucgaggacaaggucaaggaggucuucccccccuggcgcggcgcccucuccaagggcuccgagucccucacccucauguucucccacgaggaccagaagaagaucuacgccgacuccccccucaacgccaccuccgcccucgagcacaccguccccuccuacuccuccuccggccgcgccgagcagggcauccagcuccgccacucccaguccgucccccagcagcccgaggacgaggccaagccccacgaggucgagccccccuccgucacccccgacacccccgccaccauguuccuccgcaccaccaaggaggagugcgagcucgccucccccggcaccgccgccuccgagaacgacuccuccgucucccccuccuucgccaacgaggucaagaaggaggacgucuacuccgcccaccacuccaucucccucgaggccgccucccccggccucgccgccuccacccaggacggccucgaccccgaccaggagcagcccgaccucaccuccaucgagcgcgccgagcccgucuccgccaagcucacccccacccaccccuccgucaagggcgagaaggaggagaacaugcucgagcccuccaucucccucuccgagccccucaugcucgaggagcccgagaaggaggagaucgagaccucccuccccaucgccaucacccccgagcccgaggacuccaaccucgucgaggaggagaucgucgagcucgacuaccccgaguccccccucgucuccgagaagcccuuccccccccacaugucccccgaggucgagcacaaggaggaggagcucauccucccccuccucgccgccuccucccccgagcacgucgcccucuccgaggaggagcgcgaggagaucgccuccgucuccaccggcuccgccuucgucuccgaguacuccgucccccaggaccucaaccacgagcuccaggagcaggagggcgagcccgucccccccuccaacgucgaggccaucgccgagcacgccguccucuccgaggaggagaacgaggaguucgaggccuacucccccgccgccgcccccaccuccgaguccucccucucccccuccaccaccgagaagaccuccgagaaccaguccccccucuucuccaccgucacccccgaguacaugguccucuccggcgacgaggccuccgaguccggcugcuacacccccgacuccaccuccgccuccgaguacuccguccccucccucgccaccaaggagucccucaagaagaccaucgaccgcaaguccccccucauccucaagggcgucuccgaguacaugauccccuccgaggagaaggaggacaccggcuccuucacccccgccgucgcccccgccuccgagcccucccucucccccuccaccaccgagaagaccuccgagugccaguccccccuccccuccaccgccaccuccgagcacgucguccccuccgagggcgaggaccucggcuccgagcgcuucacccccgacuccaagcucaucuccaaguacgccgccccccucaacgccacccaggagucccagaagaagaucaucaacgaggccucccaguucaagcccaagggcaucuccgagcacaccguccucuccgucgacggcaaggaggucaucggccccuccucccccgaccucgucgucgccuccgagcacuccuuccccccccacaccaccgagaugaccuccgagugccaggcccccccccucuccgccacccccuccgaguacgucguccucuccgacgaggaggccgucgagcucgagcgcuacacccccuccuccaccuccgccuccgaguucuccgucccccccuacgccacccccgaggcccaggaggaggagaucguccaccgcucccucaaccucaagggcgccuccucccccaugaaccucuccgaggaggaccaggaggacaucggccccuucucccccgacuccgccuucgucuccgaguucuccuucccccccuacgccacccaggaggccgagaagcgcgaguucgagugcgacucccccaucugccucaccucccccuccgagcacaccauccucuccgacgaggacaccgaggaggccgagcucuucucccccgacuccgccucccaggucuccaucccccccuuccgcaucuccgagaccgagaagaacgagcucgagcccgacucccuccucaccgccgucuccgccuccggcuacuccugcuucuccgaggccgacgaggaggacaucggcuccaccgccgccacccccgucuccgagcaguucuccuccucccagaagcagaaggccgagaccuucccccucauguccccccucgaggaccucucccucccccccuccaccgacaaguccgagaaggccgagaucaagcccgagauccccaccaccuccaccuccgucuccgaguaccucauccucgcccagaagcagaagacccaggccuaccucgagcccgaguccgaggaccucauccccucccaccucaccuccgaggucgagaagggcgagcgcgaggccuccuccuccgucgccgccauccccgccgcccuccccgcccaguccuccaucgucaaggaggagaccaagcccgccuccccccacuccguccuccccgacuccguccccgccaucaagaaggagcaggagcccaccgccgcccucacccucaaggccgccgacgagcagauggcccucuccaagguccgcaaggaggagaucguccccgacucccaggaggccaccgcccacgucucccaggaccagaagauggagccccagccccccaacguccccgaguccgagaugaaguacuccguccuccccgacauggucgacgagcccaagaagggcgucaagcccaagcucguccucaacgucaccuccgagcucgagcagcgcaagcucuccaagaacgagcccgaggucaucaagcccuacuccccccucaaggagaccucccucuccggccccgaggcccucuccgccgucaagauggagaugaagcacgacuccaagaucaccaccacccccaucguccuccacuccgccuccuccggcgucgagaagcaggucgagcacggcccccccgcccucgccuucuccgcccucuccgaggagaucaagaaggagaucgagcccuccuccuccaccaccaccgccuccgucaccaagcucgacuccaaccucacccgcgccgucaaggaggagauccccaccgacuccucccucaucacccccgucgaccgccccguccucaccaaggucggcaagggcgagcucggcuccggccuccccccccucgucaccuccgccgacgagcacuccguccucgccgaggaggacaaggucgccaucaagggcgccucccccaucgagaccuccuccaagcaccucgccugguccgaggccgagaaggagaucaaguucgacucccuccccuccgucuccuccaucgccgagcacuccguccucuccgaggucgaggccaaggaggucaaggccggccuccccgucaucaagaccuccuccucccagcacuccgacaaguccgaggaggcccgcgucgaggacaagcaggaccuccucuucuccaccgucugcgacuccgagcgccucgucuccucccagaagaagucccucauguccaccuccgagguccucgagcccgagcacgagcucccccucucccucuggggcgagaucaagaagaaggagaccgagcuccccuccucccagaacgucucccccgccuccaagcacaucauccccaagggcaaggacgaggagaccgccuccuccucccccgagcucgagaaccucgccuccggccucgcccccacccuccuccuccucuccgacgacaagaacaagcccgccgucgaggucuccuccaccgcccagggcgacuuccccuccgagaagcaggacgucgcccucgccgagcucucccucgagcccgagaagaaggacaagccccaccagccccucgagcuccccaacgccggcuccgaguucuccuccgaccucggccgccaguccggcuccaucggcaccaagcaggccaagucccccaucaccgagaccgaggacuccguccucgagaagggccccgccgagcuccgcucccgcgagggcaaggaggagaaccgcgagcucugcgccuccuccaccaugcccgccaucuccgagcucuccucccuccuccgcgaggagucccagaacgaggagaucaagcccuucucccccaagaucaucucccucgaguccaaggagccccccgccuccgucgccgagggcggcaaccccgaggaguuccagcccuucaccuucucccucaagggccucuccgaggaggucucccaccccgccgacuucaagaagggcggcaaccaggagaucggcccccucccccccaccggcaaccucaaggcccaggucaugggcgacauccucgacaagcucuccgaggagaccggccaccccaacuccucccagguccuccaguccaucaccgagcccuccaagaucgcccccuccgaccuccucgucgagcagaagaagaccgagaaggcccuccacuccgaccagaccgucaagcuccccgacgucuccaccuccuccgaggacaagcaggaccucggcaucaagcaguucucccucaugcgcgagaaccucccccucgagcaguccaaguccuucaugaccaccaagcccgccgacgucaaggagaccaagauggaggaguucuucaucucccccaaggacgagaacuggaugcucggcaagcccgagaacgucgccucccagcacgagcagcgcaucgccggcuccguccagcucgacuccuccuccuccaacgagcuccgccccggccagcucaaggccgccgucuccuccaaggaccacaccugcgagguccgcaagcagguccucccccacuccgccgaggagucccaccucuccucccaggaggccgucuccgcccucgacaccuccuccggcaacaccgagacccucuccuccaaguccuacuccuccgaggaggucaagcucgccgaggagcccaagucccucguccucgccggcaacgucgagcgcaacaucgccgagggcaaggagauccacucccucauggaguccgagucccuccuccucgagaaggccaacaccgagcucuccuggcccuccaaggaggacucccaggagaagaucaagcucccccccgagcgcuucuuccagaagcccgucuccggccucuccgucgagcaggucaaguccgagaccaucuccuccuccgucaagaccgcccacuuccccgccgagggcgucgagcccgcccucggcaacgagaaggaggcccaccgcuccaccccccccuuccccgaggagaagccccucgaggaguccaagaugguccaguccaaggucaucgacgacgccgacgagggcaagaagcccucccccgaggucaagauccccacccagcgcaagcccaucuccuccauccacgcccgcgagccccagucccccgagucccccgaggucacccagaacccccccacccagcccaaggucgccaagcccgaccuccccgaggagaagggcaagaagggcaucuccuccuucaaguccuggauguccucccucuucuucggcuccuccacccccgacaacaaggucgccgagcaggaggaccucgagacccagcccucccccuccgucgagaaggccgucaccgucaucgaccccgagggcaccauccccaccaacuucaacgucgccgagaagcccgccgaccacucccucuccgaggucaagcucaagaccgccgacgagccccgcggcacccucgucaaguccggcgacggccagaacgucaaggagaaguccaugauccucuccaacgucgaggaccuccagcagcccaaguucaucuccgaggucucccgcgaggacuacggcaagaaggagaucuccggcgacuccgaggagaugaacaucaacuccgucgucaccuccgccgacggcgagaaccucgagauccaguccuacucccucaucggcgagaagcucgucauggaggaggccaagaccaucguccccccccacgucaccgacuccaagcgcguccagaagcccgccaucgccccccccuccaaguggaacaucuccaucuucaaggaggagccccgcuccgaccagaagcagaagucccuccucuccuucgacgucgucgacaaggucccccagcagcccaaguccgccuccuccaacuucgccuccaagaacaucaccaaggaguccgagaagcccgaguccaucauccuccccgucgaggaguccaagggcucccucaucgacuucuccgaggaccgccucaagaaggagaugcagaaccccaccucccucaagaucuccgaggaggagaccaagcuccgcuccgucucccccaccgagaagaaggacaaccucgagaaccgcuccuacacccucgccgagaagaagguccucgccgagaagcagaacuccgucgccccccucgagcuccgcgacuccaacgagaucggcaagacccagaucacccucggcucccgcuccaccgagcucaaggaguccaaggccgacgccaugccccagcacuucuaccagaacgaggacuacaacgagcgccccaagaucaucgucggcuccgagaaggagaagggcgaggagaaggagaaccaggucuacguccucuccgagggcaagaagcagcaggagcaccagcccuacuccgucaacgucgccgaguccaugucccgcgaguccgacaucucccucggccacucccucggcgagacccaguccuucucccucgucaaggccaccuccgucaccgagaaguccgaggccaugcucgccgaggcccaccccgagauccgcgaggccaaggccgucggcacccagccccacccccucgaggaguccaagguccucgucgagaagaccaagaccuuccuccccgucgcccucuccugccgcgacgagaucgagaaccacucccucucccaggagggcaaccucguccucgagaaguccucccgcgacaugcccgaccacuccgaggagaaggagcaguuccgcgaguccgagcucuccaagggcggcuccgucgacaucaccaaggagaccgucaagcagggcuuccaggagaaggccgucggcacccagccccgcccccucgaggaguccaagguccucgucgagaagaccaagaccuuccuccccgucguccucuccugccacgacgagaucgagaaccacucccucucccaggagggcaaccucguccucgagaaguccucccgcgacaugcccgaccacuccgaggagaaggagcaguucaaggaguccgagcucuggaagggcggcuccgucgacaucaccaaggaguccaugaaggagggcuuccccuccaaggaguccgagcgcacccucgcccgccccuucgacgagaccaaguccuccgagaccccccccuaccuccucucccccgucaagccccagacccucgccuccggcgccucccccgagaucaacgccgucaagaagaaggagaugccccgcuccgagcucacccccgagcgccacaccguccacaccauccagaccuccaaggacgacaccuccgacguccccaagcaguccguccucgucuccaagcaccaccucgaggccgccgaggacacccgcgucaaggagccccucuccuccgccaaguccaacuacgcccaguucaucuccaacaccuccgccuccaacgccgacaagauggucuccaacaaggagaugcccaaggagcccgaggacaccuacgccaagggcgaggacuucaccgucaccuccaagcccgccggccucuccgaggaccagaagaccgccuucuccaucaucuccgagggcugcgagauccucaacauccacgcccccgccuucaucuccuccaucgaccaggaggaguccgagcagaugcaggacaagcucgaguaccucgaggagaaggccuccuucaagaccaucccccuccccgacgacuccgagaccgucgccugccacaagacccucaagucccgccucgaggacgagaaggucaccccccucaaggagaacaagcagaaggagacccacaagaccaaggaggagaucuccaccgacuccgagaccgaccucuccuucauccagcccaccauccccuccgaggaggacuacuucgagaaguacacccucaucgacuacaacaucucccccgaccccgagaagcagaaggccccccagaagcucaacgucgaggagaagcucuccaaggaggucaccgaggagaccaucuccuuccccgucuccuccgucgaguccgcccucgagcacgaguacgaccucgucaagcucgacgaguccuucuacggccccgagaagggccacaacauccucucccaccccgagacccagucccagaacuccgccgaccgcaacgucuccaaggacaccaagcgcgacgucgacuccaagucccccggcaugccccucuucgaggccgaggagggcguccucucccgcacccagaucuuccccaccaccaucaaggucaucgaccccgaguuccucgaggagccccccgcccucgccuuccucuacaaggaccucuacgaggaggccgucggcgagaagaagaaggaggaggagaccgccuccgagggcgacuccgucaacuccgaggccuccuuccccucccgcaacuccgacaccgacgacggcaccggcaucuacuucgagaaguacauccucaaggacgacauccuccacgacaccucccucacccagaaggaccagggccagggccucgaggagaagcgcgucggcaaggacgacuccuaccagcccaucgccgccgagggcgagaucuggggcaaguucggcaccaucugccgcgagaagucccucgaggagcagaagggcgucuacggcgagggcgaguccgucgaccacgucgagaccgucggcaacgucgccaugcagaagaaggcccccaucaccgaggacguccgcgucgccacccagaagaucuccuacgccguccccuucgaggacacccaccacguccucgagcgcgccgacgaggccggcucccacggcaacgaggucggcaacgccucccccgaggucaaccucaacguccccguccaggucuccuuccccgaggaggaguucgccuccggcgccacccacguccaggagaccucccucgaggagcccaagauccucgucccccccgagcccuccgaggagcgccuccgcaacucccccguccaggacgaguacgaguucaccgagucccuccacaacgaggucgucccccaggacauccucuccgaggagcucuccuccgaguccacccccgaggacguccucucccagggcaaggaguccuucgagcacaucuccgagaacgaguucgccuccgaggccgagcaguccacccccgccgagcagaaggagcucggcuccgagcgcaaggaggaggaccagcucuccuccgaggucgucaccgagaaggcccagaaggagcucaagaagucccagaucgacaccuacugcuacaccugcaagugccccaucuccgccaccgacaaggucuucggcacccacaaggaccacgaggucuccacccucgacaccgccaucuccgccgucaagguccagcucgccgaguuccucgagaaccuccaggagaagucccuccgcaucgaggccuucgucuccgagaucgaguccuucuucaacaccaucgaggagaacugcuccaagaacgagaagcgccucgaggagcagaacgaggagaugaugaagaagguccucgcccaguacgacgagaaggcccaguccuucgaggaggucaagaagaagaagauggaguuccuccacgagcagaugguccacuuccuccaguccauggacaccgccaaggacacccucgagaccaucguccgcgaggccgaggagcucgacgaggccgucuuccucaccuccuucgaggagaucaacgagcgccuccucuccgccauggaguccaccgccucccucgagaagaugcccgccgccuucucccucuucgagcacuacgacgacuccuccgcccgcuccgaccagaugcucaagcaggucgccgucccccagcccccccgccucgagccccaggagcccaacuccgccaccuccaccaccaucgccgucuacugguccaugaacaaggaggacgucaucgacuccuuccaggucuacugcauggaggagccccaggacgaccaggaggucaacgagcucgucgaggaguaccgccucaccgucaaggaguccuacugcaucuucgaggaccucgagcccgaccgcugcuaccaggucugggucauggccgucaacuucaccggcugcucccuccccuccgagcgcgccaucuuccgcaccgcccccuccacccccgucauccgcgccgaggacugcaccgucugcuggaacaccgccaccauccgcuggcgccccaccacccccgaggccaccgagaccuacacccucgaguacugccgccagcacucccccgagggcgagggccuccgcuccuucuccggcaucaagggccuccagcucaaggucaaccuccagcccaacgacaacuacuucuucuacguccgcgccaucaacgccuucggcaccuccgagcaguccgaggccgcccucaucuccacccgcggcacccgcuuccuccuccuccgcgagaccgcccaccccgcccuccacaucuccuccuccggcaccgucaucuccuucggcgagcgccgccgccucaccgagauccccuccguccucggcgaggagcuccccuccugcggccagcacuacugggagaccaccgucaccgacugccccgccuaccgccucggcaucugcuccuccuccgccguccaggccggcgcccucggccagggcgagaccuccugguacaugcacugcuccgagccccagcgcuacaccuucuucuacuccggcaucgucuccgacguccacgucaccgagcgccccgcccgcgucggcauccuccucgacuacaacaaccagcgccucaucuucaucaacgccgaguccgagcagcuccucuucaucauccgccaccgcuucaacgagggcguccaccccgccuucgcccucgagaagcccggcaagugcacccuccaccucggcaucgagccccccgacuccguccgccacaaguga

SEQ ID NO: 41501 - RNA, 1311 nt, Artificial Sequence
  derived and/or modified sequence opt2 from CNBD1__Homo_sapiens__NP_775809
augcccauguccucccuccccgccgccauccucucccacaugaccgccaucaacaacguccccccccccccccuccacuccauccccaaccucaagaaguccaagcacaucaacuacggccagcucaacgcccucugccacauccgcggccagcacucccgcuccauguccaacauccucuccgcccacgacaccuucaugaagcaguaccccaaggucuuccuccaccagaagccccgccuccccaagcucuucaagcaggaggagcagcgcgagcucaacgagggcaaggaggagucccagcaccagcagcccgacgacuccaacaacaucgccguccacguccagcgcgcccacggcggccacauccucuaccgccccaagcgcgccaccgagaaguucgaggaguuccucgccauccucaagaagcuccccauccaccgcacccccuacgagcacaagaccgucuggaaguuccucaagaccauccccgaccucaccuuccagcucaacgacaagcaccucaagacccucuccaagaccgucuucuccgagaccuggcucaagggcuccaccgucgucgccaacgacggcuucuacgucauccucaagggccucgcccgcccccagaccaacgucuacaagaaccucaucgagggcuccgacucccccgacuccuucaucucccaguccuuccacuccuucaucugguccgaggaguucaagaacuccacccucgccgagauguaccuccccuccuacgacuccaugcucuccaagugguccaccuucggcacccucgaggucaugccccagaacgaguccgagacccagauguucuccgucgucaccgaggacgacugcgagauccucaagauccccgccaagggcuacgccaagaucaaggaggagaagaucaagcucgagaacaugcagaagcucaagcucauccgcaugugccccuacuacgaggaguggcccacccucuccaucuacgagcucaucgcccuccucaaguggaagaaguucccccccggccacgucaucgucgaguccggcaacaucaucuccuucgucggcuacaucaacuccggcugcugcaacaucuaccgcuccaucaucggcuucgucaagcuccgcuccaacaaggucaagcgcucccagaagcucgucuacaugggcaagcucaaggagaaggaguccuucggcgagaucuccguccuccuccagguccccuucaccugcaccaucaucaccaagaaggaggucgagauggccaucaucgaggacaaggaccucuucgucgccuga

SEQ ID NO: 41502 - RNA, 540 nt, Artificial Sequence
  derived and/or modified sequence opt2 from CNBP__Homo_sapiens__NP_001120664
auguccuccaacgagugcuucaagugcggccgcuccggccacugggcccgcgagugccccaccggcggcggccgcggccgcggcaugcgcucccgcggccgcggcggcuucaccuccgaccgcggcuuccaguucgucuccuccucccuccccgacaucugcuaccgcugcggcgaguccggccaccucgccaaggacugcgaccuccaggaggacgucgaggccugcuacaacugcggccgcggcggccacaucgccaaggacugcaaggagcccaagcgcgagcgcgagcagugcugcuacaacugcggcaagcccggccaccucgcccgcgacugcgaccacgccgacgagcagaagugcuacuccugcggcgaguucggccacauccagaaggacugcaccaaggucaagugcuaccgcugcggcgagaccggccacgucgccaucaacugcuccaagaccuccgaggucaacugcuaccgcugcggcgaguccggccaccucgcccgcgagugcaccaucgaggccaccgccuga

SEQ ID NO: 41503 - RNA, 1524 nt, Artificial Sequence
  derived and/or modified sequence opt2 from CNDP1__Homo_sapiens__NP_116038
auggaccccaagcucggccgcauggccgccucccuccucgccguccuccuccuccuccucgagcgcggcauguucuccucccccucccccccccccgcccuccucgagaaggucuuccaguacaucgaccuccaccaggacgaguucguccagacccucaaggagugggucgccaucgaguccgacuccguccagcccgucccccgcuuccgccaggagcucuuccgcaugauggccgucgccgccgacacccuccagcgccucggcgcccgcgucgccuccgucgacaugggcccccagcagcuccccgacggccagucccuccccaucccccccgucauccucgccgagcucggcuccgaccccaccaagggcaccgucugcuucuacggccaccucgacguccagcccgccgaccgcggcgacggcuggcucaccgaccccuacguccucaccgaggucgacggcaagcucuacggccgcggcgccaccgacaacaagggccccguccucgccuggaucaacgccgucuccgccuuccgcgcccucgagcaggaccuccccgucaacaucaaguucaucaucgagggcauggaggaggccggcuccgucgcccucgaggagcucgucgagaaggagaaggaccgcuucuucuccggcgucgacuacaucgucaucuccgacaaccucuggaucucccagcgcaagcccgccaucaccuacggcacccgcggcaacuccuacuucauggucgaggucaagugccgcgaccaggacuuccacuccggcaccuucggcggcauccuccacgagcccauggccgaccucgucgcccuccucggcucccucgucgacuccuccggccacauccucguccccggcaucuacgacgaggucgucccccucaccgaggaggagaucaacaccuacaaggccauccaccucgaccucgaggaguaccgcaacuccucccgcgucgagaaguuccucuucgacaccaaggaggagauccucaugcaccucuggcgcuaccccucccucuccauccacggcaucgagggcgccuucgacgagcccggcaccaagaccgucauccccggccgcgucaucggcaaguucuccauccgccucgucccccacaugaacgucuccgccgucgagaagcaggucacccgccaccucgaggacgucuucuccaagcgcaacuccuccaacaagauggucgucuccaugacccucggccuccaccccuggaucgccaacaucgacgacacccaguaccucgccgccaagcgcgccauccgcaccgucuucggcaccgagcccgacaugauccgcgacggcuccaccauccccaucgccaagauguuccaggagaucguccacaaguccgucguccucaucccccucggcgccgucgacgacggcgagcacucccagaacgagaagaucaaccgcuggaacuacaucgagggcaccaagcucuucgccgccuucuuccucgagauggcccagcuccacuga

SEQ ID NO: 41504 - RNA, 1176 nt, Artificial Sequence
  derived and/or modified sequence opt2 from CNDP2__Homo_sapiens__NP_001161971
auggccgcccucaccacccucuucaaguacaucgacgagaaccaggaccgcuacaucaagaagcucgccaagugggucgccauccaguccgucuccgccuggcccgagaagcgcggcgagauccgccgcaugauggaggucgccgccgccgacgucaagcagcucggcggcuccgucgagcucgucgacaucggcaagcagaaggagauccccgucaacguccgcuucugccucgagggcauggaggaguccggcuccgagggccucgacgagcucaucuucgcccgcaaggacaccuucuucaaggacgucgacuacgucugcaucuccgacaacuacuggcucggcaagaagaagcccugcaucaccuacggccuccgcggcaucugcuacuucuucaucgaggucgagugcuccaacaaggaccuccacuccggcgucuacggcggcuccguccacgaggccaugaccgaccucauccuccucaugggcucccucgucgacaagcgcggcaacauccucauccccggcaucaacgaggccgucgccgccgucaccgaggaggagcacaagcucuacgacgacaucgacuucgacaucgaggaguucgccaaggacgucggcgcccagauccuccuccacucccacaagaaggacauccucaugcaccgcuggcgcuaccccucccucucccuccacggcaucgagggcgccuucuccggcuccggcgccaagaccgucaucccccgcaaggucgucggcaaguucuccauccgccucguccccaacaugacccccgaggucgucggcgagcaggucaccuccuaccucaccaagaaguucgccgagcuccgcucccccaacgaguucaaggucuacaugggccacggcggcaagcccugggucuccgacuucucccacccccacuaccucgccggccgccgcgccaugaagaccgucuucggcgucgagcccgaccucacccgcgagggcggcuccauccccgucacccucaccuuccaggaggccaccggcaagaacgucaugcuccuccccgucggcuccgccgacgacggcgcccacucccagaacgagaagcucaaccgcuacaacuacaucgagggcaccaagaugcucgccgccuaccucuacgaggucucccagcucaaggacuga

SEQ ID NO: 41505 - RNA, 2280 nt, Artificial Sequence
  derived and/or modified sequence opt2 from CNGA1__Homo_sapiens__NP_001136036
auggagucccgcuccuccccccgccucgagugcuccggcgccaucuccgcccacugcucccuccaccuccccgacuccuccgacuuccagcucaucuucgucuuccucgucgagaugggcuuccaccacgucggccaggccggccucgagcuccucaucuccuccgaccuccccaccuccgccucccaguccgccggcaucaccgacaugaagcucuccaugaagaacaacaucaucaacacccagcaguccuucgucaccaugcccaacgucaucguccccgacaucgagaaggagauccgccgcauggagaacggcgccugcuccuccuucuccgaggacgacgacuccgccuccaccuccgaggaguccgagaacgagaacccccacgcccgcggcuccuucuccuacaagucccuccgcaagggcggccccucccagcgcgagcaguaccuccccggcgccaucgcccucuucaacgucaacaacuccuccaacaaggaccaggagcccgaggagaagaagaagaagaagaaggagaagaaguccaaguccgacgacaagaacgagaacaagaacgaccccgagaagaagaagaagaagaaggacaaggagaagaagaagaaggaggagaaguccaaggacaagaaggaggaggagaagaaggaggucgucgucaucgaccccuccggcaacaccuacuacaacuggcucuucugcaucacccuccccgucauguacaacuggaccauggucaucgcccgcgccugcuucgacgagcuccaguccgacuaccucgaguacuggcucauccucgacuacgucuccgacaucgucuaccucaucgacauguucguccgcacccgcaccggcuaccucgagcagggccuccucgucaaggaggagcucaagcucaucaacaaguacaaguccaaccuccaguucaagcucgacguccucucccucauccccaccgaccuccucuacuucaagcucggcuggaacuaccccgagauccgccucaaccgccuccuccgcuucucccgcauguucgaguucuuccagcgcaccgagacccgcaccaacuaccccaacaucuuccgcaucuccaaccucgucauguacaucgucaucaucauccacuggaacgccugcgucuucuacuccaucuccaaggccaucggcuucggcaacgacaccugggucuaccccgacaucaacgaccccgaguucggccgccucgcccgcaaguacgucuacucccucuacugguccacccucacccucaccaccaucggcgagacccccccccccguccgcgacuccgaguacgucuucgucgucgucgacuuccucaucggcguccucaucuucgccaccaucgucggcaacaucggcuccaugaucuccaacaugaacgccgcccgcgccgaguuccaggcccgcaucgacgccaucaagcaguacaugcacuuccgcaacgucuccaaggacauggagaagcgcgucaucaagugguucgacuaccucuggaccaacaagaagaccgucgacgagaaggagguccucaaguaccuccccgacaagcuccgcgccgagaucgccaucaacguccaccucgacacccucaagaagguccgcaucuucgccgacugcgaggccggccuccucgucgagcucguccucaagcuccagccccaggucuacucccccggcgacuacaucugcaagaagggcgacaucggccgcgagauguacaucaucaaggagggcaagcucgccgucgucgccgacgacggcgucacccaguucgucguccucuccgacggcuccuacuucggcgagaucuccauccucaacaucaagggcuccaaggccggcaaccgccgcaccgccaacaucaaguccaucggcuacuccgaccucuucugccucuccaaggacgaccucauggaggcccucaccgaguaccccgacgccaagaccaugcucgaggagaagggcaagcagauccucaugaaggacggccuccucgaccucaacaucgccaacgccggcuccgaccccaaggaccucgaggagaaggucacccgcauggagggcuccgucgaccuccuccagacccgcuucgcccgcauccucgccgaguacgaguccaugcagcagaagcucaagcagcgccucaccaaggucgagaaguuccucaagccccucaucgacaccgaguucuccuccaucgagggccccggcgccgaguccggccccaucgacuccaccuga

SEQ ID NO: 41506 - RNA, 2031 nt, Artificial Sequence
  derived and/or modified sequence opt2 from CNGA3__Homo_sapiens__NP_001073347
auggccaagaucaacacccaguacucccaccccucccgcacccaccucaaggucaagaccuccgaccgcgaccucaaccgcgccgagaacggccucucccgcgcccacuccuccuccgaggagaccuccuccguccuccagcccggcaucgccauggagacccgcggccucgccgacuccggccagggcuccuucaccggccagggcaucgcccgccucucccgccucaucuuccuccuccgccgcugggccgcccgccacguccaccaccaggaccagggccccgacuccuuccccgaccgcuuccgcggcgccgagcucaaggaggucuccucccaggaguccaacgcccaggccaacgucggcucccaggagcccgccgaccgcggccgccgcaagaagaccaagaagaaggacgccaucgucgucgaccccuccuccaaccucuacuaccgcuggcucaccgccaucgcccuccccgucuucuacaacugguaccuccucaucugccgcgccugcuucgacgagcuccaguccgaguaccucaugcucuggcucguccucgacuacuccgccgacguccucuacguccucgacguccucguccgcgcccgcaccggcuuccucgagcagggccucauggucuccgacaccaaccgccucuggcagcacuacaagaccaccacccaguucaagcucgacguccucucccucguccccaccgaccucgccuaccucaaggucggcaccaacuaccccgagguccgcuucaaccgccuccucaaguucucccgccucuucgaguucuucgaccgcaccgagacccgcaccaacuaccccaacauguuccgcaucggcaaccucguccucuacauccucaucaucauccacuggaacgccugcaucuacuucgccaucuccaaguucaucggcuucggcaccgacuccugggucuaccccaacaucuccauccccgagcacggccgccucucccgcaaguacaucuacucccucuacugguccacccucacccucaccaccaucggcgagacccccccccccgucaaggacgaggaguaccucuucgucgucgucgacuuccucgucggcguccucaucuucgccaccaucgucggcaacgucggcuccaugaucuccaacaugaacgccucccgcgccgaguuccaggccaagaucgacuccaucaagcaguacaugcaguuccgcaaggucaccaaggaccucgagacccgcgucauccgcugguucgacuaccucugggccaacaagaagaccgucgacgagaaggagguccucaagucccuccccgacaagcucaaggccgagaucgccaucaacguccaccucgacacccucaagaagguccgcaucuuccaggacugcgaggccggccuccucgucgagcucguccucaagcuccgccccaccgucuucucccccggcgacuacaucugcaagaagggcgacaucggcaaggagauguacaucaucaacgagggcaagcucgccgucgucgccgacgacggcgucacccaguucgucguccucuccgacggcuccuacuucggcgagaucuccauccucaacaucaagggcuccaaguccggcaaccgccgcaccgccaacauccgcuccaucggcuacuccgaccucuucugccucuccaaggacgaccucauggaggcccucaccgaguaccccgaggccaagaaggcccucgaggagaagggccgccagauccucaugaaggacaaccucaucgacgaggagcucgcccgcgccggcgccgaccccaaggaccucgaggagaaggucgagcagcucggcuccucccucgacacccuccagacccgcuucgcccgccuccucgccgaguacaacgccacccagaugaagaugaagcagcgccucucccagcucgagucccaggucaagggcggcggcgacaagccccucgccgacggcgagguccccggcgacgccaccaagaccgaggacaagcagcaguga

SEQ ID NO: 41507 - RNA, 900 nt, Artificial Sequence
  derived and/or modified sequence opt2 from CNGB1__Homo_sapiens__NP_001129111
augcucggcuggguccagcgcguccucccccagccccccggcaccccccgcaagaccaagaugcaggaggaggaggaggucgagcccgagcccgagauggaggccgaggucgagcccgagcccaaccccgaggaggccgagaccgaguccgaguccaugccccccgaggaguccuucaaggaggaggaggucgccgucgccgaccccuccccccaggagaccaaggaggccgcccucaccuccaccaucucccuccgcgcccagggcgccgagaucuccgagaugaacucccccucccgccgcguccucaccuggcucaugaagggcgucgagaaggucaucccccagcccguccacuccaucaccgaggaccccgcccagauccucggccacggcuccaccggcgacaccggcugcaccgacgagcccaacgaggcccucgaggcccaggacacccgccccggccuccgccuccuccucuggcucgagcagaaccucgagcgcguccucccccagccccccaaguccuccgaggucuggcgcgacgagcccgccgucgccaccggcgccgccuccgaccccgccccccccggccgcccccaggagaugggccccaagcuccaggcccgcgagacccccucccuccccacccccaucccccuccagcccaaggaggagcccaaggaggcccccgcccccgagccccagcccggcucccaggcccagaccuccucccucccccccacccgcgaccccgcccgccucgucgccuggguccuccaccgccucgagauggcccucccccagcccguccuccacggcaagaucggcgagcaggagcccgacucccccggcaucugcgacguccagacccgcgucaugggcgccggcggccucuga

SEQ ID NO: 41508 - RNA, 2430 nt, Artificial Sequence
  derived and/or modified sequence opt2 from CNGB3__Homo_sapiens__NP_061971
auguucaagucccucaccaaggucaacaaggucaagcccaucggcgagaacaacgagaacgagcaguccucccgccgcaacgaggagggcucccaccccuccaaccagucccagcagaccaccgcccaggaggagaacaagggcgaggagaagucccucaagaccaaguccacccccgucaccuccgaggagccccacaccaacauccaggacaagcucuccaagaagaacuccuccggcgaccucaccaccaaccccgacccccagaacgccgccgagcccaccggcaccguccccgagcagaaggagauggaccccggcaaggagggccccaacuccccccagaacaagccccccgccgcccccgucaucaacgaguacgccgacgcccagcuccacaaccucgucaagcgcaugcgccagcgcaccgcccucuacaagaagaagcucgucgagggcgaccucuccucccccgaggccuccccccagaccgccaagcccaccgccgucccccccgucaaggaguccgacgacaagcccaccgagcacuacuaccgccuccucugguucaaggucaagaagaugccccucaccgaguaccucaagcgcaucaagcuccccaacuccaucgacuccuacaccgaccgccucuaccuccucuggcuccuccucgucacccucgccuacaacuggaacugcugcuucaucccccuccgccucgucuuccccuaccagaccgccgacaacauccacuacuggcucaucgccgacaucaucugcgacaucaucuaccucuacgacaugcucuucauccagccccgccuccaguucguccgcggcggcgacaucaucgucgacuccaacgagcuccgcaagcacuaccgcaccuccaccaaguuccagcucgacgucgccuccaucauccccuucgacaucugcuaccucuucuucggcuucaaccccauguuccgcgccaaccgcaugcucaaguacaccuccuucuucgaguucaaccaccaccucgaguccaucauggacaaggccuacaucuaccgcgucauccgcaccaccggcuaccuccucuucauccuccacaucaacgccugcgucuacuacugggccuccaacuacgagggcaucggcaccacccgcugggucuacgacggcgagggcaacgaguaccuccgcugcuacuacugggccguccgcacccucaucaccaucggcggccuccccgagccccagacccucuucgagaucgucuuccagcuccucaacuucuucuccggcgucuucgucuucuccucccucaucggccagaugcgcgacgucaucggcgccgccaccgccaaccagaacuacuuccgcgccugcauggacgacaccaucgccuacaugaacaacuacuccauccccaagcucguccagaagcgcguccgcaccugguacgaguacaccugggacucccagcgcaugcucgacgaguccgaccuccucaagacccuccccaccaccguccagcucgcccucgccaucgacgucaacuucuccaucaucuccaaggucgaccucuucaagggcugcgacacccagaugaucuacgacaugcuccuccgccucaaguccguccucuaccuccccggcgacuucgucugcaagaagggcgagaucggcaaggagauguacaucaucaagcacggcgagguccagguccucggcggccccgacggcaccaagguccucgucacccucaaggccggcuccgucuucggcgagaucucccuccucgccgccggcggcggcaaccgccgcaccgccaacgucgucgcccacggcuucgccaaccuccucacccucgacaagaagacccuccaggagauccucguccacuaccccgacuccgagcgcauccucaugaagaaggcccgcguccuccucaagcagaaggccaagaccgccgaggccacccccccccgcaaggaccucgcccuccucuucccccccaaggaggagacccccaagcucuucaagacccuccucggcggcaccggcaaggccucccucgcccgccuccucaagcucaagcgcgagcaggccgcccagaagaaggagaacuccgagggcggcgaggaggagggcaaggagaacgaggacaagcagaaggagaacgaggacaagcagaaggagaacgaggacaagggcaaggagaacgaggacaaggacaagggccgcgagcccgaggagaagccccucgaccgccccgagugcaccgccucccccaucgccgucgaggaggagccccacuccguccgccgcaccguccucccccgcggcaccucccgccagucccucaucaucuccauggcccccuccgccgagggcggcgaggagguccucaccaucgaggucaaggagaaggccaagcaguga

SEQ ID NO: 41509 - RNA, 483 nt, Artificial Sequence
  derived and/or modified sequence opt2 from CNIH3__Homo_sapiens__NP_689708
auggccuucaccuucgccgccuucugcuacaugcucucccucguccucugcgccgcccucaucuucuucgccaucuggcacaucaucgccuucgacgagcuccgcaccgacuucaagucccccaucgaccagugcaaccccguccacgcccgcgagcgccuccgcaacaucgagcgcaucugcuuccuccuccgcaagcucguccuccccgaguacuccauccacucccucuucugcaucauguuccucugcgcccaggaguggcucacccucggccucaacgucccccuccucuucuaccacuucuggcgcuacuuccacugccccgccgacuccuccgagcucgccuacgacccccccgucgucaugaacgccgacacccucuccuacugccagaaggaggccuggugcaagcucgccuucuaccuccucuccuucuucuacuaccucuacugcaugaucuacacccucgucuccuccuga

SEQ ID NO: 41510 - RNA, 2163 nt, Artificial Sequence
  derived and/or modified sequence opt2 from CNKSR1__Homo_sapiens__NP_001284576
auggagcccgucgagaccuggacccccggcaaggucgccaccuggcuccgcggccucgacgacucccuccaggacuaccccuucgaggacuggcagcuccccggcaagaaccuccuccagcucugcccccagucccucgaggcccucgccguccgcucccucggccaccaggagcucauccucggcggcgucgagcagcuccaggcccucuccucccgccuccagaccgagaaccuccagucccucaccgagggccuccucggcgccacccacgacuuccaguccaucguccagggcugccucggcgacugcgccaagacccccaucgacguccucugcgccgccgucgagcuccuccacgaggccgacgcccuccucuucuggcucucccgcuaccucuucucccaccucaacgacuucuccgccugccaggagauccgcgaccuccucgaggagcucucccagguccuccacgaggacggccccgccgccgagaaggagggcaccguccuccgcaucugcucccacgucgccggcaucugccacaacauccucgucugcugccccaaggagcuccucgagcagaaggccguccucgagcagguccagcucgacuccccccucggccucgagauccacaccaccuccaacugccagcacuucgucucccaggucgacacccagguccccaccgacucccgccuccagauccagcccggcgacgaggucguccagaucaacgagcaggucgucguccgcgaggagcgcgacauggucggcuggccccgcaagaacaugguccgcgagcuccuccgcgagcccgccggccucucccucguccucaagaagauccccauccccgagacccccccccagacccccccccagguccucgacuccccccaccagcgcucccccucccucucccucgccccccucuccccccgcgcccccuccgaggacgucuucgccuucgaccucuccuccaaccccucccccggccccucccccgccuggaccgacuccgccucccucggccccgagccccuccccaucccccccgagccccccgccauccuccccgccggcgucgccggcacccccggccuccccgagucccccgacaagucccccgucggccgcaagaaguccaagggccucgccacccgccucucccgccgccgcgucuccugccgcgagcucggccgccccgacugcgacggcuggcuccuccuccgcaaggcccccggcggcuucaugggcccccgcuggcgccgccgcugguucguccucaagggccacacccucuacugguaccgccagccccaggacgagaaggccgagggccucaucaacgucuccaacuacucccucgaguccggccacgaccagaagaagaaguacgucuuccagcucacccacgacgucuacaagcccuucaucuucgccgccgacacccucaccgaccucuccauguggguccgccaccucaucaccugcaucuccaaguaccagucccccggccgcgccccccccccccgcgaggaggacugcuacuccgagaccgaggccgaggaccccgacgacgaggccggcucccacuccgccucccccucccccgcccaggccggcuccccccuccacggcgacaccucccccgccgccacccccacccagcgcuccccccgcaccuccuucggcucccucaccgacuccuccgaggaggcccucgagggcaugguccgcggccuccgccagggcggcgucucccuccucggccagccccagccccucacccaggagcaguggcgcuccuccuucaugcgccgcaaccgcgacccccagcucaacgagcgcguccaccgcguccgcgcccuccaguccacccucaaggccaagcuccaggagcuccagguccucgaggagguccucggcgaccccgagcucaccggcgagaaguuccgccaguggaaggagcagaaccgcgagcucuacuccgagggccucggcgccuggggcgucgcccaggccgagggcuccucccacauccucaccuccgacuccaccgagcaguccccccacucccuccccuccgaccccgaggagcacucccaccucugcccccucaccuccgaguccucccuccgcccccccgaccucuga

SEQ ID NO: 41511 - RNA, 3015 nt, Artificial Sequence
  derived and/or modified sequence opt2 from CNKSR2__Homo_sapiens__NP_001162118
auggcccucaucauggagcccgucuccaaguggucccccucccaggucgucgacuggaugaagggccucgacgacugccuccagcaguacaucaagaacuucgagcgcgagaagaucuccggcgaccagcuccuccgcaucacccaccaggagcucgaggaccucggcgucucccgcaucggccaccaggagcucauccucgaggccgucgaccuccucugcgcccucaacuacggccucgagaccgagaaccucaagacccucucccacaagcucaacgccuccgccaagaaccuccagaacuucaucaccggccgccgccgcuccggccacuacgacggccgcaccucccgcaagcuccccaacgacuuccucaccuccgucgucgaccucaucggcgccgccaagucccuccucgccuggcucgaccgcucccccuucgccgccgucaccgacuacuccgucacccgcaacaacgucauccagcucugccucgagcucaccaccaucguccagcaggacugcaccgucuacgagaccgagaacaagauccuccacgucugcaagacccucuccggcgucugcgaccacaucaucucccucuccuccgacccccucgucucccaguccgcccaccucgaggucauccagcucgccaacaucaagcccuccgagggccucggcauguacaucaaguccaccuacgacggccuccacgucaucaccggcaccaccgagaacucccccgccgaccgcugcaagaagauccacgccggcgacgaggucauccaggucaaccaccagaccgucgucggcuggcagcucaagaaccucgucaacgcccuccgcgaggaccccuccggcgucauccucacccucaagaagcgcccccaguccaugcucaccuccgcccccgcccuccucaagaacaugcgcuggaagccccucgcccuccagccccucaucccccgcucccccaccuccuccgucgccacccccuccuccaccaucuccacccccaccaagcgcgacuccuccgcccuccaggaccucuacaucccccccccccccgccgagcccuacaucccccgcgacgagaagggcaaccuccccugcgaggaccuccgcggccacauggucggcaagcccguccacaagggcuccgagucccccaacuccuuccucgaccaggaguaccgcaagcgcuucaacaucgucgaggaggacaccguccucuacugcuacgaguacgagaagggccgcuccuccucccagggccgccgcgaguccacccccaccuacgagaacucccuccuccgcuacauguccaacgagaagaucgcccaggaggaguacauguuccagcgcaacuccaagaaggacaccggcaagaaguccaagaagaagggcgacaaguccaacucccccacccacuacucccuccuccccucccuccagauggacgcccuccgccaggacaucaugggcacccccguccccgagaccacccucuaccacaccuuccagcaguccucccuccagcacaaguccaagaagaagaacaagggccccaucgccggcaaguccaagcgccgcaucuccugcaaggaccucggccgcggcgacugcgagggcuggcucuggaagaagaaggacgccaaguccuacuucucccagaaguggaagaaguacugguucguccucaaggacgccucccucuacugguacaucaacgaggaggacgagaaggccgagggcuucaucucccuccccgaguucaagaucgaccgcgccuccgagugccgcaagaaguacgccuucaaggccugccaccccaagaucaaguccuucuacuucgccgccgagcaccucgacgacaugaaccgcuggcucaaccgcaucaacaugcucaccgccggcuacgccgagcgcgagcgcaucaagcaggagcaggacuacugguccgaguccgacaaggaggaggccgacacccccuccacccccaagcaggacuccccccccccccccuacgacaccuacccccgcccccccuccauguccugcgccucccccuacgucgaggccaagcacucccgccucuccuccaccgagaccucccagucccaguccucccacgaggaguuccgccaggaggucaccggcuccuccgccgucucccccauccgcaagaccgccucccagcgccgcuccuggcaggaccucaucgagaccccccucaccuccuccggccuccacuaccuccagacccucccccucgaggacuccgucuucuccgacuccgccgccaucucccccgagcaccgccgccaguccacccuccccacccagaagugccaccuccaggaccacuacggccccuacccccucgccgaguccgagcgcaugcagguccucaacggcaacggcggcaagccccgcuccuucacccucccccgcgacuccggcuucaaccacugcugccucaacgcccccgucuccgccugcgacccccaggacgacguccagccccccgaggucgaggaggaggaggaggaggaggaggaggagggcgaggccgccggcgagaacaucggcgagaaguccgagucccgcgaggagaagcucggcgacucccuccaggaccucuaccgcgcccucgagcaggccucccucuccccccucggcgagcaccgcaucuccaccaagauggaguacaagcucuccuucaucaagcgcugcaacgaccccgucaugaacgagaagcuccaccgccuccgcauccucaaguccacccucaaggcccgcgagggcgaggucgccaucaucgacaagguccucgacaaccccgaccucaccuccaaggaguuccagcaguggaagcagauguaccucgaccucuuccucgacaucugccagaacaccaccuccaacgacccccucuccaucuccuccgaggucgacgucaucaccuccucccucgcccacacccacuccuacaucgagacccacgucuga

SEQ ID NO: 41512 - RNA, 1668 nt, Artificial Sequence
  derived and/or modified sequence opt2 from CNKSR3__Homo_sapiens__NP_775786
auggagcccgucaccaaguggucccccaagcaggucgucgacuggacccgcggccucgacgacugccuccagcaguacguccacaaguucgagcgcgagaagaucaacggcgagcagcuccuccagaucucccaccaggaccucgaggagcucggcgucacccgcaucggccaccaggagcucguccucgaggccgucgaccuccucugcgcccucaacuacggccucgagaccgacaacaugaagaaccucguccucaagcuccgcgccuccucccacaaccuccagaacuacaucuccucccgccgcaagucccccgccuacgacggcaacaccucccgcaaggcccccaacgaguuccucaccuccgucgucgagcucaucggcgccgccaaggcccuccucgccuggcucgaccgcgcccccuucaccggcaucaccgacuucuccgucaccaagaacaagaucauccagcucugccucgaccucaccaccaccguccagaaggacugcuucgucgccgagauggaggacaagguccucaccgucgucaagguccucaacggcaucugcgacaagaccauccgcuccaccaccgaccccgucaugucccagugcgccugccucgaggagguccaccuccccaacaucaagcccggcgagggccucggcauguacaucaaguccaccuacgacggccuccacgucaucaccggcaccaccgagaacucccccgccgaccgcucccagaagauccacgccggcgacgaggucauccaggucaaccagcagaccgucgucggcuggcagcucaagaaccucgucaagaagcuccgcgagaaccccaccggcgucguccuccuccucaagaagcgccccaccggcuccuucaacuucacccccgccccccucaagaaccuccgcuggaagcccccccucguccagaccucccccccccccgccaccacccagucccccgaguccaccauggacaccucccucaagaaggagaaguccgccauccucgaccucuacaucccccccccccccgccguccccuacuccccccgcgacgagaacggcuccuucgucuacggcggcuccuccaagugcaagcagccccuccccggccccaagggcuccgagucccccaacuccuuccucgaccaggagucccgccgccgccgcuucaccaucgccgacuccgaccagcuccccggcuacuccgucgagaccaacauccuccccaccaagaugcgcgagaagacccccuccuacggcaagccccgcccccucuccaugcccgccgacggcaacuggaugggcaucgucgaccccuucgcccgcccccgcggccacggccgcaagggcgaggacgcccucugccgcuacuucuccaacgagcgcaucccccccaucaucgaggaguccuccuccccccccuaccgcuucucccgccccaccaccgagcgccaccucguccgcggcgccgacuacauccgcggcucccgcugcuacaucaacuccgaccuccacuccuccgccaccauccccuuccaggaggagggcaccaagaagaaguccggcuccuccgccaccaaguccuccuccaccgagcccucccuccucgucuccugguucacccgccucaagcuccucacccacuga

SEQ ID NO: 41513 - RNA, 894 nt, Artificial Sequence
  derived and/or modified sequence opt2 from CNN1__Homo_sapiens__NP_001290
auguccuccgcccacuucaaccgcggccccgccuacggccucuccgccgaggucaagaacaagcucgcccagaaguacgaccaccagcgcgagcaggagcuccgcgaguggaucgagggcgucaccggccgccgcaucggcaacaacuucauggacggccucaaggacggcaucauccucugcgaguucaucaacaagcuccagcccggcuccgucaagaagaucaacgaguccacccagaacuggcaccagcucgagaacaucggcaacuucaucaaggccaucaccaaguacggcgucaagccccacgacaucuucgaggccaacgaccucuucgagaacaccaaccacacccagguccaguccacccuccucgcccucgccuccauggccaagaccaagggcaacaaggucaacgucggcgucaaguacgccgagaagcaggagcgcaaguucgagcccggcaagcuccgcgagggccgcaacaucaucggccuccagaugggcaccaacaaguucgccucccagcagggcaugaccgccuacggcacccgccgccaccucuacgaccccaagcucggcaccgaccagccccucgaccaggccaccaucucccuccagaugggcaccaacaagggcgccucccaggccggcaugaccgcccccggcaccaagcgccagaucuucgagcccggccucggcauggagcacugcgacacccucaacgucucccuccagaugggcuccaacaagggcgccucccagcgcggcaugaccgucuacggccucccccgccaggucuacgaccccaaguacugccucacccccgaguaccccgagcucggcgagcccgcccacaaccaccacgcccacaacuacuacaacuccgccuga

SEQ ID NO: 41514 - RNA, 930 nt, Artificial Sequence
  derived and/or modified sequence opt2 from CNN2__Homo_sapiens__NP_004359
auguccuccacccaguucaacaagggccccuccuacggccucuccgccgaggucaagaaccgccuccucuccaaguacgacccccagaaggaggccgagcuccgcaccuggaucgagggccucaccggccucuccaucggccccgacuuccagaagggccucaaggacggcaccauccucugcacccucaugaacaagcuccagcccggcuccguccccaagaucaaccgcuccaugcagaacuggcaccagcucgagaaccucuccaacuucaucaaggccauggucuccuacggcaugaaccccgucgaccucuucgaggccaacgaccucuucgaguccggcaacaugacccagguccaggucucccuccucgcccucgccggcaaggccaagaccaagggccuccaguccggcgucgacaucggcgucaaguacuccgagaagcaggagcgcaacuucgacgacgccaccaugaaggccggccagugcgucaucggccuccagaugggcaccaacaagugcgccucccaguccggcaugaccgccuacggcacccgccgccaccucuacgaccccaagaaccacauccucccccccauggaccacuccaccaucucccuccagaugggcaccaacaagugcgccucccaggucggcaugaccgcccccggcacccgccgccacaucuacgacaccaagcucggcaccgacaagugcgacaacuccuccaugucccuccagaugggcuacacccagggcgccaaccaguccggccaggucuucggccucggccgccagaucuacgaccccaaguacugcccccagggcaccgucgccgacggcgcccccuccggcaccggcgacugccccgaccccggcgagguccccgaguacccccccuacuaccaggaggaggccggcuacuga

SEQ ID NO: 41515 - RNA, 2856 nt, Artificial Sequence
  derived and/or modified sequence opt2 from CNNM1__Homo_sapiens__NP_065081
auggccgccgccgccgccgccgccgccgccgucggcguccgccuccgcgacugcugcucccgcggcgccguccuccuccucuucuucucccucuccccccgcccccccgccgccgccgccuggcuccucggccuccgccccgaggacaccgccggcggccgcgucucccucgagggcggcacccuccgcgccgccgagggcaccuccuuccuccuccgcgucuacuuccagcccggcccccccgccaccgccgcccccguccccucccccacccucaacuccggcgagaacggcaccggcgacugggccccccgccucgucuucaucgaggagccccccggcggcggcggcgucgcccccuccgccguccccacccgcccccccggcccccagcgcugccgcgagcaguccgacugggccuccgacgucgagguccucggcccccuccgccccggcggcgucgccggcuccgcccucguccagguccgcguccgcgagcuccgcaagggcgaggccgagcgcggcggcgccggcggcggcggcaagcucuucucccucugcgccugggacggccgcgccuggcaccaccacggcgccgccggcggcuuccuccuccgcguccgcccccgccucuacggccccggcggcgaccuccucccccccgccuggcuccgcgcccucggcgcccuccuccuccucgcccucuccgcccucuucuccggccuccgccucucccuccucucccucgaccccgucgagcuccgcguccuccgcaacuccggcuccgccgccgagcaggagcaggcccgccgcguccaggccguccgcggccgcggcacccaccuccucugcacccuccuccucggccaggccggcgccaacgccgcccucgccggcuggcucuacaccucccucccccccggcuucggcggcaccggcgaggacuacuccgaggagggcauccacuuccccuggcuccccgcccucgucugcaccggcgccgucuuccucggcgccgagaucugccccuacuccgucugcucccgccacggccucgccaucgccucccacuccgucugccucacccgccuccucauggccgccgccuuccccgucugcuacccccucggccgccuccucgacugggcccuccgccaggagaucuccaccuucuacacccgcgagaagcuccucgagacccuccgcgccgccgaccccuacuccgaccucgucaaggaggagcucaacaucauccagggcgcccucgagcuccgcaccaaggucgucgaggagguccucaccccccucggcgacugcuucaugcuccgcuccgacgccguccucgacuucgccaccgucuccgagauccuccgcuccggcuacacccgcauccccgucuacgagggcgaccagcgccacaacaucgucgacauccucuucgucaaggaccucgccuucgucgaccccgacgacugcaccccccuccucaccgucacccgcuucuacaaccgcccccuccacugcgucuucaacgacacccgccucgacaccguccucgaggaguucaagaagggcaagucccaccucgccaucguccagcgcgucaacaacgagggcgagggcgaccccuucuacgaggucaugggcaucgucacccucgaggacaucaucgaggagaucaucaaguccgagauccucgacgagaccgaccucuacaccgacaaccgcaagaagcagcgcgucccccagcgcgagcgcaagcgccacgacuucucccucuucaagcucuccgacaccgagaugcgcgucaagaucuccccccagcuccuccucgccacccaccgcuucauggccaccgaggucgagcccuucaagucccucuaccucuccgagaagauccuccuccgccuccucaagcaccccaacgucauccaggagcucaaguucgacgagaagaacaagaaggcccccgagcacuaccucuaccagcgcaaccgccccgucgacuacuucguccuccuccuccagggcaaggucgaggucgaggucggcaaggagggccuccgcuucgagaacggcgccuucaccuacuacggcguccccgccaucaugaccaccgccugcuccgacaacgacguccgcaaggucggcucccucgccggcuccuccgucuuccucaaccgcucccccucccgcugcuccggccucaaccgcuccgagucccccaaccgcgagcgcuccgacuucggcggcuccaacacccagcucuacuccuccuccaacaaccucuacaugcccgacuacuccguccacauccucuccgacguccaguucgucaagaucacccgccagcaguaccagaacgcccucaccgccugccacauggacuccuccccccagucccccgacauggaggccuucaccgacggcgacuccaccaaggcccccaccacccgcggcaccccccagacccccaaggacgaccccgccaucacccuccucaacaaccgcaacucccuccccugcucccgcuccgacggccuccgcucccccuccgaggucgucuaccuccgcauggaggagcucgccuucacccaggaggagaugaccgacuucgaggagcacuccacccagcagcucacccucucccccgccgccguccccacccgcgccgccuccgacuccgagugcugcaacaucaaccucgacaccgagaccucccccugcuccuccgacuucgaggagaacgucggcaagaagcuccuccgcacccucuccggccagaagcgcaagcgcucccccgagggcgagcgcaccuccgaggacaacuccaaccucaccccccucaucaccuga

SEQ ID NO: 41516 - RNA, 2628 nt, Artificial Sequence
  derived and/or modified sequence opt2 from CNNM2__Homo_sapiens__NP_060119
augaucggcugcggcgccugcgagcccaaggucaagauggccggcggccaggccgccgccgcccuccccaccuggaagauggccgcccgccgcucccucuccgcccgcggccgcggcauccuccaggccgccgccggccgccuccucccccuccuccuccucuccugcugcugcggcgccggcggcugcgccgccgucggcgagaacgaggagaccgucaucaucggccuccgccucgaggacaccaacgacgucuccuucauggagggcggcgcccuccgcgucuccgagcgcacccgcgucaagcuccgcgucuacggccagaacaucaacaacgagaccuggucccgcaucgccuucaccgagcacgagcgccgccgccacucccccggcgagcgcggccucggcggccccgccccccccgagcccgacuccggcccccagcgcugcggcauccgcaccuccgacaucaucauccucccccacaucauccucaaccgccgcaccuccggcaucaucgagaucgagaucaagccccuccgcaagauggagaaguccaaguccuacuaccucugcaccucccucuccacccccgcccucggcgccggcggcuccggcuccaccggcggcgccgucggcggcaagggcggcuccggcgucgccggccucccccccccccccugggccgagaccaccuggaucuaccacgacggcgaggacaccaagaugaucgucggcgaggagaagaaguuccuccuccccuucuggcuccaggucaucuucaucucccuccuccucugccucuccggcauguucuccggccucaaccucggccucauggcccucgaccccauggagcuccgcaucguccagaacugcggcaccgagaaggagaagaacuacgccaagcgcaucgagcccguccgccgccagggcaacuaccuccucugcucccuccuccucggcaacguccucgucaacaccacccucaccauccuccucgacgacaucgccggcuccggccucgucgccgucgucgucuccaccaucggcaucgucaucuucggcgagaucgucccccaggccaucugcucccgccacggccucgccgucggcgccaacaccaucuuccucaccaaguucuucaugaugaugaccuuccccgccuccuaccccgucuccaagcuccucgacugcguccucggccaggagaucggcaccgucuacaaccgcgagaagcuccucgagaugcuccgcgucaccgaccccuacaacgaccucgucaaggaggagcucaacaucauccagggcgcccucgagcuccgcaccaagaccgucgaggacgucaugaccccccuccgcgacugcuucaugaucaccggcgaggccauccucgacuucaacaccauguccgagaucauggaguccggcuacacccgcauccccgucuucgagggcgagcgcuccaacaucgucgaccuccucuucgucaaggaccucgccuucgucgaccccgacgacugcaccccccucaagaccaucaccaaguucuacaaccacccccuccacuucgucuucaacgacaccaagcucgacgccaugcucgaggaguucaagaagggcaagucccaccucgccaucguccagcgcgucaacaacgagggcgagggcgaccccuucuacgagguccucggcaucgucacccucgaggacgucaucgaggagaucaucaaguccgagauccucgacgagaccgaccucuacaccgacaaccgcaccaagaagaaggucgcccaccgcgagcgcaagcaggacuucuccgccuucaagcagaccgacuccgagaugaaggucaagaucuccccccagcuccuccucgccaugcaccgcuuccucgccaccgaggucgaggccuucucccccucccagauguccgagaagauccuccuccgccuccucaagcaccccaacgucauccaggagcucaaguacgacgagaagaacaagaaggcccccgaguacuaccucuaccagcgcaacaagcccgucgacuacuucguccucauccuccagggcaaggucgaggucgaggccggcaaggagggcaugaaguucgaggccuccgccuucuccuacuacggcgucauggcccucaccgccucccccgucccccucucccucucccgcaccuucgucgucucccgcaccgagcuccucgccgccggcucccccggcgagaacaagucccccccccgccccugcggccucaaccacuccgacucccucucccgcuccgaccgcaucgacgccgucacccccacccucggcuccuccaacaaccagcucaacuccucccuccuccaggucuacauccccgacuacuccguccgcgcccucuccgaccuccaguucgucaagaucucccgccagcaguaccagaacgcccucauggccucccgcauggacaagaccccccaguccuccgacuccgagaacaccaagaucgagcucacccucaccgagcuccacgacggccuccccgacgagaccgccaaccuccucaacgagcagaacugcgucacccacuccaaggccaaccacucccuccacaacgagggcgccaucuga

SEQ ID NO: 41517 - RNA, 2328 nt, Artificial Sequence
  derived and/or modified sequence opt2 from CNNM4__Homo_sapiens__NP_064569
auggcccccgucggcggcggcggccgccccgucggcggccccgcccgcggccgccuccuccucgccgcccccguccuccucguccuccucugggcccucggcgcccgcggccagggcuccccccagcagggcaccaucgucggcaugcgccucgccuccugcaacaaguccugcggcaccaaccccgacggcaucaucuucgucuccgagggcuccaccgucaaccuccgccucuacggcuacucccucggcaacaucuccuccaaccucaucuccuucaccgaggucgacgacgccgagacccuccacaaguccaccuccugccucgagcucaccaaggaccucgucguccagcagcucgucaacgucucccgcggcaacaccuccggcguccucgucguccucaccaaguuccuccgccgcuccgaguccaugaagcucuacgcccucugcacccgcgcccagcccgacggccccuggcucaaguggaccgacaaggacucccuccucuucauggucgaggagcccggccgcuuccucccccucuggcuccacauccuccucaucaccguccuccucguccucuccggcaucuucuccggccucaaccucggccucauggcccucgaccccauggagcuccgcaucguccagaacugcggcaccgagaaggagcgccgcuacgcccgcaagaucgagcccauccgccgcaagggcaacuaccuccucugcucccuccuccucggcaacguccucgucaacaccucccucaccauccuccucgacaaccucaucggcuccggccucauggccgucgccuccuccaccaucggcaucgucaucuucggcgagauccucccccaggcccucugcucccgccacggccucgccgucggcgccaacaccauccuccucaccaaguucuucaugcuccucaccuucccccucuccuuccccaucuccaagcuccucgacuucuuccucggccaggagauccgcaccgucuacaaccgcgagaagcucauggagaugcucaaggucaccgagcccuacaacgaccucgucaaggaggagcucaacaugauccagggcgcccucgagcuccgcaccaagaccgucgaggacaucaugacccagcuccaggacugcuucaugauccgcuccgacgccauccucgacuucaacaccauguccgagaucauggaguccggcuacacccgcauccccgucuucgaggacgagcaguccaacaucgucgacauccucuacgucaaggaccucgccuucgucgaccccgacgacugcaccccccucaagaccaucacccgcuucuacaaccaccccguccacuucgucuuccacgacaccaagcucgacgccaugcucgaggaguucaagaagggcaagucccaccucgccaucguccagaaggucaacaacgagggcgagggcgaccccuucuacgagguccucggccucgucacccucgaggacgucaucgaggagaucaucaaguccgagauccucgacgaguccgacauguacaccgacaaccgcucccgcaagcgcgucuccgagaagaacaagcgcgacuucuccgccuucaaggacgccgacaacgagcucaaggucaagaucuccccccagcuccuccucgccgcccaccgcuuccucgccaccgaggucucccaguucucccccucccucaucuccgagaagauccuccuccgccuccucaaguaccccgacgucauccaggagcucaaguucgacgagcacaacaaguacuacgcccgccacuaccucuacacccgcaacaagcccgccgacuacuucauccucauccuccagggcaaggucgaggucgaggccggcaaggagaacaugaaguucgagaccggcgccuucuccuacuacggcaccauggcccucaccuccguccccuccgaccgcucccccgcccaccccaccccccucucccgcuccgccucccucuccuaccccgaccgcaccgacgucuccaccgccgccacccucgccggcuccuccaaccaguucggcuccuccguccucggccaguacaucuccgacuucuccguccgcgcccucgucgaccuccaguacaucaagaucacccgccagcaguaccagaacggccuccucgccucccgcauggagaacuccccccaguuccccaucgacggcugcaccacccacauggagaaccucgccgagaaguccgagcuccccgucgucgacgagaccaccacccuccucaacgagcgcaacucccuccuccacaaggccucccacgagaacgccaucuga

SEQ ID NO: 41518 - RNA, 7116 nt, Artificial Sequence
  derived and/or modified sequence opt2 from CNOT1__Homo_sapiens__NP_001252541
augaaccucgacucccucucccucgcccucucccagaucuccuaccucgucgacaaccucaccaagaagaacuaccgcgccucccagcaggagauccagcacaucgucaaccgccacggccccgaggccgaccgccaccuccuccgcugccucuucucccacgucgacuucuccggcgacggcaaguccuccggcaaggacuuccaccagacccaguuccucauccaggagugcgcccuccucaucaccaagcccaacuucaucuccacccucuccuacgccaucgacaacccccuccacuaccagaagucccucaagcccgccccccaccucuucgcccagcucuccaagguccucaagcucuccaagguccaggaggucaucuucggccucgcccuccucaacuccuccuccuccgaccuccgcggcuucgccgcccaguucaucaagcagaagcuccccgaccuccuccgcuccuacaucgacgccgacgucuccggcaaccaggagggcggcuuccaggacaucgccaucgagguccuccaccuccuccucucccaccuccucuucggccagaagggcgccuucggcgucggccaggagcagaucgacgccuuccucaagacccuccgccgcgacuucccccaggagcgcugccccgucguccucgccccccuccucuaccccgagaagcgcgacauccucauggaccgcauccuccccgacuccggcggcgucgccaagaccaugauggaguccucccucgccgacuucaugcaggaggucggcuacggcuucugcgccuccaucgaggagugccgcaacaucaucguccaguucggcguccgcgaggucaccgccgcccaggucgcccgcguccucggcaugauggcccgcacccacuccggccucaccgacggcaucccccuccaguccaucuccgcccccggcuccggcaucugguccgacggcaaggacaaguccgacggcgcccaggcccacaccuggaacgucgagguccucaucgacguccucaaggagcucaaccccucccucaacuucaaggaggucaccuacgagcucgaccaccccggcuuccagauccgcgacuccaagggccuccacaacgucgucuacggcauccagcgcggccucggcauggaggucuuccccgucgaccucaucuaccgccccuggaagcacgccgagggccagcucuccuucauccagcacucccucaucaaccccgagaucuucugcuucgccgacuaccccugccacaccgucgccaccgacauccucaaggccccccccgaggacgacaaccgcgagaucgccaccuggaagucccucgaccucaucgagucccuccuccgccucgccgaggucggccaguacgagcaggucaagcagcucuucuccuuccccaucaagcacugccccgacaugcucguccucgcccuccuccagaucaacaccuccuggcacacccuccgccacgagcucaucuccacccucaugcccaucuuccucggcaaccaccccaacuccgccaucauccuccacuacgccuggcacggccagggccagucccccuccauccgccagcucaucaugcacgccauggccgagugguacaugcgcggcgagcaguacgaccaggccaagcucucccgcauccucgacgucgcccaggaccucaaggcccucuccaugcuccucaacggcacccccuucgccuucgucaucgaccucgccgcccucgccucccgccgcgaguaccucaagcucgacaaguggcucaccgacaagauccgcgagcacggcgagcccuucauccaggccugcaugaccuuccucaagcgccgcugccccuccauccucggcggccucgcccccgagaaggaccagcccaaguccgcccagcucccccccgagacccucgccaccaugcucgccugccuccaggccugcgccggcuccgucucccaggagcucuccgagaccauccucaccauggucgccaacugcuccaacgucaugaacaaggcccgccagcccccccccggcgucaugcccaagggccgcccccccuccgccuccucccucgacgccaucucccccguccagaucgacccccucgccggcaugaccucccucuccaucggcggcuccgccgccccccacacccaguccaugcagggcuucccccccaaccucggcuccgccuucuccaccccccagucccccgccaaggccuuccccccccucuccacccccaaccagaccaccgccuucuccggcaucggcggccucuccucccagcuccccgucggcggccucggcaccggcucccucaccggcaucggcaccggcgcccucggccuccccgccgucaacaacgaccccuucguccagcgcaagcucggcaccuccggccucaaccagcccaccuuccagcagaccgaccucucccaggucuggcccgaggccaaccagcacuucuccaaggagaucgacgacgaggccaacuccuacuuccagcgcaucuacaaccaccccccccaccccaccauguccgucgacgagguccucgagaugcuccagcgcuucaaggacuccaccaucaagcgcgagcgcgaggucuucaacugcaugcuccgcaaccucuucgaggaguaccgcuucuucccccaguaccccgacaaggagcuccacaucaccgccugccucuucggcggcaucaucgagaagggccucgucaccuacauggcccucggccucgcccuccgcuacguccucgaggcccuccgcaagcccuucggcuccaagauguacuacuucggcaucgccgcccucgaccgcuucaagaaccgccucaaggacuacccccaguacugccagcaccucgccuccaucucccacuucaugcaguucccccaccaccuccaggaguacaucgaguacggccagcagucccgcgacccccccgucaagaugcagggcuccaucaccacccccggcuccaucgcccucgcccaggcccaggcccaggcccagguccccgccaaggccccccucgccggccaggucuccaccauggucaccaccuccaccaccaccaccgucgccaagaccgucaccgucacccgccccaccggcgucuccuucaagaaggacgucccccccuccaucaacaccaccaacaucgacacccuccucgucgccaccgaccagaccgagcgcaucgucgagccccccgagaacauccaggagaagaucgccuucaucuucaacaaccucucccaguccaacaugacccagaaggucgaggagcucaaggagaccgucaaggaggaguucaugcccugggucucccaguaccucgucaugaagcgcgucuccaucgagcccaacuuccacucccucuacuccaacuuccucgacacccucaagaaccccgaguucaacaagaugguccucaacgagaccuaccgcaacaucaagguccuccucaccuccgacaaggccgccgccaacuucuccgaccgcucccuccucaagaaccucggccacuggcucggcaugaucacccucgccaagaacaagcccauccuccacaccgaccucgacgucaagucccuccuccucgaggccuacgucaagggccagcaggagcuccucuacgucguccccuucgucgccaagguccucgaguccuccauccgcuccgucgucuuccgcccccccaaccccuggaccauggccaucaugaacguccucgccgagcuccaccaggagcacgaccucaagcucaaccucaaguucgagaucgagguccucugcaagaaccucgcccucgacaucaacgagcucaagcccggcaaccuccucaaggacaaggaccgccucaagaaccucgacgagcagcucuccgcccccaagaaggacgucaagcagcccgaggagcucccccccaucaccaccaccaccaccuccaccacccccgccaccaacaccaccugcaccgccaccguccccccccagccccaguacuccuaccacgacaucaacgucuacucccucgccggccucgccccccacaucacccucaaccccaccaucccccucuuccaggcccacccccagcucaagcagugcguccgccaggccaucgagcgcgccguccaggagcucguccaccccgucgucgaccgcuccaucaagaucgccaugaccaccugcgagcagaucguccgcaaggacuucgcccucgacuccgaggagucccgcaugcgcaucgccgcccaccacaugaugcgcaaccucaccgccggcauggccaugaucaccugccgcgagccccuccucauguccaucuccaccaaccucaagaacuccuucgccuccgcccuccgcaccgccuccccccagcagcgcgagaugauggaccaggccgccgcccagcucgcccaggacaacugcgagcucgccugcugcuucauccagaagaccgccgucgagaaggccggccccgagauggacaagcgccucgccaccgaguucgagcuccgcaagcacgcccgccaggagggccgccgcuacugcgaccccgucguccucaccuaccaggccgagcgcaugcccgagcagauccgccucaaggucggcggcgucgaccccaagcagcucgccgucuacgaggaguucgcccgcaacguccccggcuuccuccccaccaacgaccucucccagcccaccggcuuccucgcccagcccaugaagcaggccugggccaccgacgacgucgcccagaucuacgacaagugcaucaccgagcucgagcagcaccuccacgccaucccccccacccucgccaugaacccccaggcccaggcccuccgcucccuccucgaggucgucguccucucccgcaacucccgcgacgccaucgccgcccucggccuccuccagaaggccgucgagggccuccucgacgccaccuccggcgccgacgccgaccuccuccuccgcuaccgcgagugccaccuccucguccucaaggcccuccaggacggccgcgccuacggcucccccuggugcaacaagcagaucacccgcugccucaucgagugccgcgacgaguacaaguacaacgucgaggccgucgagcuccucauccgcaaccaccucgucaacaugcagcaguacgaccuccaccucgcccaguccauggagaacggccucaacuacauggccgucgccuucgccaugcagcucgucaagauccuccucgucgacgagcgcuccgucgcccacgucaccgaggccgaccucuuccacaccaucgagacccucaugcgcaucaacgcccacucccgcggcaacgcccccgagggccucccccagcucauggaggucguccgcuccaacuacgaggccaugaucgaccgcgcccacggcggccccaacuucaugaugcacuccggcaucucccaggccuccgaguacgacgacccccccggccuccgcgagaaggccgaguaccuccuccgcgagugggucaaccucuaccacuccgccgccgccggccgcgacuccaccaaggccuucuccgccuucgucggccagaugcaccagcagggcauccucaagaccgacgaccucaucacccgcuucuuccgccucugcaccgagaugugcgucgagaucuccuaccgcgcccaggccgagcagcagcacaaccccgccgccaaccccaccaugauccgcgccaagugcuaccacaaccucgacgccuucguccgccucaucgcccuccucgucaagcacuccggcgaggccaccaacaccgucaccaagaucaaccuccucaacaagguccucggcaucgucgucggcguccuccuccaggaccacgacguccgccaguccgaguuccagcagcuccccuaccaccgcaucuucaucaugcuccuccucgagcucaacgcccccgagcacguccucgagaccaucaacuuccagacccucaccgccuucugcaacaccuuccacauccuccgccccaccaaggcccccggcuucgucuacgccuggcucgagcucaucucccaccgcaucuucaucgcccgcaugcucgcccacaccccccagcagaagggcuggcccauguacgcccagcuccucaucgaccucuucaaguaccucgcccccuuccuccgcaacgucgagcucaccaagcccaugcagauccucuacaagggcacccuccgcguccuccucguccuccuccacgacuuccccgaguuccucugcgacuaccacuacggcuucugcgacgucaucccccccaacugcauccagcuccgcaaccucauccucuccgccuucccccgcaacaugcgccuccccgaccccuucacccccaaccucaaggucgacaugcucuccgagaucaacaucgccccccgcauccucaccaacuucaccggcgucaugcccccccaguucaagaaggaccucgacuccuaccucaagacccgcucccccgucaccuuccucuccgaccuccgcuccaaccuccaggucuccaacgagcccggcaaccgcuacaaccuccagcucaucaacgcccucguccucuacgucggcacccaggccaucgcccacauccacaacaagggcuccacccccuccauguccaccaucacccacuccgcccacauggacaucuuccagaaccucgccgucgaccucgacaccgagggccgcuaccucuuccucaacgccaucgccaaccagcuccgcuaccccaacucccacacccacuacuucuccugcaccaugcucuaccucuucgccgaggccaacaccgaggccauccaggagcagaucacccgcguccuccucgagcgccucaucgucaaccgcccccaccccuggggccuccucaucaccuucaucgagcucaucaagaaccccgccuucaaguucuggaaccacgaguucguccacugcgcccccgagaucgagaagcucuuccaguccgucgcccagugcugcaugggccagaagcaggcccagcaggucauggagggcaccggcgccuccuga

SEQ ID NO: 41519 - RNA, 1623 nt, Artificial Sequence
  derived and/or modified sequence opt2 from CNOT2__Homo_sapiens__NP_055330
augguccgcaccgacggccacacccucuccgagaagcgcaacuaccaggucaccaacuccauguucggcgccucccgcaagaaguucgucgagggcgucgacuccgacuaccacgacgagaacauguacuacucccaguccuccauguucccccaccgcuccgagaaggacaugcucgccucccccuccaccuccggccagcucucccaguucggcgccucccucuacggccagcaguccgcccucggccuccccaugcgcggcauguccaacaacaccccccagcucaaccgcucccucucccagggcacccagcuccccucccacgucacccccaccaccggcguccccaccaugucccuccacaccccccccucccccucccgcggcauccuccccaugaacccccgcaacaugaugaaccacucccaggucggccagggcaucggcauccccucccgcaccaacuccauguccuccuccggccucggcucccccaaccgcuccucccccuccaucaucugcaugcccaagcagcagcccucccgccagcccuucaccgucaacuccauguccggcuucggcaugaaccgcaaccaggccuucggcaugaacaacucccucuccuccaacaucuucaacggcaccgacggcuccgagaacgucaccggccucgaccucuccgacuuccccgcccucgccgaccgcaaccgccgcgagggcuccggcaaccccaccccccucaucaacccccucgccggccgcgcccccuacgucggcauggucaccaagcccgccaacgagcagucccaggacuucuccauccacaacgaggacuuccccgcccuccccggcuccuccuacaaggaccccaccuccuccaacgacgacuccaaguccaaccucaacaccuccggcaagaccaccuccuccaccgacggccccaaguuccccggcgacaaguccuccaccacccagaacaacaaccagcagaagaagggcauccagguccuccccgacggccgcgucaccaacaucccccagggcauggucaccgaccaguucggcaugaucggccuccucaccuucauccgcgccgccgagaccgaccccggcaugguccaccucgcccucggcuccgaccucaccacccucggccucaaccucaacucccccgagaaccucuaccccaaguucgccucccccugggccuccucccccugccgcccccaggacaucgacuuccacguccccuccgaguaccucaccaacauccacauccgcgacaagcucgccgccaucaagcucggccgcuacggcgaggaccuccucuucuaccucuacuacaugaacggcggcgacguccuccagcuccucgccgccgucgagcucuucaaccgcgacuggcgcuaccacaaggaggagcgcgucuggaucacccgcgcccccggcauggagcccaccaugaagaccaacaccuacgagcgcggcaccuacuacuucuucgacugccucaacuggcgcaaggucgccaaggaguuccaccucgaguacgacaagcucgaggagcgcccccaccuccccuccaccuucaacuacaaccccgcccagcaggccuucuga

SEQ ID NO: 41520 - RNA, 2262 nt, Artificial Sequence
  derived and/or modified sequence opt2 from CNOT3__Homo_sapiens__NP_055331
auggccgacaagcgcaagcuccagggcgagaucgaccgcugccucaagaaggucuccgagggcgucgagcaguucgaggacaucuggcagaagcuccacaacgccgccaacgccaaccagaaggagaaguacgaggccgaccucaagaaggagaucaagaagcuccagcgccuccgcgaccagaucaagaccugggucgccuccaacgagaucaaggacaagcgccagcucaucgacaaccgcaagcucaucgagacccagauggagcgcuucaaggucgucgagcgcgagaccaagaccaaggccuacuccaaggagggccucggccucgcccagaaggucgaccccgcccagaaggagaaggaggaggucggccaguggcucaccaacaccaucgacacccucaacaugcaggucgaccaguucgaguccgaggucgagucccucuccguccagacccgcaagaagaagggcgacaaggacaagcaggaccgcaucgagggccucaagcgccacaucgagaagcaccgcuaccacguccgcaugcucgagaccauccuccgcaugcucgacaacgacuccauccucgucgacgccauccgcaagaucaaggacgacgucgaguacuacgucgacuccucccaggaccccgacuucgaggagaacgaguuccucuacgacgaccucgaccucgaggacaucccccaggcccucgucgccaccuccccccccucccacucccacauggaggacgagaucuucaaccaguccuccuccacccccaccuccaccaccuccuccucccccaucccccccucccccgccaacugcaccaccgagaacuccgaggacgacaagaagcgcggccgcuccaccgacuccgaggucucccagucccccgccaagaacggcuccaagcccguccacuccaaccagcacccccagucccccgccgucccccccaccuaccccuccggccccccccccgccgccuccgcccucuccaccacccccggcaacaacggcguccccgcccccgccgccccccccuccgcccucggccccaaggccucccccgcccccucccacaacuccggcacccccgcccccuacgcccaggccgucgccccccccgcccccuccggccccuccaccacccagccccgcccccccuccguccagcccuccggcggcggcggcggcggcuccggcggcggcggcuccuccuccuccuccaacuccuccgccggcggcggcgccggcaagcagaacggcgccaccuccuacuccuccgucgucgccgacucccccgccgaggucgcccucuccuccuccggcggcaacaacgccuccucccaggcccucggcccccccuccggcccccacaaccccccccccuccaccuccaaggagcccuccgccgccgcccccaccggcgccggcggcgucgcccccggcuccggcaacaacuccggcggccccucccuccucgucccccuccccgucaacccccccuccucccccacccccuccuucuccgacgccaaggccgccggcgcccuccucaacggccccccccaguucuccaccgcccccgagaucaaggcccccgagccccucuccucccucaaguccauggccgagcgcgccgccaucuccuccggcaucgaggaccccguccccacccuccaccucaccgagcgcgacaucauccucuccuccaccuccgccccccccgccuccgcccagcccccccuccagcucuccgaggucaacaucccccucucccucggcgucugcccccucggccccgucccccucaccaaggagcagcucuaccagcaggccauggaggaggccgccuggcaccacaugccccaccccuccgacuccgagcgcauccgccaguaccucccccgcaaccccugccccaccccccccuaccaccaccagaugccccccccccacuccgacaccgucgaguucuaccagcgccucuccaccgagacccucuucuucaucuucuacuaccucgagggcaccaaggcccaguaccucgccgccaaggcccucaagaagcaguccuggcgcuuccacaccaaguacaugaugugguuccagcgccacgaggagcccaagaccaucaccgacgaguucgagcagggcaccuacaucuacuucgacuacgagaaguggggccagcgcaagaaggagggcuucaccuucgaguaccgcuaccucgaggaccgcgaccuccaguga

SEQ ID NO: 41521 - RNA, 1719 nt, Artificial Sequence
  derived and/or modified sequence opt2 from CNOT4__Homo_sapiens__NP_001008226
augucccgcucccccgacgccaaggaggaccccgucgagugcccccucugcauggagccccucgagaucgacgacaucaacuucuuccccugcaccugcggcuaccagaucugccgcuucugcuggcaccgcauccgcaccgacgagaacggccucugccccgccugccgcaagcccuaccccgaggaccccgccgucuacaagccccucucccaggaggagcuccagcgcaucaagaacgagaagaagcagaagcagaacgagcgcaagcagaagaucuccgagaaccgcaagcaccucgccuccguccgcgucguccagaagaaccucgucuucgucgucggccucucccagcgccucgccgaccccgagguccucaagcgccccgaguacuucggcaaguucggcaagauccacaaggucgucaucaacaacuccaccuccuacgccggcucccagggccccuccgccuccgccuacgucaccuacauccgcuccgaggacgcccuccgcgccauccagugcgucaacaacgucgucgucgacggccgcacccucaaggccucccucggcaccaccaaguacugcuccuacuuccucaagaacaugcagugccccaagcccgacugcauguaccuccacgagcucggcgacgaggccgccuccuucaccaaggaggagaugcaggccggcaagcaccaggaguacgagcagaagcuccuccaggagcucuacaagcucaaccccaacuuccuccagcucuccaccggcuccgucgacaagaacaagaacaaggucaccccccuccagucccccaucgacaagcccuccgacucccucuccaucggcaacggcgacaacucccagcagaucuccaacuccgacacccccucccccccccccggccucuccaaguccaaccccgucauccccaucuccuccuccaaccacuccgcccgcucccccuucgagggcgccgucaccgagucccagucccucuucuccgacaacuuccgccaccccaaccccauccccuccggccucccccccuuccccuccuccccccagaccuccuccgacuggcccaccgcccccgagccccagucccucuucaccuccgagaccauccccgucuccuccuccaccgacuggcaggccgccuucggcuucggcuccuccaagcagcccgaggacgaccucggcuucgaccccuucgacgucacccgcaaggcccucgccgaccucaucgagaaggagcucuccguccaggaccagcccucccucucccccaccucccuccagaacuccuccucccacaccaccaccgccaagggccccggcuccggcuuccuccaccccgccgccgccaccaacgccaacucccucaacuccaccuucuccguccucccccagcgcuucccccaguuccagcagcaccgcgccgucuacaacuccuucuccuuccccggccaggccgcccgcuaccccuggauggccuucccccgcaacuccaucaugcaccucaaccacaccgccaaccccaccuccaacuccaacuuccucgaccucaaccuccccccccagcacaacaccggccucggcggcauccccgucgccggcgaggaggaggucaaggucuccaccaugccccucuccaccuccucccacucccuccagcagggccagcagcccaccucccuccacaccaccgucgccuga

SEQ ID NO: 41522 - RNA, 1674 nt, Artificial Sequence
  derived and/or modified sequence opt2 from CNOT6__Homo_sapiens__NP_001290170
augcccaaggagaaguacgagccccccgacccccgccgcauguacaccaucauguccuccgaggaggccgccaacggcaagaagucccacugggccgagcucgagaucuccggcaagguccgcucccucuccgccucccucuggucccucacccaccucaccgcccuccaccucuccgacaacucccucucccgcauccccuccgacaucgccaagcuccacaaccucgucuaccucgaccucuccuccaacaagauccgcucccuccccgccgagcucggcaacauggucucccuccgcgagcuccaccucaacaacaaccuccuccgcguccuccccuucgagcucggcaagcucuuccagcuccagacccucggccucaagggcaacccccucacccaggacauccucaaccucuaccaggagcccgacggcacccgccgccuccucaacuaccuccucgacaaccucuccggcaccgccaagcgcaucaccaccgagcagccccccccccgcuccuggaucaugcuccaggagcccgaccgcacccgccccaccgcccucuucuccgucaugugcuacaacguccucugcgacaaguacgccacccgccagcucuacggcuacugccccuccugggcccucaacugggacuaccgcaagaaggccaucauccaggagauccucuccugcaacgccgacaucgucucccuccaggaggucgagaccgagcaguacuacuccuucuuccucgucgagcucaaggagcgcggcuacaacggcuucuucucccccaagucccgcgcccgcaccauguccgagcaggagcgcaagcacgucgacggcugcgccaucuucuucaagaccgagaaguucacccucguccagaagcacaccgucgaguucaaccagcucgccauggccaacuccgagggcuccgaggccaugcucaaccgcgucaugaccaaggacaacaucggcgucgccguccuccucgagcuccgcaaggaguccaucgagaugcccuccggcaagccccaccucggcaccgagaagcagcucauccucgucgccaacgcccacaugcacugggaccccgaguacuccgacgucaagcucguccagaccaugauguuccucuccgaggucaagaacaucaucgacaaggccucccgcaaccucaaguccuccguccucggcgaguucggcaccaucccccucguccucugcgccgaccucaacucccuccccgacuccggcgucgucgaguaccucuccaccggcggcgucgagaccaaccacaaggacuucaaggagcuccgcuacaacgagucccucaccaacuucuccugccacggcaagaacggcaccaccaacggccgcaucacccacggcuucaagcuccaguccgccuacgaguccggccucaugcccuacaccaacuacaccuucgacuucaagggcaucaucgacuacaucuucuacuccaagccccagcucaacacccucggcauccucggcccccucgaccaccacuggcucgucgagaacaacaucuccggcugcccccacccccucauccccuccgaccacuucucccucuucgcccagcucgagcuccuccuccccuuccucccccaggucaacggcauccaccuccccggccgccgcuga

SEQ ID NO: 41523 - RNA, 1668 nt, Artificial Sequence
  derived and/or modified sequence opt2 from CNOT6L__Homo_sapiens__NP_653172
augcgccucaucggcaugcccaaggagaaguacgacccccccgacccccgccgcaucuacaccaucauguccgccgaggaggucgccaacggcaagaagucccacugggccgagcucgagaucuccggccgcguccgcucccucuccaccucccucuggucccucacccaccucaccgcccuccaccucaacgacaacuaccucucccgcaucccccccgacaucgccaagcuccacaaccucgucuaccucgaccucuccuccaacaagcuccgcucccuccccgccgagcucggcaacauggucucccuccgcgagcuccuccucaacaacaaccuccuccgcguccuccccuacgagcucggccgccucuuccagcuccagacccucggccucaagggcaacccccucucccaggacauccucaaccucuaccaggaccccgacggcacccgcaagcuccucaacuucaugcucgacaaccucgccguccaccccgagcagcuccccccccgccccuggaucacccucaaggagcgcgaccagauccuccccuccgccuccuucaccgucaugugcuacaacguccucugcgacaaguacgccacccgccagcucuacggcuacugccccuccugggcccucaacugggaguaccgcaagaagggcaucauggaggagaucgucaacugcgacgccgacaucaucucccuccaggaggucgagaccgagcaguacuucacccucuuccuccccgcccucaaggagcgcggcuacgacggcuucuucucccccaagucccgcgccaagaucauguccgagcaggagcgcaagcacgucgacggcugcgccaucuucuucaagaccgagaaguucacccucguccagaagcacaccgucgaguucaaccaggucgccauggccaacuccgacggcuccgaggccaugcucaaccgcgucaugaccaaggacaacaucggcgucgccgucguccucgagguccacaaggagcucuucggcgccggcaugaagcccauccacgccgccgacaagcagcuccucaucgucgccaacgcccacaugcacugggaccccgaguacuccgacgucaagcucauccagaccaugauguucgucuccgaggucaagaacauccucgagaaggccuccucccgccccggcucccccaccgccgaccccaacuccaucccccucguccucugcgccgaccucaacucccuccccgacuccggcgucgucgaguaccucuccaacggcggcgucgccgacaaccacaaggacuucaaggagcuccgcuacaacgagugccucaugaacuucuccugcaacggcaagaacggcuccuccgagggccgcaucacccacggcuuccagcucaaguccgccuacgagaacaaccucaugcccuacaccaacuacaccuucgacuucaagggcgucaucgacuacaucuucuacuccaagacccacaugaacguccucggcguccucggcccccucgacccccaguggcucgucgagaacaacaucaccggcugcccccacccccacauccccuccgaccacuucucccuccucacccagcucgagcuccaccccccccuccucccccucgucaacggcguccaccuccccaaccgccgcuga

SEQ ID NO: 41524 - RNA, 858 nt, Artificial Sequence
  derived and/or modified sequence opt2 from CNOT7__Homo_sapiens__NP_037486
augcccgccgccaccgucgaccacucccagcgcaucugcgaggucugggccugcaaccucgacgaggagaugaagaagauccgccaggucauccgcaaguacaacuacgucgccauggacaccgaguuccccggcgucgucgcccgccccaucggcgaguuccgcuccaacgccgacuaccaguaccagcuccuccgcugcaacgucgaccuccucaagaucauccagcucggccucaccuucaugaacgagcagggcgaguacccccccggcaccuccaccuggcaguucaacuucaaguucaaccucaccgaggacauguacgcccaggacuccaucgagcuccucaccaccuccggcauccaguucaagaagcacgaggaggagggcaucgagacccaguacuucgccgagcuccucaugaccuccggcgucguccucugcgagggcgucaaguggcucuccuuccacuccggcuacgacuucggcuaccucaucaagauccucaccaacuccaaccuccccgaggaggagcucgacuucuucgagauccuccgccucuucuuccccgucaucuacgacgucaaguaccucaugaaguccugcaagaaccucaagggcggccuccaggaggucgccgagcagcucgagcucgagcgcaucggcccccagcaccaggccggcuccgacucccuccucaccggcauggccuucuucaagaugcgcgagauguucuucgaggaccacaucgacgacgccaaguacugcggccaccucuacggccucggcuccggcuccuccuacguccagaacggcaccggcaacgccuacgaggaggaggccaacaagcaguccuga

SEQ ID NO: 41525 - RNA, 717 nt, Artificial Sequence
  derived and/or modified sequence opt2 from CNOT8__Homo_sapiens__NP_001288003
augcccgccgcccucgucgagaacucccaggucaucugcgaggucugggccuccaaccucgaggaggagaugcgcaagauccgcgagaucguccucuccuacuccuacaucgccauggacaccgaguuccccggcgucgucguccgccccaucggcgaguuccgcuccuccaucgacuaccaguaccagcuccuccgcugcaacgucgaccuccucaagaucauccagcucggccucaccuucaccaacgagaagggcgaguaccccuccggcaucaacaccuggcaguucaacuucaaguucaaccucaccggcuacgacuucggcuacauggucaagcuccucaccgacucccgccuccccgaggaggagcacgaguucuuccacauccucaaccucuucuuccccuccaucuacgacgucaaguaccucaugaaguccugcaagaaccucaagggcggccuccaggaggucgccgaccagcucgaccuccagcgcaucggccgccagcaccaggccggcuccgacucccuccucaccggcauggccuucuuccgcaugaaggagcucuucuucgaggacuccaucgacgacgccaaguacugcggccgccucuacggccucggcaccggcgucgcccagaagcagaacgaggacgucgacuccgcccaggagaagauguccauccucgccaucaucaacaacaugcagcaguga

SEQ ID NO: 41526 - RNA, 1266 nt, Artificial Sequence
  derived and/or modified sequence opt2 from CNP__Homo_sapiens__NP_149124
augaaccgcggcuucucccgcaagucccacaccuuccuccccaagaucuucuuccgcaagauguccuccuccggcgccaaggacaagcccgagcuccaguuccccuuccuccaggacgaggacaccgucgccacccuccucgagugcaagacccucuucauccuccgcggccuccccggcuccggcaaguccacccucgcccgcgucaucgucgacaaguaccgcgacggcaccaagauggucuccgccgacgccuacaagaucacccccggcgcccgcggcgccuucuccgaggaguacaagcgccucgacgaggaccucgccgccuacugccgccgccgcgacauccgcauccucguccucgacgacaccaaccacgagcgcgagcgccucgagcagcucuucgagauggccgaccaguaccaguaccaggucguccucgucgagcccaagaccgccuggcgccucgacugcgcccagcucaaggagaagaaccaguggcagcucuccgccgacgaccucaagaagcucaagcccggccucgagaaggacuuccucccccucuacuucggcugguuccucaccaagaaguccuccgagacccuccgcaaggccggccaggucuuccucgaggagcucggcaaccacaaggccuucaagaaggagcuccgccaguucguccccggcgacgagccccgcgagaagauggaccucgucaccuacuucggcaagcgcccccccggcguccuccacugcaccaccaaguucugcgacuacggcaaggcccccggcgccgaggaguacgcccagcaggacguccucaagaaguccuacuccaaggccuucacccucaccaucuccgcccucuucgucacccccaagaccaccggcgcccgcgucgagcucuccgagcagcagcuccagcucuggcccuccgacgucgacaagcucucccccaccgacaaccucccccgcggcucccgcgcccacaucacccucggcugcgccgccgacgucgaggccguccagaccggccucgaccuccucgagauccuccgccaggagaagggcggcucccgcggcgaggaggucggcgagcucucccgcggcaagcucuacucccucggcaacggccgcuggaugcucacccucgccaagaacauggagguccgcgccaucuucaccggcuacuacggcaagggcaagcccguccccacccagggcucccgcaagggcggcgcccuccaguccugcaccaucaucuga

SEQ ID NO: 41527 - RNA, 549 nt, Artificial Sequence
  derived and/or modified sequence opt2 from CNPY2__Homo_sapiens__NP_055070
augaagggcuggggcuggcucgcccuccuccucggcgcccuccucggcaccgccugggcccgccgcucccaggaccuccacugcggcgccugccgcgcccucgucgacgagcucgagugggagaucgcccaggucgaccccaagaagaccauccagaugggcuccuuccgcaucaaccccgacggcucccaguccgucgucgagguccccuacgcccgcuccgaggcccaccucaccgagcuccucgaggagaucugcgaccgcaugaaggaguacggcgagcagaucgaccccuccacccaccgcaagaacuacguccgcgucgucggccgcaacggcgaguccuccgagcucgaccuccagggcauccgcaucgacuccgacaucuccggcacccucaaguucgccugcgaguccaucgucgaggaguacgaggacgagcucaucgaguucuucucccgcgaggccgacaacgucaaggacaagcucugcuccaagcgcaccgaccucugcgaccacgcccuccacaucucccacgacgagcucuga

SEQ ID NO: 41528 - RNA, 837 nt, Artificial Sequence
  derived and/or modified sequence opt2 from CNPY3__Homo_sapiens__NP_006577
auggacuccaugcccgagcccgccucccgcugccuccuccuccucccccuccuccuccuccuccuccuccuccuccccgcccccgagcucggccccucccaggccggcgccgaggagaacgacuggguccgccuccccuccaagugcgaggucugcaaguacgucgccgucgagcucaaguccgccuucgaggagaccggcaagaccaaggaggucaucggcaccggcuacggcauccucgaccagaaggccuccggcgucaaguacaccaaguccgaccuccgccucaucgaggucaccgagaccaucugcaagcgccuccucgacuacucccuccacaaggagcgcaccggcuccaaccgcuucgccaagggcauguccgagaccuucgagacccuccacaaccucguccacaagggcgucaaggucgucauggacauccccuacgagcucuggaacgagaccuccgccgaggucgccgaccucaagaagcagugcgacguccucgucgaggaguucgaggaggucaucgaggacugguaccgcaaccaccaggaggaggaccucaccgaguuccucugcgccaaccacguccucaagggcaaggacaccuccugccucgccgagcagugguccggcaagaagggcgacaccgccgcccucggcggcaagaaguccaagaagaaguccucccgcgccaaggccgccggcggccgcuccuccuccuccaagcagcgcaaggagcucggcggccucgagggcgaccccucccccgaggaggacgagggcauccagaaggccuccccccucacccacuccccccccgacgagcucuga

SEQ ID NO: 41529 - RNA, 1419 nt, Artificial Sequence
  derived and/or modified sequence opt2 from CNR1__Homo_sapiens__NP_001153731
augaaguccauccucgacggccucgccgacaccaccuuccgcaccaucaccaccgaccuccucuacgucggcuccaacgacauccaguacgaggacaucaagggcgacauggccuccaagcucggcuacuucccccagaaguucccccucaccuccuuccgcggcucccccuuccaggagaagaugaccgccggcgacaacccccagcucguccccgccgaccaggucaacaucaccgaguucuacaacaagucccucuccuccuucaaggagaacgaggagaacauccagugcggcgagaacuucauggacaucgagugcuucaugguccucaaccccucccagcagcucgccaucgccguccucucccucacccucggcaccuucaccguccucgagaaccuccucguccucugcgucauccuccacucccgcucccuccgcugccgccccuccuaccacuucaucggcucccucgccgucgccgaccuccucggcuccgucaucuucgucuacuccuucaucgacuuccacgucuuccaccgcaaggacucccgcaacgucuuccucuucaagcucggcggcgucaccgccuccuucaccgccuccgucggcucccucuuccucaccgccaucgaccgcuacaucuccauccaccgcccccucgccuacaagcgcaucgucacccgccccaaggccgucgucgccuucugccucauguggaccaucgccaucgucaucgccguccucccccuccucggcuggaacugcgagaagcuccaguccgucugcuccgacaucuucccccacaucgacgagaccuaccucauguucuggaucggcgucaccuccguccuccuccucuucaucgucuacgccuacauguacauccucuggaaggcccacucccacgccguccgcaugauccagcgcggcacccagaaguccaucaucauccacaccuccgaggacggcaagguccaggucacccgccccgaccaggcccgcauggacauccgccucgccaagacccucguccucauccucgucguccucaucaucugcuggggcccccuccucgccaucauggucuacgacgucuucggcaagaugaacaagcucaucaagaccgucuucgccuucugcuccaugcucugccuccucaacuccaccgucaaccccaucaucuacgcccuccgcuccaaggaccuccgccacgccuuccgcuccauguuccccuccugcgagggcaccgcccagccccucgacaacuccaugggcgacuccgacugccuccacaagcacgccaacaacgccgccuccguccaccgcgccgccgaguccugcaucaaguccaccgucaagaucgccaaggucaccauguccgucuccaccgacaccuccgccgaggcccucuga

SEQ ID NO: 41530 - RNA, 1083 nt, Artificial Sequence
  derived and/or modified sequence opt2 from CNR2__Homo_sapiens__XP_011538931
auggaggagugcugggucaccgagaucgccaacggcuccaaggacggccucgacuccaaccccaugaaggacuacaugauccucuccggcccccagaagaccgccgucgccguccucugcacccuccucggccuccucuccgcccucgagaacgucgccguccucuaccucauccucuccucccaccagcuccgccgcaagcccuccuaccucuucaucggcucccucgccggcgccgacuuccucgccuccgucgucuucgccugcuccuucgucaacuuccacgucuuccacggcgucgacuccaaggccgucuuccuccucaagaucggcuccgucaccaugaccuucaccgccuccgucggcucccuccuccucaccgccaucgaccgcuaccucugccuccgcuacccccccuccuacaaggcccuccucacccgcggccgcgcccucgucacccucggcaucauguggguccucuccgcccucgucuccuaccucccccucaugggcuggaccugcugcccccgccccugcuccgagcucuucccccucauccccaacgacuaccuccucuccuggcuccucuucaucgccuuccucuucuccggcaucaucuacaccuacggccacguccucuggaaggcccaccagcacgucgccucccucuccggccaccaggaccgccagguccccggcauggcccgcaugcgccucgacguccgccucgccaagacccucggccucguccucgccguccuccucaucugcugguuccccguccucgcccucauggcccacucccucgccaccacccucuccgaccaggucaagaaggccuucgccuucugcuccaugcucugccucaucaacuccauggucaaccccgucaucuacgcccuccgcuccggcgagauccgcuccuccgcccaccacugccucgcccacuggaagaagugcguccgcggccucggcuccgaggccaaggaggaggccccccgcuccuccgucaccgagaccgaggccgacggcaagaucacccccuggcccgacucccgcgaccucgaccucuccgacugcuga

SEQ ID NO: 41531 - RNA, 387 nt, Artificial Sequence
  derived and/or modified sequence opt2 from CNRIP1__Homo_sapiens__NP_001104571
augggcgaccuccccggccucguccgccucuccaucgcccuccgcauccagcccaacgacggccccgucuucuacaaggucgacggccagcgcuucggccagaaccgcaccaucaagcuccucaccggcuccuccuacaaggucgaggucaagaucaagcccuccacccuccaggucgagaacaucuccaucggcggcguccucgucccccucgagcucaaguccaaggagcccgacggcgaccgcgucgucuacaccggcaccuacgacaccgagggcgucacccccaccaaguccggcgagcgccagcccauccagaucaccaugcccgagugccucgagcagcgcccccaggagaucucccucaccuacgagugcgaggaguga

SEQ ID NO: 41532 - RNA, 1851 nt, Artificial Sequence
  derived and/or modified sequence opt2 from CNST__Homo_sapiens__NP_001132931
auggacgacuccgacacccccaccuacuaccuccagaucgagccccaggacggcugccaccccggcgacuccgucgagcgcuccgucaccugccuccccuccgccuccgacgagaacgagaaccagcucgacggcgacggccacgagcaccucaccuccuccgacuccgccaugggcaagccccaggucuccgagcaggacucccucaacaacaacgaguccugcacccucuccugcgaggucgccgccggcgagaaccuccagaacacccucugcgaggccucccgcgacgagcaggccuuccucggcaaggacaagaagauccccggcaagcgcuccccccgcuccaagaagggcaccgccaagaagaucccccccggccucuucuccggcgacaucgccccccucaugcaggagaagguccucuccgccgucaccuacgccgucgacgacgaggaggccgccgaggucaacgccaacgagcagcccgaggcccccaagcucguccuccagucccucuucucccucauccgcggcgaggucgagcagcucgacucccgcgcccucccccucugccuccaccagaucgccgaguccuacuuccaggaggaggacuacgagaaggccaugaaguucauccagcucgagcgccucuaccacgagcagcuccucgccaaccucuccgccauccaggagcagugggagaccaaguggaagaccguccagccccacaccgucaccgcccuccgcaacuccgagaagggcuucaacggcgaggacuucgagcgccucaccaagaucugcgccacccaccaggacccccuccucuccaagcacaagaucgccgccgucgagaagucccaggagcgcaagugcuccacccagcuccucgucuccgaggaccccaaggagggcggcgccaccaccaaggaguccgaguccaagaccugccucggcaccgaguccuccaaggagucccagcacaccgucgagccccucggcuccucccccugcugccaccagauggacguccagaccgacucccccucccucuccgucaccgccggcaaggaccacauggaggagcuccucugcuccgccgaggccacccucgcccuccacacccaguccuccgagaccgccggcucccccuccggccccgacuccuccgaggacgccugcgaggacgacucccgccuccagcucgcccagaccgaggccugccaggacgucgcccgcaucgagggcaucgccgaggaccccaaggucuuccucuccuccaaguccaagaccgagccccucaucucccccggcugcgaccgcaucccccccgcccucaucuccgagggcaaguacucccaggcccagcgcaaggagcuccgccucccccuccgcgacgccuccgaggcccuccccaccgaccagcucgagaacaacgagcucaacgagcuccagcagcccgaccucaccgacuccgacggcaaguccccccaggcccaggccgacuccgacggcuccgagaacguccucugcggcaacaaccagaucuccgaccucggcauccuccuccccgaggucugcauggcccccgaggagaagggcgacaaggacgaccagcucaacaaggagaccgaggacuaccucaacucccuccucgagggcugccucaaggacaccgaggacucccucuccuacgaggacaaccaggacgacgacuccgaccuccuccaggaccucucccccgaggaggccuccuacucccuccaggagaaccuccccuccgacgaguccugccucucccucgacgaccucgccaagcgcaucgagaucgccgaggucaaccagcgcuga

SEQ ID NO: 41533 - RNA, 603 nt, Artificial Sequence
  derived and/or modified sequence opt2 from CNTF__Homo_sapiens__NP_000605
auggccuucaccgagcacuccccccucaccccccaccgccgcgaccucugcucccgcuccaucuggcucgcccgcaagauccgcuccgaccucaccgcccucaccgaguccuacgucaagcaccagggccucaacaagaacaucaaccucgacuccgccgacggcaugcccgucgccuccaccgaccagugguccgagcucaccgaggccgagcgccuccaggagaaccuccaggccuaccgcaccuuccacguccuccucgcccgccuccucgaggaccagcagguccacuucacccccaccgagggcgacuuccaccaggccauccacacccuccuccuccaggucgccgccuucgccuaccagaucgaggagcucaugauccuccucgaguacaagaucccccgcaacgaggccgacggcaugcccaucaacgucggcgacggcggccucuucgagaagaagcucuggggccucaagguccuccaggagcucucccaguggaccguccgcuccauccacgaccuccgcuucaucuccucccaccagaccggcauccccgcccgcggcucccacuacaucgccaacaacaagaagauguga

SEQ ID NO: 41534 - RNA, 1119 nt, Artificial Sequence
  derived and/or modified sequence opt2 from CNTFR__Homo_sapiens__NP_001193940
auggccgcccccguccccugggccugcugcgccguccucgccgccgccgccgccgucgucuacgcccagcgccacuccccccaggaggccccccacguccaguacgagcgccucggcuccgacgucacccuccccugcggcaccgccaacugggacgccgccgucaccuggcgcgucaacggcaccgaccucgcccccgaccuccucaacggcucccagcucguccuccacggccucgagcucggccacuccggccucuacgccugcuuccaccgcgacuccuggcaccuccgccaccagguccuccuccacgucggccuccccccccgcgagcccguccucuccugccgcuccaacaccuaccccaagggcuucuacugcuccuggcaccuccccacccccaccuacauccccaacaccuucaacgucaccguccuccacggcuccaagaucauggucugcgagaaggaccccgcccucaagaaccgcugccacauccgcuacaugcaccucuucuccaccaucaaguacaaggucuccaucuccgucuccaacgcccucggccacaacgccaccgccaucaccuucgacgaguucaccaucgucaagcccgacccccccgagaacgucgucgcccgccccguccccuccaacccccgccgccucgaggucaccuggcagacccccuccaccuggcccgaccccgaguccuucccccucaaguucuuccuccgcuaccgcccccucauccucgaccaguggcagcacgucgagcucuccgacggcaccgcccacaccaucaccgacgccuacgccggcaaggaguacaucauccaggucgccgccaaggacaacgagaucggcaccugguccgacugguccgucgccgcccacgccacccccuggaccgaggagccccgccaccucaccaccgaggcccaggccgccgagaccaccaccuccaccaccuccucccucgcccccccccccaccaccaagaucugcgaccccggcgagcucggcuccggcggcggccccuccgcccccuuccucgucuccguccccaucacccucgcccucgccgccgccgccgccaccgccuccucccuccucaucuga

SEQ ID NO: 41535 - RNA, 1176 nt, Artificial Sequence
  derived and/or modified sequence opt2 from CNTLN__Homo_sapiens__NP_001107867
auggccgcccgcuccccccccuccccccaccccuccccccccgcccgccagcucggcccccgcuccccccgcgucggccgcggcgccgagguccacgccaugcgcuccgaggccuccggcuucgccggcgccgcccgcgaggucgucgccgacgaguccgacaagaucugggucggcgaggagggcuccggcggccgccgcggccccggcggcgccgcccccgcccacgccccccuccucuccgcccccaugggcucccgccgccucgagggcaucuccgucgaggaggccauggucacccgcacccagcuccucgaggaggagcucuccucccucaaggaggagcucgcccucugccaggccgacaaggaguucgucuggucccucuggaagcgccuccaggucaccaaccccgaccucacccaggucgucucccucgucgucgagcgcgagaagcagaaguccgaggccaaggaccgcaagguccucgagauccuccaggucaaggacgccaagauccaggaguucgagcagcgcgaguccguccucaagcaggagaucaacgaccucgucaagcgcaagaucgccgucgacgaggagaacgccuuccuccgcaaggaguucuccgaccucgagaagaaguucaaggacaagucccaggagaucaaggacaccaaggagugcguccagaacaaggaggagcagaaccgccucgucaucaagaaccucgaggaggagaacaagaagcucuccacccgcugcaccgaccuccucaacgaccucgagaagcuccgcaagcaggaggcccaccuccgcaaggagaaguacuccaccgacgccaagaucaagaccuucgaggacaaccucaucgaggcccgcaaggaggucgaggucucccaguccaaguacaacgcccucucccuccagcucuccaacaagcagaccgagcucauccagaaggacauggacaucacccucguccgcaaggagcuccaggagcuccagaaccucuacaagcagaacuccacccacaccgcccagcaggccgagcucauccagcagcuccagguccucaacauggacacccagaagguccuccgcaaccaggaggacguccacaccgccgaguccaucuccuaccagaaggucugcuucuacuccgucaucaagauguga

SEQ ID NO: 41536 - RNA, 1884 nt, Artificial Sequence
  derived and/or modified sequence opt2 from CNTN1__Homo_sapiens__NP_001242993
augaagauguggcuccucgucucccaccucgucaucaucuccaucaccaccugccucgccgaguucaccugguaccgccgcuacggccacggcgucuccgaggaggacaagggcuucggccccaucuucgaggagcagcccaucaacaccaucuaccccgaggagucccucgagggcaaggucucccucaacugccgcgcccgcgccucccccuuccccgucuacaaguggcgcaugaacaacggcgacgucgaccucaccuccgaccgcuacuccauggucggcggcaaccucgucaucaacaaccccgacaagcagaaggacgccggcaucuacuacugccucgccuccaacaacuacggcaugguccgcuccaccgaggccacccucuccuucggcuaccucgaccccuucccccccgaggagcgccccgagguccgcgucaaggagggcaagggcaugguccuccucugcgacccccccuaccacuuccccgacgaccucuccuaccgcuggcuccucaacgaguuccccgucuucaucaccauggacaagcgccgcuucgucucccagaccaacggcaaccucuacaucgccaacgucgaggccuccgacaagggcaacuacuccugcuucgucuccucccccuccaucaccaaguccgucuucuccaaguucaucccccucauccccauccccgagcgcaccaccaagcccuaccccgccgacaucgucguccaguucaaggacgucuacgcccucaugggccagaacgucacccucgagugcuucgcccucggcaaccccguccccgacauccgcuggcgcaagguccucgagcccaugcccuccaccgccgagaucuccaccuccggcgccguccucaagaucuucaacauccagcucgaggacgagggcaucuacgagugcgaggccgagaacauccgcggcaaggacaagcaccaggcccgcaucuacguccaggccuuccccgagugggucgagcacaucaacgacaccgaggucgacaucggcuccgaccucuacuggcccugcgucgccaccggcaagcccauccccaccauccgcuggcucaagaacggcuacgccuaccacaagggcgagcuccgccucuacgacgucaccuucgagaacgccggcauguaccagugcaucgccgagaacaccuacggcgccaucuacgccaacgccgagcucaagauccucgcccucgcccccaccuucgagaugaaccccaugaagaagaagauccucgccgccaagggcggccgcgucaucaucgagugcaagcccaaggccgcccccaagcccaaguucuccugguccaagggcaccgaguggcucgucaacuccucccgcauccucaucugggaggacggcucccucgagaucaacaacaucacccgcaacgacggcggcaucuacaccugcuucgccgagaacaaccgcggcaaggccaacuccaccggcacccucgucaucaccgaccccacccgcaucauccucgcccccaucaacgccgacaucaccgucggcgagaacgccaccaugcagugcgccgccuccuucgaccccgcccucgaccucaccuucgucugguccuucaacggcuacgucaucgacuucaacaaggagaacauccacuaccagcgcaacuucaugcucgacuccaacggcgagcuccucauccgcaacgcccagcucaagcacgccggccgcuacaccugcaccgcccagaccaucgucgacaacuccuccgccuccgccgaccucgucguccgcggcaagaaccgcaagggcggcgagaagaacauggucgacuccuuccuccccgucugcgccucccucccccccaccugguga

SEQ ID NO: 41537 - RNA, 3123 nt, Artificial Sequence
  derived and/or modified sequence opt2 from CNTN2__Homo_sapiens__NP_005067
augggcaccgccacccgccgcaagccccaccuccuccucgucgccgccgucgcccucgucuccuccuccgccugguccuccgcccucggcucccagaccaccuucggccccgucuucgaggaccagccccucuccguccucuuccccgaggaguccaccgaggagcagguccuccucgccugccgcgcccgcgccuccccccccgccaccuaccgcuggaagaugaacggcaccgagaugaagcucgagcccggcucccgccaccagcucgucggcggcaaccucgucaucaugaaccccaccaaggcccaggacgccggcgucuaccagugccucgccuccaaccccgucggcaccgucgucucccgcgaggccauccuccgcuucggcuuccuccaggaguucuccaaggaggagcgcgaccccgucaaggcccacgagggcuggggcgucaugcuccccugcaacccccccgcccacuaccccggccucuccuaccgcuggcuccucaacgaguuccccaacuucauccccaccgacggccgccacuucgucucccagaccaccggcaaccucuacaucgcccgcaccaacgccuccgaccucggcaacuacuccugccucgccaccucccacauggacuucuccaccaaguccgucuucuccaaguucgcccagcucaaccucgccgccgaggacacccgccucuucgcccccuccaucaaggcccgcuuccccgccgagaccuacgcccucgucggccagcaggucacccucgagugcuucgccuucggcaaccccgucccccgcaucaaguggcgcaaggucgacggcucccucuccccccaguggaccaccgccgagcccacccuccagauccccuccgucuccuucgaggacgagggcaccuacgagugcgaggccgagaacuccaagggccgcgacaccguccagggccgcaucaucguccaggcccagcccgaguggcucaaggucaucuccgacaccgaggccgacaucggcuccaaccuccgcuggggcugcgccgccgccggcaagccccgccccaccguccgcuggcuccgcaacggcgagccccucgccucccagaaccgcgucgagguccucgccggcgaccuccgcuucuccaagcucucccucgaggacuccggcauguaccagugcgucgccgagaacaagcacggcaccaucuacgccuccgccgagcucgccguccaggcccucgcccccgacuuccgccucaaccccguccgccgccucauccccgccgcccgcggcggcgagauccucauccccugccagccccgcgccgcccccaaggccgucguccucugguccaagggcaccgagauccucgucaacuccucccgcgucaccgucacccccgacggcacccucaucauccgcaacaucucccgcuccgacgagggcaaguacaccugcuucgccgagaacuucaugggcaaggccaacuccaccggcauccucuccguccgcgacgccaccaagaucacccucgcccccuccuccgccgacaucaaccucggcgacaaccucacccuccagugccacgccucccacgaccccaccauggaccucaccuucaccuggacccucgacgacuuccccaucgacuucgacaagcccggcggccacuaccgccgcaccaacgucaaggagaccaucggcgaccucaccauccucaacgcccagcuccgccacggcggcaaguacaccugcauggcccagaccgucgucgacuccgccuccaaggaggccaccguccucguccgcggcccccccggcccccccggcggcgucgucguccgcgacaucggcgacaccaccauccagcucuccuggucccgcggcuucgacaaccacucccccaucgccaaguacacccuccaggcccgcaccccccccgccggcaaguggaagcagguccgcaccaaccccgccaacaucgagggcaacgccgagaccgcccagguccucggccucacccccuggauggacuacgaguuccgcgucaucgccuccaacauccucggcaccggcgagcccuccggccccuccuccaagauccgcacccgcgaggccgcccccuccgucgcccccuccggccucuccggcggcggcggcgcccccggcgagcucaucgucaacuggacccccaugucccgcgaguaccagaacggcgacggcuucggcuaccuccucuccuuccgccgccagggcuccacccacuggcagaccgcccgcguccccggcgccgacgcccaguacuucgucuacuccaacgaguccguccgccccuacacccccuucgaggucaagauccgcuccuacaaccgccgcggcgacggccccgagucccucaccgcccucgucuacuccgccgaggaggagccccgcgucgcccccaccaaggucugggccaagggcgucuccuccuccgagaugaacgucaccugggagcccguccagcaggacaugaacggcauccuccucggcuacgagauccgcuacuggaaggccggcgacaaggaggccgccgccgaccgcguccgcaccgccggccucgacaccuccgcccgcgucuccggccuccaccccaacaccaaguaccacgucaccguccgcgccuacaaccgcgccggcaccggccccgccucccccuccgccaacgccaccaccaugaagccccccccccgccgcccccccggcaacaucuccuggaccuucuccuccuccucccucuccaucaagugggaccccgucguccccuuccgcaacgaguccgccgucaccggcuacaagaugcucuaccagaacgaccuccaccucacccccacccuccaccucaccggcaagaacuggaucgagauccccguccccgaggacaucggccacgcccucguccagauccgcaccaccggccccggcggcgacggcauccccgccgagguccacaucguccgcaacggcggcaccuccaugauggucgagaacauggccguccgccccgccccccaccccggcaccgucaucucccacuccgucgccaugcucauccucaucggcucccucgagcucuga

SEQ ID NO: 41538 - RNA, 3087 nt, Artificial Sequence
  derived and/or modified sequence opt2 from CNTN3__Homo_sapiens__NP_065923
augauguuccccuggaagcagcucauccuccucuccuucaucggcugccucggcggcgagcuccuccuccagggccccgucuucaucaaggagcccuccaacuccaucuuccccgucggcuccgaggacaagaagaucacccuccacugcgaggcccgcggcaaccccuccccccacuaccgcuggcagcucaacggcuccgacaucgacauguccauggagcaccgcuacaagcucaacggcggcaaccucgucgucaucaaccccaaccgcaacugggacaccggcaccuaccagugcuucgccaccaacucccucggcaccaucgucucccgcgaggccaagcuccaguucgccuaccucgagaacuucaagaccaagaugcgcuccaccgucuccguccgcgagggccagggcgucguccuccucugcggcccccccccccacuccggcgagcucuccuacgccuggaucuucaacgaguaccccuccuucgucgaggaggacucccgccgcuucgucucccaggagaccggccaccucuacaucuccaaggucgagcccuccgacgucggcaacuacaccugcgucgucaccuccauggucaccaacgcccgcguccucggcucccccaccccccucguccuccgcuccgacggcgucaugggcgaguacgagcccaagaucgagguccaguuccccgagacccuccccgccgccaagggcuccaccgucaagcucgagugcuucgcccucggcaaccccaucccccagaucaacuggcgccgcuccgacggccuccccuucuccuccaagaucaagcuccgcaaguucuccggcguccucgagauccccaacuuccagcaggaggacgccggcuccuacgagugcaucgccgagaacucccgcggcaagaacgucgcccgcggccgccucaccuacuacgccaagccccacuggguccagcucaucaaggacgucgagaucgccgucgaggacucccucuacugggagugccgcgccuccggcaagcccaagcccuccuaccgcuggcucaagaacggcgccgcccucguccucgaggagcgcacccagaucgagaacggcgcccucaccaucuccaaccucuccgucaccgacuccggcauguuccagugcaucgccgagaacaagcacggccucgucuacuccuccgccgagcucaaggucgucgccuccgcccccgacuucuccaagaaccccaugaagaagcucguccagguccaggucggcucccucgucucccucgacugcaagccccgcgccuccccccgcgcccucuccuccuggaagaagggcgacgucuccguccaggagcacgagcgcaucucccuccucaacgacggcggccucaagaucgccaacgucaccaaggccgacgccggcaccuacaccugcauggccgagaaccaguucggcaaggccaacggcaccacccaccucgucgucaccgagcccacccgcaucacccucgcccccuccaacauggacgucuccgucggcgaguccgucauccuccccugccagguccagcacgacccccuccucgacaucaucuucaccugguacuucaacggcgcccucgccgacuucaagaaggacggcucccacuucgagaaggucggcggcuccuccuccggcgaccucaugauccgcaacauccagcucaagcacuccggcaaguacgucugcaugguccagaccggcgucgacuccgucuccuccgccgccgaccucaucguccgcggcucccccggcccccccgagaacgucaaggucgacgagaucaccgacaccaccgcccagcucuccuggaaggagggcaaggacaaccacucccccgucaucuccuacuccauccaggcccgcacccccuucuccgucggcuggcagaccgucaccaccguccccgaggucaucgacggcaagacccacaccgccaccgucgucgagcucaaccccugggucgaguacgaguuccgcgucgucgccuccaacaagaucggcggcggcgagcccucccuccccuccgagaagguccgcaccgaggaggccguccccgaggucccccccuccgaggucaacggcggcggcggcucccgcuccgagcucgucaucaccugggaccccguccccgaggagcuccagaacggcgagggcuucggcuacgucgucgccuuccgcccccucggcgucaccaccuggauccagaccgucgucaccucccccgacaccccccgcuacgucuuccgcaacgaguccaucguccccuacucccccuacgaggucaaggucggcgucuacaacaacaagggcgagggccccuucucccccgucaccaccgucuucuccgccgaggaggagcccaccgucgcccccucccaggucuccgccaacucccucuccuccuccgagaucgaggucuccuggaacaccauccccuggaagcucuccaacggccaccuccucggcuacgagguccgcuacuggaacggcggcggcaaggaggaguccuccuccaagaugaaggucgccggcaacgagaccuccgcccgccuccgcggccucaaguccaaccucgccuacuacaccgccguccgcgccuacaacuccgccggcgccggccccuucuccgccaccgucaacgucaccaccaagaagaccccccccucccagccccccggcaacgucgucuggaacgccaccgacaccaagguccuccucaacugggagcaggucaaggccauggagaacgaguccgaggucaccggcuacaaggucuucuaccgcaccuccucccagaacaacguccagguccucaacaccaacaagaccuccgccgagcucguccuccccaucaaggaggacuacaucaucgaggucaaggccaccaccgacggcggcgacggcaccuccuccgagcagauccgcaucccccgcaucaccuccauggacgcccgcggcuccaccuccgccaucuccaacguccaccccauguccuccuacaugcccaucguccucuuccucaucgucuacguccucugguga

SEQ ID NO: 41539 - RNA, 3081 nt, Artificial Sequence
  derived and/or modified sequence opt2 from CNTN4__Homo_sapiens__NP_001193884
augcgccuccccugggagcuccucguccuccaguccuucauccucugccucgccgacgacuccacccuccacggccccaucuucauccaggagcccucccccgucauguucccccucgacuccgaggagaagaaggucaagcucaacugcgaggucaagggcaaccccaagccccacauccgcuggaagcucaacggcaccgacgucgacaccggcauggacuuccgcuacuccgucgucgagggcucccuccucaucaacaaccccaacaagacccaggacgccggcaccuaccagugcaccgccaccaacuccuucggcaccaucgucucccgcgaggccaagcuccaguucgccuaccucgacaacuucaagacccgcacccgcuccaccgucuccguccgccgcggccagggcaugguccuccucugcggcccccccccccacuccggcgagcucuccuacgccuggaucuucaacgaguaccccuccuaccaggacaaccgccgcuucgucucccaggagaccggcaaccucuacaucgccaaggucgagaaguccgacgucggcaacuacaccugcgucgucaccaacaccgucaccaaccacaagguccucggcccccccaccccccucauccuccgcaacgacggcgucaugggcgaguacgagcccaagaucgagguccaguuccccgagaccguccccaccgccaagggcgccaccgucaagcucgagugcuucgcccucggcaaccccguccccaccaucaucuggcgccgcgccgacggcaagcccaucgcccgcaaggcccgccgccacaaguccaacggcauccucgagauccccaacuuccagcaggaggacgccggccucuacgagugcgucgccgagaacucccgcggcaagaacgucgcccgcggccagcucaccuucuacgcccagcccaacuggauccagaagaucaacgacauccacgucgccauggaggagaacgucuucugggagugcaaggccaacggccgccccaagcccaccuacaaguggcucaagaacggcgagccccuccucacccgcgaccgcauccagaucgagcagggcacccucaacaucaccaucgucaaccucuccgacgccggcauguaccagugccucgccgagaacaagcacggcgucaucuucuccaacgccgagcucuccgucaucgccgucggccccgacuucucccgcacccuccucaagcgcgucacccucgucaaggucggcggcgaggucgucaucgagugcaagcccaaggccucccccaagcccgucuacaccuggaagaagggccgcgacauccucaaggagaacgagcgcaucaccaucuccgaggacggcaaccuccgcaucaucaacgucaccaaguccgacgccggcuccuacaccugcaucgccaccaaccacuucggcaccgccuccuccaccggcaaccucgucgucaaggaccccacccgcgucauggucccccccuccuccauggacgucaccgucggcgaguccaucguccuccccugccaggucacccacgaccacucccucgacaucgucuucaccugguccuucaacggccaccucaucgacuucgaccgcgacggcgaccacuucgagcgcgucggcggccaggacuccgccggcgaccucaugauccgcaacauccagcucaagcacgccggcaaguacgucugcaugguccagaccuccgucgaccgccucuccgccgccgccgaccucaucguccgcggcccccccggcccccccgaggccgucaccaucgacgagaucaccgacaccaccgcccagcucuccuggcgccccggccccgacaaccacucccccaucaccauguacgucauccaggcccgcacccccuucuccgucggcuggcaggccgucuccaccguccccgagcucaucgacggcaagaccuucaccgccaccgucgucggccucaaccccugggucgaguacgaguuccgcaccgucgccgccaacgucaucggcaucggcgagcccucccgccccuccgagaagcgccgcaccgaggaggcccuccccgaggucacccccgccaacgucuccggcggcggcggcuccaaguccgagcucgucaucaccugggagaccguccccgaggagcuccagaacggccgcggcuucggcuacgucgucgccuuccgccccuacggcaagaugaucuggaugcucaccguccucgccuccgccgacgccucccgcuacgucuuccgcaacgaguccguccaccccuucucccccuucgaggucaaggucggcgucuucaacaacaagggcgagggccccuucucccccaccaccgucgucuacuccgccgaggaggagcccaccaagccccccgccuccaucuucgcccgcucccucuccgccaccgacaucgaggucuucugggccuccccccucgagaagaaccgcggccgcauccagggcuacgaggucaaguacuggcgccacgaggacaaggaggagaacgcccgcaagauccgcaccgucggcaaccagaccuccaccaagaucaccaaccucaagggcuccguccucuaccaccucgccgucaaggccuacaacuccgccggcaccggccccuccuccgccaccgucaacgucaccacccgcaagcccccccccucccagccccccggcaacaucaucuggaacuccuccgacuccaagaucauccucaacugggaccaggucaaggcccucgacaacgaguccgaggucaagggcuacaagguccucuaccgcuggaaccgccaguccuccaccuccgucaucgagaccaacaagaccuccgucgagcucucccuccccuucgacgaggacuacaucaucgagaucaagcccuucuccgacggcggcgacggcuccuccuccgagcagauccgcauccccaagaucuccaacgccuacgcccgcggcuccggcgccuccaccuccaacgccugcacccucuccgccaucuccaccaucaugaucucccucaccgcccgcuccucccucuga

SEQ ID NO: 41540 - RNA, 3303 nt, Artificial Sequence
  derived and/or modified sequence opt2 from CNTN5__Homo_sapiens__NP_001230199
auggccuccuccuggaagcucaugcucuuccucuccgucaccaugugccucuccgaguacuccaagucccuccccggccucuccaccuccuacgccgcccuccuccgcaucaagaaguccuccuccuccucccucuucggcuccaagacccgcccccgcuacuccucccccucccucggcacccucuccgccuccucccccuccuggcucggcgccgcccagaacuacuacucccccaucaaccucuaccacuccuccgacgccuucaagcaggacgaguccgucgacuacggccccgucuucguccaggagcccgacgacaucaucuuccccaccgacuccgacgagaagaaggucgcccucaacugcgagguccgcggcaaccccguccccuccuaccgcuggcuccgcaacggcaccgagaucgaccucgaguccgacuaccgcuacucccucaucgacggcaccuucaucaucuccaaccccuccgaggccaaggacuccggccacuaccagugccucgccaccaacaccgucggcuccauccucucccgcgaggccacccuccaguucgccuaccucggcaacuucuccggccgcacccgcuccgccgucuccguccgcgagggccagggcgucguccucaugugcuccccccccccccacucccccgagaucaucuacuccugggucuucaacgaguuccccuccuucgucgccgaggacucccgccgcuucaucucccaggagaccggcaaccucuacaucuccaagguccagaccuccgacgucggcuccuacaucugccucgucaagaacaccgucaccaacgcccgcguccucuccccccccaccccccucacccuccgcaacgacggcgucaugggcgaguacgagcccaagaucgagguccacuuccccuucaccgucaccgccgccaagggcaccaccgucaagauggagugcuucgcccucggcaaccccguccccaccaucaccuggaugaaggucaacggcuacauccccuccaaggcccgccuccgcaagucccaggccguccucgagauccccaacguccagcucgacgacgccggcaucuacgagugccgcgccgagaacucccgcggcaagaacuccuuccgcggccagcuccaggucuacaccuacccccacugggucgagaagcucaacgacacccagcucgacuccggcuccccccuccgcugggagugcaaggccaccggcaagccccgccccaccuaccgcuggcucaagaacggcgucccccucuccccccagucccgcgucgagauggucaacggcguccucaugauccacaacgucaaccaguccgacgccggcauguaccagugccucgccgagaacaaguacggcgccaucuacgccuccgccgagcucaagauccucgccuccgcccccaccuucgcccucaaccagcucaagaagaccaucaucgucaccaaggaccaggaggucgucaucgagugcaagccccagggcucccccaagcccaccaucuccuggaagaagggcgaccgcgccguccgcgagaacaagcgcaucgccauccuccccgacggcucccuccgcauccucaacgccuccaaguccgacgagggcaaguacgucugccgcggcgagaacgucuucggcuccgccgagaucaucgccucccucuccgucaaggagcccacccgcaucgagcucacccccaagcgcaccgagcucaccgucggcgaguccaucguccucaacugcaaggccauccacgacgccucccucgacgucaccuucuacuggacccucaagggccagcccaucgacuucgaggaggagggcggccacuucgaguccauccgcgcccaggccuccuccgccgaccucaugauccgcaacauccuccucaugcacgccggccgcuacggcugccgcguccagaccaccgccgacuccgucuccgacgaggccgagcuccucguccgcggcccccccggcccccccggcaucgucaucgucgaggagaucaccgaguccaccgccacccucuccuggucccccgccgccgacaaccacucccccaucuccuccuacaaccuccaggcccgcucccccuucucccucggcuggcagaccgucaagaccguccccgagaucaucaccggcgacauggaguccgccauggccgucgaccucaaccccugggucgaguacgaguuccgcgucgucgccaccaaccccaucggcaccggcgaccccuccacccccucccgcaugauccgcaccaacgaggccguccccaagaccgcccccaccaacgucuccggccgcuccggccgccgccacgagcucgucaucgccugggagcccgucuccgaggaguuccagaacggcgagggcuucggcuacaucgucgccuuccgccccaacggcacccgcggcuggaaggagaagauggucaccuccuccgaggccuccaaguucaucuaccgcgacgaguccguccccccccucacccccuucgaggucaaggucggcgucuacaacaacaagggcgacggccccuucucccagaucgucgucaucugcuccgccgagggcgagcccuccgccgcccccaccgacgucaaggccaccuccgucuccgucuccgagauccucgucgccuggaagcacaucaaggagucccucggccgcccccagggcuucgaggucggcuacuggaaggacauggagcaggaggacaccgccgagaccgucaagacccgcggcaacgaguccuucgucauccucaccggccucgagggcaacacccucuaccacuucaccguccgcgccuacaacggcgccggcuacggcccccccuccuccgaggucuccgccaccaccaagaaguccccccccucccaggcccccuccaaccuccgcugggagcagcagggcucccaggucucccucggcugggagcccgucaucccccucgccaacgaguccgaggucgucggcuacaaggucuucuaccgccaggagggccacuccaacucccaggucaucgagacccagaagcuccaggccgucgucccccuccccgacgccggcgucuacaucaucgagguccgcgccuacuccgagggcggcgacggcaccgccuccucccagauccgcguccccuccuacuccggcggcaagaucaccuccgcccaguccacccuccacucccucuccaccuccuccuccuccgucacccuccuccucgcccucaugauccccuccaccuccugguga

SEQ ID NO: 41541 - RNA, 2871 nt, Artificial Sequence
  derived and/or modified sequence opt2 from CNTN6__Homo_sapiens__NP_001276010
auguccuaccacuaccgccucgacggcggcucccucgccaucaacuccccccacaccgaccaggacaucggcauguaccagugccucgccaccaaccuccucggcaccauccucucccgcaaggccaagcuccaguucgccuacaucgaggacuucgagaccaagacccgcuccaccgucuccguccgcgagggccagggcgucguccuccucugcggcccccccccccacuucggcgaccucuccuacgccuggaccuucaacgacaacccccucuacguccaggaggacaaccgccgcuucgucucccaggagaccggcaaccucuacaucgccaaggucgagcccuccgacgucggcaacuacaccugcuucaucaccaacaaggaggcccagcgcuccguccagggcccccccaccccccucguccagcgcaccgacggcgucaugggcgaguacgagcccaagaucgagguccgcuuccccgagaccauccaggccgccaaggacuccuccgucaagcucgagugcuucgcccucggcaaccccguccccgacaucuccuggcgccgccucgacggcuccccccuccccggcaaggucaaguacuccaagucccaggccauccucgagauccccaacuuccagcaggaggacgagggcuucuacgagugcaucgccuccaaccuccgcggccgcaaccucgccaagggccagcucaucuucuacgccccccccgagugggagcagaagauccagaacacccaccucuccaucuacgacaaccuccucugggagugcaaggccuccggcaagcccaaccccugguacaccuggcucaagaacggcgagcgccucaaccccgaggagcgcauccagaucgagaacggcacccucaucaucaccaugcucaacgucuccgacuccggcgucuaccagugcgccgccgagaacaaguaccagaucaucuacgccaacgccgagcuccgcguccucgccuccgcccccgacuucuccaagucccccgucaagaagaaguccuucguccaggucggcggcgacaucgucaucggcugcaagcccaacgccuucccccgcgccgccaucuccuggaagcgcggcaccgagacccuccgccaguccaagcgcaucuuccuccucgaggacggcucccucaagaucuacaacaucacccgcuccgacgccggcuccuacaccugcaucgccaccaaccaguucggcaccgccaagaacaccggcucccucaucgucaaggagcgcaccgucaucaccgucccccccuccaagauggacgucaccgucggcgaguccaucguccuccccugccaggucucccacgaccccuccaucgaggucgucuucgucugguucuucaacggcgacgucaucgaccucaagaagggcgucgcccacuucgagcgcaucggcggcgaguccgucggcgaccucaugauccgcaacauccagcuccaccacuccggcaaguaccucugcaccguccagaccacccucgagucccucuccgccgucgccgacaucaucguccgcggcccccccggcccccccgaggacguccaggucgaggacaucuccuccaccaccucccagcucuccuggcgcgccggccccgacaacaacucccccauccagaucuucaccauccagacccgcacccccuucuccgucggcuggcaggccgucgccaccguccccgagauccucaacggcaagaccuacaacgccaccgucgucggccucucccccugggucgaguacgaguuccgcgucgucgccggcaacuccaucggcaucggcgagcccuccgagcccuccgagcuccuccgcaccaaggccuccguccccgucgucgcccccgucaacauccacggcggcggcggcucccgcuccgagcucgucaucaccugggaguccauccccgaggagcuccagaacggcgagggcuucggcuacaucaucauguuccgccccgucggcuccaccaccugguccaaggagaaggucuccuccgucgaguccucccgcuucgucuaccgcaacgaguccaucaucccccucucccccuucgaggucaaggucggcgucuacaacaacgagggcgagggcucccucuccaccgucaccaucgucuacuccggcgaggacgagccccagcucgccccccgcggcaccucccuccaguccuucuccgccuccgagauggaggucuccuggaacgccaucgccuggaaccgcaacaccggccgcguccucggcuacgagguccucuacuggaccgacgacuccaaggaguccaugaucggcaagauccgcgucuccggcaacgucaccaccaagaacaucaccggccucaaggccaacaccaucuacuucgccuccguccgcgccuacaacaccgccggcaccggccccuccuccccccccgucaacgucaccaccaagaaguccccccccucccagccccccgccaacaucgccuggaagcucaccaacuccaagcucugccucaacugggagcacgucaagaccauggagaacgaguccgagguccucggcuacaagauccucuaccgccagaaccgccaguccaagacccacauccucgagaccaacaacaccuccgccgagcuccucguccccuucgaggaggacuaccucaucgagauccgcaccgucuccgacggcggcgacggcuccuccuccgaggagauccgcauccccaagauguccucccucuccucccgcggcauccaguuccucgagcccuccacccacuuccucuccaucgucaucgucaucuuccacugcuucgccauccagccccucaucuga

SEQ ID NO: 41542 - RNA, 4155 nt, Artificial Sequence
  derived and/or modified sequence opt2 from CNTNAP1__Homo_sapiens__NP_003623
augaugcaccuccgccucuucugcauccuccucgccgccgucuccggcgccgagggcuggggcuacuacggcugcgacgaggagcucgucggcccccucuacgcccgcucccucggcgccuccuccuacuacucccuccucaccgccccccgcuucgcccgccuccacggcaucuccggcugguccccccgcaucggcgaccccaaccccuggcuccagaucgaccucaugaagaagcaccgcauccgcgccgucgccacccagggcuccuucaacuccugggacugggucacccgcuacaugcuccucuacggcgaccgcgucgacuccuggacccccuucuaccagcgcggccacaacuccaccuucuucggcaacgucaacgaguccgccgucguccgccacgaccuccacuuccacuucaccgcccgcuacauccgcaucgucccccucgccuggaacccccgcggcaagaucggccuccgccucggccucuacggcugccccuacaaggccgacauccucuacuucgacggcgacgacgccaucuccuaccgcuucccccgcggcgucucccgcucccucugggacgucuucgccuucuccuucaagaccgaggagaaggacggccuccuccuccacgccgagggcgcccagggcgacuacgucacccucgagcucgagggcgcccaccuccuccuccacaugucccucggcuccucccccauccagccccgccccggccacaccaccgucuccgccggcggcguccucaacgaccagcacuggcacuacguccgcgucgaccgcuucggccgcgacgucaacuucacccucgacggcuacguccagcgcuucauccucaacggcgacuucgagcgccucaaccucgacaccgagauguucaucggcggccucgucggcgccgcccgcaagaaccucgccuaccgccacaacuuccgcggcugcaucgagaacgucaucuucaaccgcgucaacaucgccgaccucgccguccgccgccacucccgcaucaccuucgagggcaaggucgccuuccgcugccucgaccccgucccccaccccaucaacuucggcggcccccacaacuucguccagguccccggcuucccccgccgcggccgccucgccgucuccuuccgcuuccgcaccugggaccucaccggccuccuccucuucucccgccucggcgacggccucggccacgucgagcucacccucuccgagggccaggucaacgucuccaucgcccaguccggccgcaagaagcuccaguucgccgccggcuaccgccucaacgacggcuucuggcacgaggucaacuucgucgcccaggagaaccacgccgucaucuccaucgacgacgucgagggcgccgagguccgcgucuccuacccccuccucauccgcaccggcaccuccuacuucuucggcggcugccccaagcccgccucccgcugggacugccacuccaaccagaccgccuuccacggcugcauggagcuccucaaggucgacggccagcucgucaaccucacccucgucgagggccgccgccucggcuucuacgccgagguccucuucgacaccugcggcaucaccgaccgcugcucccccaacaugugcgagcacgacggccgcugcuaccaguccugggacgacuucaucugcuacugcgagcucaccggcuacaagggcgagaccugccacaccccccucuacaaggaguccugcgaggccuaccgccucuccggcaagaccuccggcaacuucaccaucgaccccgacggcuccggcccccucaagcccuucgucgucuacugcgacauccgcgagaaccgcgccuggaccgucguccgccacgaccgccucuggaccacccgcgucaccggcuccuccauggagcgccccuuccucggcgccauccaguacuggaacgccuccugggaggaggucuccgcccucgccaacgccucccagcacugcgagcaguggaucgaguucuccugcuacaacucccgccuccucaacaccgccggcggcuaccccuacuccuucuggaucggccgcaacgaggagcagcacuucuacuggggcggcucccagcccggcauccagcgcugcgccugcggccucgaccgcuccugcgucgaccccgcccucuacugcaacugcgacgccgaccagccccaguggcgcaccgacaagggccuccucaccuucgucgaccaccuccccgucacccaggucgucaucggcgacaccaaccgcuccaccuccgaggcccaguucuuccuccgcccccuccgcugcuacggcgaccgcaacuccuggaacaccaucuccuuccacaccggcgccgcccuccgcuucccccccauccgcgccaaccacucccucgacgucuccuucuacuuccgcaccuccgcccccuccggcgucuuccucgagaacaugggcggccccuacugccaguggcgccgccccuacguccgcgucgagcucaacaccucccgcgacgucgucuucgccuucgacgucggcaacggcgacgagaaccucaccguccacuccgacgacuucgaguucaacgacgacgaguggcaccucguccgcgccgagaucaacgucaagcaggcccgccuccgcgucgaccaccgccccuggguccuccgccccaugccccuccagaccuacaucuggauggaguacgaccagccccucuacgucggcuccgccgagcucaagcgccgccccuucgucggcugccuccgcgccaugcgccucaacggcgucacccucaaccucgagggccgcgccaacgccuccgagggcaccucccccaacugcaccggccacugcgcccacccccgccuccccugcuuccacggcggccgcugcgucgagcgcuacuccuacuacaccugcgacugcgaccucaccgccuucgacggccccuacugcaaccacgacaucggcggcuucuucgagcccggcaccuggaugcgcuacaaccuccaguccgcccuccgcuccgccgcccgcgaguucucccacaugcucucccgccccguccccggcuacgagcccggcuacauccccggcuacgacacccccggcuacguccccggcuaccacggccccggcuaccgccuccccgacuacccccgccccggccgccccguccccggcuaccgcggccccgucuacaacgucaccggcgaggaggucuccuucuccuucuccaccuccuccgcccccgccguccuccucuacgucuccuccuucguccgcgacuacauggccguccucaucaaggacgacggcacccuccagcuccgcuaccagcucggcaccucccccuacgucuaccagcucaccacccgccccgucaccgacggccagccccacuccaucaacaucacccgcgucuaccgcaaccucuucauccaggucgacuacuucccccucaccgagcagaaguucucccuccucgucgacucccagcucgacucccccaaggcccucuaccucggccgcgucauggagaccggcgucaucgaccccgagauccagcgcuacaacacccccggcuucuccggcugccucuccggcguccgcuucaacaacgucgccccccucaagacccacuuccgcaccccccgccccaugaccgccgagcucgccgaggcccuccgcguccagggcgagcucuccgaguccaacugcggcgccaugccccgccucgucuccgaggucccccccgagcucgaccccugguaccucccccccgacuuccccuacuaccacgacgagggcugggucgccauccuccucggcuuccucgucgccuuccuccuccucggccucgucggcaugcucguccucuucuaccuccagaaccaccgcuacaagggcuccuaccacaccaacgagcccaaggccgcccacgaguaccaccccggcuccaagcccccccuccccaccuccggccccgcccagguccccacccccaccgccgcccccaaccaggcccccgccuccgcccccgcccccgcccccacccccgcccccgcccccggcccccgcgaccagaaccucccccagauccucgaggagucccgcuccgaguga

SEQ ID NO: 41543 - RNA, 3996 nt, Artificial Sequence
  derived and/or modified sequence opt2 from CNTNAP2__Homo_sapiens__NP_054860
augcaggccgccccccgcgccggcugcggcgccgcccuccuccucuggaucgucuccuccugccucugccgcgccuggaccgcccccuccaccucccagaagugcgacgagccccucgucuccggccucccccacgucgccuucuccuccuccuccuccaucuccggcuccuacucccccggcuacgccaagaucaacaagcgcggcggcgccggcggcuggucccccuccgacuccgaccacuaccaguggcuccaggucgacuucggcaaccgcaagcagaucuccgccaucgccacccagggccgcuacuccuccuccgacugggucacccaguaccgcaugcucuacuccgacaccggccgcaacuggaagcccuaccaccaggacggcaacaucugggccuuccccggcaacaucaacuccgacggcgucguccgccacgagcuccagcaccccaucaucgcccgcuacguccgcaucgucccccucgacuggaacggcgagggccgcaucggccuccgcaucgaggucuacggcugcuccuacugggccgacgucaucaacuucgacggccacgucguccuccccuaccgcuuccgcaacaagaagaugaagacccucaaggacgucaucgcccucaacuucaagaccuccgaguccgagggcgucauccuccacggcgagggccagcagggcgacuacaucacccucgagcucaagaaggccaagcucguccucucccucaaccucggcuccaaccagcucggccccaucuacggccacaccuccgucaugaccggcucccuccucgacgaccaccacuggcacuccgucgucaucgagcgccagggccgcuccaucaaccucacccucgaccgcuccaugcagcacuuccgcaccaacggcgaguucgacuaccucgaccucgacuacgagaucaccuucggcggcauccccuucuccggcaagcccuccuccuccucccgcaagaacuucaagggcugcauggaguccaucaacuacaacggcgucaacaucaccgaccucgcccgccgcaagaagcucgagcccuccaacgucggcaaccucuccuucuccugcgucgagcccuacaccguccccgucuucuucaacgccaccuccuaccucgagguccccggccgccucaaccaggaccucuucuccgucuccuuccaguuccgcaccuggaaccccaacggccuccucgucuucucccacuucgccgacaaccucggcaacgucgagaucgaccucaccgaguccaaggucggcguccacaucaacaucacccagaccaagaugucccagaucgacaucuccuccggcuccggccucaacgacggccaguggcacgagguccgcuuccucgccaaggagaacuucgccauccucaccaucgacggcgacgaggccuccgccguccgcaccaacuccccccuccaggucaagaccggcgagaaguacuucuucggcggcuuccucaaccagaugaacaacuccucccacuccguccuccagcccuccuuccagggcugcaugcagcucauccaggucgacgaccagcucgucaaccucuacgaggucgcccagcgcaagcccggcuccuucgccaacgucuccaucgacaugugcgccaucaucgaccgcugcguccccaaccacugcgagcacggcggcaagugcucccagaccugggacuccuucaagugcaccugcgacgagaccggcuacuccggcgccaccugccacaacuccaucuacgagcccuccugcgaggccuacaagcaccucggccagaccuccaacuacuacuggaucgaccccgacggcuccggcccccucggcccccucaaggucuacugcaacaugaccgaggacaaggucuggaccaucgucucccacgaccuccagaugcagacccccgucgucggcuacaaccccgagaaguacuccgucacccagcucgucuacuccgccuccauggaccagaucuccgccaucaccgacuccgccgaguacugcgagcaguacgucuccuacuucugcaagaugucccgccuccucaacacccccgacggcucccccuacaccuggugggucggcaaggccaacgagaagcacuacuacuggggcggcuccggccccggcauccagaagugcgccugcggcaucgagcgcaacugcaccgaccccaaguacuacugcaacugcgacgccgacuacaagcaguggcgcaaggacgccggcuuccucuccuacaaggaccaccuccccgucucccaggucgucgucggcgacaccgaccgccagggcuccgaggccaagcucuccgucggcccccuccgcugccagggcgaccgcaacuacuggaacgccgccuccuuccccaaccccuccuccuaccuccacuucuccaccuuccagggcgagaccuccgccgacaucuccuucuacuucaagacccucacccccuggggcgucuuccucgagaacaugggcaaggaggacuucaucaagcucgagcucaaguccgccaccgaggucuccuucuccuucgacgucggcaacggccccgucgagaucgucguccgcucccccaccccccucaacgacgaccaguggcaccgcgucaccgccgagcgcaacgucaagcaggccucccuccaggucgaccgccucccccagcagauccgcaaggcccccaccgagggccacacccgccucgagcucuacucccagcucuucgucggcggcgccggcggccagcagggcuuccucggcugcauccgcucccuccgcaugaacggcgucacccucgaccucgaggagcgcgccaaggucaccuccggcuucaucuccggcugcuccggccacugcaccuccuacggcaccaacugcgagaacggcggcaagugccucgagcgcuaccacggcuacuccugcgacugcuccaacaccgccuacgacggcaccuucugcaacaaggacgucggcgccuucuucgaggagggcauguggcuccgcuacaacuuccaggcccccgccaccaacgcccgcgacuccuccucccgcgucgacaacgcccccgaccagcagaacucccaccccgaccucgcccaggaggagauccgcuucuccuucuccaccaccaaggcccccugcauccuccucuacaucuccuccuucaccaccgacuuccucgccguccucgucaagcccaccggcucccuccagauccgcuacaaccucggcggcacccgcgagcccuacaacaucgacgucgaccaccgcaacauggccaacggccagccccacuccgucaacaucacccgccacgagaagaccaucuuccucaagcucgaccacuaccccuccgucuccuaccaccuccccuccuccuccgacacccucuucaacucccccaagucccucuuccucggcaaggucaucgagaccggcaagaucgaccaggagauccacaaguacaacacccccggcuucaccggcugccucucccgcguccaguucaaccagaucgccccccucaaggccgcccuccgccagaccaacgccuccgcccacguccacauccagggcgagcucgucgaguccaacugcggcgccuccccccucacccucucccccauguccuccgccaccgaccccuggcaccucgaccaccucgacuccgccuccgccgacuuccccuacaaccccggccagggccaggccauccgcaacggcgucaaccgcaacuccgccaucaucggcggcgucaucgccgucgucaucuucaccauccucugcacccucgucuuccucauccgcuacauguuccgccacaagggcaccuaccacaccaacgaggccaagggcgccgaguccgccgaguccgccgacgccgccaucaugaacaacgaccccaacuucaccgagaccaucgacgaguccaagaaggaguggcucaucuga

SEQ ID NO: 41544 - RNA, 3867 nt, Artificial Sequence
  derived and/or modified sequence opt2 from CNTNAP3__Homo_sapiens__NP_387504
auggccuccgucgccugggccguccucaagguccuccuccuccuccccacccagaccuggucccccgucggcgccggcaacccccccgacugcgacgccccccucgccuccgcccucccccgcuccuccuucuccuccuccuccgagcucuccuccucccacggccccggcuucucccgccucaaccgccgcgacggcgccggcggcuggaccccccucgucuccaacaaguaccaguggcuccagaucgaccucggcgagcgcauggaggucaccgccgucgccacccagggcggcuacggcuccuccgacugggucaccuccuaccuccucauguucuccgacggcggccgcaacuggaagcaguaccgccgcgaggaguccaucuggggcuuccccggcaacaccaacgccgacuccgucguccacuaccgccuccagccccccuucgaggcccgcuuccuccgcuuccucccccucgccuggaacccccgcggccgcaucggcaugcgcaucgaggucuacggcugcgccuacaaguccgaggucgucuacuucgacggccaguccgcccuccucuaccgccucgacaagaagccccucaagcccauccgcgacgucaucucccucaaguucaaggccaugcaguccaacggcauccuccuccaccgcgagggccagcacggcaaccacaucacccucgagcucaucaagggcaagcucgucuucuuccucaacuccggcaacgccaagcuccccuccaccaucgcccccgucacccucacccucggcucccuccucgacgaccagcacuggcacuccguccucaucgagcuccucgacacccaggucaacuucaccgucgacaagcacacccaccacuuccaggccaagggcgacuccuccuaccucgaccucaacuucgagaucuccuucggcggcauccccacccccggccgcucccgcgccuuccgccgcaaguccuuccacggcugccucgagaaccucuacuacaacggcgucgacgucaccgagcucgccaagaagcacaagccccagauccucaugaugggcaacgucuccuucuccugcccccagccccagaccguccccgucaccuuccucuccucccgcuccuaccucgcccuccccggcaacuccggcgaggacaaggucuccgucaccuuccaguuccgcaccuggaaccgcgccggccaccuccucuucggcgagcuccgccgcggcuccggcuccuucguccucuuccucaaggacggcaagcucaagcucucccucuuccagcccggccaguccccccgcaacgucaccgccggcgccggccucaacgacggccaguggcacuccgucuccuucuccgccaaguggucccacaugaacgucgucgucgacgacgacaccgccguccagccccucgucgccguccucaucgacuccggcgacaccuacuacuucggcggcugccucgacaacuccuccggcuccggcugcaaguccccccucggcggcuuccagggcugccuccgccucaucaccaucggcgacaaggccgucgaccccauccucguccagcagggcgcccucggcuccuuccgcgaccuccagaucgacuccugcggcaucaccgaccgcugccuccccuccuacugcgagcacggcggcgagugcucccaguccugggacaccuucuccugcgacugccucggcaccggcuacaccggcgagaccugccacuccucccucuacgagcaguccugcgaggcccacaagcaccgcggcaaccccuccggccucuacuacaucgacgccgacggcuccggcccccucggccccuuccucgucuacugcaacaugaccgccgacgccgccuggaccgucguccagcacggcggccccgacgccgucacccuccgcggcgcccccuccggccacccccgcuccgccgucuccuucgccuacgccgccggcgccggccagcuccgcuccgccgucaaccucgccgagcgcugcgagcagcgccucgcccuccgcugcggcaccgcccgccgccccgacucccgcgacggcaccccccucuccuggugggucggccgcaccaacgagacccacaccuccuggggcggcucccuccccgacgcccagaagugcaccugcggccucgagggcaacugcaucgacucccaguacuacugcaacugcgacgccggccgcaacgaguggaccuccgacaccaucguccucucccagaaggagcaccuccccgucacccagaucgucaugaccgacgccggccgcccccacuccgaggccgccuacacccucggcccccuccucugccgcggcgaccaguccuucuggaacuccgccuccuucaacaccgagaccuccuaccuccacuuccccgccuuccacggcgagcucaccgccgacgucugcuucuucuucaagaccaccgucuccuccggcgucuucauggagaaccucggcaucaccgacuucauccgcaucgagcuccgcgcccccaccgaggucaccuucuccuucgacgucggcaacggccccugcgaggucaccguccagucccccacccccuucaacgacaaccaguggcaccacguccgcgccgagcgcaacgucaagggcgccucccuccaggucgaccagcucccccagaagaugcagcccgcccccgccgacggccacguccgccuccagcucaacucccagcucuucaucggcggcaccgccacccgccagcgcggcuuccucggcugcauccgcucccuccagcucaacggcgucgcccucgaccucgaggagcgcgccaccgucacccccggcgucgagcccggcugcgccggccacugcuccaccuacggccaccucugccgcaacggcggccgcugccgcgagaagcgccgcggcgucaccugcgacugcgccuucuccgccuacgacggccccuucugcuccaacgagaucuccgccuacuucgccaccggcuccuccaugaccuaccacuuccaggagcacuacacccucuccgagaacuccuccucccucgucuccucccuccaccgcgacgucacccucacccgcgagaugaucacccucuccuuccgcaccacccgcacccccucccuccuccucuacgucuccuccuucuacgaggaguaccucuccgucauccucgccaacaacggcucccuccagauccgcuacaagcucgaccgccaccagaaccccgacgccuucaccuucgacuucaagaacauggccgacggccagcuccaccaggucaagaucaaccgcgaggaggccgucgucauggucgaggucaaccaguccaccaagaagcaggucauccucuccuccggcaccgaguucaacgccgucaagucccucauccucggcaagguccucgaggccgccggcgccgaccccgacacccgccgcgccgccaccuccggcuucaccggcugccucuccgccguccgcuucggccgcgccgccccccucaaggccgcccuccgccccuccggccccucccgcgucaccguccgcggccacgucgcccccauggcccgcugcgccgccggcgccgccuccggcucccccgcccgcgagcucgccccccgccucgccggcggcgccggccgcuccggccccgccgacgagggcgagccccucgucaacgccgaccgccgcgacuccgccgucaucggcggcgucaucgccgucgucaucuucauccuccucugcaucaccgccaucgccauccgcaucuaccagcagcgcaagcuccgcaaggagaacgaguccaaggucuccaagaaggaggagugcuga

SEQ ID NO: 41545 - RNA, 3927 nt, Artificial Sequence
  derived and/or modified sequence opt2 from CNTNAP4__Homo_sapiens__NP_207837
augggcuccgucaccggcgccguccucaagacccuccuccuccucuccacccagaacuggaaccgcgucgaggccggcaacuccuacgacugcgacgacccccucgucuccgcccucccccaggccuccuucuccuccuccuccgagcucuccuccucccacggccccggcuucgcccgccucaaccgccgcgacggcgccggcggcugguccccccucgucuccaacaaguaccaguggcuccagaucgaccucggcgagcgcauggaggucaccgccgucgccacccagggcggcuacggcuccuccaacugggucaccuccuaccuccucauguucuccgacuccggcuggaacuggaagcaguaccgccaggaggacuccaucuggggcuucuccggcaacgccaacgccgacuccgucgucuacuaccgccuccagcccuccaucaaggcccgcuuccuccgcuucaucccccucgaguggaaccccaagggccgcaucggcaugcgcaucgaggucuucggcugcgccuaccgcuccgaggucgucgaccucgacggcaaguccucccuccucuaccgcuucgaccagaagucccucucccccaucaaggacaucaucucccucaaguucaagaccaugcaguccgacggcauccuccuccaccgcgagggccccaacggcgaccacaucacccuccagcuccgccgcgcccgccucuuccuccucaucaacuccggcgaggccaagcuccccuccaccuccacccucgucaaccucacccucggcucccuccucgacgaccagcacuggcacuccguccucauccagcgccucggcaagcaggucaacuucaccgucgacgagcaccgccaccacuuccacgcccgcggcgaguucaaccucaugaaccucgacuacgagaucuccuucggcggcauccccgcccccggcaaguccgucuccuucccccaccgcaacuuccacggcugccucgagaaccucuacuacaacggcgucgacaucaucgaccucgccaagcagcagaagccccagaucaucgccaugggcaacgucuccuucuccugcucccagccccaguccaugcccgucaccuuccucuccucccgcuccuaccucgcccuccccgacuucuccggcgaggaggaggucuccgccaccuuccaguuccgcaccuggaacaaggccggccuccuccucuucuccgagcuccagcucaucuccggcggcauccuccucuuccucuccgacggcaagcucaaguccaaccucuaccagcccggcaagcuccccuccgacaucaccgccggcgucgagcucaacgacggccaguggcacuccgucucccucuccgccaagaagaaccaccucuccgucgccgucgacggccagauggccuccgccgccccccuccucggccccgagcagaucuacuccggcggcaccuacuacuucggcggcugccccgacaaguccuucggcuccaagugcaaguccccccucggcggcuuccagggcugcaugcgccucaucuccaucuccggcaaggucgucgaccucaucuccguccagcagggcucccucggcaacuucuccgaccuccagaucgacuccugcggcaucuccgaccgcugccuccccaacuacugcgagcacggcggcgagugcucccaguccugguccaccuuccacugcaacugcaccaacaccggcuaccgcggcgccaccugccacaacuccaucuacgagcaguccugcgaggccuacaagcaccgcggcaacaccuccggcuucuacuacaucgacuccgacggcuccggcccccucgagcccuuccuccucuacugcaacaugaccgagaccgccuggaccaucauccagcacaacggcuccgaccucacccgcguccgcaacaccaaccccgagaaccccuacgccggcuucuucgaguacgucgccuccauggagcagcuccaggccaccaucaaccgcgccgagcacugcgagcaggaguucaccuacuacugcaagaagucccgccucgucaacaagcaggacggcaccccccucuccuggugggucggccgcaccaacgagacccagaccuacuggggcggcuccucccccgaccuccagaagugcaccugcggccucgagggcaacugcaucgacucccaguacuacugcaacugcgacgccgaccgcaacgaguggaccaacgacaccggccuccucgccuacaaggagcaccuccccgucaccaagaucgucaucaccgacaccggccgccuccacuccgaggccgccuacaagcucggcccccuccucugccagggcgaccgcuccuucuggaacuccgccuccuucgacaccgaggccuccuaccuccacuuccccaccuuccacggcgagcucuccgccgacgucuccuucuucuucaagaccaccgccuccuccggcgucuuccucgagaaccucggcaucgccgacuucauccgcaucgagcuccgcucccccaccgucgucaccuucuccuucgacgucggcaacggccccuucgagaucuccguccagucccccacccacuucaacgacaaccaguggcaccacguccgcgucgagcgcaacaugaaggaggccucccuccaggucgaccagcucacccccaagacccagcccgcccccgccgacggccacguccuccuccagcucaacucccagcucuucgucggcggcaccgccacccgccagcgcggcuuccucggcugcauccgcucccuccagcucaacggcaugacccucgaccucgaggagcgcgcccaggucacccccgagguccagcccggcugccgcggccacugcuccuccuacggcaagcucugccgcaacggcggcaagugccgcgagcgccccaucggcuucuucugcgacugcaccuucuccgccuacaccggccccuucugcuccaacgagaucuccgccuacuucggcuccggcuccuccgucaucuacaacuuccaggagaacuaccuccucuccaagaacuccuccucccacgccgccuccuuccacggcgacaugaagcucucccgcgagaugaucaaguucuccuuccgcaccacccgcacccccucccuccuccucuucgucuccuccuucuacaaggaguaccucuccgucaucaucgccaagaacggcucccuccagauccgcuacaagcucaacaaguaccaggagcccgacgucgucaacuucgacuucaagaacauggccgacggccagcuccaccacaucaugaucaaccgcgaggagggcgucgucuucaucgagaucgacgacaaccgccgccgccagguccaccucuccuccggcaccgaguucuccgccgucaagucccucguccucggccgcauccucgagcacuccgacgucgaccaggacaccgcccucgccggcgcccagggcuucaccggcugccucuccgccguccagcucucccacgucgccccccucaaggccgcccuccaccccucccaccccgaccccgucaccgucaccggccacgucaccgaguccuccugcauggcccagcccggcaccgacgccaccucccgcgagcgcacccacuccuucgccgaccacuccggcaccaucgacgaccgcgagccccucgccaacgccaucaaguccgacuccgccgucaucggcggccucaucgccgucgucaucuucauccuccucugcaucaccgccaucgccguccgcaucuaccagcagaagcgccucuacaagcgcuccgaggccaagcgcuccgagaacgucgacuccgccgaggccguccucaaguccgagcucaacauccagaacgccgucaacgagaaccagaaggaguacuucuucuga

SEQ ID NO: 41546 - RNA, 3921 nt, Artificial Sequence
  derived and/or modified sequence opt2 from CNTNAP5__Homo_sapiens__NP_570129
auggacucccucccccgccucaccuccguccucacccuccucuucuccggccucuggcaccucggccucaccgccaccaacuacaacugcgacgacccccucgccucccuccucucccccauggccuucuccuccuccuccgaccucaccggcacccacucccccgcccagcucaacuggcgcgucggcaccggcggcuggucccccgccgacuccaacgcccagcaguggcuccagauggaccucggcaaccgcgucgagaucaccgccgucgccacccagggccgcuacggcuccuccgacugggucaccuccuacucccucauguucuccgacaccggccgcaacuggaagcaguacaagcaggaggacuccaucuggaccuucgccggcaacaugaacgccgacuccgucguccaccacaagcuccuccacuccguccgcgcccgcuucguccgcuucgucccccucgaguggaaccccuccggcaagaucggcaugcgcgucgaggucuacggcugcuccuacaaguccgacgucgccgacuucgacggccgcuccucccuccucuaccgcuucaaccagaagcucauguccacccucaaggacgucaucucccucaaguucaaguccaugcagggcgacggcguccucuuccacggcgagggccagcgcggcgaccacaucacccucgagcuccagaagggccgccucgcccuccaccucaaccucggcgacuccaaggcccgccucuccuccucccuccccuccgccacccucggcucccuccucgacgaccagcacuggcacuccguccucaucgagcgcgucggcaagcaggucaacuucaccgucgacaagcacacccagcacuuccgcaccaagggcgagaccgacgcccucgacaucgacuacgagcucuccuucggcggcauccccguccccggcaagcccggcaccuuccucaagaagaacuuccacggcugcaucgagaaccucuacuacaacggcgucaacaucaucgaccucgccaagcgccgcaagcaccagaucuacaccggcaacgucaccuucuccugcuccgagccccagaucguccccaucaccuucgucaacuccuccggcuccuaccuccuccuccccggcaccccccagaucgacggccucuccgucuccuuccaguuccgcaccuggaacaaggacggccuccuccucuccaccgagcucuccgagggcuccggcacccuccuccucucccucgagggcggcauccuccgccucgucauccagaagaugaccgagcgcgucgccgagauccucaccggcuccaaccucaacgacggccucuggcacuccgucuccaucaacgcccgccgcaaccgcaucacccucacccucgacgacgaggccgccccccccgcccccgacuccaccuggguccagaucuacuccggcaacuccuacuacuucggcggcugccccgacaaccucaccgacucccagugccucaaccccaucaaggccuuccagggcugcaugcgccucaucuucaucgacaaccagcccaaggaccucaucuccguccagcagggcucccucggcaacuucuccgaccuccacaucgaccucugcuccaucaaggaccgcugccuccccaacuacugcgagcacggcggcuccugcucccaguccuggaccaccuucuacugcaacugcuccgacaccuccuacaccggcgccaccugccacaacuccaucuacgagcaguccugcgaggucuaccgccaccagggcaacaccgccggcuucuucuacaucgacuccgacggcuccggcccccucggcccccuccaggucuacugcaacaucaccgaggacaagaucuggaccuccguccagcacaacaacaccgagcucacccgcguccgcggcgccaaccccgagaagcccuacgccauggcccucgacuacggcggcuccauggagcagcucgaggccgucaucgacggcuccgagcacugcgagcaggaggucgccuaccacugccgccgcucccgccuccucaacacccccgacggcacccccuucaccugguggaucggccgcuccaacgagcgccaccccuacuggggcggcuccccccccggcguccagcagugcgagugcggccucgacgaguccugccucgacauccagcacuucugcaacugcgacgccgacaaggacgaguggaccaacgacaccggcuuccucuccuucaaggaccaccuccccgucacccagaucgucaucaccgacaccgaccgcuccaacuccgaggccgccuggcgcaucggcccccuccgcugcuacggcgaccgccgcuucuggaacgccgucuccuucuacaccgaggccuccuaccuccacuuccccaccuuccacgccgaguucuccgccgacaucuccuucuucuucaagaccaccgcccucuccggcgucuuccucgagaaccucggcaucaaggacuucauccgccucgagaucuccucccccuccgagaucaccuucgccaucgacgucggcaacggccccgucgagcucgucguccagucccccucccuccucaacgacaaccaguggcacuacguccgcgccgagcgcaaccucaaggagaccucccuccaggucgacaaccucccccgcuccacccgcgagaccuccgaggagggccacuuccgccuccagcucaacucccagcucuucgucggcggcaccuccucccgccagaagggcuuccucggcugcauccgcucccuccaccucaacggccagaagauggaccucgaggagcgcgccaaggucaccuccggcguccgccccggcugccccggccacugcuccuccuacggcuccaucugccacaacggcggcaagugcgucgagaagcacaacggcuaccucugcgacugcaccaacucccccuacgagggccccuucugcaagaaggaggucuccgccgucuucgaggccggcaccuccgucaccuacauguuccaggagcccuaccccgucaccaagaacaucucccucuccuccuccgccaucuacaccgacuccgcccccuccaaggagaacaucgcccucuccuucgucaccacccaggcccccucccuccuccucuucaucaacuccuccucccaggacuucgucgucguccuccucugcaagaacggcucccuccagguccgcuaccaccucaacaaggaggagacccacgucuucaccaucgacgccgacaacuucgccaaccgccgcaugcaccaccucaagaucaaccgcgagggccgcgagcucaccauccagauggaccagcagcuccgccucuccuacaacuucucccccgaggucgaguuccgcgucauccgcucccucacccucggcaaggucaccgagaaccucggccucgacuccgaggucgccaaggccaacgccaugggcuucgccggcugcauguccuccguccaguacaaccacaucgccccccucaaggccgcccuccgccacgccaccgucgcccccgucaccguccacggcacccucaccgaguccuccugcggcuucauggucgacuccgacgucaacgccgucaccaccguccacuccuccuccgaccccuucggcaagaccgacgagcgcgagccccucaccaacgccguccgcuccgacuccgccgucaucggcggcgucaucgccgucgucaucuucaucaucuucugcaucaucggcaucaugacccgcuuccucuaccagcacaagcagucccaccgcaccucccagaugaaggagaaggaguaccccgagaaccucgacuccuccuuccgcaacgagaucgaccuccagaacaccgucuccgagugcaagcgcgaguacuucaucuga

SEQ ID NO: 41547 - RNA, 6978 nt, Artificial Sequence
  derived and/or modified sequence opt2 from CNTRL__Homo_sapiens__XP_005251736
augaagaagggcucccagcagaagaucuucuccaaggccaagauccccuccuccucccacucccccauccccuccuccauguccaacaugcgcucccgcucccucuccccccucaucggcuccgagacccuccccuuccacuccggcggccaguggugcgagcaggucgagaucgccgacgagaacaacaugcuccucgacuaccaggaccacaagggcgccgacucccacgccggcguccgcuacaucaccgaggcccucaucaagaagcucaccaagcaggacaaccucgcccucaucaagucccucaaccucucccucuccaaggacggcggcaagaaguucaaguacaucgagaaccucgagaagugcgucaagcucgagguccucaaccucuccuacaaccucaucggcaagaucgagaagcucgacaagcuccucaagcuccgcgagcucaaccucuccuacaacaagaucuccaagaucgagggcaucgagaacaugugcaaccuccagaagcucaaccucgccggcaacgagaucgagcacauccccgucuggcucggcaagaagcucaagucccuccgcguccucaaccucaagggcaacaagaucuccucccuccaggacaucuccaagcucaagccccuccaggaccucaucucccucauccucgucgagaaccccgucgucacccucccccacuaccuccaguucaccaucuuccaccuccgcucccucgagucccucgagggccagcccgucaccacccaggaccgccaggaggccuucgagcgcuucucccucgaggaggucgagcgccucgagcgcgaccucgagaagaagaugaucgagaccgaggagcucaaguccaagcagacccgcuuccucgaggagaucaagaaccaggacaagcucaacaagucccucaaggaggaggccaugcuccagaagcaguccugcgaggagcucaaguccgaccucaacaccaagaacgagcuccucaagcagaagaccaucgagcucacccgcgccugccagaagcaguacgagcucgagcaggagcucgccuucuacaagaucgacgccaaguucgagccccucaacuacuaccccuccgaguacgccgagaucgacaaggcccccgacgagucccccuacaucggcaagucccgcuacaagcgcaacauguucgccaccgaguccuacaucaucgacuccgcccaggccguccagaucaagaagauggagcccgacgagcagcuccgcaacgaccacaugaaccuccgcggccacaccccccucgacacccagcucgaggacaaggagaagaagaucuccgccgcccagacccgccucuccgagcuccacgacgagaucgagaaggccgagcagcagauccuccgcgccaccgaggaguucaagcagcucgaggaggccauccagcucaagaagaucuccgaggccggcaaggaccuccucuacaagcagcucuccggccgccuccagcucgucaacaagcuccgccaggaggcccucgaccucgagcuccagauggagaagcagaagcaggagaucgccggcaagcagaaggagaucaaggaccuccagaucgccaucgacucccucgacuccaaggaccccaagcacucccacaugaaggcccagaaguccggcaaggagcagcagcucgacaucaugaacaagcaguaccagcagcucgagucccgccucgacgagauccucucccgcaucgccaaggagaccgaggagaucaaggaccucgaggagcagcucaccgagggccagaucgccgccaacgaggcccucaagaaggaccucgagggcgucaucuccggccuccaggaguaccucggcaccaucaagggccaggccacccaggcccagaacgagugccgcaagcuccgcgacgagaaggagacccuccuccagcgccucaccgaggucgagcaggagcgcgaccagcucgagaucgucgccauggacgccgagaacaugcgcaaggagcucgccgagcucgaguccgcccuccaggagcagcacgaggucaacgccucccuccagcagacccagggcgaccucuccgccuacgaggccgagcucgaggcccgccucaaccuccgcgacgccgaggccaaccagcucaaggaggagcucgagaaggucacccgccucacccagcucgagcaguccgcccuccaggccgagcucgagaaggagcgccaggcccucaagaacgcccucggcaaggcccaguucuccgaggagaaggagcaggagaacuccgagcuccacgccaagcucaagcaccuccaggacgacaacaaccuccucaagcagcagcucaaggacuuccagaaccaccucaaccacgucgucgacggccucguccgccccgaggaggucgccgcccgcgucgacgagcuccgccgcaagcucaagcucggcaccggcgagaugaacauccacucccccuccgacguccucggcaagucccucgccgaccuccagaagcaguucuccgagauccucgcccgcuccaagugggagcgcgacgaggcccagguccgcgagcgcaagcuccaggaggagauggcccuccagcaggagaagcucgccaccggccaggaggaguuccgccaggccugcgagcgcgcccucgaggcccgcaugaacuucgacaagcgccagcacgaggcccgcauccagcagauggagaacgagauccacuaccuccaggagaaccucaaguccauggaggagauccagggccucaccgaccuccagcuccaggaggccgacgaggagaaggagcgcauccucgcccagcuccgcgagcucgagaagaagaagaagcucgaggacgccaagucccaggagcaggucuucggccucgacaaggagcucaagaagcucaagaaggccgucgccaccuccgacaagcucgccaccgccgagcucaccaucgccaaggaccagcucaagucccuccacggcaccgucaugaagaucaaccaggagcgcgccgaggagcuccaggaggccgagcgcuucucccgcaaggccgcccaggccgcccgcgaccucacccgcgccgaggccgagaucgagcuccuccagaaccuccuccgccagaagggcgagcaguuccgccucgagauggagaagaccggcgucggcaccggcgccaacucccagguccucgagaucgagaagcucaacgagaccauggagcgccagcgcaccgagaucgcccgccuccagaacguccucgaccucaccggcuccgacaacaagggcggcuucgagaacguccucgaggagaucgccgagcuccgccgcgaggucuccuaccagaacgacuacaucuccuccauggccgaccccuucaagcgccgcggcuacugguacuucaugccccccccccccuccuccaaggucuccucccacuccucccaggccaccaaggacuccggcgucggccucaaguacuccgccuccacccccguccgcaagccccgccccggccagcaggacggcaaggagggcucccagcccccccccgccuccggcuacugggucuacucccccauccgcuccggccuccacaagcucuuccccucccgcgacgccgacuccggcggcgacucccaggaggaguccgagcucgacgaccaggaggagccccccuucguccccccccccggcuacaugauguacaccguccuccccgacggcucccccgucccccagggcauggcccucuacgcccccccccccccccuccccaacaacucccgcccccucacccccggcaccgucgucuacggccccccccccgccggcgcccccauggucuacggcccccccccccccaacuucuccauccccuucauccccaugggcguccuccacugcaacguccccgagcaccacaaccucgagaacgaggucucccgccucgaggacaucaugcagcaccucaaguccaagaagcgcgaggagcgcuggaugcgcgccuccaagcgccaguccgagaaggagauggaggagcuccaccacaacaucgacgaccuccuccaggagaagaagucccucgagugcgaggucgaggagcuccaccgcaccguccagaagcgccagcagcagaaggacuucaucgacggcaacgucgagucccucaugaccgagcucgagaucgagaagucccucaagcaccacgaggacaucgucgacgagaucgagugcaucgagaagacccuccucaagcgccgcuccgagcuccgcgaggccgaccgccuccucgccgaggccgaguccgagcucuccugcaccaaggagaagaccaagaacgccgucgagaaguucaccgacgccaagcgcucccuccuccagaccgaguccgacgccgaggagcucgagcgccgcgcccaggagaccgccgucaaccucgucaaggccgaccagcagcuccgcucccuccaggccgacgccaaggaccucgagcagcacaagaucaagcaggaggagauccucaaggagaucaacaagaucgucgccgccaaggacuccgacuuccagugccucuccaagaagaaggagaagcucaccgaggagcuccagaagcuccagaaggacaucgagauggccgagcgcaacgaggaccaccaccuccagguccucaaggaguccgagguccuccuccaggccaagcgcgccgagcucgagaagcucaagucccaggucaccucccagcagcaggagauggccguccucgaccgccagcucggccacaagaaggaggagcuccaccuccuccagggcuccaugguccaggccaaggccgaccuccaggaggcccuccgccucggcgagaccgaggucaccgagaagugcaaccacauccgcgaggucaagucccuccucgaggagcucuccuuccagaagggcgagcucaacguccagaucuccgagcgcaagacccagcucacccucaucaagcaggagaucgagaaggaggaggagaaccuccaggucguccuccgccagauguccaagcacaagaccgagcucaagaacauccucgacaugcuccagcucgagaaccacgagcuccagggccucaagcuccagcacgaccagcgcgucuccgagcucgagaagacccaggucgccguccucgaggagaagcucgagcucgagaaccuccagcagaucucccagcagcagaagggcgagaucgaguggcagaagcagcuccucgagcgcgacaagcgcgagaucgagcgcaugaccgccgagucccgcgcccuccaguccugcgucgagugccucuccaaggagaaggaggaccuccaggagaagugcgacaucugggagaagaagcucgcccagaccaagcgcguccucgccgccgccgaggagaacuccaagauggagcaguccaaccucgagaagcucgagcucaacguccgcaagcuccagcaggagcucgaccagcucaaccgcgacaagcucucccuccacaacgacaucuccgccaugcagcagcagcuccaggagaagcgcgaggccgucaacucccuccaggaggagcucgccaacguccaggaccaccucaaccucgccaagcaggaccuccuccacaccaccaagcaccaggacguccuccucuccgagcagacccgccuccagaaggacaucuccgagugggccaaccgcuucgaggacugccagaaggaggaggagaccaagcagcagcagcuccagguccuccagaacgagaucgaggagaacaagcucaagcucguccagcaggagaugauguuccagcgccuccagaaggagcgcgaguccgaggaguccaagcucgagaccuccaaggucacccucaaggagcagcagcaccagcucgagaaggagcucaccgaccagaaguccaagcucgaccagguccucuccaagguccucgccgccgaggagcgcguccgcacccuccaggaggaggagcgcuggugcgagucccucgagaagacccucucccagaccaagcgccagcucuccgagcgcgagcagcagcucgucgagaaguccggcgagcuccucgcccuccagaaggaggccgacuccaugcgcgccgacuucucccuccuccgcaaccaguuccucaccgagcgcaagaaggccgagaagcaggucgccucccucaaggaggcccucaagauccagcgcucccagcucgagaagaaccuccucgagcagaagcaggagaacuccugcauccagaaggagauggccaccaucgagcucgucgcccaggacaaccacgagcgcgcccgccgccucaugaaggagcucaaccagaugcaguacgaguacaccgagcucaagaagcagauggccaaccagaaggaccucgagcgccgccagauggagaucuccgacgccaugcgcacccucaaguccgaggucaaggacgagauccgcaccucccucaagaaccucaaccaguuccuccccgagcuccccgccgaccucgaggccauccucgagcgcaacgagaaccucgagggcgagcucgagucccucaaggagaaccuccccuucaccaugaacgagggccccuucgaggagaagcucaacuucucccagguccacaucauggacgagcacuggcgcggcgaggcccuccgcgagaagcuccgccaccgcgaggaccgccucaaggcccagcuccgccacugcauguccaagcaggccgagguccucaucaagggcaagcgccagaccgagggcacccuccacucccuccgccgccaggucgacgcccucggcgagcucgucaccuccaccuccgccgacuccgccuccucccccucccucucccagcucgaguccucccucaccgaggacucccagcucggccagaaccaggagaagaacgccuccgcccgcuga

SEQ ID NO: 41548 - RNA, 2778 nt, Artificial Sequence
  derived and/or modified sequence opt2 from CNTROB__Homo_sapiens__NP_001032221
auggccaccuccgccgacucccccuccuccccccucggcgccgaggaccuccucuccgacuccuccgagccccccggccucaaccaggucuccuccgaggucaccucccagcucuacgccucccuccgccucucccgccaggccgaggccaccgcccgcgcccagcucuaccuccccuccaccucccccccccacgagggccucgacggcuucgcccaggagcucucccgcucccucuccgucggccucgagaagaaccucaagaagaaggacggcuccaagcacaucuucgagauggaguccguccgcggccagcuccagaccaugcuccagaccucccgcgacaccgccuaccgcgacccccucauccccggcgccggcuccgagcgccgcgaggaggacuccuucgacuccgacuccaccgccacccuccucaacacccgcccccuccaggaccucucccccuccuccuccgcccaggcccucgaggagcucuucccccgcuacaccucccuccgccccggccccccccucaacccccccgacuuccagggccuccgcgacgcccucgacuccgagcacacccgccgcaagcacugcgagcgccacauccagucccuccagacccgcguccucgagcuccagcagcagcucgccgucgccgucgccgccgaccgcaagaaggacaccaugaucgagcagcucgacaagacccucgcccgcgucgucgagggcuggaaccgccacgaggccgagcgcaccgagguccuccgcggccuccaggaggagcaccaggccgccgagcucacccgcuccaagcagcaggagaccgucacccgccucgagcagucccucuccgaggccauggaggcccucaaccgcgagcaggaguccgcccgccuccagcagcgcgagcgcgagacccucgaggaggagcgccaggcccucacccuccgccucgaggccgagcagcagcgcugcugcguccuccaggaggagcgcgacgccgcccgcgccggccagcucuccgagcaccgcgagcucgagacccuccgcgccgcccucgaggaggagcgccagaccugggcccagcaggagcaccagcucaaggagcacuaccaggcccuccaggaggagucccaggcccagcucgagcgcgagaaggagaagucccagcgcgaggcccaggccgccugggagacccagcaccagcucgcccucguccaguccgagguccgccgccucgagggcgagcucgacaccgcccgccgcgagcgcgacgcccuccagcucgagaugucccucguccaggcccgcuacgagucccagcgcauccagcucgaguccgagcucgccguccagcucgagcagcgcgucaccgagcgccucgcccaggcccaggaguccucccuccgccaggccgccucccuccgcgagcaccaccgcaagcagcuccaggaccucuccggccagcaccagcaggagcucgccucccagcucgcccaguucaaggucgagauggccgagcgcgaggagcgccagcagcaggucgccgaggacuacgagcuccgccucgcccgcgagcaggcccgcgucugcgagcuccaguccggcaaccagcagcucgaggagcagcgcgucgagcucgucgagcgccuccaggccaugcuccaggcccacugggacgaggccaaccagcuccucuccaccacccuccccccccccaacccccccgccccccccgccggccccuccucccccggcccccaggagcccgagaaggaggagcgccgcgucuggaccaugccccccauggccgucgcccucaagcccguccuccagcagucccgcgaggcccgcgacgagcuccccggcgccccccccguccucugcuccuccuccuccgaccucucccuccuccucggccccuccuuccagucccagcacuccuuccagccccucgagcccaagcccgaccucaccuccuccaccgccggcgccuucuccgcccucggcgccuuccaccccgaccaccgcgccgagcgccccuuccccgaggaggaccccggccccgacggcgagggccuccucaagcagggccucccccccgcccagcucgagggccucaagaacuuccuccaccagcuccucgagaccgucccccagaacaacgagaaccccuccgucgaccuccucccccccaaguccggcccccucaccguccccuccugggaggaggccccccaggucccccgcauccccccccccguccacaagaccaaggucccccucgccauggccuccucccucuuccgcguccccgagccccccuccucccacucccagggcuccggccccuccuccggcucccccgagcgcggcggcgacggccucaccuucccccgccagcucauggaggucucccagcuccuccgccucuaccaggcccgcggcuggggcgcccuccccgccgaggaccuccuccucuaccucaagcgccucgagcacuccggcuacaagcccggccgcaaggaggagggcuucuccggcuggaagcucgacuacggcgagugguccggcaccgacggccgcggcgacaacgucccccgccgcaacaccgacucccgccucggcgagaucccccgcaaggagauccccucccaggccgucccccgccgccucgccaccgcccccaagaccgagaagccccccgcccgcaagaaguccggccaccccgcccccuccuccaugcgcucccgcggcggcgucuggcgcuga

SEQ ID NO: 41549 - RNA, 441 nt, Artificial Sequence
  derived and/or modified sequence opt2 from COA1__Homo_sapiens__NP_060694
augauguggcagaaguacgccggcucccgccgcuccaugccccucggcgcccgcauccucuuccacggcgucuucuacgccggcggcuucgccaucgucuacuaccucauccagaaguuccacucccgcgcccucuacuacaagcucgccgucgagcagcuccagucccaccccgaggcccaggaggcccucggccccccccucaacauccacuaccucaagcucaucgaccgcgagaacuucgucgacaucgucgacgccaagcucaagauccccgucuccggcuccaaguccgagggccuccucuacguccacuccucccgcggcggccccuuccagcgcuggcaccucgacgaggucuuccucgagcucaaggacggccagcagauccccgucuucaagcucuccggcgagaacggcgacgaggucaagaaggaguga

SEQ ID NO: 41550 - RNA, 225 nt, Artificial Sequence
  derived and/or modified sequence opt2 from COA5__Homo_sapiens__NP_001008216
augcccaaguacuacgaggacaagccccagggcggcgccugcgccggccucaaggaggaccucggcgccugccuccuccaguccgacugcgucguccaggagggcaaguccccccgccagugccucaaggagggcuacugcaacucccucaaguacgccuucuucgagugcaagcgcuccguccucgacaaccgcgcccgcuuccgcggccgcaagggcuacuga

SEQ ID NO: 41551 - RNA, 1782 nt, Artificial Sequence
  derived and/or modified sequence opt2 from COASY__Homo_sapiens__NP_001035997
augcgcaccccccgccuccgcgcccagccccgcggcgccgucuaccaggcccccucccccccccccgcccccgucggccucggcuccauggccgucuuccgcuccggccuccucguccucaccaccccccucgccucccucgccccccgccucgccuccauccucaccuccgccgcccgccucgucaaccacacccucuacguccaccuccagcccggcaugucccucgagggccccgcccagccccaguccucccccguccaggccaccuucgagguccucgacuucaucacccaccucuacgccggcgccgacguccaccgccaccucgacguccgcauccuccucaccaacauccgcaccaaguccaccuuccuccccccccuccccaccuccguccagaaccucgcccacccccccgaggucguccucaccgacuuccagacccucgacggcucccaguacaaccccgucaagcagcagcucguccgcuacgccaccuccugcuacuccugcugcccccgccucgccuccguccuccucuacuccgacuacggcaucggcgagguccccgucgagccccucgacgucccccuccccuccaccauccgccccgccucccccgucgccggcucccccaagcagcccguccgcggcuacuaccgcggcgccgucggcggcaccuucgaccgccuccacaacgcccacaagguccuccucuccgucgccugcauccucgcccaggagcagcucgucgucggcgucgccgacaaggaccuccucaaguccaagcuccuccccgagcuccuccagcccuacaccgagcgcgucgagcaccucuccgaguuccucgucgacaucaagcccucccucaccuucgacgucaucccccuccucgaccccuacggccccgccggcuccgaccccucccucgaguuccucgucgucuccgaggagaccuaccgcggcggcauggccaucaaccgcuuccgccucgagaacgaccucgaggagcucgcccucuaccagauccagcuccucaaggaccuccgccacaccgagaacgaggaggacaaggucuccuccuccuccuuccgccagcgcaugcucggcaaccuccuccgcccccccuacgagcgccccgagcuccccaccugccucuacgucaucggccucaccggcaucuccggcuccggcaaguccuccaucgcccagcgccucaagggccucggcgccuucgucaucgacuccgaccaccucggccaccgcgccuacgcccccggcggccccgccuaccagcccgucgucgaggccuucggcaccgacauccuccacaaggacggcaucaucaaccgcaagguccucggcucccgcgucuucggcaacaagaagcagcucaagauccucaccgacaucauguggcccaucaucgccaagcucgcccgcgaggagauggaccgcgccgucgccgagggcaagcgcgucugcgucaucgacgccgccguccuccucgaggccggcuggcagaaccucguccacgaggucuggaccgccgucauccccgagaccgaggccguccgccgcaucgucgagcgcgacggccucuccgaggccgccgcccagucccgccuccagucccagauguccggccagcagcucgucgagcagucccacgucguccucuccacccucugggagccccacaucacccagcgccaggucgagaaggccugggcccuccuccagaagcgcauccccaagacccaccaggcccucgacuga

SEQ ID NO: 41552 - RNA, 1140 nt, Artificial Sequence
  derived and/or modified sequence opt2 from COBL__Homo_sapiens__NP_001274367
auggacgccccccgcgccuccgccgccaagccccccaccggccgcaagaugaaggcccgcgccccccccccccccggcaaggccgccacccuccacguccacuccgaccagaagcccccccacgacggcgcccucggcucccagcagaaccucguccgcaugaaggaggcccuccgcgccuccaccauggacgucaccgucguccuccccuccggccucgagaagcgcuccguccucaacggcucccacgccaugauggaccuccucgucgagcucugccuccagaaccaccucaaccccucccaccacgcccucgagauccgcuccuccgagacccagcagccccucuccuucaagcccaacacccucaucggcacccucaacguccacaccgucuuccucaaggagaagguccccgaggagaaggucaagcccggcccccccaagguccccgagaaguccguccgccucgucgucaacuaccuccgcacccagaaggccgucguccgcgucucccccgaggucccccuccagaacauccuccccgucaucugcgccaagugcgaggucucccccgagcacgucguccuccuccgcgacaacaucgccggcgaggagcucgagcucuccaagucccucaacgagcucggcaucaaggagcucuacgccugggacaaccgccgcgagaccuuccgcaaguccucccucggcaacgacgagaccgacaaggagaagaagaaguuccucggcuucuucaaggucaacaagcgcuccaacuccaagggcugccucaccacccccaacucccccuccaugcacucccgcucccucacccucggccccucccucucccucggcuccaucuccggcgucuccgucaaguccgagaugaagaagcgccgcgccccccccccccccggcuccggcccccccguccaggacaaggccuccgagaaggucucccucggcucccagaucgaccuccagaagaagaagcgccgcgcccccgcccccccccccccccagccccccccccccuccccccucauccccaaccgcaccgaggacaaggaggagaaccgcaaguccaccauggucuacugcugcgccuccuuccccacccaggccaagcgcuucuga

SEQ ID NO: 41553 - RNA, 3702 nt, Artificial Sequence
  derived and/or modified sequence opt2 from COBLL1__Homo_sapiens__NP_001265387
augccccccuccugguccccccucaugugcggccgcgccgccgaggccgccgccuccucccgcacccccggccgcgagaugggccaggccgucacccgccgccucggcgccggcgcccgcgccgccccccgccgcgccauggacggccgcaccccccgcccccaggacgcccccgcccgccgcgagaucgccggcuccuggcgcaagcccaaggccaaggccccccucccccccgccgagaccaaguacaccgacgucuccuccgccgccgacuccgucgaguccaccgccuucaucauggagcagaaggagaacaugaucgacaaggacgucgagcucuccgucguccuccccggcgacaucaucaaguccaccaccguccacggcuccaagcccaugauggaccuccucaucuuccucugcgcccaguaccaccucaaccccuccuccuacaccaucgaccuccucuccgccgagcagaaccacaucaaguucaagcccaacacccccaucggcaugcucgaggucgagaaggucauccucaagcccaagaugcucgacaagaagaagcccacccccaucauccccgagaagaccguccgcgucgucaucaacuucaagaagacccagaagaccaucguccgcgucuccccccacgccucccuccaggagcucgcccccaucaucugcuccaagugcgaguucgacccccuccacacccuccuccucaaggacuaccagucccaggagccccucgaccucaccaagucccucaacgaccucggccuccgcgagcucuacgccauggacgucaaccgcgccaccuccgucaccgucuucuccaaguccucccuccaggaguccugccagaucucccagaaccucgacaucaugaaggagaaggagaacaagggcuucuucuccuucuuccagcgcuccaagaagaagcgcgaccagaccgccuccgcccccgccaccccccucgucaacaagcaccgccccaccuucacccgcuccaacaccaucuccaagcccuacaucuccaacacccuccccuccgacgcccccaagaagcgccgcgccccccucccccccaugcccgccucccaguccgucccccaggaccucgcccacauccaggagcgccccgccuccugcaucgucaaguccauguccgucgacgagaccgacaagucccccugcgaggccggccgcguccgcgccggcucccuccagcucuccuccauguccgccggcaacuccucccuccgccgcaccaagcgcaaggcccccuccccccccuccaagauccccccccaccaguccgacgagaacucccgcgucaccgcccuccagcccgucgacggcgucccccccgacuccgccuccgaggccaacucccccgaggagcucuccucccccgagaccuuccaccccggccucuccucccaggagcagugcaccgcccccaagcucauggaggagaccuccgucuucgagugccccggcacccccgaggccgccaucaccucccucaccuccggcaucuccuccgacuacucccucgaggagaucgacgagaaggaggagcucuccgagguccccaaggucgaggccgagaacaucucccccaagucccaggacauccccuucgucuccaccgacaucaucaacacccucaagaacgaccccgacuccgcccucggcaacggcuccggcgaguucucccagaacuccauggaggagaagcaggagaccaaguccaccgacggccaggagccccacuccgucgucuacgacaccuccaacggcaagaaggucgucgacuccauccgcaaccucaagucccucggccccaaccaggagaacgucguccagaacgagaucaucgucuaccccgagaacaccgaggacaacaugaagaacggcgucaagaagaccgagaucaacgucgagggcgucgccaagaacaacaacaucgacauggaggucgagcgccccuccaacuccgaggcccacgagaccgacaccgccaucuccuacaaggagaaccaccucgccgccuccuccguccccgaccagaagcucaaccagcccuccgccgagaagaccaaggacgccgccauccagaccacccccuccugcaacuccuucgacggcaagcaccaggaccacaaccucuccgacuccaaggucgaggagugcguccagaccuccaacaacaacaucuccacccagcacuccugccucuccucccaggacuccgucaacaccucccgcgaguuccgcucccagggcacccucaucauccacuccgaggacccccucaccgucaaggaccccaucugcgcccacggcaacgacgaccuccucccccccgucgaccgcaucgacaagaacuccaccgccuccuaccucaagaacuacccccucuaccgccaggacuacaaccccaagcccaagcccuccaacgagaucacccgcgaguacauccccaagaucggcaugaccaccuacaagaucgucccccccaagucccucgagaucuccaaggacuggcaguccgagaccaucgaguacaaggacgaccaggacaugcacgcccucggcaagaagcacacccacgagaacgucaaggagaccgccauccagaccgaggacuccgccaucuccgagucccccgaggagccccuccccaaccucaagcccaagcccaaccuccgcaccgagcaccagguccccuccuccgucuccucccccgacgacgccauggucuccccccucaagcccgcccccaagaugacccgcgacaccggcaccgcccccuucgcccccaaccucgaggagaucaacaacauccucgaguccaaguucaagucccgcgccuccaacgcccaggccaagcccuccuccuucuuccuccagaugcagaagcgcgucuccggccacuacgucaccuccgccgccgccaaguccguccacgccgcccccaaccccgcccccaaggagcucaccaacaaggaggccgagcgcgacaugcuccccucccccgagcagacccucuccccccucuccaagaugccccacuccgucccccagccccucgucgagaagaccgacgacgacgucaucggccaggcccccgccgaggccucccccccccccaucgcccccaagcccgucaccauccccgccucccaggucuccacccagaaccucaagacccucaagaccuucggcgccccccgccccuacuccuccuccggccccucccccuucgcccucgccgucgucaagcgcucccaguccuucuccaaggagcgcaccgagucccccuccgccuccgcccucguccagccccccgccaacaccgaggagggcaagacccacuccgucaacaaguucgucgacaucccccagcucggcgucuccgacaaggagaacaacuccgcccacaacgagcagaacucccagauccccacccccaccgacggccccuccuucaccgucaugcgccaguccucccucaccuuccaguccuccgaccccgagcagaugcgccagucccuccucaccgccauccgcuccggcgaggccgccgccaagcucaagcgcgucaccauccccuccaacaccaucuccgucaacggccgcucccgccucucccacuccaugucccccgacgcccaggacggccacuga

SEQ ID NO: 41554 - RNA, 1653 nt, Artificial Sequence
  derived and/or modified sequence opt2 from COCH__Homo_sapiens__XP_011534841
auguccgccgccuggauccccgcccucggccucggcgucugccuccuccuccuccccggccccgccggcuccgagggcgccgcccccaucgccaucaccugcuucacccgcggccucgacauccgcaaggagaaggccgacguccucugccccggcggcugcccccucgaggaguucuccgucuacggcaacaucgucuacgccuccgucuccuccaucugcggcgccgccguccaccgcggcgucaucuccaacuccggcggccccguccgcgucuacucccuccccggccgcgagaacuacuccuccgucgacgccaacggcauccagucccagaugcucucccgcugguccgccuccuucaccgucaccaagggcaaguccuccacccaggaggccaccggccaggccgucuccaccgcccacccccccaccggcaagcgccucaagaagacccccgagaagaagaccggcaacaaggacugcaaggccgacaucgccuuccucaucgacggcuccuucaacaucggccagcgccgcuucaaccuccagaagaacuucgucggcaaggucgcccucaugcucggcaucggcaccgagggcccccacgucggccucguccaggccuccgagcaccccaagaucgaguucuaccucaagaacuucaccuccgccaaggacguccucuucgccaucaaggaggucggcuuccgcggcggcaacuccaacaccggcaaggcccucaagcacaccgcccagaaguucuucaccgucgacgccggcguccgcaagggcauccccaaggucgucgucgucuucaucgacggcuggcccuccgacgacaucgaggaggccggcaucgucgcccgcgaguucggcgucaacgucuucaucgucuccgucgccaagcccauccccgaggagcucggcaugguccaggacgucaccuucgucgacaaggccgucugccgcaacaacggcuucuucuccuaccacaugcccaacugguucggcaccaccaaguacgucaagccccucguccagaagcucugcacccacgagcagaugaugugcuccaagaccugcuacaacuccgucaacaucgccuuccucaucgacggcuccuccuccgucggcgacuccaacuuccgccucaugcucgaguucgucuccaacaucgccaagaccuucgagaucuccgacaucggcgccaagaucgccgccguccaguucaccuacgaccagcgcaccgaguucuccuucaccgacuacuccaccaaggagaacguccucgccgucauccgcaacauccgcuacauguccggcggcaccgccaccggcgacgccaucuccuucaccguccgcaacgucuucggccccauccgcgagucccccaacaagaacuuccucgucaucgucaccgacggccaguccuacgacgacguccagggccccgccgccgccgcccacgacgccggcaucaccaucuucuccgucggcgucgccugggccccccucgacgaccucaaggacauggccuccaagcccaaggagucccacgccuucuucacccgcgaguucaccggccucgagcccaucgucuccgacgucauccgcggcaucugccgcgacuuccucgagucccagcaguga

SEQ ID NO: 41555 - RNA, 2943 nt, Artificial Sequence
  derived and/or modified sequence opt2 from COG1__Homo_sapiens__NP_061184
auggccaccgccgccaccucccccgcccucaagcgccucgaccuccgcgaccccgccgcccucuucgagacccacggcgccgaggagauccgcggccucgagcgccagguccgcgccgagaucgagcacaagaaggaggagcuccgccagauggucggcgagcgcuaccgcgaccucaucgaggccgccgacaccaucggccagaugcgccgcugcgccgucggccucgucgacgccgucaaggccaccgaccaguacugcgcccgccuccgccaggccggcuccgccgccccccgccccccccgcgcccagcagccccagcagcccucccaggagaaguucuacuccauggccgcccagaucaagcuccuccucgagauccccgagaagaucugguccuccauggaggccucccagugccuccacgccacccagcucuaccuccucugcugccaccuccacucccuccuccagcucgacuccuccuccucccgcuacucccccguccucucccgcuuccccauccucauccgccaggucgccgccgccucccacuuccgcuccaccauccuccacgaguccaagaugcuccucaagugccagggcgucuccgaccaggccgucgccgaggcccucugcuccaucaugcuccucgaggaguccuccccccgccaggcccucaccgacuuccuccucgcccgcaaggccaccauccagaagcuccucaaccagccccaccacggcgccggcaucaaggcccagaucugcucccucgucgagcuccucgccaccacccucaagcaggcccacgcccucuucuacacccuccccgagggccuccuccccgaccccgcccuccccugcggccuccucuucuccacccucgagaccaucaccggccagcaccccgccggcaagggcaccggcguccuccaggaggagaugaagcucugcuccugguucaagcaccuccccgccuccaucgucgaguuccagcccacccuccgcacccucgcccaccccaucucccaggaguaccucaaggacacccuccagaaguggauccacaugugcaacgaggacaucaagaacggcaucaccaaccuccucauguacgucaaguccaugaagggccucgccggcauccgcgacgccaugugggagcuccucaccaacgaguccaccaaccacuccugggacguccucugccgccgccuccucgagaagccccuccucuucugggaggacaugaugcagcagcucuuccucgaccgccuccagacccucaccaaggagggcuucgacuccaucuccuccuccuccaaggagcuccucgucuccgcccuccaggagcucgaguccuccaccuccaacucccccuccaacaagcacauccacuucgaguacaacaugucccucuuccucugguccgagucccccaacgaccuccccuccgacgccgccugggucuccgucgccaaccgcggccaguucgccuccuccggccucuccaugaaggcccaggccaucucccccugcguccagaacuucugcuccgcccucgacuccaagcucaaggucaagcucgacgaccuccucgccuaccuccccuccgacgacuccucccuccccaaggacgucucccccacccaggccaaguccuccgccuucgaccgcuacgccgacgccggcaccguccaggagaugcuccgcacccaguccgucgccugcaucaagcacaucgucgacugcauccgcgccgagcuccaguccaucgaggagggcguccagggccagcaggacgcccucaacuccgccaagcuccacuccguccucuucauggcccgccucugccagucccucggcgagcucugcccccaccucaagcagugcauccucggcaaguccgaguccuccgagaagcccgcccgcgaguuccgcgcccuccgcaagcagggcaaggucaagacccaggagaucauccccacccaggccaaguggcaggaggucaaggagguccuccuccagcaguccgucaugggcuaccaggucugguccuccgccgucgucaagguccucauccacggcuucacccagucccuccuccucgacgacgccggcuccguccucgccaccgccaccuccugggacgagcucgagauccaggaggaggccgaguccggcuccuccgucaccuccaagauccgccuccccgcccagcccuccugguacguccaguccuuccucuucucccucugccaggagaucaaccgcgucggcggccacgcccuccccaaggucacccuccaggagaugcucaaguccugcaugguccaggucgucgccgccuacgagaagcucuccgaggagaagcagaucaagaaggagggcgccuuccccgucacccagaaccgcgcccuccagcuccucuacgaccuccgcuaccucaacaucguccucaccgccaagggcgacgaggucaaguccggccgcuccaagcccgacucccgcaucgagaaggucaccgaccaccucgaggcccucaucgaccccuucgaccucgacgucuucaccccccaccucaacuccaaccuccaccgccucguccagcgcaccuccguccucuucggccucgucaccggcaccgagaaccagcucgccccccgcuccuccaccuucaacucccaggagccccacaacauccucccccucgccuccucccagauccgcuucggccuccucccccucuccaugaccuccacccgcaaggccaaguccacccgcaacaucgagaccaaggcccaggucgucccccccgcccgcuccaccgccggcgaccccaccguccccggcucccucuuccgccagcucgucuccgaggaggacaacaccuccgcccccucccucuucaagcucggcuggcucuccuccaugaccaaguga

SEQ ID NO: 41556 - RNA, 2214 nt, Artificial Sequence
  derived and/or modified sequence opt2 from COG2__Homo_sapiens__NP_001138508
auggagaagucccgcaugaaccuccccaagggccccgacacccucugcuucgacaaggacgaguucaugaaggaggacuucgacgucgaccacuucgucuccgacugccgcaagcgcguccagcucgaggagcuccgcgacgaccucgagcucuacuacaagcuccucaagaccgccauggucgagcucaucaacaaggacuacgccgacuucgucaaccucuccaccaaccucgucggcauggacaaggcccucaaccagcucuccgucccccucggccagcuccgcgaggagguccucucccuccgcuccuccgucuccgagggcauccgcgccgucgacgagcgcauguccaagcaggaggacauccgcaagaagaagaugugcguccuccgccucauccaggucauccgcuccgucgagaagaucgagaagauccucaacucccaguccuccaaggagaccuccgcccucgaggccuccuccccccuccucaccggccagauccucgagcgcaucgccaccgaguucaaccagcuccaguuccacgccguccaguccaagggcaugccccuccucgacaagguccgcccccgcaucgccggcaucaccgccaugcuccagcagucccucgagggccuccuccucgagggccuccagaccuccgacgucgacaucauccgccacugccuccgcaccuacgccaccaucgacaagacccgcgacgccgaggcccucgucggccagguccucgucaagcccuacaucgacgaggucaucaucgagcaguucgucgagucccaccccaacggccuccaggucauguacaacaagcuccucgaguucgucccccaccacugccgccuccuccgcgaggucaccggcggcgccaucuccuccgagaagggcaacaccguccccggcuacgacuuccucgucaacuccgucuggccccagaucguccagggccucgaggagaagcuccccucccucuucaaccccggcaaccccgacgccuuccacgagaaguacaccaucuccauggacuucguccgccgccucgagcgccagugcggcucccaggccuccgucaagcgccuccgcgcccaccccgccuaccacuccuucaacaagaaguggaaccuccccgucuacuuccagauccgcuuccgcgagaucgccggcucccucgaggccgcccucaccgacguccucgaggacgcccccgccgagucccccuacugccuccucgccucccaccgcaccugguccucccuccgccgcugcugguccgacgagauguuccucccccuccucguccaccgccucuggcgccucacccuccagauccucgcccgcuacuccgucuucgucaacgagcucucccuccgccccaucuccaacgagucccccaaggagaucaagaagccccucgucaccggcuccaaggagcccuccaucacccagggcaacaccgaggaccagggcuccggccccuccgagaccaagcccgucgucuccaucucccgcacccagcucgucuacgucgucgccgaccucgacaagcuccaggagcagcuccccgagcuccucgagaucaucaagcccaagcucgagaugaucggcuucaagaacuucuccuccaucuccgcccucgaggacucccaguccuccuucuccgccugcguccccucccucuccuccaagaucauccaggaccucuccgacuccugcuucggcuuccucaaguccgcccucgaggucccccgccucuaccgccgcaccaacaaggagguccccaccaccgccuccuccuacgucgacuccgcccucaagccccucuuccagcuccaguccggccacaaggacaagcucaagcaggccaucauccagcaguggcucgagggcacccucuccgaguccacccacaaguacuacgagaccgucuccgacguccucaacuccgucaagaagauggaggagucccucaagcgccucaagcaggcccgcaagaccacccccgccaaccccgucggccccuccggcggcauguccgacgacgacaagauccgccuccagcucgcccucgacgucgaguaccucggcgagcagauccagaagcucggccuccaggccuccgacaucaaguccuucuccgcccucgccgagcucgucgccgccgccaaggaccaggccaccgccgagcagcccuga

SEQ ID NO: 41557 - RNA, 2487 nt, Artificial Sequence
  derived and/or modified sequence opt2 from COG3__Homo_sapiens__NP_113619
auggccgaggccgcccuccuccuccuccccgaggccgccgccgagcgcgacgcccgcgagaagcucgcccucugggaccgccgccccgacaccaccgccccccucaccgaccgccagaccgacuccguccucgagcucaaggccgccgccgagaaccuccccguccccgccgagcuccccaucgaggaccucugcucccucaccucccagucccuccccaucgagcucaccuccgucguccccgaguccaccgaggacauccuccucaagggcuucaccucccucggcauggaggaggagcgcaucgagaccgcccagcaguucuucuccugguucgccaagcuccagacccagauggaccaggacgagggcaccaaguaccgccagaugcgcgacuaccucuccggcuuccaggagcagugcgacgccauccucaacgacgucaacuccgcccuccagcaccucgagucccuccagaagcaguaccucuucgucuccaacaagaccggcacccuccacgaggccugcgagcagcuccucaaggagcaguccgagcucgucgaccucgccgagaacauccagcagaagcucuccuacuucaacgagcucgagaccaucaacaccaagcucaacucccccacccucuccgucaacuccgacggcuucauccccaugcucgccaagcucgacgacugcaucaccuacaucuccucccaccccaacuucaaggacuaccccaucuaccuccucaaguucaagcagugccucuccaaggcccuccaccucaugaagaccuacaccgucaacacccuccagacccucaccucccagcuccucaagcgcgaccccuccuccguccccaacgccgacaacgccuucacccucuucuacgucaaguuccgcgccgccgcccccaagguccgcacccucaucgagcagaucgagcuccgcuccgagaagauccccgaguaccagcagcuccucaacgacauccaccagugcuaccucgaccagcgcgagcuccuccucggccccuccaucgccugcaccgucgccgagcucaccucccagaacaaccgcgaccacugcgcccucguccgcuccggcugcgccuucaugguccacgucugccaggacgagcaccagcucuacaacgaguucuucaccaagcccaccuccaagcucgacgagcuccucgagaagcucugcgucucccucuacgacgucuuccgcccccucaucauccacgucauccaccucgagacccucuccgagcucugcggcauccucaagaacgagguccucgaggaccacguccagaacaacgccgagcagcucggcgccuucgccgccggcgucaagcagaugcucgaggacguccaggagcgccucgucuaccgcacccacaucuacauccagaccgacaucaccggcuacaagcccgcccccggcgaccucgccuaccccgacaagcucgucaugauggagcagaucgcccagucccucaaggacgagcagaagaagguccccuccgaggccuccuucuccgacguccaccucgaggagggcgaguccaacucccucaccaaguccggcuccaccgagucccucaacccccgcccccagaccaccaucucccccgccgaccuccacggcaugugguaccccaccguccgccgcacccucgucugccucuccaagcucuaccgcugcaucgaccgcgccgucuuccagggccucucccaggaggcccucuccgccugcauccagucccuccucggcgccuccgaguccaucuccaagaacaagacccagaucgacggccagcucuuccucaucaagcaccuccucauccuccgcgagcagaucgcccccuuccacaccgaguucaccaucaaggagaucucccucgaccucaagaagacccgcgacgccgccuucaagauccucaaccccaugaccgucccccgcuucuuccgccucaacuccaacaacgcccucaucgaguuccuccucgagggcacccccgagauccgcgagcacuaccucgacuccaagaaggacgucgaccgccaccucaaguccgccugcgagcaguucauccagcagcagaccaagcucuucgucgagcagcucgaggaguucaugaccaaggucuccgcccucaagaccauggccucccagggcggccccaaguacacccucucccagcagcccugggcccagcccgccaaggucaacgaccucgccgccaccgccuacaagaccaucaagaccaagcuccccgucacccuccgcuccaugucccucuaccucuccaacaaggacaccgaguucauccucuucaagcccguccgcaacaacauccagcaggucuuccagaaguuccacgcccuccucaaggaggaguucucccccgaggacauccagaucaucgccugccccuccauggagcagcucucccuccuccucuccgucuccaaguga

SEQ ID NO: 41558 - RNA, 2307 nt, Artificial Sequence
  derived and/or modified sequence opt2 from COG4__Homo_sapiens__NP_001182068
augggcaccaagauggccgaccucgacuccccccccaagcucuccggcguccagcagcccuccgagggcgucggcggcggccgcugcuccgagaucuccgccgagcucauccgcucccucaccgagcuccaggagcucgaggccgucuacgagcgccucugcggcgaggagaaggucgucgagcgcgagcucgacgcccuccucgagcagcagaacaccaucgaguccaagauggucacccuccaccgcaugggccccaaccuccagcucaucgagggcgacgccaagcagcucgccggcaugaucaccuucaccugcaaccucgccgagaacgucuccuccaagguccgccagcucgaccucgccaagaaccgccucuaccaggccauccagcgcgccgacgacauccucgaccucaaguucugcauggacggcguccagaccgcccuccgcuccgaggacuacgagcaggccgccgcccacacccaccgcuaccucugccucgacaaguccgucaucgagcucucccgccagggcaaggagggcuccaugaucgacgccaaccucaagcuccuccaggaggccgagcagcgccucaaggccaucgucgccgagaaguucgccaucgccaccaaggagggcgaccucccccaggucgagcgcuucuucaagaucuucccccuccucggccuccacgaggagggccuccgcaaguucuccgaguaccucugcaagcaggucgccuccaaggccgaggagaaccuccucaugguccucggcaccgacauguccgaccgccgcgccgccgucaucuucgccgacacccucacccuccucuucgagggcaucgcccgcaucgucgagacccaccagcccaucgucgagaccuacuacggccccggccgccucuacacccucaucaaguaccuccaggucgagugcgaccgccaggucgagaaggucgucgacaaguucaucaagcagcgcgacuaccaccagcaguuccgccacguccagaacaaccucaugcgcaacuccaccaccgagaagaucgagccccgcgagcucgaccccauccucaccgaggucacccucaugaacgcccgcuccgagcucuaccuccgcuuccucaagaagcgcaucuccuccgacuucgaggucggcgacuccauggccuccgaggaggucaagcaggagcaccagaagugccucgacaagcuccucaacaacugccuccucuccugcaccaugcaggagcucaucggccucuacgucaccauggaggaguacuucaugcgcgagaccgucaacaaggccgucgcccucgacaccuacgagaagggccagcucaccuccuccauggucgacgacgucuucuacaucgucaagaagugcaucggccgcgcccucuccuccuccuccaucgacugccucugcgccaugaucaaccucgccaccaccgagcucgaguccgacuuccgcgacguccucugcaacaagcuccgcaugggcuuccccgccaccaccuuccaggacauccagcgcggcgucaccuccgccgucaacaucaugcacuccucccuccagcagggcaaguucgacaccaagggcaucgaguccaccgacgaggccaagauguccuuccucuccgacugcaccaagcucuucucccagggcaucggcggcgagcaggcccaggccaaguucgacuccugccucuccgaccucgccgccgucuccaacaaguuccgcgaccuccuccaggagggccucaccgagcucaacuccaccgccaucaagccccagguccagcccuggaucaacuccuucuucuccgucucccacaacaucgaggaggaggaguucaacgacuacgaggccaacgaccccuggguccagcaguucauccucaaccucgagcagcagauggccgaguucaaggccucccucucccccgucaucuacgacucccucaccggccucaugaccucccucgucgccgucgagcucgagaaggucguccucaaguccaccuucaaccgccucggcggccuccaguucgacaaggagcuccgcucccucaucgccuaccucaccaccgucaccaccuggaccauccgcgacaaguucgcccgccucucccagauggccaccauccucaaccucgagcgcgucaccgagauccucgacuacuggggccccaacuccggcccccucaccuggcgccucacccccgccgagguccgccagguccucgcccuccgcaucgacuuccgcuccgaggacaucaagcgccuccgccucuga

SEQ ID NO: 41559 - RNA, 2583 nt, Artificial Sequence
  derived and/or modified sequence opt2 from COG5__Homo_sapiens__NP_006339
augggcugggucggcggccgccgccgcgacuccgccuccccccccggccgcucccgcuccgccgccgacgacaucaaccccgcccccgccaacauggagggcggcggcggcuccgucgccgucgccggccucggcgcccgcggcuccggcgccgccgccgccaccguccgcgagcuccuccaggacggcugcuacuccgacuuccucaacgaggacuucgacgucaagaccuacaccucccaguccauccaccaggccgucaucgccgagcagcucgccaagcucgcccagggcaucucccagcucgaccgcgagcuccaccuccaggucgucgcccgccacgaggaccuccucgcccaggccaccggcaucgagucccucgagggcguccuccagaugaugcagacccgcaucggcgcccuccagggcgccgucgaccgcaucaaggccaagaucgucgagcccuacaacaagaucgucgcccgcaccgcccagcucgcccgccuccaggucgccugcgaccuccuccgccgcaucauccgcauccucaaccucuccaagcgccuccagggccagcuccagggcggcucccgcgagaucaccaaggccgcccagucccucaacgagcucgacuaccucucccagggcaucgaccucuccggcaucgaggucaucgagaacgaccuccucuucaucgcccgcgcccgccucgaggucgagaaccaggccaagcgccuccucgagcagggccucgagacccagaaccccacccaggucggcaccgcccuccaggucuucuacaaccucggcacccucaaggacaccaucaccuccgucgucgacggcuacugcgccacccucgaggagaacaucaacuccgcccucgacaucaagguccucacccagcccucccaguccgccguccgcggcggccccggccgcuccaccaugcccacccccggcaacaccgccgcccuccgcgccuccuucuggaccaacauggagaagcucauggaccacaucuacgccgucugcggccagguccagcaccuccagaagguccucgccaagaagcgcgaccccgucucccacaucugcuucaucgaggagaucgucaaggacggccagcccgagaucuucuacaccuucuggaacuccgucacccaggcccucuccucccaguuccacauggccaccaacuccuccauguuccucaagcaggccuucgagggcgaguaccccaagcuccuccgccucuacaacgaccucuggaagcgccuccagcaguacucccagcacauccagggcaacuucaacgccuccggcaccaccgaccucuacgucgaccuccagcacauggaggacgacgcccaggacaucuucauccccaagaagcccgacuacgaccccgagaaggcccucaaggacucccuccagcccuacgaggccgccuaccucuccaagucccucucccgccucuucgaccccaucaaccucgucuucccccccggcggccgcaacccccccuccuccgacgagcucgacggcaucaucaagaccaucgccuccgagcucaacgucgccgccgucgacaccaaccucacccucgccgucuccaagaacgucgccaagaccauccagcucuacuccgucaaguccgagcagcuccucuccacccagggcgacgccucccaggucaucggcccccucaccgagggccagcgccgcaacgucgccgucgucaacucccucuacaagcuccaccaguccgucaccaaggucgucuccucccaguccuccuucccccucgccgccgagcagaccaucaucuccgcccucaaggccauccacgcccucauggagaacgccguccagccccuccucaccuccgucggcgacgccaucgaggccaucaucaucaccaugcaccaggaggacuucuccggcucccucuccuccuccggcaagcccgacguccccugcucccucuacaugaaggagcuccagggcuucaucgcccgcgucauguccgacuacuucaagcacuucgagugccucgacuucgucuucgacaacaccgaggccaucgcccagcgcgccgucgagcucuucauccgccacgccucccucauccgcccccucggcgagggcggcaagaugcgccucgccgccgacuucgcccagauggagcucgccgucggccccuucugccgccgcgucuccgaccucggcaaguccuaccgcaugcuccgcuccuuccgcccccuccucuuccaggccuccgagcacgucgccuccucccccgcccucggcgacgucauccccuucuccaucaucauccaguuccucuucacccgcgcccccgccgagcucaagucccccuuccagcgcgccgaguggucccacacccgcuucucccaguggcucgacgaccaccccuccgagaaggaccgccuccuccucauccgcggcgcccucgaggccuacguccaguccguccgcucccgcgagggcaaggaguucgcccccgucuaccccaucaugguccagcuccuccagaaggccauguccgcccuccaguga

SEQ ID NO: 41560 - RNA, 1848 nt, Artificial Sequence
  derived and/or modified sequence opt2 from COG6__Homo_sapiens__NP_001138551
auggccgagggcuccggcgaggucgucgccgucuccgccaccggcgccgccaacggccucaacaacggcgccggcggcaccuccgccaccaccugcaacccccucucccgcaagcuccacaagauccucgagacccgccucgacaacgacaaggagaugcucgaggcccucaaggcccucuccaccuucuucgucgagaacucccuccgcacccgccgcaaccuccgcggcgacaucgagcgcaagucccucgccaucaacgaggaguucgucuccaucuucaaggaggucaaggaggagcucgaguccaucuccgaggacguccaggccauguccaacugcugccaggacaugaccucccgccuccaggccgccaaggagcagacccaggaccucaucgucaagaccaccaagcuccaguccgagucccagaagcucgagauccgcgcccaggucgccgacgccuuccucuccaaguuccagcucaccuccgacgagaugucccuccuccgcggcacccgcgagggccccaucaccgaggacuucuucaaggcccucggccgcgucaagcagauccacaacgacgucaagguccuccuccgcaccaaccagcagaccgccggccucgagaucauggagcagauggcccuccuccaggagaccgccuacgagcgccucuaccgcugggcccaguccgagugccgcacccucacccaggaguccugcgacgucucccccguccucacccaggccauggaggcccuccaggaccgccccguccucuacaaguacacccucgacgaguucggcaccgcccgccgcuccaccgucguccgcggcuucaucgacgcccucacccgcggcggccccggcggcaccccccgccccaucgagaugcacucccacgacccccuccgcuacgucggcgacaugcucgccuggcuccaccaggccaccgccuccgagaaggagcaccucgaggcccuccucaagcacgucaccacccagggcgucgaggagaacauccaggaggucgucggccacaucaccgagggcgucugccgcccccucaagguccgcaucgagcaggucaucgucgccgagcccggcgccguccuccucuacaagaucuccaaccuccucaaguucuaccaccacaccaucuccggcaucgucggcaacuccgccaccgcccuccucaccaccaucgaggagaugcaccuccucuccaagaagaucuucuucaacucccucucccuccacgccuccaagcucauggacaaggucgagcuccccccccccgaccucggccccuccuccgcccucaaccagacccucaugcuccuccgcgagguccucgccucccacgacuccuccgucgucccccucgacgcccgccaggccgacuucguccagguccucuccugcguccucgacccccuccuccagaugugcaccgucuccgccuccaaccucggcaccgccgacauggccaccuucauggucaacucccucuacaugaugaagaccacccucgcccucuucgaguucaccgaccgccgccucgagaugcuccaguuccagaucgaggcccaccucgacacccucaucaacgagcaggccuccuacguccucacccgcgucggccucuccuacaucuacaacaccguccagcagcacaagcccgagcagggcucccucgccaacaugcccaaccucgacuccgucacccucaaggccgccaugguccaguucgaccgcuaccucuccgcccccgacaaccuccucaucccccagcucaacuuccuccucuccgccaccgucaagcgcccccccaacggccccuga

SEQ ID NO: 41561 - RNA, 2313 nt, Artificial Sequence
  derived and/or modified sequence opt2 from COG7__Homo_sapiens__NP_705831
auggacuucuccaaguuccucgccgacgacuucgacgucaaggaguggaucaacgccgccuuccgcgccggcuccaaggaggccgccuccggcaaggccgacggccacgccgccacccucgucaugaagcuccagcucuucauccaggaggucaaccacgccgucgaggagaccucccaccaggcccuccagaacaugcccaagguccuccgcgacgucgaggcccucaagcaggaggccuccuuccucaaggagcagaugauccucgucaaggaggacaucaagaaguucgagcaggacaccucccaguccaugcagguccucgucgagaucgaccaggucaagucccgcaugcagcucgccgccgagucccuccaggaggccgacaagugguccacccucuccgccgacaucgaggagaccuucaagacccaggacaucgccgucaucuccgccaagcucaccggcaugcagaacucccucaugaugcucgucgacacccccgacuacuccgagaagugcguccaccucgaggcccucaagaaccgccucgaggcccucgccuccccccagaucgucgccgccuucaccucccaggccgucgaccaguccaaggucuucgucaaggucuucaccgagaucgaccgcaugccccagcuccucgccuacuacuacaagugccacaagguccagcuccucgccgccuggcaggagcucugccaguccgaccucucccucgaccgccagcucaccggccucuacgacgcccuccucggcgccuggcacacccagauccagugggccacccaggucuuccagaagccccacgaggucgucaugguccuccucauccagacccucggcgcccucaugcccucccuccccuccugccucuccaacggcgucgagcgcgccggccccgagcaggagcucacccgccuccucgaguucuacgacgccaccgcccacuucgccaagggccucgagauggcccuccucccccaccuccacgagcacaaccucgucaaggucaccgagcucgucgacgccgucuacgaccccuacaagcccuaccagcucaaguacggcgacauggaggaguccaaccuccucauccagauguccgccgucccccucgagcacggcgaggucaucgacugcguccaggagcucucccacuccgucaacaagcucuucggccucgccuccgccgccgucgaccgcugcguccgcuucaccaacggccucggcaccugcggccuccucuccgcccucaagucccucuucgccaaguacgucuccgacuucaccuccacccuccaguccauccgcaagaagugcaagcucgaccacaucccccccaacucccucuuccaggaggacuggaccgccuuccagaacuccauccgcaucaucgccaccugcggcgagcuccuccgccacugcggcgacuucgagcagcagcucgccaaccgcauccucuccaccgccggcaaguaccucuccgacuccugcuccccccgcucccucgccggcuuccaggaguccauccucaccgacaagaagaacuccgccaagaaccccuggcaggaguacaacuaccuccagaaggacaaccccgccgaguacgccucccucauggagauccucuacacccucaaggagaagggcuccuccaaccacaaccuccucgccgccccccgcgccgcccucacccgccucaaccagcaggcccaccagcucgccuucgacuccgucuuccuccgcaucaagcagcagcuccuccucaucuccaagauggacuccuggaacaccgccggcaucggcgagacccucaccgacgagcuccccgccuucucccucaccccccucgaguacaucuccaacaucggccaguacaucaugucccucccccucaaccucgagcccuucgucacccaggaggacuccgcccucgagcucgcccuccacgccggcaagcuccccuucccccccgagcagggcgacgagcuccccgagcucgacaacauggccgacaacuggcucggcuccaucgcccgcgccaccaugcagaccuacugcgacgccauccuccagauccccgagcucuccccccacuccgccaagcagcucgccaccgacaucgacuaccucaucaacgucauggacgcccucggccuccagcccucccgcacccuccagcacaucgucacccuccucaagacccgccccgaggacuaccgccaggucuccaagggccucccccgccgccucgccaccaccgucgccaccaugcgcuccgucaacuacuga

SEQ ID NO: 41562 - RNA, 1839 nt, Artificial Sequence
  derived and/or modified sequence opt2 from COG8__Homo_sapiens__NP_115758
auggccaccgccgccaccauccccuccgucgccaccgccaccgccgccgcccucggcgaggucgaggacgagggccuccucgccucccucuuccgcgaccgcuuccccgaggcccaguggcgcgagcgccccgacgucggccgcuaccuccgcgagcucuccggcuccggccucgagcgccuccgccgcgagcccgagcgccucgccgaggagcgcgcccagcuccuccagcagacccgcgaccucgccuucgccaacuacaagaccuucauccgcggcgccgagugcaccgagcgcauccaccgccucuucggcgacgucgaggccucccucggccgccuccucgaccgccuccccuccuuccagcaguccugccgcaacuucgucaaggaggccgaggagaucuccuccaaccgccgcaugaacucccucacccucaaccgccacaccgagauccucgagauccucgagaucccccagcucauggacaccugcguccgcaacuccuacuacgaggaggcccucgagcucgccgccuacguccgccgccucgagcgcaaguacuccuccauccccgucauccagggcaucgucaacgagguccgccaguccaugcagcucaugcucucccagcucauccagcagcuccgcaccaacauccagcuccccgccugccuccgcgucaucggcuaccuccgccgcauggacgucuucaccgaggccgagcuccgcgucaaguuccuccaggcccgcgacgccuggcuccgcuccauccucaccgccauccccaacgacgaccccuacuuccacaucaccaagaccaucgaggccucccgcguccaccucuucgacaucaucacccaguaccgcgccaucuucuccgacgaggacccccuccucccccccgccaugggcgagcacaccgucaacgaguccgccaucuuccacggcuggguccuccagaaggucucccaguuccuccagguccucgagaccgaccucuaccgcggcaucggcggccaccucgacucccuccucggccagugcauguacuucggccucuccuucucccgcgucggcgccgacuuccgcggccagcucgcccccgucuuccagcgcgucgccaucuccaccuuccagaaggccauccaggagaccgucgagaaguuccaggaggagaugaacuccuacaugcucaucuccgcccccgccauccucggcaccuccaacaugcccgccgccguccccgccacccagcccggcacccuccagccccccaugguccuccucgacuuccccccccucgccugcuuccucaacaacauccucgucgccuucaacgaccuccgccucugcugccccgucgcccucgcccaggacgucaccggcgcccucgaggacgcccucgccaaggucaccaagaucauccucgccuuccaccgcgccgaggaggccgccuucuccuccggcgagcaggagcucuucguccaguucugcaccgucuuccucgaggaccucguccccuaccucaaccgcugccuccagguccucuucccccccgcccagaucgcccagacccucggcaucccccccacccagcucuccaaguacggcaaccucggccacgucaacaucggcgccauccaggagccccucgccuucauccuccccaagcgcgagacccucuucacccucgacgaccaggcccucggccccgagcucaccgcccccgcccccgagccccccgccgaggagccccgccucgagcccgccggccccgccugccccgagggcggccgcgccgagacccaggccgagccccccuccgucggccccuga

SEQ ID NO: 41563 - RNA, 1731 nt, Artificial Sequence
  derived and/or modified sequence opt2 from COIL__Homo_sapiens__NP_004636
auggccgccuccgagaccguccgccuccgccuccaguucgacuaccccccccccgccaccccccacugcaccgccuucuggcuccucgucgaccucaaccgcugccgcgucgucaccgaccucaucucccucauccgccagcgcuucggcuucuccuccggcgccuuccucggccucuaccucgagggcggccuccucccccccgccgaguccgcccgccucguccgcgacaacgacugccuccgcgucaagcucgaggagcgcggcgucgccgagaacuccgucgucaucuccaacggcgacaucaaccucucccuccgcaaggccaagaagcgcgccuuccagcucgaggagggcgaggagaccgagcccgacugcaaguacuccaagaagcacuggaagucccgcgagaacaacaacaacaacgagaagguccucgaccucgagcccaaggccgucaccgaccagaccgucuccaagaagaacaagcgcaagaacaaggccaccugcggcaccgucggcgacgacaacgaggaggccaagcgcaagucccccaagaagaaggagaagugcgaguacaagaagaaggccaagaaccccaagucccccaagguccaggccgucaaggacugggccaaccagcgcugcuccucccccaagggcuccgcccgcaacucccucgucaaggccaagcgcaagggcuccgucuccgucugcuccaaggagucccccuccuccuccuccgaguccgaguccugcgacgaguccaucuccgacggccccuccaaggucacccucgaggcccgcaacuccuccgagaagcuccccaccgagcucuccaaggaggagcccuccaccaagaacaccaccgccgacaagcucgccaucaagcucggcuucucccucacccccuccaagggcaagaccuccggcaccaccuccuccuccuccgacuccuccgccgaguccgacgaccagugccucauguccuccuccacccccgagugcgccgccggcuuccucaagaccgucggccucuucgccggccgcggccgccccggccccggccucuccucccagaccgccggcgccgccggcuggcgccgcuccggcuccaacggcggcggccaggcccccggcgccucccccuccgucucccuccccgccucccucggccgcggcuggggccgcgaggagaaccucuucuccuggaagggcgccaagggccgcggcaugcgcggccgcggccgcggccgcggccaccccgucuccugcgucgucaaccgcuccaccgacaaccagcgccagcagcagcucaacgacgucgucaagaacuccuccaccaucauccagaaccccgucgagacccccaagaaggacuacucccuccucccccuccucgccgccgccccccaggucggcgagaagaucgccuucaagcuccucgagcucaccuccuccuacucccccgacgucuccgacuacaaggagggccgcauccucucccacaaccccgagacccagcaggucgacaucgagauccucuccucccuccccgcccuccgcgagcccggcaaguucgaccucgucuaccacaacgagaacggcgccgaggucgucgaguacgccgucacccaggaguccaagaucaccgucuucuggaaggagcucaucgacccccgccucaucaucgagucccccuccaacaccuccuccaccgagcccgccuga

SEQ ID NO: 41564 - RNA, 2043 nt, Artificial Sequence
  derived and/or modified sequence opt2 from COL10A1__Homo_sapiens__XP_011533735
augcucccccagauccccuuccuccuccucgucucccucaaccucguccacggcgucuucuacgccgagcgcuaccagaugcccaccggcaucaagggcccccuccccaacaccaagacccaguucuucauccccuacaccaucaaguccaagggcaucgccguccgcggcgagcagggcacccccggcccccccggccccgccggcccccgcggccaccccggccccuccggcccccccggcaagcccggcuacggcucccccggccuccagggcgagcccggccuccccggcccccccggccccuccgccgucggcaagcccggcguccccggccuccccggcaagcccggcgagcgcggccccuacggccccaagggcgacgucggccccgccggccuccccggcccccgcggcccccccggcccccccggcauccccggccccgccggcaucuccguccccggcaagcccggccagcagggccccaccggcgcccccggcccccgcggcuuccccggcgagaagggcgcccccggcguccccggcaugaacggccagaagggcgagaugggcuacggcgcccccggccgccccggcgagcgcggccuccccggcccccagggccccaccggccccuccggcccccccggcgucggcaagcgcggcgagaacggcguccccggccagcccggcaucaagggcgaccgcggcuuccccggcgagaugggccccaucggcccccccggcccccagggcccccccggcgagcgcggccccgagggcaucggcaagcccggcgccgccggcgcccccggccagcccggcauccccggcaccaagggccuccccggcgcccccggcaucgccggcccccccggcccccccggcuucggcaagcccggccuccccggccucaagggcgagcgcggccccgccggccuccccggcggccccggcgccaagggcgagcagggccccgccggccuccccggcaagcccggccucaccggcccccccggcaacaugggcccccagggccccaagggcauccccggcucccacggccuccccggccccaagggcgagaccggccccgccggccccgccggcuaccccggcgccaagggcgagcgcggcucccccggcuccgacggcaagcccggcuaccccggcaagcccggccucgacggccccaagggcaaccccggccuccccggccccaagggcgaccccggcgucggcggcccccccggccuccccggccccgucggccccgccggcgccaagggcaugcccggccacaacggcgaggccggcccccgcggcgcccccggcauccccggcacccgcggccccaucggcccccccggcauccccggcuuccccggcuccaagggcgaccccggcucccccggcccccccggccccgccggcaucgccaccaagggccucaacggccccaccggcccccccggcccccccggcccccgcggccacuccggcgagcccggccuccccggcccccccggcccccccggcccccccggccaggccgucaugcccgagggcuucaucaaggccggccagcgccccucccucuccggcaccccccucgucuccgccaaccagggcgucaccggcaugcccgucuccgccuucaccgucauccucuccaaggccuaccccgccaucggcacccccauccccuucgacaagauccucuacaaccgccagcagcacuacgacccccgcaccggcaucuucaccugccagauccccggcaucuacuacuucuccuaccacguccacgucaagggcacccacgucugggucggccucuacaagaacggcacccccgucauguacaccuacgacgaguacaccaagggcuaccucgaccaggccuccggcuccgccaucaucgaccucaccgagaacgaccaggucuggcuccagcuccccaacgccgaguccaacggccucuacuccuccgaguacguccacuccuccuucuccggcuuccucgucgcccccauguga

SEQ ID NO: 41565 - RNA, 4395 nt, Artificial Sequence
  derived and/or modified sequence opt2 from COL11A1__Homo_sapiens__XP_011539021
auggagcccugguccucccgcuggaagaccaagcgcuggcucugggacuucaccgucaccacccucgcccucaccuuccucuuccaggcccgcgagguccgcggcgccgcccccgucgacguccucaaggcccucgacuuccacaacucccccgagggcaucuccaagaccaccggcuucugcaccaaccgcaagaacuccaagggcuccgacaccgccuaccgcgucuccaagcaggcccagcucuccgcccccaccaagcagcucuuccccggcggcaccuuccccgaggacuucuccauccucuucaccgucaagcccaagaagggcauccaguccuuccuccucuccaucuacaacgagcacggcauccagcagaucggcgucgaggucggccgcucccccgucuuccucuucgaggaccacaccggcaagcccgcccccgaggacuacccccucuuccgcaccgucaacaucgccgacggcaaguggcaccgcgucgccaucuccgucgagaagaagaccgucaccaugaucgucgacugcaagaagaagaccaccaagccccucgaccgcuccgagcgcgccaucgucgacaccaacggcaucaccgucuucggcacccgcauccucgacgaggaggucuucgagggcgacauccagcaguuccucaucaccggcgaccccaaggccgccuacgacuacugcgagcacuacucccccgacugcgacuccuccgcccccaaggccgcccaggcccaggagccccagaucgacgaguacgcccccgaggacaucaucgaguacgacuacgaguacggcgaggccgaguacaaggaggccgaguccgucaccgagggccccaccgucaccgaggagaccaucgcccagaccgaggccaacaucgucgacgacuuccaggaguacaacuacggcaccauggaguccuaccagaccgaggccccccgccacgucuccggcaccaacgagcccaaccccgucgaggagaucuucaccgaggaguaccucaccggcgaggacuacgacucccagcgcaagaacuccgaggacacccucuacgagaacaaggagaucgacggccgcgacuccgaccuccucgucgacggcgaccucggcgaguacgacuucuacgaguacaaggaguacgaggacaagcccaccuccccccccaacgaggaguucggccccggcguccccgccgagaccgacaucaccgagaccuccaucaacggccacggcgccuacggcgagaagggccagaagggcgagcccgccgucgucgagcccggcaugcucgucgagggcccccccggccccgccggccccgccggcaucaugggcccccccggccuccagggccccaccggcccccccggcgaccccggcgaccgcggcccccccggccgccccggccuccccggcgccgacggccuccccggcccccccggcaccaugcucaugcuccccuuccgcuacggcggcgacggcuccaagggccccaccaucuccgcccaggaggcccaggcccaggccauccuccagcaggcccgcaucgcccuccgcggcccccccggccccaugggccucaccggccgccccggccccgucggcggccccggcuccuccggcgccaagggcgaguccggcgaccccggcccccagggcccccgcggcguccagggcccccccggccccaccggcaagcccggcaagcgcggccgccccggcgccgacggcggccgcggcaugcccggcgagcccggcgccaagggcgaccgcggcuucgacggccuccccggccuccccggcgacaagggccaccgcggcgagcgcggcccccagggcccccccggcccccccggcgacgacggcaugcgcggcgaggacggcgagaucggcccccgcggccuccccggcgaggccggcccccgcggccuccucggcccccgcggcacccccggcgcccccggccagcccggcauggccggcgucgacggcccccccggccccaagggcaacaugggcccccagggcgagcccggcccccccggccagcagggcaaccccggcccccagggccuccccggcccccagggccccaucggcccccccggcgagaagggcccccagggcaagcccggccucgccggccuccccggcgccgacggcccccccggccaccccggcaaggagggccaguccggcgagaagggcgcccucggcccccccggcccccagggccccaucggcuaccccggcccccgcggcgucaagggcgccgacggcguccgcggccucaagggcuccaagggcgagaagggcgaggacggcuuccccggcuucaagggcgacaugggccucaagggcgaccgcggcgaggucggccagaucggcccccgcggcgaggacggccccgagggccccaagggccgcgccggccccaccggcgaccccggccccuccggccaggccggcgagaagggcaagcucggcguccccggccuccccggcuaccccggccgccagggccccaagggcuccaccggcuuccccggcuuccccggcgccaacggcgagaagggcgcccgcggcgucgccggcaagcccggcccccgcggccagcgcggccccaccggcccccgcggcucccgcggcgcccgcggccccaccggcaagcccggccccaagggcaccuccggcggcgacggcccccccggcccccccggcgagcgcggcccccagggcccccagggccccgucggcuuccccggccccaagggcccccccggcccccccggcaaggacggccuccccggccaccccggccagcgcggcgagaccggcuuccagggcaagaccggcccccccggccccggcggcgucgucggcccccagggccccaccggcgagaccggccccaucggcgagcgcggccaccccggcccccccggcccccccggcgagcagggccuccccggcgccgccggcaaggagggcgccaagggcgaccccggcccccagggcaucuccggcaaggacggccccgccggccuccgcggcuuccccggcgagcgcggccuccccggcgcccagggcgcccccggccucaagggcggcgagggcccccagggcccccccggccccgucggcucccccggcgagcgcggcuccgccggcaccgccggccccaucggccuccccggccgccccggcccccagggcccccccggccccgccggcgagaagggcgcccccggcgagaagggcccccagggccccgccggccgcgacggcguccagggccccgucggccuccccggccccgccggccccgccggcucccccggcgaggacggcgacaagggcgagaucggcgagcccggccagaagggcuccaagggcgacaagggcgagaacggcccccccggcccccccggccuccagggccccgucggcgcccccggcaucgccggcggcgacggcgagcccggcccccgcggccagcagggcauguucggccagaagggcgacgagggcgcccgcggcuuccccggcccccccggccccaucggccuccagggccuccccggcccccccggcgagaagggcgagaacggcgacgucggccccaugggcccccccggcccccccggcccccgcggcccccagggccccaacggcgccgacggcccccagggcccccccggcuccgucggcuccgucggcggcgucggcgagaagggcgagcccggcgaggccggcaaccccggcccccccggcgaggccggcgucggcggccccaagggcgagcgcggcgagaagggcgaggccggcccccccggcgccgccggcccccccggcgccaagggcccccccggcgacgacggccccaagggcaaccccggccccgucggcuuccccggcgaccccggcccccccggcgagcccggccccgccggccaggacggcgucggcggcgacaagggcgaggacggcgaccccggccagcccggcccccccggccccuccggcgaggccggcccccccggcccccccggcaagcgcggcccccccggcgccgccggcgccgagggccgccagggcgagaagggcgccaagggcgaggccggcgccgagggcccccccggcaagaccggccccgucggcccccagggccccgccggcaagcccggccccgagggccuccgcggcauccccggccccgucggcgagcagggccuccccggcgccgccggccaggacggcccccccggccccaugaagcuccccgucaccaccuacugcaucgucuccaccggcgagaucaagcucccccgccacucccccuucccccaccuccucaacaccaccuga

SEQ ID NO: 41566 - RNA, 873 nt, Artificial Sequence
  derived and/or modified sequence opt2 from COL11A2__Homo_sapiens__NP_001157243
auggagcgcugcucccgcugccaccgccuccuccuccuccucccccucguccucggccucuccgccgcccccggcugggccggcgccccccccgucgacguccuccgcgcccuccgcuuccccucccuccccgacggcguccgccgcgccaagggcaucugccccgccgacgucgccuaccgcgucgcccgccccgcccagcucuccgcccccacccgccagcucuuccccggcggcuuccccaaggacuucucccuccucaccgucguccgcacccgccccggccuccaggccccccuccucacccucuacuccgcccagggcguccgccagcucggccucgagcucggccgccccguccgcuuccucuacgaggaccagaccggccgcccccagccccccucccagcccgucuuccgcggccucucccucgccgacggcaaguggcaccgcgucgccgucgccgucaagggccaguccgucacccucaucgucgacugcaagaagcgcgucacccgcccccucccccgcuccgcccgccccguccucgacacccacggcgucaucaucuucggcgcccgcauccucgacgaggaggucuucgagggcgacguccaggagcucgccaucguccccggcguccaggccgccuacgaguccugcgagcagaaggagcucgagugcgagggcggccagcgcgagcgcccccagaaccagcagccccaccgcgcccagcgcuccccccagcagcagcccucccgccuccaccgcccccagaaccaggagccccagucccagguccgcgagcucggcgagccccccuccgccgcccacccccgcgagggccgccaccccggcaucuccccccccuga

SEQ ID NO: 41567 - RNA, 9192 nt, Artificial Sequence
  derived and/or modified sequence opt2 from COL12A1__Homo_sapiens__NP_004361
augcgcucccgccucccccccgcccucgccgcccucggcgccgcccuccuccucuccuccaucgaggccgaggucgacccccccuccgaccucaacuucaagaucaucgacgagaacaccguccacauguccugggccaagcccgucgaccccaucgucggcuaccgcaucaccgucgaccccaccaccgacggccccaccaaggaguucacccucuccgccuccaccaccgagacccuccucuccgagcucguccccgagaccgaguacgucgucaccaucaccuccuacgacgaggucgaggaguccguccccgucaucggccagcucaccauccagaccggcuccuccaccaagcccgucgagaagaagcccggcaagaccgagauccagaagugcuccgucuccgccuggaccgaccucgucuuccucgucgacggcuccugguccgucggccgcaacaacuucaaguacauccucgacuucaucgccgcccucgucuccgccuucgacaucggcgaggagaagacccgcgucggcgucguccaguacuccuccgacacccgcaccgaguucaaccucaaccaguacuaccagcgcgacgagcuccucgccgccaucaagaagauccccuacaagggcggcaacaccaugaccggcgacgccaucgacuaccucgucaagaacaccuucaccgaguccgccggcgcccgcgucggcuuccccaaggucgccaucaucaucaccgacggcaagucccaggacgaggucgagauccccgcccgcgagcuccgcaacgucggcgucgaggucuucucccucggcaucaaggccgccgacgccaaggagcucaagcagaucgccuccacccccucccucaaccacgucuucaacgucgccaacuucgacgccaucgucgacauccagaacgagaucaucucccaggucugcuccggcgucgacgagcagcucggcgagcucgucuccggcgaggaggucgucgagccccccuccaaccucaucgccauggaggucuccuccaaguacgucaagcucaacuggaaccccucccccucccccgucaccggcuacaaggucauccucacccccaugaccgccggcucccgccagcacgcccucuccgucggcccccagaccaccacccucuccguccgcgaccucuccgccgacaccgaguaccagaucuccgucuccgccaugaagggcaugaccuccuccgagcccaucuccaucauggagaagacccagcccaugaagguccaggucgagugcucccgcggcgucgacaucaaggccgacaucgucuuccucgucgacggcuccuacuccaucggcaucgccaacuucgucaagguccgcgccuuccucgagguccucgucaaguccuucgagaucucccccaaccgcguccagaucucccucguccaguacucccgcgacccccacaccgaguucacccucaagaaguucaccaaggucgaggacaucaucgaggccaucaacaccuuccccuaccgcggcggcuccaccaacaccggcaaggccaugaccuacguccgcgagaagaucuucguccccuccaagggcucccgcuccaacguccccaaggucaugauccucaucaccgacggcaaguccuccgacgccuuccgcgaccccgccaucaagcuccgcaacuccgacgucgagaucuucgccgucggcgucaaggacgccguccgcuccgagcucgaggccaucgccuccccccccgccgagacccacgucuucaccgucgaggacuucgacgccuuccagcgcaucuccuucgagcucacccaguccaucugccuccgcaucgagcaggagcucgccgccaucaagaagaaggccuacgucccccccaaggaccucuccuucuccgaggucaccuccuacggcuucaagaccaacuggucccccgccggcgagaacgucuucuccuaccacaucaccuacaaggaggccgccggcgacgacgaggucaccgucgucgagcccgccuccuccaccuccgucguccucuccucccucaagcccgagacccucuaccucgucaacgucaccgccgaguacgaggacggcuucuccaucccccucgccggcgaggagaccaccgaggaggucaagggcgccccccgcaaccucaaggucaccgacgagaccaccgacuccuucaagaucaccuggacccaggcccccggccgcguccuccgcuaccgcaucaucuaccgccccgucgccggcggcgagucccgcgaggucaccaccccccccaaccagcgccgccgcacccucgagaaccucauccccgacaccaaguacgaggucuccgucauccccgaguacuucuccggccccggcaccccccucaccggcaacgccgccaccgaggagguccgcggcaacccccgcgaccuccgcgucuccgaccccaccaccuccaccaugaagcucuccugguccggcgcccccggcaaggucaagcaguaccucgucaccuacacccccgucgccggcggcgagacccaggaggucaccguccgcggcgacaccaccaacaccguccuccagggccucaaggagggcacccaguacgcccucuccgucaccgcccucuacgccuccggcgccggcgacgcccucuucggcgagggcaccacccucgaggagcgcggcuccccccaggaccucgucaccaaggacaucaccgacaccuccaucggcgccuacuggaccuccgcccccggcaugguccgcggcuaccgcgucuccuggaagucccucuacgacgacgucgacaccggcgagaagaaccuccccgaggacgccauccacaccaugaucgagaaccuccagcccgagaccaaguaccgcaucuccgucuucgccaccuacuccuccggcgagggcgagccccucaccggcgacgccaccaccgagcucucccaggacuccaagacccucaaggucgacgaggagaccgagaacaccaugcgcgucaccuggaagcccgcccccggcaaggucgucaacuaccgcgucgucuaccgcccccacggccgcggcaagcagauggucgccaaggucccccccaccgucaccuccaccguccucaagcgccuccagccccagaccaccuacgacaucaccguccuccccaucuacaagaugggcgagggcaagcuccgccagggcuccggcaccaccgccucccgcuucaaguccccccgcaaccucaagaccuccgaccccaccauguccuccuuccgcgucaccugggagcccgcccccggcgaggucaagggcuacaaggucaccuuccaccccaccggcgacgaccgccgccucggcgagcucgucgucggccccuacgacaacaccgucguccucgaggagcuccgcgccggcaccaccuacaaggucaacgucuucggcauguucgacggcggcgaguccuccccccucgucggccaggagaugaccacccucuccgacaccaccgucaugcccauccucuccuccggcauggagugccucacccgcgccgaggccgacaucguccuccucgucgacggcuccugguccaucggccgcgccaacuuccgcaccguccgcuccuucaucucccgcaucgucgaggucuucgacaucggccccaagcgcguccagaucgcccucgcccaguacuccggcgacccccgcaccgaguggcagcucaacgcccaccgcgacaagaagucccuccuccaggccgucgccaaccuccccuacaagggcggcaacacccucaccggcauggcccucaacuucauccgccagcagaacuuccgcacccaggccggcaugcgcccccgcgcccgcaagaucggcguccucaucaccgacggcaagucccaggacgacgucgaggcccccuccaagaagcucaaggacgagggcgucgagcucuucgccaucggcaucaagaacgccgacgaggucgagcucaagaugaucgccaccgaccccgacgacacccacgccuacaacgucgccgacuucgagucccucucccgcaucgucgacgaccucaccaucaaccucugcaacuccgucaagggccccggcgaccucgaggcccccuccaaccucgucaucuccgagcgcacccaccgcuccuuccgcgucuccuggaccccccccuccgacuccgucgaccgcuacaaggucgaguacuaccccgucuccggcggcaagcgccaggaguucuacgucucccgcauggagaccuccaccguccucaaggaccucaagcccgagaccgaguacgucgucaacgucuacuccgucgucgaggacgaguacuccgagccccucaagggcaccgagaagacccuccccguccccgucgucucccucaacaucuacgacgucggccccaccaccaugcacguccaguggcagcccgucggcggcgccaccggcuacauccucuccuacaagcccgucaaggacaccgagcccacccgccccaaggagguccgccucggccccaccgucaacgacaugcagcucaccgaccucguccccaacaccgaguacgccgucaccguccaggccguccuccacgaccucaccuccgagcccgucaccguccgcgaggucacccucccccucccccgcccccaggaccucaagcuccgcgacgucacccacuccaccaugaacgucuucugggagcccguccccggcaagguccgcaaguacaucguccgcuacaagacccccgaggaggacgucaaggaggucgaggucgaccgcuccgagaccuccaccucccucaaggaccucuucucccagacccucuacaccgucuccgucuccgccguccacgacgagggcgaguccccccccgucaccgcccaggagaccacccgccccguccccgcccccaccaaccucaagaucaccgaggucaccuccgagggcuuccgcggcaccugggaccacggcgccuccgacgucucccucuaccgcaucaccugggcccccuucggcuccuccgacaagauggagaccauccucaacggcgacgagaacacccucgucuucgagaaccucaaccccaacaccaucuacgaggucuccaucaccgccaucuaccccgacgaguccgaguccgacgaccucaucggcuccgagcgcacccuccccauccucaccacccaggcccccaaguccggcccccgcaaccuccaggucuacaacgccaccuccaacucccucaccgucaagugggaccccgccuccggccgcguccagaaguaccgcaucaccuaccagcccuccaccggcgagggcaacgagcagaccaccaccaucggcggccgccagaacuccgucguccuccagaagcucaagcccgacacccccuacaccaucaccgucuccucccucuaccccgacggcgagggcggccgcaugaccggccgcggcaagaccaagccccucaacaccguccgcaaccuccgcgucuacgaccccuccaccuccacccucaacguccgcugggaccacgccgagggcaacccccgccaguacaagcucuucuacgcccccgccgccggcggccccgaggagcucguccccauccccggcaacaccaacuacgccauccuccgcaaccuccagcccgacaccuccuacaccgucaccgucguccccgucuacaccgagggcgacggcggccgcaccuccgacaccggccgcacccucaugcgcggccucgcccgcaacguccaggucuacaaccccacccccaacucccucgacguccgcugggaccccgcccccggccccguccuccaguaccgcgucgucuacucccccgucgacggcacccgccccuccgaguccaucgucguccccggcaacacccgcaugguccaccucgagcgccucauccccgacacccucuacuccgucaaccucgucgcccucuacuccgacggcgagggcaaccccucccccgcccagggccgcacccucccccgcuccggcccccgcaaccuccgcgucuucggcgagaccaccaacucccucuccgucgccugggaccacgccgacggccccguccagcaguaccgcaucaucuacucccccaccgucggcgaccccaucgacgaguacaccaccguccccggccgccgcaacaacgucauccuccagccccuccagcccgacacccccuacaagaucaccgucaucgccgucuacgaggacggcgacggcggccaccucaccggcaacggccgcaccgucggccuccuccccccccagaacauccacaucuccgacgagugguacacccgcuuccgcgucuccugggaccccucccccucccccguccucggcuacaagaucgucuacaagcccgucggcuccaacgagcccauggaggccuucgucggcgagaugaccuccuacacccuccacaaccucaaccccuccaccaccuacgacgucaacgucuacgcccaguacgacuccggccucuccgucccccucaccgaccagggcaccacccucuaccucaacgucaccgaccucaagaccuaccagaucggcugggacaccuucugcgucaagugguccccccaccgcgccgccaccuccuaccgccucaagcucucccccgccgacggcacccgcggccaggagaucaccguccgcggcuccgagaccucccacugcuucaccggccucucccccgacaccgacuacggcgucaccgucuucguccagacccccaaccucgagggccccggcgucuccgucaaggagcacaccaccgucaagcccaccgaggcccccaccgagccccccacccccccccccccccccaccaucccccccgcccgcgacgucugcaagggcgccaaggccgacaucgucuuccucaccgacgccuccugguccaucggcgacgacaacuucaacaaggucgucaaguucaucuucaacaccgucggcggcuucgacgagaucucccccgccggcauccaggucuccuucguccaguacuccgacgaggucaaguccgaguucaagcucaacaccuacaacgacaaggcccucgcccucggcgcccuccagaacauccgcuaccgcggcggcaacacccgcaccggcaaggcccucaccuucaucaaggagaagguccucaccugggaguccggcaugcgcaagaacguccccaagguccucgucgucgucaccgacggccgcucccaggacgaggucaagaaggccgcccucgucauccagcaguccggcuucuccgucuucgucgucggcgucgccgacgucgacuacaacgagcucgccaacaucgccuccaagcccuccgagcgccacgucuucaucgucgacgacuucgaguccuucgagaagaucgaggacaaccucaucaccuucgucugcgagaccgccaccuccuccugcccccucaucuaccucgacggcuacaccucccccggcuucaagaugcucgaggccuacaaccucaccgagaagaacuucgccuccguccagggcgucucccucgaguccggcuccuuccccuccuacuccgccuaccgcauccagaagaacgccuucgucaaccagcccaccgccgaccuccaccccaacggccucccccccuccuacaccaucauccuccucuuccgccuccuccccgagacccccuccgaccccuucgccaucuggcagaucaccgaccgcgacuacaagccccaggucggcgucaucgccgaccccuccuccaagacccucuccuucuucaacaaggacacccgcggcgagguccagaccgucaccuucgacaccgaggaggucaagacccucuucuacggcuccuuccacaagguccacaucgucgucaccuccaaguccgucaagaucuacaucgacugcuacgagaucaucgagaaggacaucaaggaggccggcaacaucaccaccgacggcuacgagauccucggcaagcuccucaagggcgagcgcaaguccgccgccuuccagauccaguccuucgacaucgucugcucccccgucuggaccucccgcgaccgcugcugcgacauccccucccgccgcgacgagggcaagugccccgccuuccccaacuccugcaccugcacccaggacuccgucggcccccccggcccccccggccccgccggcggccccggcgccaagggcccccgcggcgagcgcggcaucuccggcgccaucggcccccccggcccccgcggcgacaucggcccccccggcccccagggcccccccggcccccagggccccaacggccucuccauccccggcgagcagggccgccagggcaugaagggcgacgccggcgagcccggccuccccggccgcaccggcacccccggccuccccggcccccccggccccaugggcccccccggcgaccgcggcuucaccggcaaggacggcgccaugggcccccgcggcccccccggcccccccggcucccccggcucccccggcgucaccggccccuccggcaagcccggcaagcccggcgaccacggccgccccggccccuccggccucaagggcgagaagggcgaccgcggcgacaucgccucccagaacaugaugcgcgccgucgcccgccaggucugcgagcagcucaucuccggccagaugaaccgcuucaaccagaugcucaaccagauccccaacgacuaccaguccucccgcaaccagcccggcccccccggcccccccggcccccccggcuccgccggcgcccgcggcgagcccggccccggcggccgccccggcuuccccggcacccccggcaugcagggcccccccggcgagcgcggccuccccggcgagaagggcgagcgcggcaccggcuccuccggcccccgcggccuccccggcccccccggcccccagggcgagucccgcaccggcccccccggcuccaccggcucccgcggcccccccggcccccccggccgccccggcaacuccggcauccgcggcccccccggcccccccggcuacugcgacuccucccagugcgccuccauccccuacaacggccagggcuaccccggcuccggcuga

SEQ ID NO: 41568 - RNA, 2154 nt, Artificial Sequence
  derived and/or modified sequence opt2 from COL13A1__Homo_sapiens__NP_001123575
auggucgccgagcgcacccacaaggccgccgccaccggcgcccgcggccccggcgagcucggcgcccccggcaccgucgcccucgucgccgcccgcgccgagcgcggcgcccgccuccccucccccggcuccugcggccuccucacccucgcccucugcucccucgcccucucccuccucgcccacuuccgcaccgccgagcuccaggcccgcguccuccgccucgaggccgagcgcggcgagcagcagauggagaccgccauccucggccgcgucaaccagcuccucgacgagaaguggaagcuccacucccgccgccgccgcgaggcccccaagaccucccccggcugcaacugcccccccggcccccccggccccaccggccgccccggccuccccggcgacaagggcgccaucggcaugcccggccgcgucggcucccccggcgacgccggccucuccaucaucggcccccgcggcccccccggccagcccggcacccgcggcuuccccggcuuccccggccccaucggccucgacggcaagcccggccaccccggccccaagggcgacaugggccucaccggcccccccggccagcccggcccccagggccagaagggcgagaagggccagugcggcgaguacccccaccgcgagugccucuccuccaugcccgccgcccuccgcuccucccagaucaucgcccucaagcuccucccccuccucaacuccguccgccucgcccccccccccgucaucaagcgccgcaccuuccagggcgagcagucccaggccuccauccagggcccccccggcccccccggcccccccggccccuccggcccccucggccaccccggccuccccggccccaugggcccccccggccuccccggcccccccggccccaagggcgaccccggcauccagggcuaccacggccgcaagggcgagcgcggcaugcccggcaugcccggcaagcacggcgccaagggcgcccccggcaucgccgucgccggcaugaagggcgagcccggcauccccggcaccaagggcgagaagggcgccgagggcucccccggccuccccggccuccucggccagaagggcgagaagggcgacgccggcaacuccaucggcggcggccgcggcgagcccggcccccccggccuccccggcccccccggccccaagggcgaggccggcgucgacggccaggucggcccccccggccagcccggcgacaagggcgagcgcggcgccgccggcgagcagggccccgacggccccaagggcuccaagggcgagcccggcaagggcgagauggucgacuacaacggcaacaucaacgaggcccuccaggagauccgcacccucgcccucaugggcccccccggccuccccggccagaucggcccccccggcgcccccggcauccccggccagaagggcgagaucggccuccccggcccccccggccacgacggcgagaagggcccccgcggcaagcccggcgacaugggcccccccggcccccagggcccccccggcaaggacggcccccccggcgucaagggcgagaacggccaccccggcucccccggcgagaagggcgagaagggcgagaccggccaggccggcucccccggcgagaagggcgaggccggcgagaagggcaaccccggcgccgagguccccggccuccccggccccgagggcccccccggcccccccggccuccagggcguccccggccccaagggcgaggccggccucgacggcgccaagggcgagaagggcuuccagggcgagaagggcgaccgcggcccccucggccuccccggcgccuccggccucgacggccgccccggcccccccggcacccccggccccaucggcguccccggccccgccggccccaagggcgagcgcggcuccaagggcgaccccggcaugaccggccccaccggcgccgccggccuccccggccuccacggcccccccggcgacaagggcaaccgcggcgagcgcggcaagaagggcucccgcggccccaagggcgacaagggcgaccagggcgcccccggccucgacgcccccugcccccucggcgaggacggccuccccguccagggcugcuggaacaaguga

SEQ ID NO: 41569 - RNA, 5343 nt, Artificial Sequence
  derived and/or modified sequence opt2 from COL14A1__Homo_sapiens__XP_005251116
augaagaucuuccagcgcaagaugcgcuacuggcuccucccccccuuccucgccaucgucuacuucugcaccaucguccagggccaggucgccccccccacccgccuccgcuacaacgucaucucccacgacuccauccagaucuccuggaaggccccccgcggcaaguucggcggcuacaagcuccucgucacccccaccuccggcggcaagaccaaccagcucaaccuccagaacaccgccaccaaggccaucauccagggccucaugcccgaccagaacuacaccguccagaucaucgccuacaacaaggacaaggaguccaagcccgcccagggccaguuccgcaucaaggaccucgagaagcgcaaggaccccaagccccgcgucaaggucgucgaccgcggcaacggcucccgccccuccucccccgaggaggucaaguucgucugccagacccccgccaucgccgacaucgucauccucgucgacggcuccugguccaucggccgcuucaacuuccgccucguccgccacuuccucgagaaccucgucaccgccuucgacgucggcuccgagaagacccgcaucggccucgcccaguacuccggcgacccccgcaucgaguggcaccucaacgccuucuccaccaaggacgaggucaucgaggccguccgcaaccuccccuacaagggcggcaacacccucaccggccucgcccucaacuacaucuucgagaacuccuucaagcccgaggccggcucccgcaccggcgucuccaagaucggcauccucaucaccgacggcaagucccaggacgacaucaucccccccucccgcaaccuccgcgaguccggcgucgagcucuucgccaucggcgucaagaacgccgacgucaacgagcuccaggagaucgccuccgagcccgacuccacccacgucuacaacgucgccgaguucgaccucaugcacaccgucgucgagucccucacccgcacccucugcucccgcgucgaggagcaggaccgcgagaucaaggccuccgcccacgccaucaccggcccccccaccgagcucaucaccuccgaggucaccgcccgcuccuucauggucaacuggacccacgcccccggcaacgucgagaaguaccgcgucgucuacuaccccacccgcggcggcaagcccgacgaggucgucgucgacggcaccgucuccuccaccguccucaagaaccucaugucccucaccgaguaccagaucgccgucuucgccaucuacgcccacaccgccuccgagggccuccgcggcaccgagaccacccucgcccuccccauggccuccgaccuccuccucuacgacgucaccgagaacuccaugcgcgucaagugggacgccguccccggcgccuccggcuaccucauccucuacgccccccucaccgagggccucgccggcgacgagaaggagaugaagaucggcgagacccacaccgacaucgagcucuccggccuccuccccaacaccgaguacaccgucaccgucuacgccauguucggcgaggaggccuccgaccccgucaccggccaggagaccacccucgcccucucccccccccgcaaccuccgcaucuccaacgucggcuccaacuccgcccgccucaccugggaccccaccucccgccagaucaacggcuaccgcaucgucuacaacaacgccgacggcaccgagaucaacgaggucgaggucgaccccaucaccaccuucccccucaagggccucaccccccucaccgaguacaccaucgccaucuucuccaucuacgacgagggccaguccgagccccucaccggcgucuucaccaccgaggagguccccgcccagcaguaccucgagaucgacgaggucaccaccgacuccuuccgcgucaccuggcacccccucuccgccgacgagggccuccacaagcucauguggauccccgucuacggcggcaagaccgaggaggucguccucaaggaggagcaggacucccacgucaucgagggccucgagcccggcaccgaguacgaggucucccuccucgccguccucgacgacggcuccgaguccgaggucgucaccgccgucggcaccacccucgacuccuucuggaccgagcccgccaccaccaucguccccaccaccuccgucaccuccgucuuccagaccggcauccgcaaccucgucgucggcgacgagaccaccuccucccuccgcgucaagugggacaucuccgacuccgacguccagcaguuccgcgucaccuacaugaccgcccagggcgaccccgaggaggaggucaucggcaccgucaugguccccggcucccagaacaaccuccuccucaagccccuccuccccgacaccgaguacaaggucaccgucacccccaucuacaccgacggcgagggcgucuccgucuccgcccccggcaagacccuccccuccuccggcccccagaaccuccgcgucuccgaggagugguacaaccgccuccgcaucaccugggacccccccuccucccccgucaagggcuaccgcaucgucuacaagcccgucuccguccccggccccacccucgagaccuucgucggcgccgacaucaacaccauccucaucaccaaccuccucuccggcauggacuacaacgucaagaucuucgccucccaggccuccggcuucuccgacgcccucaccggcauggucaagacccucuuccucggcgucaccaaccuccaggccaagcacgucgagaugaccucccucugcgcccacuggcagguccaccgccacgccaccgccuaccgcgucgucaucgagucccuccaggaccgccagaagcaggaguccaccgucggcggcggcaccacccgccacugcuucuacggccuccagcccgacuccgaguacaagaucuccgucuacaccaagcuccaggagaucgagggccccuccgucuccaucauggagaagacccagucccuccccacccgcccccccaccuucccccccaccaucccccccgccaaggaggucugcaaggccgccaaggccgaccucgucuucauggucgacggcuccugguccaucggcgacgagaacuucaacaagaucaucuccuuccucuacuccaccgucggcgcccucaacaagaucggcaccgacggcacccaggucgccaugguccaguucaccgacgacccccgcaccgaguucaagcucaacgccuacaagaccaaggagacccuccucgacgccaucaagcacaucuccuacaagggcggcaacaccaagaccggcaaggccaucaaguacguccgcgacacccucuucaccgccgaguccggcacccgccgcggcauccccaaggucaucgucgucaucaccgacggccgcucccaggacgacgucaacaagaucucccgcgagaugcagcucgacggcuacuccaucuucgccaucggcgucgccgacgccgacuacuccgagcucgucuccaucggcuccaagcccuccgcccgccacgucuucuucgucgacgacuucgacgccuucaagaagaucgaggacgagcucaucaccuucgucugcgagaccgccuccgccaccugccccgucguccacaaggacggcaucgaccucgccggcuucaagaugauggagauguucggccucgucgagaaggacuucuccuccgucgagggcgucuccauggagcccggcaccuucaacgucuuccccugcuaccagcuccacaaggacgcccucgucucccagcccacccgcuaccuccaccccgagggccuccccuccgacuacaccaucuccuuccucuuccgcauccuccccgacaccccccaggagcccuucgcccucugggagauccucaacaagaacuccgacccccucgucggcgucauccucgacaacggcggcaagacccucaccuacuucaacuacgaccaguccggcgacuuccagaccgucaccuucgagggccccgagauccgcaagaucuucuacggcuccuuccacaagcuccacaucgucgucuccgagacccucgucaaggucgucaucgacugcaagcaggucggcgagaaggccaugaacgccuccgccaacaucaccuccgacggcgucgagguccucggcaagaugguccgcucccgcggccccggcggcaacuccgcccccuuccagcuccagauguucgacaucgucugcuccaccuccugggccaacaccgacaagugcugcgagcuccccggccuccgcgacgacgaguccugccccgaccucccccacuccugcuccugcuccgagaccaacgaggucgcccucggccccgccggcccccccggcggccccggccuccgcggccccaagggccagcagggcgagcccggccccaagggccccgacggcccccgcggcgagaucggccuccccggcccccagggcccccccggcccccagggccccuccggccucuccauccagggcaugcccggcaugcccggcgagaagggcgagaagggcgacaccggccuccccggcccccagggcauccccggcggcgucggcucccccggccgcgacggcucccccggccagcgcggccuccccggcaaggacggcuccuccggcccccccggcccccccggccccaucggcauccccggcacccccggcguccccggcaucaccggcuccaugggcccccagggcgcccucggcccccccggcguccccggcgccaagggcgagcgcggcgagcgcggcgaccuccagucccaggccaugguccgcuccgucgcccgccaggucugcgagcagcucauccagucccacauggcccgcuacaccgccauccucaaccagauccccucccacuccuccuccauccgcaccguccagggcccccccggcgagcccggccgccccggcucccccggcgcccccggcgagcagggcccccccggcacccccggcuuccccggcaacgccggcguccccggcacccccggcgagcgcggccucaccggcaucaagggcgagaagggcaaccccggcgucggcacccagggcccccgcggcccccccggccccgccggccccuccggcgagucccgccccggcucccccggcccccccggcucccccggcccccgcggcccccccggccaccucggcguccccggcccccagggccccuccggccagcccggcuacugcgaccccuccuccugcuccgccuacggcguccgcgaccucauccccuacaacgacuaccagcacuga

SEQ ID NO: 41570 - RNA, 4167 nt, Artificial Sequence
  derived and/or modified sequence opt2 from COL15A1__Homo_sapiens__XP_011516516
auggccccccgccgcaacaacggccagugcuggugccuccucaugcuccucuccgucuccaccccccuccccgccgucacccagacccgcggcgccaccgagaccgccucccagggccaccucgaccucacccagcucaucggcgucccccuccccuccuccgucuccuucgucaccggcuacggcggcuuccccgccuacuccuucggccccggcgccaacgucggccgccccgcccgcacccucauccccuccaccuucuuccgcgacuucgccaucuccgucgucgucaagcccuccuccacccgcggcggcguccucuucgccaucaccgacgccuuccagaaggucaucuaccucggccuccgccucuccggcgucgaggacggccaccagcgcaucauccucuacuacaccgagcccggcucccacgucucccaggaggccgccgccuucuccguccccgucaugacccaccgcuggaaccgcuucgccaugaucguccagggcgaggaggucacccuccucgucaacugcgaggagcacucccgcauccccuuccagcgcuccucccaggcccucgccuucgaguccuccgccggcaucuucaugggcaacgccggcgccaccggccucgagcgcuucaccggcucccuccagcagcucaccguccaccccgacccccgcacccccgaggagcucugcgaccccgaggaguccuccgccuccggcgagaccuccggccuccaggaggccgacggcgucgccgagauccucgaggccgucaccuacacccaggccucccccaaggaggccaaggucgagcccaucaacaccccccccacccccuccucccccuucgaggacauggagcucuccggcgagcccguccccgagggcacccucgagaccaccaacauguccaucauccagcacuccucccccaagcagggcuccggcgagauccucaacgacacccucgagggcguccacuccgucgacggcgaccccaucaccgacuccggcuccggcgccggcgccuuccucgacaucgccgaggagaagaaccucgccgccaccgccgccggccucgccgagguccccaucuccaccgccggcgaggccgaggccuccuccguccccaccggcggccccacccucuccauguccaccgagaaccccgaggagggcgucacccccggccccgacaacgaggagcgccucgccgccaccgccgccggcgaggccgaggcccucgccuccaugcccggcgaggucgaggccuccggcgucgcccccggcgagcucgaccucuccauguccgcccagucccucggcgaggaggccaccgucggccccuccuccgaggacucccucaccaccgccgccgccgccaccgaggucucccucuccaccuucgaggacgaggaggccuccggcguccccaccgacggccucgccccccucaccgccaccauggcccccgagcgcgccgucaccuccggccccggcgacgaggaggaccucgccgccgccaccaccgaggagccccucaucaccgccggcggcgaggaguccggcucccccccccccgacggccccccccucccccuccccaccgucgcccccgagcgcuggaucacccccgcccagcgcgagcacgucggcaugaagggccaggccggccccaagggcgagaagggcgacgccggcgaggagcuccccggcccccccgagcccuccggccccgucggccccaccgccggcgccgaggccgagggcuccggccucggcuggggcuccgacgucggcuccggcuccggcgaccucgucggcuccgagcagcuccuccgcggcccccccggcccccccggcccccccggccuccccggcauccccggcaagcccggcaccgacgucuucaugggcccccccggcucccccggcgaggacggccccgccggcgagcccggcccccccggccccgagggccagcccggcgucgacggcgccaccggccuccccggcaugaagggcgagaagggcgcccgcggccccaacggcuccgucggcgagaagggcgaccccggcaaccgcggccuccccggcccccccggcaagaagggccaggccggcccccccggcgucaugggcccccccggcccccccggcccccccggcccccccggccccggcugcaccaugggccucggcuucgaggacaccgagggcuccggcuccacccagcuccucaacgagcccaagcucucccgccccaccgccgccaucggccucaagggcgagaagggcgaccgcggccccaagggcgagcgcggcauggacggcgccuccaucgucggcccccccggcccccgcggcccccccggccacaucaagguccucuccaacucccucaucaacaucacccacggcuucaugaacuucuccgacauccccgagcucgucggcccccccggccccgacggccuccccggccuccccggcuuccccggcccccgcggccccaagggcgacaccggccuccccggcuuccccggccucaagggcgagcagggcgagaagggcgagcccggcgccauccucaccgaggacaucccccucgagcgccucaugggcaagaagggcgagcccggcaugcacggcgcccccggccccaugggccccaagggcccccccggccacaagggcgaguucggccuccccggccgccccggccgccccggccucaacggccucaagggcaccaagggcgaccccggcgucaucaugcagggcccccccggccuccccggcccccccggcccccccggcccccccggcgccgucaucaacaucaagggcgccaucuuccccauccccguccgcccccacugcaagaugcccgucgacaccgcccaccccggcucccccgagcucaucaccuuccacggcgucaagggcgagaagggcuccuggggccuccccggcuccaagggcgagaagggcgaccagggcgcccagggcccccccggccccccccucgaccucgccuaccuccgccacuuccucaacaaccucaagggcgagaacggcgacaagggcuucaagggcgagaagggcgagaagggcgacaucaacggcuccuuccucauguccggcccccccggccuccccggcaaccccggccccgccggccagaagggcgagaccgucgucggcccccagggcccccccggcgcccccggccuccccggcccccccggcuucggccgccccggcgaccccggcccccccggcccccccggcccccccggcccccccgccauccucggcgccgccgucgcccuccccggcccccccggcccccccggccagcccggccuccccggcucccgcaaccucgucaccgccuucuccaacauggacgacaugcuccagaaggcccaccucgucaucgagggcaccuucaucuaccuccgcgacuccaccgaguucuucauccgcguccgcgacggcuggaagaagcuccagcucggcgagcucauccccauccccgccgacuccccccccccccccgcccucuccuccaacccccaccagcuccuccccccccccaaccccaucuccuccgccaacuacgagaagcccgcccuccaccucgccgcccucaacaugcccuucuccggcgacauccgcgccgacuuccagugcuucaagcaggcccgcgccgccggccuccucuccaccuaccgcgccuuccucuccucccaccuccaggaccucuccaccaucguccgcaaggccgagcgcuacucccuccccaucgucaaccucaagggccagguccucuucaacaacugggacuccaucuucuccggccacggcggccaguucaacaugcacauccccaucuacuccuucgacggccgcgacaucaugaccgaccccuccuggccccagaaggucaucuggcacggcuccuccccccacggcguccgccucgucgacaacuacugcgaggccuggcgcaccgccgacaccgccgucaccggccucgccuccccccucuccaccggcaagauccucgaccagaaggccuacuccugcgccaaccgccucaucguccucugcaucgagaacuccuucaugaccgacgcccgcaaguga

SEQ ID NO: 41571 - RNA, 4692 nt, Artificial Sequence
  derived and/or modified sequence opt2 from COL16A1__Homo_sapiens__XP_011539026
augugggucuccugggcccccggccucuggcuccucggccucugggccaccuucggccacggcgccaacaccggcgcccagugcccccccucccagcaggagggccucaagcucgagcacuccuccucccuccccgccaacgucaccggcuucaaccucauccaccgccucucccucaugaagaccuccgccaucaagaagauccgcaaccccaagggcccccucauccuccgccucggcgccgcccccgucacccagcccacccgccgcgucuucccccgcggccuccccgaggaguucgcccucguccucacccuccuccucaagaagcacacccaccagaagaccugguaccucuuccaggucaccgacgccaacggcuacccccagaucucccucgaggucaacucccaggagcgcucccucgagcuccgcgcccagggccaggacggcgacuucgucuccugcaucuuccccgucccccagcucuucgaccuccgcuggcacaagcucaugcucuccgucgccggccgcgucgccuccguccacgucgacugcuccuccgccuccucccagccccucggcccccgccgccccaugcgccccgucggccacgucuuccucggccucgacgccgagcagggcaagcccgucuccuucgaccuccagcagguccacaucuacugcgaccccgagcucguccucgaggagggcugcugcgagauccuccccgccggcugcccccccgagaccuccaaggcccgccgcgacacccaguccaacgagcucaucgagaucaacccccaguccgagggcaaggucuacacccgcugcuucugccucgaggagccccagaacuccgaggucgacgcccagcucaccggccgcaucucccagaaggccgagcgcggcgccaagguccaccaggagaccgccgccgacgagugcccccccugcguccacggcgcccgcgacuccaacgucacccucgcccccuccggccccaagggcggcaagggcgagcgcggccuccccggcccccccggcuccaagggcgagaagggcgcccgcggcaacgacugcguccgcaucucccccgacgccccccuccagugcgccgagggccccaagggcgagaagggcgaguccggcgcccucggccccuccggccuccccggcuccaccggcgagaagggccagaagggcgagaagggcgacggcggcaucaagggcguccccggcaagcccggccgcgacggccgccccggcgagaucugcgucaucggccccaagggccagaagggcgaccccggcuucgucggccccgagggccucgccggcgagcccggcccccccggccuccccggcccccccggcaucggccuccccggcacccccggcgaccccggcggcccccccggccccaagggcgacaagggcuccuccggcauccccggcaaggagggccccggcggcaagcccggcaagcccggcgucaagggcgagaagggcgaccccugcgaggucugccccacccuccccgagggcuuccagaacuucgucggccuccccggcaagcccggccccaagggcgagcccggcgaccccguccccgcccgcggcgaccccggcauccagggcaucaagggcgagaagggcgagcccugccucuccugcuccuccgucgucggcgcccagcaccucgucuccuccaccggcgccuccggcgacgucggcucccccggcuucggccuccccggccuccccggccgcgccggcguccccggccucaagggcgagaagggcaacuucggcgaggccggccccgccggcucccccggcccccccggccccgucggccccgccggcaucaagggcgccaagggcgagcccugcgagcccugccccgcccucuccaaccuccaggacggcgacguccgcgucgucgcccuccccggccccuccggcgagaagggcgagcccggcccccccggcuucggccuccccggcaagcagggcaaggccggcgagcgcggccucaagggccagaagggcgacgccggcaaccccggcgaccccggcacccccggcaccaccggccgccccggccucuccggcgagcccggcguccagggccccgccggccccaagggcgagaagggccagcccggccuccccggcguccagggcccccccggccucaagggcguccagggcgagcccggcccccccggccgcggcguccagggcccccagggcgagcccggcgcccccggccuccccggcauccagggccuccccggcccccgcggcccccccggccccaccggcgagaagggcgcccagggcucccccggcgucaagggcgccaccggccccgucggcccccccggcgccuccgucuccggcccccccggccgcgacggccagcagggccagaccggccuccgcggcacccccggcgagaagggcccccgcggcgagaagggcgagcccggcgagugcuccugccccucccagggcgaccucaucuucuccggcaugcccggcgcccccggccucuggaugggcuccuccuggcagcccggcccccagggcccccccggcauccccggcccccccggcccccccggcguccccggccuccagggcguccccggcaacaacggccuccccggccagcccggccucaccgccgagcucggcucccuccccaucgagcagcaccuccucaaguccaucugcggcgacugcguccagggccagcgcgcccaccccggcuaccucgucgagaagggcgagaagggcgaccagggcauccccggcguccccggccucgacaacugcgcccagugcuuccucucccucgagcgcccccgcgccgaggaggcccgcggcgacaacuccgagggcgaccccggcugcgucggcucccccggccuccccggcccccccggccuccccggccagcgcggcgaggagggcccccccggcaugcgcggcucccccggcccccccggccccaucggcccccccggcuuccccggcgccgucggcucccccggccuccccggccuccagggcgagcgcggccucaccggccucaccggcgacaagggcgagcccggcccccccggccagcccggcuaccccggcgccaccggcccccccggccuccccggcaucaagggcgagcgcggcuacaccggcuccgccggcgagaagggcgagcccggcccccccggcuccgagggccuccccggcccccccggccccgccggcccccgcggcgagcgcggcccccagggcaacuccggcgagaagggcgaccagggcuuccagggccagcccggcuuccccggcccccccggcccccccggcuuccccggcaaggucggcucccccggcccccccggcccccaggccgagaagggcuccgagggcauccgcggccccuccggccuccccggcucccccggcccccccggcccccccggcauccagggccccgccggccucgacggccucgacggcaaggacggcaagcccggccuccgcggcgaccccggccccgccggcccccccggccucaugggcccccccggcuucaagggcaagaccggccaccccggccuccccggccccaagggcgacugcggcaagcccggcccccccggcuccaccggccgccccggcgccgagggcgagcccggcgccaugggcccccagggccgccccggcccccccggccacgucggcccccccggcccccccggccagcccggccccgccggcaucuccgccgucggccucaagggcgaccgcggcgccaccggcgagcgcggccucgccggccuccccggccagcccggcccccccggccaccccggcccccccggcgagcccggcaccgacggcgccgccggcaaggagggcccccccggcaagcagggcuucuacggcccccccggccccaagggcgaccccggcgccgccggccagaagggccaggccggcgagaagggccgcgccggcaugcccggcggccccggcaaguccggcuccaugggccccgucggcccccccggccccgccggcgagcgcggccaccccggcgcccccggccccuccggcucccccggccuccccggcguccccggcuccaugggcgacauggucaacuacgacgagaucaagcgcuucauccgccaggagaucaucaagauguucgacgagcgcauggccuacuacaccucccgcaugcaguuccccauggagauggccgccgcccccggccgccccggcccccccggcaaggacggcgcccccggccgccccggcgcccccggcucccccggccuccccggccagaucggccgcgagggccgccagggccuccccggcguccgcggccuccccggcaccaagggcgagaagggcgacaucggcaucggcaucgccggcgagaacggccuccccggcccccccggcccccagggcccccccggcuacggcaagaugggcgccaccggccccaugggccagcagggcauccccggcauccccggcccccccggccccaugggccagcccggcaaggccggccacugcaaccccuccgacugcuucggcgccaugcccauggagcagcaguacccccccaugaagaccaugaagggccccuucggcuga

SEQ ID NO: 41572 - RNA, 4494 nt, Artificial Sequence
  derived and/or modified sequence opt2 from COL17A1__Homo_sapiens__NP_000485
auggacgucaccaagaagaacaagcgcgacggcaccgaggucaccgagcgcaucgucaccgagaccgucaccacccgccucaccucccucccccccaagggcggcaccuccaacggcuacgccaagaccgccucccucggcggcggcucccgccucgagaagcagucccucacccacggcuccuccggcuacaucaacuccaccggcuccacccgcggccacgccuccaccuccuccuaccgccgcgcccacucccccgccuccacccuccccaacucccccggcuccaccuucgagcgcaagacccacgucacccgccacgccuacgagggcuccuccuccggcaacuccucccccgaguacccccgcaaggaguucgccuccuccuccacccgcggccgcucccagacccgcgaguccgagauccgcguccgccuccaguccgccucccccuccacccgcuggaccgagcucgacgacgucaagcgccuccucaagggcucccgcuccgccuccgucucccccacccgcaacuccuccaacacccuccccauccccaagaagggcaccgucgagaccaagaucgucaccgccuccucccaguccgucuccggcaccuacgacgccaccauccucgacgccaaccuccccucccacgucugguccuccacccuccccgccggcuccuccaugggcaccuaccacaacaacaugaccacccaguccuccucccuccucaacaccaacgccuacuccgccggcuccgucuucggcguccccaacaacauggccuccugcucccccacccuccaccccggccucuccaccuccuccuccgucuucggcaugcagaacaaccucgcccccucccucaccacccucucccacggcaccaccaccaccuccaccgccuacggcgucaagaagaacaugccccagucccccgccgccgucaacaccggcgucuccaccuccgccgccugcaccaccuccguccaguccgacgaccuccuccacaaggacugcaaguuccucauccucgagaaggacaacacccccgccaagaaggagauggagcuccucaucaugaccaaggacuccggcaaggucuucaccgccucccccgccuccaucgccgccaccuccuucuccgaggacacccucaagaaggagaagcaggccgccuacaacgccgacuccggccucaaggccgaggccaacggcgaccucaagaccgucuccaccaagggcaagaccaccaccgccgacauccacuccuacggcuccuccggcggcggcggcuccggcggcggcggcggcgucggcggcgccggcggcggccccuggggccccgcccccgccuggugccccugcggcuccugcugcuccugguggaaguggcuccucggccuccuccucaccuggcuccuccuccucggccuccucuucggccucaucgcccucgccgaggagguccgcaagcucaaggcccgcgucgacgagcucgagcgcauccgccgcuccauccuccccuacggcgacuccauggaccgcaucgagaaggaccgccuccagggcauggcccccgccgccggcgccgaccucgacaagaucggccuccacuccgacucccaggaggagcucuggauguucguccgcaagaagcucaugauggagcaggagaacggcaaccuccgcggcucccccggccccaagggcgacaugggcucccccggccccaagggcgaccgcggcuuccccggcacccccggcauccccggcccccucggccaccccggcccccagggccccaagggccagaagggcuccgucggcgaccccggcauggagggccccaugggccagcgcggccgcgagggccccaugggcccccgcggcgaggccggcccccccggcuccggcgagaagggcgagcgcggcgccgccggcgagcccggcccccacggcccccccggcguccccggcuccgucggccccaagggcuccuccggcucccccggcccccagggcccccccggccccgucggccuccagggccuccgcggcgaggucggccuccccggcgucaagggcgacaagggccccaugggcccccccggccccaagggcgaccagggcgagaagggcccccgcggccucaccggcgagcccggcaugcgcggccuccccggcgccgucggcgagcccggcgccaagggcgccaugggccccgccggccccgacggccaccagggcccccgcggcgagcagggccucaccggcaugcccggcauccgcggcccccccggccccuccggcgaccccggcaagcccggccucaccggcccccagggcccccagggccuccccggcacccccggccgccccggcaucaagggcgagcccggcgcccccggcaagaucgucaccuccgagggcuccuccaugcucaccguccccggcccccccggcccccccggcgccaugggcccccccggcccccccggcgcccccggccccgccggccccgccggccuccccggccaccaggagguccucaaccuccagggcccccccggcccccccggcccccgcggcccccccggccccuccauccccggcccccccggcccccgcggcccccccggcgagggccuccccggcccccccggcccccccggcuccuuccucuccaacuccgagaccuuccucuccggcccccccggcccccccggcccccccggccccaagggcgaccagggcccccccggcccccgcggccaccagggcgagcagggccuccccggcuucuccaccuccggcuccuccuccuucggccucaaccuccagggcccccccggcccccccggcccccagggccccaagggcgacaagggcgaccccggcguccccggcgcccucggcauccccuccggccccuccgagggcggcuccuccuccaccauguacgucuccggcccccccggcccccccggcccccccggcccccccggcuccaucuccuccuccggccaggagauccagcaguacaucuccgaguacaugcaguccgacuccauccgcuccuaccucuccggcguccagggcccccccggcccccccggcccccccggccccgucaccaccaucaccggcgagaccuucgacuacuccgagcucgccucccacgucgucuccuaccuccgcaccuccggcuacggcgucucccucuucuccuccuccaucuccuccgaggacauccucgccguccuccagcgcgacgacguccgccaguaccuccgccaguaccucaugggcccccgcggcccccccggcccccccggcgccuccggcgacggcucccuccucucccucgacuacgccgagcucuccucccgcauccucuccuacauguccuccuccggcaucuccaucggccuccccggcccccccggcccccccggccuccccggcaccuccuacgaggagcuccucucccuccuccgcggcuccgaguuccgcggcaucgucggcccccccggcccccccggcccccccggcauccccggcaacgucugguccuccaucuccgucgaggaccucuccuccuaccuccacaccgccggccucuccuucauccccggcccccccggcccccccggcccccccggcccccgcggcccccccggcgucuccggcgcccucgccaccuacgccgccgagaacuccgacuccuuccgcuccgagcucaucuccuaccucaccucccccgacguccgcuccuucaucgucggcccccccggcccccccggcccccagggcccccccggcgacucccgccuccucuccaccgacgccucccacucccgcggcuccuccuccuccucccacuccuccuccguccgccgcggcuccuccuacuccuccuccauguccaccggcggcggcggcgccggcucccucggcgccggcggcgccuucggcgaggccgccggcgaccgcggccccuacggcaccgacaucggccccggcggcggcuacggcgccgccgccgagggcggcauguacgccggcaacggcggccuccucggcgccgacuucgccggcgaccucgacuacaacgagcucgccguccgcgucuccgaguccaugcagcgccagggccuccuccagggcauggccuacaccguccagggcccccccggccagcccggcccccagggcccccccggcaucuccaaggucuucuccgccuacuccaacgucaccgccgaccucauggacuucuuccagaccuacggcgccauccagggcccccccggccagaagggcgagaugggcacccccggccccaagggcgaccgcggccccgccggcccccccggccaccccggcccccccggcccccgcggccacaagggcgagaagggcgacaagggcgaccaggucuacgccggccgccgccgccgccgcuccaucgccgucaagcccuga

SEQ ID NO: 41573 - RNA, 4551 nt, Artificial Sequence
  derived and/or modified sequence opt2 from COL18A1__Homo_sapiens__NP_085059
auggcccccuaccccugcggcugccacauccuccuccuccucuucugcugccucgccgccgcccgcgccaaccuccucaaccucaacuggcucugguucaacaacgaggacaccucccacgccgccaccaccauccccgagccccagggcccccuccccguccagcccaccgccgacaccaccacccacgucaccccccgcaacggcuccaccgagcccgccaccgcccccggcucccccgagccccccuccgagcuccucgaggacggccaggacacccccaccuccgccgagucccccgacgcccccgaggagaacaucgccggcgucggcgccgagauccucaacgucgccaagggcauccgcuccuucguccagcucuggaacgacaccguccccaccgagucccucgcccgcgccgagacccucguccucgagacccccgucggcccccucgcccucgccggccccuccuccaccccccaggagaacggcaccacccucuggcccucccgcggcauccccuccucccccggcgcccacaccaccgaggccggcacccuccccgcccccacccccuccccccccucccucggccgccccugggccccccucaccggccccuccguccccccccccuccuccgagcgcaucuccgaggaggucggccuccuccagcuccucggcgacccccccccccagcaggucacccagaccgacgaccccgacgucggccucgccuacgucuucggccccgacgccaacuccggccaggucgcccgcuaccacuuccccucccucuucuuccgcgacuucucccuccucuuccacauccgccccgccaccgagggccccggcguccucuucgccaucaccgacuccgcccaggccaugguccuccucggcgucaagcucuccggcguccaggacggccaccaggacaucucccuccucuacaccgagcccggcgccggccagacccacaccgccgccuccuuccgccuccccgccuucgucggccaguggacccaccucgcccucuccgucgccggcggcuucgucgcccucuacgucgacugcgaggaguuccagcgcaugccccucgcccgcuccucccgcggccucgagcucgagcccggcgccggccucuucgucgcccaggccggcggcgccgaccccgacaaguuccagggcgucaucgccgagcucaagguccgccgcgacccccaggucucccccaugcacugccucgacgaggagggcgacgacuccgacggcgccuccggcgacuccggcuccggccucggcgacgcccgcgagcuccuccgcgaggagaccggcgccgcccucaagccccgccuccccgcccccccccccgucaccacccccccccucgccggcggcuccuccaccgaggacucccgcuccgaggaggucgaggagcagaccaccgucgccucccucggcgcccagacccuccccggcuccgacuccgucuccaccugggacggcuccguccgcacccccggcggccgcgucaaggagggcggccucaagggccagaagggcgagcccggcguccccggcccccccggccgcgccggcccccccggcucccccugccuccccggcccccccggccuccccugccccgucuccccccucggccccgccggccccgcccuccagaccguccccggcccccagggcccccccggcccccccggccgcgacggcacccccggccgcgacggcgagcccggcgaccccggcgaggacggcaagcccggcgacaccggcccccagggcuuccccggcacccccggcgacgucggccccaagggcgacaagggcgaccccggcgucggcgagcgcggcccccccggcccccagggcccccccggcccccccggccccuccuuccgccacgacaagcucaccuucaucgacauggagggcuccggcuucggcggcgaccucgaggcccuccgcggcccccgcggcuuccccggcccccccggcccccccggcguccccggccuccccggcgagcccggccgcuucggcgucaacuccuccgacguccccggccccgccggccuccccggcguccccggccgcgagggcccccccggcuuccccggccuccccggcccccccggcccccccggccgcgagggcccccccggccgcaccggccagaagggcucccucggcgaggccggcgcccccggccacaagggcuccaagggcgcccccggccccgccggcgcccgcggcgaguccggccucgccggcgcccccggccccgccggcccccccggcccccccggcccccccggcccccccggccccggccuccccgccggcuucgacgacauggagggcuccggcggccccuucugguccaccgcccgcuccgccgacggcccccagggcccccccggccuccccggccucaagggcgaccccggcguccccggccuccccggcgccaagggcgaggucggcgccgacggcguccccggcuuccccggccuccccggccgcgagggcaucgccggcccccagggccccaagggcgaccgcggcucccgcggcgagaagggcgaccccggcaaggacggcgucggccagcccggccuccccggcccccccggcccccccggccccgucgucuacgucuccgagcaggacggcuccguccucuccguccccggccccgagggccgccccggcuucgccggcuuccccggccccgccggccccaagggcaaccucggcuccaagggcgagcgcggcucccccggccccaagggcgagaagggcgagcccggcuccaucuucucccccgacggcggcgcccucggccccgcccagaagggcgccaagggcgagcccggcuuccgcggcccccccggccccuacggccgccccggcuacaagggcgagaucggcuuccccggccgccccggccgccccggcaugaacggccucaagggcgagaagggcgagcccggcgacgccucccucggcuucggcaugcgcggcaugcccggcccccccggcccccccggcccccccggcccccccggcacccccgucuacgacuccaacgucuucgccgaguccucccgccccggcccccccggccuccccggcaaccagggcccccccggccccaagggcgccaagggcgaggucggcccccccggcccccccggccaguuccccuucgacuuccuccagcucgaggccgagaugaagggcgagaagggcgaccgcggcgacgccggccagaagggcgagcgcggcgagcccggcggcggcggcuucuucggcuccucccuccccggcccccccggcccccccggcccccgcggcuaccccggcauccccggccccaagggcgaguccauccgcggccagcccggcccccccggcccccagggcccccccggcaucggcuacgagggccgccagggcccccccggcccccccggcccccccggcccccccuccuuccccggcccccaccgccagaccaucuccguccccggcccccccggcccccccggcccccccggcccccccggcaccaugggcgccuccuccggcguccgccucugggccacccgccaggccaugcucggccagguccacgagguccccgagggcuggcucaucuucgucgccgagcaggaggagcucuacguccgcguccagaacggcuuccgcaagguccagcucgaggcccgcaccccccucccccgcggcaccgacaacgaggucgccgcccuccagccccccgucguccagcuccacgacuccaaccccuacccccgccgcgagcacccccaccccaccgcccgccccuggcgcgccgacgacauccucgccucccccccccgccuccccgagccccagcccuaccccggcgccccccaccacuccuccuacguccaccuccgccccgcccgccccaccuccccccccgcccacucccaccgcgacuuccagcccguccuccaccucgucgcccucaacuccccccucuccggcggcaugcgcggcauccgcggcgccgacuuccagugcuuccagcaggcccgcgccgucggccucgccggcaccuuccgcgccuuccucuccucccgccuccaggaccucuacuccaucguccgccgcgccgaccgcgccgccguccccaucgucaaccucaaggacgagcuccucuuccccuccugggaggcccucuucuccggcuccgagggcccccucaagcccggcgcccgcaucuucuccuucgacggcaaggacguccuccgccaccccaccuggccccagaaguccgucuggcacggcuccgaccccaacggccgccgccucaccgaguccuacugcgagaccuggcgcaccgaggcccccuccgccaccggccaggccuccucccuccucggcggccgccuccucggccaguccgccgccuccugccaccacgccuacaucguccucugcaucgagaacuccuucaugaccgccuccaaguga

SEQ ID NO: 41574 - RNA, 4395 nt, Artificial Sequence
  derived and/or modified sequence opt2 from COL1A1__Homo_sapiens__NP_000079
auguucuccuucgucgaccuccgccuccuccuccuccucgccgccaccgcccuccucacccacggccaggaggagggccaggucgagggccaggacgaggacaucccccccaucaccugcguccagaacggccuccgcuaccacgaccgcgacgucuggaagcccgagcccugccgcaucugcgucugcgacaacggcaagguccucugcgacgacgucaucugcgacgagaccaagaacugccccggcgccgagguccccgagggcgagugcugccccgucugccccgacggcuccgagucccccaccgaccaggagaccaccggcgucgagggccccaagggcgacaccggcccccgcggcccccgcggccccgccggcccccccggccgcgacggcauccccggccagcccggccuccccggcccccccggcccccccggcccccccggcccccccggccucggcggcaacuucgccccccagcucuccuacggcuacgacgagaaguccaccggcggcaucuccguccccggccccaugggccccuccggcccccgcggccuccccggcccccccggcgcccccggcccccagggcuuccagggcccccccggcgagcccggcgagcccggcgccuccggccccaugggcccccgcggcccccccggcccccccggcaagaacggcgacgacggcgaggccggcaagcccggccgccccggcgagcgcggcccccccggcccccagggcgcccgcggccuccccggcaccgccggccuccccggcaugaagggccaccgcggcuucuccggccucgacggcgccaagggcgacgccggccccgccggccccaagggcgagcccggcucccccggcgagaacggcgcccccggccagaugggcccccgcggccuccccggcgagcgcggccgccccggcgcccccggccccgccggcgcccgcggcaacgacggcgccaccggcgccgccggcccccccggccccaccggccccgccggcccccccggcuuccccggcgccgucggcgccaagggcgaggccggcccccagggcccccgcggcuccgagggcccccagggcguccgcggcgagcccggcccccccggccccgccggcgccgccggccccgccggcaaccccggcgccgacggccagcccggcgccaagggcgccaacggcgcccccggcaucgccggcgcccccggcuuccccggcgcccgcggccccuccggcccccagggccccggcggcccccccggccccaagggcaacuccggcgagcccggcgcccccggcuccaagggcgacaccggcgccaagggcgagcccggccccgucggcguccagggcccccccggccccgccggcgaggagggcaagcgcggcgcccgcggcgagcccggccccaccggccuccccggcccccccggcgagcgcggcggccccggcucccgcggcuuccccggcgccgacggcgucgccggccccaagggccccgccggcgagcgcggcucccccggccccgccggccccaagggcucccccggcgaggccggccgccccggcgaggccggccuccccggcgccaagggccucaccggcucccccggcucccccggccccgacggcaagaccggcccccccggccccgccggccaggacggccgccccggcccccccggcccccccggcgcccgcggccaggccggcgucaugggcuuccccggccccaagggcgccgccggcgagcccggcaaggccggcgagcgcggcguccccggcccccccggcgccgucggccccgccggcaaggacggcgaggccggcgcccagggcccccccggccccgccggccccgccggcgagcgcggcgagcagggccccgccggcucccccggcuuccagggccuccccggccccgccggcccccccggcgaggccggcaagcccggcgagcagggcguccccggcgaccucggcgcccccggccccuccggcgcccgcggcgagcgcggcuuccccggcgagcgcggcguccagggcccccccggccccgccggcccccgcggcgccaacggcgcccccggcaacgacggcgccaagggcgacgccggcgcccccggcgcccccggcucccagggcgcccccggccuccagggcaugcccggcgagcgcggcgccgccggccuccccggccccaagggcgaccgcggcgacgccggccccaagggcgccgacggcucccccggcaaggacggcguccgcggccucaccggccccaucggcccccccggccccgccggcgcccccggcgacaagggcgaguccggccccuccggccccgccggccccaccggcgcccgcggcgcccccggcgaccgcggcgagcccggcccccccggccccgccggcuucgccggcccccccggcgccgacggccagcccggcgccaagggcgagcccggcgacgccggcgccaagggcgacgccggcccccccggccccgccggccccgccggcccccccggccccaucggcaacgucggcgcccccggcgccaagggcgcccgcggcuccgccggcccccccggcgccaccggcuuccccggcgccgccggccgcgucggcccccccggccccuccggcaacgccggcccccccggcccccccggccccgccggcaaggagggcggcaagggcccccgcggcgagaccggccccgccggccgccccggcgaggucggcccccccggcccccccggccccgccggcgagaagggcucccccggcgccgacggccccgccggcgcccccggcacccccggcccccagggcaucgccggccagcgcggcgucgucggccuccccggccagcgcggcgagcgcggcuuccccggccuccccggccccuccggcgagcccggcaagcagggccccuccggcgccuccggcgagcgcggcccccccggccccaugggcccccccggccucgccggcccccccggcgaguccggccgcgagggcgcccccggcgccgagggcucccccggccgcgacggcucccccggcgccaagggcgaccgcggcgagaccggccccgccggcccccccggcgcccccggcgcccccggcgcccccggccccgucggccccgccggcaaguccggcgaccgcggcgagaccggccccgccggccccgccggccccgucggccccgucggcgcccgcggccccgccggcccccagggcccccgcggcgacaagggcgagaccggcgagcagggcgaccgcggcaucaagggccaccgcggcuucuccggccuccagggcccccccggcccccccggcucccccggcgagcagggccccuccggcgccuccggccccgccggcccccgcggcccccccggcuccgccggcgcccccggcaaggacggccucaacggccuccccggccccaucggcccccccggcccccgcggccgcaccggcgacgccggccccgucggcccccccggcccccccggcccccccggcccccccggcccccccuccgccggcuucgacuucuccuuccucccccagcccccccaggagaaggcccacgacggcggccgcuacuaccgcgccgacgacgccaacgucguccgcgaccgcgaccucgaggucgacaccacccucaagucccucucccagcagaucgagaacauccgcucccccgagggcucccgcaagaaccccgcccgcaccugccgcgaccucaagaugugccacuccgacuggaaguccggcgaguacuggaucgaccccaaccagggcugcaaccucgacgccaucaaggucuucugcaacauggagaccggcgagaccugcgucuaccccacccagcccuccgucgcccagaagaacugguacaucuccaagaaccccaaggacaagcgccacgucugguucggcgaguccaugaccgacggcuuccaguucgaguacggcggccagggcuccgaccccgccgacgucgccauccagcucaccuuccuccgccucauguccaccgaggccucccagaacaucaccuaccacugcaagaacuccgucgccuacauggaccagcagaccggcaaccucaagaaggcccuccuccuccagggcuccaacgagaucgagauccgcgccgagggcaacucccgcuucaccuacuccgucaccgucgacggcugcaccucccacaccggcgccuggggcaagaccgucaucgaguacaagaccaccaagaccucccgccuccccaucaucgacgucgccccccucgacgucggcgcccccgaccaggaguucggcuucgacgucggccccgucugcuuccucuga

SEQ ID NO: 41575 - RNA, 4101 nt, Artificial Sequence
  derived and/or modified sequence opt2 from COL1A2__Homo_sapiens__NP_000080
augcucuccuucgucgacacccgcacccuccuccuccucgccgucacccucugccucgccaccugccagucccuccaggaggagaccguccgcaagggccccgccggcgaccgcggcccccgcggcgagcgcggcccccccggcccccccggccgcgacggcgaggacggccccaccggcccccccggcccccccggcccccccggcccccccggccucggcggcaacuucgccgcccaguacgacggcaagggcgucggccucggccccggccccaugggccucaugggcccccgcggcccccccggcgccgccggcgcccccggcccccagggcuuccagggccccgccggcgagcccggcgagcccggccagaccggccccgccggcgcccgcggccccgccggcccccccggcaaggccggcgaggacggccaccccggcaagcccggccgccccggcgagcgcggcgucgucggcccccagggcgcccgcggcuuccccggcacccccggccuccccggcuucaagggcauccgcggccacaacggccucgacggccucaagggccagcccggcgcccccggcgucaagggcgagcccggcgcccccggcgagaacggcacccccggccagaccggcgcccgcggccuccccggcgagcgcggccgcgucggcgcccccggccccgccggcgcccgcggcuccgacggcuccgucggccccgucggccccgccggccccaucggcuccgccggcccccccggcuuccccggcgcccccggccccaagggcgagaucggcgccgucggcaacgccggccccgccggccccgccggcccccgcggcgaggucggccuccccggccucuccggccccgucggcccccccggcaaccccggcgccaacggccucaccggcgccaagggcgccgccggccuccccggcgucgccggcgcccccggccuccccggcccccgcggcauccccggccccgucggcgccgccggcgccaccggcgcccgcggccucgucggcgagcccggccccgccggcuccaagggcgaguccggcaacaagggcgagcccggcuccgccggcccccagggcccccccggccccuccggcgaggagggcaagcgcggccccaacggcgaggccggcuccgccggcccccccggcccccccggccuccgcggcucccccggcucccgcggccuccccggcgccgacggccgcgccggcgucaugggcccccccggcucccgcggcgccuccggccccgccggcguccgcggccccaacggcgacgccggccgccccggcgagcccggccucaugggcccccgcggccuccccggcucccccggcaacaucggccccgccggcaaggagggccccgucggccuccccggcaucgacggccgccccggccccaucggccccgccggcgcccgcggcgagcccggcaacaucggcuuccccggccccaagggccccaccggcgaccccggcaagaacggcgacaagggccacgccggccucgccggcgcccgcggcgcccccggccccgacggcaacaacggcgcccagggcccccccggcccccagggcguccagggcggcaagggcgagcagggcccccccggcccccccggcuuccagggccuccccggccccuccggccccgccggcgaggucggcaagcccggcgagcgcggccuccacggcgaguucggccuccccggccccgccggcccccgcggcgagcgcggcccccccggcgaguccggcgccgccggccccaccggccccaucggcucccgcggccccuccggcccccccggccccgacggcaacaagggcgagcccggcgucgucggcgccgucggcaccgccggccccuccggccccuccggccuccccggcgagcgcggcgccgccggcauccccggcggcaagggcgagaagggcgagcccggccuccgcggcgagaucggcaaccccggccgcgacggcgcccgcggcgcccccggcgccgucggcgcccccggccccgccggcgccaccggcgaccgcggcgaggccggcgccgccggccccgccggccccgccggcccccgcggcucccccggcgagcgcggcgaggucggccccgccggccccaacggcuucgccggccccgccggcgccgccggccagcccggcgccaagggcgagcgcggcgccaagggccccaagggcgagaacggcgucgucggccccaccggccccgucggcgccgccggccccgccggccccaacggcccccccggccccgccggcucccgcggcgacggcggcccccccggcaugaccggcuuccccggcgccgccggccgcaccggcccccccggccccuccggcaucuccggcccccccggcccccccggccccgccggcaaggagggccuccgcggcccccgcggcgaccagggccccgucggccgcaccggcgaggucggcgccgucggcccccccggcuucgccggcgagaagggccccuccggcgaggccggcaccgccggcccccccggcacccccggcccccagggccuccucggcgcccccggcauccucggccuccccggcucccgcggcgagcgcggccuccccggcgucgccggcgccgucggcgagcccggcccccucggcaucgccggcccccccggcgcccgcggcccccccggcgccgucggcucccccggcgucaacggcgcccccggcgaggccggccgcgacggcaaccccggcaacgacggcccccccggccgcgacggccagcccggccacaagggcgagcgcggcuaccccggcaacaucggccccgucggcgccgccggcgcccccggcccccacggccccgucggccccgccggcaagcacggcaaccgcggcgagaccggccccuccggccccgucggccccgccggcgccgucggcccccgcggccccuccggcccccagggcauccgcggcgacaagggcgagcccggcgagaagggcccccgcggccuccccggccucaagggccacaacggccuccagggccuccccggcaucgccggccaccacggcgaccagggcgcccccggcuccgucggccccgccggcccccgcggccccgccggccccuccggccccgccggcaaggacggccgcaccggccaccccggcaccgucggccccgccggcauccgcggcccccagggccaccagggccccgccggcccccccggcccccccggcccccccggcccccccggcgucuccggcggcggcuacgacuucggcuacgacggcgacuucuaccgcgccgaccagccccgcuccgcccccucccuccgccccaaggacuacgaggucgacgccacccucaagucccucaacaaccagaucgagacccuccucacccccgagggcucccgcaagaaccccgcccgcaccugccgcgaccuccgccucucccaccccgagugguccuccggcuacuacuggaucgaccccaaccagggcugcaccauggacgccaucaaggucuacugcgacuucuccaccggcgagaccugcauccgcgcccagcccgagaacauccccgccaagaacugguaccgcuccuccaaggacaagaagcacgucuggcucggcgagaccaucaacgccggcucccaguucgaguacaacgucgagggcgucaccuccaaggagauggccacccagcucgccuucaugcgccuccucgccaacuacgccucccagaacaucaccuaccacugcaagaacuccaucgccuacauggacgaggagaccggcaaccucaagaaggccgucauccuccagggcuccaacgacgucgagcucgucgccgagggcaacucccgcuucaccuacaccguccucgucgacggcugcuccaagaagaccaacgaguggggcaagaccaucaucgaguacaagaccaacaagcccucccgccuccccuuccucgacaucgccccccucgacaucggcggcgccgaccaggaguucuucgucgacaucggccccgucugcuucaaguga

SEQ ID NO: 41576 - RNA, 3855 nt, Artificial Sequence
  derived and/or modified sequence opt2 from COL20A1__Homo_sapiens__NP_065933
auguccuccggcgaccccgcccaccucggccucugccucuggcucuggcucggcgccacccucggccgcgagcagguccaggccuccggccuccuccgccucgccguccuccccgaggaccgccuccagaugaaguggcgcgaguccgagggcuccggccucggcuaccucguccaggucaagcccauggccggcgacuccgagcaggaggucauccucaccaccaagacccccaaggccaccgucggcggccucucccccuccaagggcuacacccuccagaucuucgagcucaccggcuccggccgcuuccuccucgcccgccgcgaguucgucaucgaggaccucaaguccuccucccucgaccgcuccucccagcgcccccucggcuccggcgcccccgagcccacccccucccacaccggcucccccgaccccgagcaggccuccgagccccaggucgccuucacccccucccaggacccccgcacccccgccggcccccaguuccgcugccucccccccguccccgccgacauggucuuccucgucgacggcuccugguccaucggccacucccacuuccagcaggucaaggacuuccucgccuccgucaucgcccccuucgagaucggccccgacaagguccaggucggccucacccaguacuccggcgacgcccagaccgagugggaccucaacucccucuccaccaaggagcagguccucgccgccguccgccgccuccgcuacaagggcggcaacaccuucaccggccucgcccucacccacguccucggccagaaccuccagcccgccgccggccuccgccccgaggccgccaaggucgucauccucgucaccgacggcaagucccaggacgacguccacaccgccgcccgcguccucaaggaccucggcgucaacgucuucgccgucggcgucaagaacgccgacgaggccgagcuccgccuccucgccucccccccccgcgacaucaccguccacuccguccucgacuuccuccagcucggcgcccucgccggccuccucucccgccucaucugccagcgccuccagggcggcuccccccgccagggccccgccgccgcccccgcccucgacacccuccccgcccccaccucccucguccucucccaggucaccuccuccuccauccgccucuccuggacccccgccccccgccacccccucaaguaccucaucgucuggcgcgccucccgcggcggcaccccccgcgaggucgucgucgagggccccgccgccuccaccgagcuccacaaccucgccucccgcaccgaguaccucgucuccgucuuccccaucuacgagggcggcgucggcgagggccuccgcggccucgucaccaccgccccccucccccccccccgcgcccucacccucgccgccgucaccccccgcaccguccaccucaccuggcagcccuccgccggcgccacccacuaccucguccgcugcucccccgccucccccaagggcgaggaggaggagcgcgagguccaggucggccgccccgagguccuccucgacggccucgagcccggccgcgacuacgaggucuccguccagucccuccgcggccccgagggcuccgaggcccgcggcauccgcgcccgcacccccacccucgcccccccccgccaccucggcuucuccgacgucucccacgacgccgcccgcgucuucugggagggcgccccccgccccguccgccucguccgcgucaccuacgucuccuccgagggcggccacuccggccagaccgaggcccccggcaacgccaccuccgccacccucggcccccucuccuccuccaccaccuacaccguccgcgucaccugccucuaccccggcggcggcuccuccacccucaccggccgcgucaccaccaagaaggcccccucccccucccagcucuccaugaccgagcuccccggcgacgccguccagcucgccugggucgccgccgcccccuccggcguccucgucuaccagaucaccuggaccccccucggcgagggcaaggcccacgagaucuccguccccggcaaccucggcaccgccguccuccccggccucggccgccacaccgaguacgacgucaccauccucgccuacuaccgcgacggcgcccgcuccgaccccgucucccuccgcuacacccccuccaccgucucccgcuccccccccuccaaccucgcccucgccuccgagacccccgacucccuccaggucuccuggacccccccccucggccgcguccuccacuacuggcucaccuacgcccccgccuccggccucggccccgagaaguccgucuccguccccggcgcccgcucccacgucacccuccccgaccuccaggccgccaccaaguaccgcguccucgucuccgccaucuacgccgccggccgcuccgaggccgucuccgccaccggccagaccgccugccccgcccuccgccccgacggcucccuccccggcuucgaccucauggucgccuucucccucgucgagaaggccuacgccuccauccgcggcgucgccauggagcccuccgccuucggcggcacccccaccuucacccucuucaaggacgcccagcucacccgccgcgucuccgacgucuaccccgccccccucccccccgagcacaccaucgucuuccucguccgccuccuccccgagaccccccgcgaggccuucgcccucuggcagaugaccgccgaggacuuccagccccuccucggcguccuccucgacgccggcaagaagucccucaccuacuuccaccgcgacccccgcgccgcccuccaggaggccaccuucgacccccaggagguccgcaagaucuucuucggcuccuuccacaagguccacgucgccgucggccgcuccaagguccgccucuacgucgacugccgcaaggucgccgagcgcccccucggcgagaugggcuccccccccgccgccggcuucgucacccucggccgccucgccaaggcccgcggcccccgcuccuccuccgccgccuuccagcuccagaugcuccagaucgucugcuccgacaccugggccgacgaggaccgcugcugcgagcuccccgccucccgcgacggcgagaccugccccgccuucgucuccgccugcuccugcuccuccgagacccccggcccccccggcccccagggcccccccggccuccccggccgcaacggcacccccggcgagcagggcuuccccggcccccgcggcccccccggcgucaagggcgagaagggcgaccacggccuccccggccuccagggccaccccggccaccagggcauccccggccgcgucggccuccagggccccaagggcaugcgcggccucgagggcaccgccggccuccccggcccccccggcccccgcggcuuccagggcauggccggcgcccgcggcaccuccggcgagcgcggcccccccggcaccgucggccccaccggccuccccggccccaagggcgagcgcggcgagaagggcgagccccagucccucgccacccucuaccagcucgucucccaggccucccacgucuccaaguucgacuccuuccacgagaacacccgcccccccaugcccauccucgagcagaagcucgagcccggcaccgagccccucggcucccccggcacccgcuccaaggcccucguccccggcgaguggggccgcggcggccgccaccucgagggccgcggcgagcccggcgccgucggccagaugggcucccccggccagcagggcgccuccacccagggccucugggaguga

SEQ ID NO: 41577 - RNA, 2874 nt, Artificial Sequence
  derived and/or modified sequence opt2 from COL21A1__Homo_sapiens__NP_110447
auggcccacuacaucaccuuccucugcaugguccucguccuccuccuccagaacuccguccucgccgaggacggcgagguccgcuccuccugccgcaccgcccccaccgaccucgucuucauccucgacggcuccuacuccgucggccccgagaacuucgagaucgucaagaaguggcucgucaacaucaccaagaacuucgacaucggccccaaguucauccaggucggcgucguccaguacuccgacuaccccguccucgagaucccccucggcuccuacgacuccggcgagcaccucaccgccgccgucgaguccauccucuaccucggcggcaacaccaagaccggcaaggccauccaguucgcccucgacuaccucuucgccaaguccucccgcuuccucaccaagaucgccgucguccucaccgacggcaagucccaggacgacgucaaggacgccgcccaggccgcccgcgacuccaagaucacccucuucgccaucggcgucggcuccgagaccgaggacgccgagcuccgcgccaucgccaacaagcccuccuccaccuacgucuucuacgucgaggacuacaucgccaucuccaagauccgcgaggucaugaagcagaagcucugcgaggaguccgucugccccacccgcauccccgucgccgcccgcgacgagcgcggcuucgacauccuccucggccucgacgucaacaagaaggucaagaagcgcauccagcucucccccaagaagaucaagggcuacgaggucaccuccaaggucgaccucuccgagcucaccuccaacgucuuccccgagggccucccccccuccuacgucuucgucuccacccagcgcuucaaggucaagaagaucugggaccucuggcgcauccucaccaucgacggccgcccccagaucgccgucacccucaacggcgucgacaagauccuccucuucaccaccaccuccgucaucaacggcucccaggucgucaccuucgccaacccccaggucaagacccucuucgacgagggcuggcaccagauccgccuccucgucaccgagcaggacgucacccucuacaucgacgaccagcagaucgagaacaagccccuccaccccguccucggcauccucaucaacggccagacccagaucggcaaguacuccggcaaggaggagaccguccaguucgacguccagaagcuccgcaucuacugcgaccccgagcagaacaaccgcgagaccgccugcgagauccccggcuucaacggcgagugccucaacggccccuccgacgucggcuccacccccgcccccugcaucugcccccccggcaagcccggccuccagggccccaagggcgaccccggccuccccggcaaccccggcuaccccggccagcccggccaggacggcaagcccggcuaccagggcaucgccggcacccccggcguccccggcucccccggcauccagggcgcccgcggccuccccggcuacaagggcgagcccggccgcgacggcgacaagggcgaccgcggccuccccggcuuccccggccuccacggcaugcccggcuccaagggcgagaugggcgccaagggcgacaagggcucccccggcuucuacggcaagaagggcgccaagggcgagaagggcaacgccggcuuccccggccuccccggccccgccggcgagcccggccgccacggcaaggacggccucaugggcucccccggcuucaagggcgaggccggcucccccggcgcccccggccaggacggcacccgcggcgagcccggcauccccggcuuccccggcaaccgcggccucaugggccagaagggcgagaucggcccccccggccagcagggcaagaagggcgcccccggcaugcccggccucaugggcuccaacggcucccccggccagcccggcacccccggcuccaagggcuccaagggcgagcccggcauccagggcaugcccggcgccuccggccucaagggcgagcccggcgccaccggcucccccggcgagcccggcuacaugggccuccccggcauccagggcaagaagggcgacaagggcaaccagggcgagaagggcauccagggccagaagggcgagaacggccgccagggcauccccggccagcagggcauccagggccaccacggcgccaagggcgagcgcggcgagaagggcgagcccggcguccgcggcgccaucggcuccaagggcgaguccggcgucgacggccucaugggccccgccggccccaagggccagcccggcgaccccggcccccagggcccccccggccucgacggcaagcccggccgcgaguucuccgagcaguucauccgccaggucugcaccgacgucauccgcgcccagcuccccguccuccuccaguccggccgcauccgcaacugcgaccacugccucucccagcacggcucccccggcauccccggcccccccggccccaucggccccgagggcccccgcggccuccccggccuccccggccgcgacggcguccccggccucgucggcguccccggccgccccggcguccgcggccucaagggccuccccggccgcaacggcgagaagggcucccagggcuucggcuaccccggcgagcagggcccccccggcccccccggccccgagggcccccccggcaucuccaaggagggcccccccggcgaccccggccuccccggcaaggacggcgaccacggcaagcccggcauccagggccagcccggcccccccggcaucugcgaccccucccucugcuucuccgucaucgcccgccgcgaccccuuccgcaagggccccaacuacuga

SEQ ID NO: 41578 - RNA, 4881 nt, Artificial Sequence
  derived and/or modified sequence opt2 from COL22A1__Homo_sapiens__NP_690848
auggccggccuccgcggcaacgccgucgccggccuccucuggaugcuccuccucugguccggcggcggcggcugccaggcccagcgcgccggcugcaaguccguccacuacgaccucgucuuccuccucgacaccuccuccuccgucggcaaggaggacuucgagaagguccgccagugggucgccaaccucgucgacaccuucgaggucggccccgaccgcacccgcgucggcgucguccgcuacuccgaccgccccaccaccgccuucgagcucggccucuucggcucccaggaggaggucaaggccgccgcccgccgccucgccuaccacggcggcaacaccaacaccggcgacgcccuccgcuacaucaccgcccgcuccuucuccccccacgccggcggccgcccccgcgaccgcgccuacaagcaggucgccauccuccucaccgacggccgcucccaggaccucguccucgacgccgccgccgccgcccaccgcgccggcauccgcaucuucgccgucggcgucggcgaggcccucaaggaggagcucgaggagaucgccuccgagcccaaguccgcccacgucuuccacgucuccgacuucaacgccaucgacaagauccgcggcaagcuccgccgccgccucugcgagaacguccucugccccuccguccgcgucgagggcgaccgcuucaagcacaccaacggcggcaccaaggagaucaccggcuucgaccucauggaccucuucuccgucaaggagauccucggcaagcgcgagaacggcgcccaguccuccuacguccgcaugggcuccuuccccgucguccaguccaccgaggacgucuucccccagggccuccccgacgaguacgccuucgucaccaccuuccgcuuccgcaagaccucccgcaaggaggacugguacaucuggcaggucaucgaccaguacuccaucccccaggucuccauccgccucgacggcgagaacaaggccgucgaguacaacgccgucggcgccaugaaggacgccguccgcgucgucuuccgcggcucccgcgucaacgaccucuucgaccgcgacuggcacaagauggcccucuccauccaggcccagaacgucucccuccacaucgacugcgcccucguccagacccuccccaucgaggagcgcgagaacaucgacauccagggcaagaccgucaucggcaagcgccucuacgacuccguccccaucgacuucgaccuccagcgcaucgucaucuacugcgacucccgccacgccgagcucgagaccugcugcgacauccccuccggccccugccaggucaccgucgucaccgagccccccccccccccccccccccagcgcccccccacccccggcuccgagcagaucggcuuccucaagaccaucaacugcuccugccccgccggcgagaagggcgagaugggcgucgccggccccaugggccuccccggccccaagggcgacaucggcgccaucggccccgucggcgcccccggccccaagggcgagaagggcgacgucggcaucggccccuucggccagggcgagaagggcgagaagggcucccucggccuccccggcccccccggccgcgacggcuccaagggcaugcgcggcgagcccggcgagcucggcgagcccggccuccccggcgaggucggcaugcgcggcccccagggcccccccggccuccccggcccccccggccgcgucggcgcccccggccuccagggcgagcgcggcgagaagggcacccgcggcgagaagggcgagcgcggccucgacggcuuccccggcaagcccggcgacaccggccagcagggccgccccggccccuccggcgucgccggcccccagggcgagaagggcgacgucggccccgccggcccccccggcguccccggcuccgucguccagcaggagggccucaagggcgagcagggcgcccccggcccccgcggccaccagggcgcccccggcccccccggcgcccgcggccccaucggccccgagggccgcgacggcccccccggccuccagggccuccgcggcaagaagggcgacaugggcccccccggcauccccggccuccucggccuccagggcccccccggcccccccggcguccccggcccccccggccccggcggcucccccggccuccccggcgagaucggcuuccccggcaagcccggcccccccggccccaccggcccccccggcaaggacggccccaacggcccccccggcccccccggcaccaagggcgagcccggcgagcgcggcgaggacggccuccccggcaagcccggccuccgcggcgagaucggcgagcagggccucgccggccgccccggcgagaagggcgaggccggccuccccggcgcccccggcuuccccggcguccgcggcgagaagggcgaccagggcgagaagggcgagcucggccuccccggccucaagggcgaccgcggcgagaagggcgaggccggccccgccggcccccccggccuccccggcaccaccucccucuucaccccccacccccgcaugcccggcgagcagggccccaagggcgagaagggcgaccccggccuccccggcgagcccggccuccagggccgccccggcgagcucggcccccagggccccaccggcccccccggcgccaagggccaggagggcgcccacggcgcccccggcgccgccggcaaccccggcgcccccggccacgucggcgcccccggccccuccggcccccccggcuccgucggcgcccccggccuccgcggcacccccggcaaggacggcgagcgcggcgagaagggcgccgccggcgaggagggcucccccggccccgucggcccccgcggcgaccccggcgcccccggccuccccggcccccccggcaagggcaaggacggcgagcccggccuccgcggcucccccggccuccccggcccccucggcaccaaggccgccugcggcaagguccgcggcuccgagaacugcgcccucggcggccagugcgucaagggcgaccgcggcgcccccggcauccccggcucccccggcucccgcggcgaccccggcaucggcgucgccggcccccccggccccuccggcccccccggcgacaagggcucccccggcucccgcggccuccccggcuuccccggcccccagggccccgccggccgcgacggcgcccccggcaaccccggcgagcgcggcccccccggcaagcccggccucuccucccuccucucccccggcgacaucaaccuccucgccaaggacgucugcaacgacugcccccccggcccccccggccuccccggccuccccggcuucaagggcgacaagggcguccccggcaagcccggccgcgagggcaccgagggcaagaagggcgaggccggcccccccggccuccccggcccccccggcaucgccggcccccagggcucccagggcgagcgcggcgccgacggcgaggucggccagaagggcgaccagggccaccccggcguccccggcuucaugggcccccccggcaaccccggcccccccggcgccgacggcaucgccggcgccgccggcccccccggcauccagggcucccccggcaaggagggcccccccggcccccagggccccuccggccuccccggcauccccggcgaggagggcaaggagggccgcgacggcaagcccggcccccccggcgagcccggcaaggccggcgagcccggccuccccggccccgagggcgcccgcggcccccccggcuucaagggccacaccggcgacuccggcgcccccggcccccgcggcgaguccggcgccaugggccuccccggccaggagggccuccccggcaaggacggcgacaccggccccaccggcccccagggcccccagggcccccgcggcccccccggcaagaacggcucccccggcucccccggcgagcccggccccuccggcacccccggccagaagggcuccaagggcgagaacggcucccccggccuccccggcuuccucggcccccgcggcccccccggcgagcccggcgagaagggcguccccggcaaggagggcguccccggcaagcccggcgagcccggcuucaagggcgagcgcggcgaccccggcaucaagggcgacaagggcccccccggcggcaagggccagcccggcgaccccggcauccccggccacaagggccacaccggccucaugggcccccagggccuccccggcgagaacggccccgucggcccccccggcccccccggccagcccggcuuccccggccuccgcggcgagucccccuccauggagacccuccgccgccucauccaggaggagcucggcaagcagcucgagacccgccucgccuaccuccucgcccagaugccccccgccuacaugaaguccucccagggccgccccggcccccccggcccccccggcaaggacggccuccccggccgcgccggccccaugggcgagcccggccgccccggccagggcggccucgagggccccuccggccccaucggccccaagggcgagcgcggcgccaagggcgaccccggcgcccccggcgucggccuccgcggcgagaugggcccccccggcauccccggccagcccggcgagcccggcuacgccaaggacggccuccccggcauccccggcccccagggcgagaccggccccgccggccaccccggccuccccggcccccccggcccccccggccagugcgaccccucccagugcgccuacuucgccucccucgccgcccgccccggcaacgucaagggccccuga

SEQ ID NO: 41579 - RNA, 1623 nt, Artificial Sequence
  derived and/or modified sequence opt2 from COL23A1__Homo_sapiens__NP_775736
augggccccggcgagcgcgccggcggcggcggcgacgccggcaagggcaacgccgccggcggcggcggcggcggccgcuccgccaccaccgccggcucccgcgccgucuccgcccucugccuccuccucuccgucggcuccgccgccgccugccuccuccucggcguccaggccgccgcccuccagggccgcgucgccgcccucgaggaggagcgcgagcuccuccgccgcgccggcccccccggcgcccucgacgccugggccgagccccaccucgagcgccuccuccgcgagaagcucgacggccucgccaagauccgcaccgcccgcgaggcccccuccgagugcgucugcccccccggcccccccggccgccgcggcaagcccggccgccgcggcgaccccggcccccccggccaguccggccgcgacggcuaccccggcccccucggccucgacggcaagcccggccuccccggccccaagggcgagaagggcgcccccggcgacuucggcccccgcggcgaccagggccaggacggcgccgccggcccccccggcccccccggcccccccggcgcccgcggcccccccggcgacaccggcaaggacggcccccgcggcgcccagggccccgccggccccaagggcgagcccggccaggacggcgagaugggccccaagggcccccccggccccaagggcgagcccggcguccccggcaagaagggcgacgacggcacccccucccagcccggcccccccggccccaagggcgagcccggcuccaugggcccccgcggcgagaacggcgucgacggcgcccccggccccaagggcgagcccggccaccgcggcaccgacggcgccgccggcccccgcggcgcccccggccucaagggcgagcagggcgacaccgucgucaucgacuacgacggccgcauccucgacgcccucaagggcccccccggcccccagggcccccccggcccccccggcauccccggcgccaagggcgagcucggccuccccggcgcccccggcaucgacggcgagaagggccccaagggccagaagggcgaccccggcgagcccggccccgccggccucaagggcgaggccggcgagaugggccucuccggccuccccggcgccgacggccucaagggcgagaagggcgaguccgccuccgacucccuccaggagucccucgcccagcucaucgucgagcccggcccccccggcccccccggcccccccggccccaugggccuccagggcauccagggccccaagggccucgacggcgccaagggcgagaagggcgccuccggcgagcgcggccccuccggccuccccggccccgucggcccccccggccucaucggccuccccggcaccaagggcgagaagggccgccccggcgagcccggccucgacggcuuccccggcccccgcggcgagaagggcgaccgcuccgagcgcggcgagaagggcgagcgcggcguccccggccgcaagggcgucaagggccagaagggcgagcccggcccccccggccucgaccagcccugccccgucggccccgacggccuccccguccccggcugcuggcacaaguga

SEQ ID NO: 41580 - RNA, 5091 nt, Artificial Sequence
  derived and/or modified sequence opt2 from COL24A1__Homo_sapiens__XP_011539493
augcaccuccgcgcccaccgcacccgccgcggcaaggucucccccaccgccaagaccaagucccuccuccacuucaucguccucugcgucgccggcgucgucguccacgcccaggagcagggcaucgacauccuccaccagcucggccucggcggcaaggacguccgccacuccucccccgccaccgccguccccuccgccuccaccccccucccccagggcguccaccucaccgaguccggcgucaucuucaagaacgacgccuacaucgagacccccuucgucaagauccuccccgucaaccucggccagcccuucaccauccucaccggccuccagucccaccgcgucaacaacgccuuccucuucuccauccgcaacaagaaccgccuccagcucggcguccagcuccuccccaagaagcucgucguccacauccgcggcaagcagcccgccgucuucaacuacuccguccacgacgagcaguggcacuccuucgccaucaccauccgcaaccaguccgucuccauguucgucgagugcggcaagaaguacuucuccaccgagaccauccccgagguccagaccuucgacuccaacuccgucuucacccucggcuccaugaacaacaacuccauccacuucgagggcaucgucugccagcucgacaucauccccuccgccgaggccuccgccgacuacugccgcuacgucaagcagcagugccgccaggccgacaaguaccagcccgagaccuccauccccugcaccacccucauccccaccaagauccccgagcacucccccccccccaagcucuucgccgagaagguccucuccgaggacaccuucaccgagggcaaguccauccccaacaucaucaagaacgacuccgagaccgucuacaagcgccaggagcaccagaucucccgcucccagcucuccucccuccaguccggcaacgucuccgccgucgaccucaccaaccacggcauccaggccaaggagaugaucaccgaggaggacacccagaccaacuucucccucuccgucaccacccaccgcaucuccgaggccaagaugaacaccaaggagaaguucuccucccuccucaacauguccgacaacaucacccagcacgacgaccgcgucaccggccucucccucuucaagaagaugcccuccauccucccccagaucaagcaggacaccaucaccaaccucaagaaggccaucaccgccaaccuccacaccaacgagcucauggagaugcagcccauccucaacaccucccuccaccgcgucaccaacgagcccuccgucgacaaccaccucgaccuccgcaaggagggcgaguucuaccccgacgccaccuaccccaucgagaacuccuacgagaccgagcucuacgacuacuacuacuacgaggaccucaacaccaugcucgagauggaguaccuccgcggccccaagggcgacaccggcccccccggcccccccggccccgccggcauccccggccccuccggcaagcgcggcccccgcggcauccccggcccccacggcaaccccggccuccccggccuccccggccccaagggccccaagggcgaccccggcuucucccccggccagcccguccccggcgagaagggcgaccagggccucuccggccucaugggcccccccggcaugcagggcgacaagggccucaagggccaccccggccuccccggccuccccggcgagcagggcauccccggcuucgccggcaacaucggcucccccggcuaccccggccgccagggccucgccggccccgagggcaaccccggccccaagggcgcccagggcuucaucggcucccccggcgaggccggccagcucggccccgagggcgagcgcggcauccccggcauccgcggcaagaagggcuucaagggccgccagggcuuccccggcgacuucggcgaccgcggccccgccggccucgacggcucccccggccucgucggcggcaccggcccccccggcuuccccggccuccgcggcuccgucggccccgucggccccaucggccccgccggcauccccggccccaugggccucuccggcaacaagggccuccccggcaucaagggcgacaagggcgagcagggcaccgccggcgagcucggcgagcccggcuaccccggcgacaagggcgccgucggccuccccggcccccccggcaugcgcggcaaguccggccccuccggccagaccggcgaccccggccuccagggccccuccggcccccccggccccgagggcuuccccggcgacaucggcauccccggccagaacggccccgagggccccaagggccuccucggcaaccgcggcccccccggcccccccggccucaagggcacccagggcgaggagggccccaucggcgccuucggcgagcucggcccccgcggcaagcccggccagaagggcuacgccggcgagcccggccccgagggccucaagggcgaggucggcgaccagggcaacaucggcaagaucggcgagaccggccccgucggccuccccggcgaggucggcaugaccggcuccaucggcgagaagggcgagcgcggcucccccggcccccucggcccccagggcgagaagggcgucaugggcuaccccggcccccccggcguccccggccccaucggcccccucggccuccccggcucccgcggccccgacggccuccucggcgagcagggcauccagggcgccaagggcgagaagggcgaccagggcaagcgcggcccccacggccucaucggcaagaccggcaaccccggcgagcgcggcuuccagggcaagcccggccuccagggccuccccggcuccaccggcgaccgcggccuccccggcgagcccggccuccgcggccuccagggcgacgucggcccccccggcgagaugggcauggagggcccccccggcaccgagggcgaguccggccuccagggcgagcccggcgccaagggcgacgucggcaccgccggcuccgucggcggcaccggcgagcccggccuccgcggcgagcccggcgcccccggcgaggagggccuccagggcaaggacggccucaagggcguccccggcggccgcggccuccccggcgaggacggcgagaagggcgagaugggccuccccggcaucaucggcccccucggccgcuccggccagaccggccuccccggccccgagggcaucgucggcauccccggccagcgcggccgccccggcaagaagggcgacaagggccagaucggccccaccggcgaggucggcucccgcggcccccccggcaagaucggcaaguccggccccaagggcgcccgcggcacccgcggcgccgucggccaccucggccucaugggccccgacggcgagcccggcauccccggcuaccgcggccaccagggccagcccggccccuccggccuccccggccccaagggcgagaagggcuaccccggcgaggacuccaccguccucggcccccccggcccccgcggcgagcccggccccgucggcgaccagggcgagcgcggcgagcccggcgccgagggcuacaagggccacgucggcguccccggccuccgcggcgccaccggccagcagggcccccccggcgagcccggcgaccagggcgagcagggccucaagggcgagcgcggcuccgagggcaacaagggcaagaagggcgcccccggccccuccggcaagcccggcauccccggccuccagggccuccucggccccaagggcauccagggcuaccacggcgccgacggcaucuccggcaaccccggcaagaucggcccccccggcaagcagggccuccccggcauccgcggcggccccggccgcaccggccucgccggcgcccccggcccccccggcgucaagggcuccuccggccuccccggcucccccggcauccagggccccaagggcgagcagggccuccccggccagcccggcauccagggcaagcgcggccaccgcggcgcccagggcgaccagggccccugcggcgaccccggccucaagggccagcccggcgaguacggcguccagggccucaccggcuuccagggcuuccccggccccaagggccccgagggcgacgccggcaucgucggcaucuccggccccaagggccccaucggccaccgcggcaacaccggcccccucggccgcgagggcaucaucggccccaccggccgcaccggcccccgcggcgagaagggcuuccgcggcgagaccggcccccagggcccccgcggccagcccggcccccccggcccccccggcgcccccggcccccgcaagcagauggacaucaacgccgccauccaggcccucaucgaguccaacaccgcccuccagauggaguccuaccagaacaccgaggucacccucaucgaccacuccgaggagaucuucaagacccucaacuaccucuccaaccuccuccacuccaucaagaacccccucggcacccgcgacaaccccgcccgcaucugcaaggaccuccucaacugcgagcagaaggucuccgacggcaaguacuggaucgaccccaaccucggcugccccuccgacgccaucgaggucuucugcaacuucuccgccggcggccagaccugccucccccccgucuccgucaccaagcucgaguucggcgucggcaagguccagaugaacuuccuccaccuccucuccuccgaggccacccacaucaucaccauccacugccucaacaccccccgcuggaccuccacccagaccuccggccccggccuccccaucggcuucaagggcuggaacggccagaucuucaaggucaacacccuccucgagcccaagguccucuccgacgacugcaagauccaggacggcuccuggcacaaggccaccuuccucuuccacacccaggagcccaaccagcuccccgucaucgagguccagaagcucccccaccucaagaccgagcgcaaguacuacaucgacuccuccuccgucugcuuccucuga

SEQ ID NO: 41581 - RNA, 1938 nt, Artificial Sequence
  derived and/or modified sequence opt2 from COL25A1__Homo_sapiens__NP_001243003
augcuccucaagaagcacgccggcaagggcggcggccgcgagccccgcuccgaggaccccacccccgccgagcagcacugcgcccgcaccaugccccccugcgccguccucgccgcccuccucuccgucgucgccgucgucuccugccucuaccucggcgucaagaccaacgaccuccaggcccgcaucgccgcccucgaguccgccaagggcgcccccuccauccaccuccuccccgacacccucgaccaccucaagaccaugguccaggagaaggucgagcgccuccucgcccagaaguccuacgagcacauggccaagauccgcaucgcccgcgaggcccccuccgagugcaacugccccgccggcccccccggcaagcgcggcaagcgcggccgccgcggcgaguccggcccccccggccagcccggcccccagggcccccccggccccaagggcgacaagggcgagcagggcgaccagggcccccgcggccuccccggcuuccccaccgucgccgcccuccacuccaaccagauccucaccgucaagggcgaccagggccaggccggcccccccggcccccccggcccccccggcccccgcggcccccccggcgacaccggcaaggacggcccccgcggcaugcccggcguccccggcgagcccggcaagcccggcgagcagggccucaugggcccccucggcccccccggccagaagggcuccaucggcgcccccggcauccccggcaugaacggccagaagggcgagcccggccuccccggcgccgucggccagaacggcauccccggccccaagggcgagcccggcgagcagggcgagaagggcgacgccggcgagaacggccccaagggcgacaccggcgagaagggcgaccccggcuccuccgccgccggcaucaagggcgagcccggcgaguccggccgccccggccagaagggcgagcccggccuccccggccuccccggccuccccggcaucaagggcgagcccggcuucaucggcccccagggcgagcccggccuccccggccuccccggcaccaagggcgagcgcggcgaggccggcccccccggccgcggcgagcgcggcgagcccggcgcccccggccccaagggcgaccgcggcgagaagggcgacuccggcgcccagggcccccgcggcccccccggccagaagggcgaccagggcgccaccgagaucaucgacuacaacggcaaccuccacgaggcccuccagggcccccccggcccccccggcccccagggccuccagggccccaagggcgagcagggcucccccggcauccccggcauggacggcgagcagggccucaagggcuccaagggcgacaugggcgaccccggcaugaccggcgagaagggcggcaucggccuccccggccuccccggcgccaacggcaugaagggcgagaagggcgacuccggcaugcccggcccccagggccccuccaucaucggcccccccggcccccccggcccccacggcccccccggccccaugggcccccacggccuccccggccccaagggcgagcccggccucaacggcgucaagggccucaagggcgagcccggccagaagggcgaccgcggcccccucggccuccccggcgccuccggccucgacggcaagcccggcucccgcggcaccgacggccccaugggcccccacggccccgccggccccaagggcgagcgcggcgagaagggcgccaugggcgagcccggcccccgcggccccuacggccuccccggcuuccccggcccccgcggcgagaagggcgaccucggcgagaagggcgagaaggucaccucccccucccagcacguccccugccucauccuccuccuccucuccgcccuccucuucucccucugcgacuccaucuga

SEQ ID NO: 41582 - RNA, 1326 nt, Artificial Sequence
  derived and/or modified sequence opt2 from COL26A1__Homo_sapiens__NP_001265492
augaagcucgcccuccuccuccccugggccugcugcugccucugcggcuccgcccucgccaccggcuuccucuaccccuucuccgccgccgcccuccagcagcacggcuaccccgagcccggcgccggcucccccggcuccggcuacgccucccgccgccacuggugccaccacaccgucacccgcaccgucuccugccagguccagaacggcuccgagaccgucguccagcgcgucuaccaguccugccgcuggcccggccccugcgccaaccucgucuccuaccgcacccucauccgccccaccuaccgcgucuccuaccgcaccgucaccguccucgaguggcgcugcugccccggcuucaccggcuccaacugcgacgaggagugcaugaacugcacccgccucuccgacauguccgagcgccucaccacccucgaggccaagguccuccuccucgaggccgccgagcgccccuccucccccgacaacgaccuccccgcccccgaguccaccccccccaccuggaacgaggacuuccuccccgacgccaucccccucgcccaccccgucccccgccagcgccgccccaccggccccgccggcccccccggccagaccggcccccccggccccgccggcccccccggcuccaagggcgaccgcggccagaccggcgagaagggccccgccggcccccccggccuccucggcccccccggcccccgcggccuccccggcgagaugggccgccccggcccccccggcccccccggccccgccggcaaccccggccccucccccaacuccccccagggcgcccucuacucccuccagccccccaccgacaaggacaacggcgacucccgccucgccuccgccaucgucgacaccguccucgccggcguccccggcccccgcggcccccccggcccccccggcccccccggcccccgcggcccccccggcccccccggcacccccggcucccagggccucgccggcgagcgcggcaccgucggccccuccggcgagcccggcgucaagggcgaggagggcgagaaggccgccaccgccgagggcgagggcguccagcagcuccgcgaggcccucaagauccucgccgagcgcguccucauccucgagcacaugaucggcauccacgacccccucgccucccccgagggcggcuccggccaggacgccgcccuccgcgccaaccucaagaugaagcgcggcggcgcccagcccgacggcguccucgccgcccuccucggccccgaccccggccagaaguccgucgaccaggccuccucccgcaaguga

SEQ ID NO: 41583 - RNA, 5583 nt, Artificial Sequence
  derived and/or modified sequence opt2 from COL27A1__Homo_sapiens__NP_116277
augggcgccggcuccgcccgcggcgcccgcggcaccgccgccgccgccgccgcccgcggcggcggcuuccucuucuccuggauccucgucuccuucgccugccaccucgccuccacccagggcgcccccgaggacgucgacauccuccagcgccucggccucuccuggaccaaggccggcucccccgccccccccggcgucauccccuuccaguccggcuucaucuucacccagcgcgcccgccuccaggcccccaccggcaccgucauccccgccgcccucggcaccgagcucgcccucguccucucccucugcucccaccgcgucaaccacgccuuccucuucgccguccgcucccagaagcgcaagcuccagcucggccuccaguuccuccccggcaagaccgucguccaccucggcucccgccgcuccgucgccuucgaccucgacaugcacgacggccgcuggcaccaccucgcccucgagcuccgcggccgcaccgucacccucgucaccgccugcggccagcgccgcguccccguccuccuccccuuccaccgcgaccccgcccucgaccccggcggcuccuuccucuucggcaagaugaacccccacgccguccaguucgagggcgcccucugccaguucuccaucuaccccgucacccaggucgcccacaacuacugcacccaccuccgcaagcagugcggccaggccgacaccuaccaguccccccucggcccccucuucucccaggacuccggccgccccuucaccuuccaguccgaccucgcccuccucggccucgagaaccucaccaccgccacccccgcccucggcucccuccccgccggccgcggcccccgcggcaccgucgcccccgccacccccaccaagccccagcgcaccucccccaccaacccccaccagcacauggccgucggcggccccgcccagaccccccuccuccccgccaagcucuccgccuccaacgcccucgaccccaugcuccccgccuccgucggcggcuccacccgcaccccccgccccgccgccgcccagcccucccagaagaucaccgccaccaagauccccaagucccuccccaccaagcccuccgcccccuccaccuccaucguccccaucaaguccccccaccccacccagaagaccgcccccuccuccuucaccaaguccgcccuccccacccagaagcaggucccccccaccucccgccccguccccgcccgcgucucccgccccgccgagaagcccauccagcgcaaccccggcaugccccgcccccccccccccuccacccgcccccucccccccaccaccuccuccuccaagaagcccauccccacccucgcccgcaccgaggccaagaucaccucccacgccuccaagcccgccuccgcccgcaccuccacccacaagcccccccccuucaccgcccucuccuccucccccgcccccacccccggcuccacccgcuccacccgcccccccgccaccauggucccccccaccuccggcaccuccaccccccgcaccgcccccgccguccccacccccggcuccgcccccaccggcuccaagaagcccaucggcuccgaggccuccaagaaggccggccccaaguccuccccccgcaagcccgucccccuccgccccggcaaggccgcccgcgacgucccccucuccgaccucaccacccgccccuccccccgccagccccagcccucccagcagaccacccccgcccucguccucgcccccgcccaguuccucuccuccuccccccgccccaccuccuccggcuacuccaucuuccaccucgccggcuccacccccuucccccuccucaugggcccccccggccccaagggcgacugcggccuccccggcccccccggccuccccggccuccccggcauccccggcgcccgcggcccccgcggcccccccggccccuacggcaaccccggccuccccggcccccccggcgccaagggccagaagggcgaccccggccucucccccggcaaggcccacgacggcgccaagggcgacaugggccuccccggccucuccggcaaccccggcccccccggccgcaagggccacaagggcuaccccggccccgccggccaccccggcgagcagggccagcccggccccgagggcucccccggcgccaagggcuaccccggccgccagggccuccccggccccgucggcgaccccggccccaagggcucccgcggcuacaucggccuccccggccucuucggccuccccggcuccgacggcgagcgcggccuccccggcguccccggcaagcgcggcaagaugggcaugcccggcuuccccggcgucuucggcgagcgcggcccccccggccucgacggcaaccccggcgagcucggccuccccggcccccccggcguccccggccucaucggcgaccucggcguccucggccccaucggcuaccccggccccaagggcaugaagggccucaugggcuccgucggcgagcccggccucaagggcgacaagggcgagcagggcguccccggcgucuccggcgaccccggcuuccagggcgacaagggcucccagggccuccccggcuuccccggcgcccgcggcaagcccggcccccucggcaaggucggcgacaagggcuccaucggcuuccccggcccccccggccccgagggcuuccccggcgacaucggcccccccggcgacaacggccccgagggcaugaagggcaagcccggcgcccgcggccuccccggcccccgcggccagcucggccccgagggcgacgagggccccaugggcccccccggcgcccccggccucgagggccagcccggccgcaagggcuuccccggccgccccggccucgacggcgucaagggcgagcccggcgaccccggccgccccggccccgucggcgagcagggcuucaugggcuucaucggccucgucggcgagcccggcaucgucggcgagaagggcgaccgcggcaugaugggcccccccggcguccccggccccaagggcuccaugggccaccccggcaugcccggcggcaugggcacccccggcgagcccggcccccagggcccccccggcucccgcggcccccccggcaugcgcggcgccaagggccgccgcggcccccgcggccccgacggccccgccggcgagcagggcucccgcggccucaagggcccccccggcccccagggccgccccggccgccccggccagcagggcgucgccggcgagcgcggccaccucggcucccgcggcuuccccggcauccccggccccuccggcccccccggcaccaagggccuccccggcgagcccggcccccagggcccccagggccccaucggcccccccggcgagaugggccccaagggcccccccggcgccgucggcgagcccggccuccccggcgaggccggcaugaagggcgaccucggcccccucggcacccccggcgagcagggccucaucggccagcgcggcgagcccggccucgagggcgacuccggccccaugggccccgacggccucaagggcgaccgcggcgaccccggccccgacggcgagcacggcgagaagggccaggagggccucaugggcgaggacggcccccccggcccccccggcgucaccggcguccgcggccccgagggcaaguccggcaagcagggcgagaagggccgcaccggcgccaagggcgccaagggcuaccagggccagcucggcgagaugggcguccccggcgaccccggcccccccggcacccccggccccaagggcucccgcggcucccucggccccaccggcgcccccggccgcaugggcgcccagggcgagcccggccucgccggcuacgacggccacaagggcaucgucggcccccucggcccccccggccccaagggcgagaagggcgagcagggcgaggacggcaaggccgagggcccccccggcccccccggcgaccgcggccccgucggcgaccgcggcgaccgcggcgagcccggcgaccccggcuaccccggccaggagggcguccagggccuccgcggcaagcccggccagcagggccagcccggccaccccggcccccgcggcuggcccggccccaagggcuccaagggcgccgagggccccaagggcaagcagggcaaggccggcgcccccggccgccgcggcguccagggccuccagggccuccccggcccccgcggcgucgucggccgccagggccucgagggcaucgccggccccgacggccuccccggccgcgacggccaggccggccagcagggcgagcagggcgacgacggcgaccccggccccaugggccccgccggcaagcgcggcaaccccggcgucgccggccuccccggcgcccagggcccccccggcuucaagggcgaguccggccuccccggccagcucggcccccccggcaagcgcggcaccgagggccgcaccggccuccccggcaaccagggcgagcccggcuccaagggccagcccggcgacuccggcgagaugggcuuccccggcauggccggccucuucggccccaagggcccccccggcgacaucggcuucaagggcauccagggcccccgcggcccccccggccucaugggcaaggagggcaucgucggcccccucggcauccucggccccuccggccuccccggccccaagggcgacaagggcucccgcggcgacuggggccuccagggcccccgcggcccccccggcccccgcggccgccccggcccccccggcccccccggcggccccauccagcuccagcaggacgaccucggcgccgccuuccagaccuggauggacaccuccggcgcccuccgccccgaguccuacuccuaccccgaccgccucguccucgaccagggcggcgagaucuucaagacccuccacuaccucuccaaccucauccaguccaucaagaccccccucggcaccaaggagaaccccgcccgcgucugccgcgaccucauggacugcgagcagaagauggucgacggcaccuacugggucgaccccaaccucggcugcuccuccgacaccaucgaggucuccugcaacuucacccacggcggccagaccugccucaagcccaucaccgccuccaaggucgaguucgccaucucccgcguccagaugaacuuccuccaccuccucuccuccgaggucacccagcacaucaccauccacugccucaacaugaccgucuggcaggagggcaccggccagacccccgccaagcaggccguccgcuuccgcgccuggaacggccagaucuucgaggccggcggccaguuccgccccgaggucuccauggacggcugcaagguccaggacggccgcuggcaccagacccucuucaccuuccgcacccaggacccccagcagcuccccaucaucuccgucgacaaccucccccccgccuccuccggcaagcaguaccgccucgaggucggccccgccugcuuccucuga

SEQ ID NO: 41584 - RNA, 3378 nt, Artificial Sequence
  derived and/or modified sequence opt2 from COL28A1__Homo_sapiens__XP_011513662
auguggaaccgcuacuucgucuucuaccuccuccuccucuccgccuucaccucccagaccgucuccggccagcgcaagaagggccccaaguccaaccuccucgcccgcaaguccgacguccagggcuccaucugcuucaucgacaucgucuucaucgucgacuccuccgaguccuccaagaucgcccucuucgacaagcagaaggacuucgucgacucccucuccgacaagaucuuccagcucacccccggccgcucccucgaguacgacaucaagcucgccgcccuccaguucuccuccuccguccagaucgacccccccuucuccuccuggaaggaccuccagaccuucaagcagaaggucaaguccaugaaccucaucggccagggcaccuucuccuacuacgccaucuccaacgccacccgccuccucaagcgcgagggccgcaaggacggcgucaaggucguccuccucaugaccgacggcaucgaccaccccaagaaccccgacguccaguccaucuccgaggacgcccgcaucuccggcaucuccuucaucaccaucgcccucuccaccgucgucaacgaggccaagcuccgccucaucuccggcgacuccuccuccgagcccacccuccuccucuccgaccccacccucgucgacaagauccaggaccgccucgacauccucuucgagaagaagugcgagcgcaagaucugcgagugcgagaagggcgaccccggcgaccccggcccccccggcacccacggcaaccccggcaucaagggcgagcgcggccccaagggcaaccccggcaacgcccagaagggcgaggccggcgagcgcggccccggcggcauccccggcuacaagggcgacaagggcgagcgcggcgagugcggcaagcccggcaucaagggcgacaagggcucccccggccccuacggccccaagggcccccgcggcauccagggcaucaccggcccccccggcgaccccggccccaagggcuuccagggcaacaagggcgagcccggcccccccggccccuacggcucccccggcgcccccggcaucggccagcagggcaucaagggcgagcgcggccaggagggccgccccggcgcccccggccccaucggcgucggcgagcccggccagcccggcccccgcggccccgagggcguccccggcgagcgcggccuccccggcgagggcuuccccggccccaagggcgagaagggcuccgagggccccaccggcccccagggccuccagggccucuccaucaagggcgagaagggcgacaucggccccgucggcccccagggccccaugggcauccccggcaucggcucccagggcgagcagggcauccagggccccaucggcccccccggcccccagggccccgccggccagggccuccccggcuccaagggcgaggucggccagaugggccccaccggcccccgcggccccgucggcaucggcguccagggccccaagggcgagcccggcuccaucggccuccccggccagcccggcguccccggcgaggacggcgccgccggcaagaagggcgaggccggccuccccggcgcccgcggccccgagggcccccccggcaagggccagcccggccccaagggcgacgagggcaagaagggcuccaagggcaaccagggccagcgcggccuccccggccccgagggccccaagggcgagcccggcaucaugggccccuucggcaugcccggcaccuccauccccggcccccccggccccaagggcgaccgcggcggccccggcauccccggcuucaagggcgagcccggccucuccauccgcggccccaagggcguccagggcccccgcggccccgucggcgcccccggccucaagggcgacggcuaccccggcguccccggcccccgcggccuccccggcccccccggccccaugggccuccgcggcgucggcgacaccggcgccaagggcgagcccggcguccgcggcccccccggccccuccggcccccgcggcgucggcacccagggccccaagggcgacaccggccagaagggccuccccggcccccccggcccccccggcuacggcucccagggcaucaagggcgagcagggcccccagggcuuccccggccccaagggcaccaugggccacggccuccccggccagaagggcgagcacggcgagcgcggcgacgucggcaagaagggcgacaagggcgagaucggcgagcccggcucccccggcaagcagggccuccagggccccaagggcgaccucggccucaccaaggaggagaucaucaagcucaucaccgagaucugcggcugcggccccaagugcaaggagaccccccucgagcucgucuucgucaucgacuccuccgaguccgucggccccgagaacuuccagaucaucaagaacuucgucaagaccauggccgaccgcgucgcccucgaccucgccaccgcccgcaucggcaucaucaacuacucccacaaggucgagaaggucgccaaccucaagcaguucuccuccaaggacgacuucaagcucgccgucgacaacaugcaguaccucggcgagggcaccuacaccgccaccgcccuccaggccgccaacgacauguucgaggacgcccgccccggcgucaagaaggucgcccucgucaucaccgacggccagaccgacucccgcgacaaggagaagcucaccgaggucgucaagaacgccuccgacaccaacgucgagaucuucgucaucggcgucgucaagaagaacgaccccaacuucgagaucuuccacaaggagaugaaccucaucgccaccgaccccgagcacgucuaccaguucgacgacuucuucacccuccaggacacccucaagcagaagcucuuccagaagaucugcgaggacuucgacuccuaccucguccagaucuucggcuccuccuccccccagcccggcuucggcauguccggcgaggagcucuccgaguccacccccgagccccagaaggagaucuccgagucccucuccgucacccgcgaccaggacgaggacgacaaggcccccgagcccaccugggccgacgaccuccccgccaccaccuccuccgaggccaccaccaccccccgcccccuccucuccacccccgucgacggcgccgaggacccccgcugccucgaggcccucaagcccggcaacugcggcgaguacgucguccgcugguacuacgacaagcaggucaacuccugcgcccgcuucugguucuccggcugcaacggcuccggcaaccgcuucaacuccgagaaggagugccaggagaccugcauccagggcuga

SEQ ID NO: 41585 - RNA, 4464 nt, Artificial Sequence
  derived and/or modified sequence opt2 from COL2A1__Homo_sapiens__NP_001835
augauccgccucggcgccccccagacccucguccuccucacccuccucgucgccgccguccuccgcugccagggccaggacguccaggaggccggcuccugcguccaggacggccagcgcuacaacgacaaggacgucuggaagcccgagcccugccgcaucugcgucugcgacaccggcaccguccucugcgacgacaucaucugcgaggacgucaaggacugccucucccccgagauccccuucggcgagugcugccccaucugccccaccgaccucgccaccgccuccggccagcccggccccaagggccagaagggcgagcccggcgacaucaaggacaucgucggccccaagggcccccccggcccccagggccccgccggcgagcagggcccccgcggcgaccgcggcgacaagggcgagaagggcgcccccggcccccgcggccgcgacggcgagcccggcacccccggcaaccccggcccccccggcccccccggcccccccggcccccccggccucggcggcaacuucgccgcccagauggccggcggcuucgacgagaaggccggcggcgcccagcucggcgucaugcagggccccaugggccccaugggcccccgcggcccccccggccccgccggcgcccccggcccccagggcuuccagggcaaccccggcgagcccggcgagcccggcgucuccggccccaugggcccccgcggcccccccggcccccccggcaagcccggcgacgacggcgaggccggcaagcccggcaaggccggcgagcgcggcccccccggcccccagggcgcccgcggcuuccccggcacccccggccuccccggcgucaagggccaccgcggcuaccccggccucgacggcgccaagggcgaggccggcgcccccggcgucaagggcgaguccggcucccccggcgagaacggcucccccggccccaugggcccccgcggccuccccggcgagcgcggccgcaccggccccgccggcgccgccggcgcccgcggcaacgacggccagcccggccccgccggcccccccggccccgucggccccgccggcggccccggcuuccccggcgcccccggcgccaagggcgaggccggccccaccggcgcccgcggccccgagggcgcccagggcccccgcggcgagcccggcacccccggcucccccggccccgccggcgccuccggcaaccccggcaccgacggcauccccggcgccaagggcuccgccggcgcccccggcaucgccggcgcccccggcuuccccggcccccgcggcccccccggcccccagggcgccaccggcccccucggccccaagggccagaccggcgagcccggcaucgccggcuucaagggcgagcagggccccaagggcgagcccggccccgccggcccccagggcgcccccggccccgccggcgaggagggcaagcgcggcgcccgcggcgagcccggcggcgucggccccaucggcccccccggcgagcgcggcgcccccggcaaccgcggcuuccccggccaggacggccucgccggccccaagggcgcccccggcgagcgcggccccuccggccucgccggccccaagggcgccaacggcgaccccggccgccccggcgagcccggccuccccggcgcccgcggccucaccggccgccccggcgacgccggcccccagggcaaggucggccccuccggcgcccccggcgaggacggccgccccggcccccccggcccccagggcgcccgcggccagcccggcgucaugggcuuccccggccccaagggcgccaacggcgagcccggcaaggccggcgagaagggccuccccggcgcccccggccuccgcggccuccccggcaaggacggcgagaccggcgccgccggcccccccggccccgccggccccgccggcgagcgcggcgagcagggcgcccccggccccuccggcuuccagggccuccccggcccccccggcccccccggcgagggcggcaagcccggcgaccagggcguccccggcgaggccggcgcccccggccucgucggcccccgcggcgagcgcggcuuccccggcgagcgcggcucccccggcgcccagggccuccagggcccccgcggccuccccggcacccccggcaccgacggccccaagggcgccuccggccccgccggcccccccggcgcccagggcccccccggccuccagggcaugcccggcgagcgcggcgccgccggcaucgccggccccaagggcgaccgcggcgacgucggcgagaagggccccgagggcgcccccggcaaggacggcggccgcggccucaccggccccaucggcccccccggccccgccggcgccaacggcgagaagggcgaggucggcccccccggccccgccggcuccgccggcgcccgcggcgcccccggcgagcgcggcgagaccggcccccccggccccgccggcuucgccggcccccccggcgccgacggccagcccggcgccaagggcgagcagggcgaggccggccagaagggcgacgccggcgcccccggcccccagggccccuccggcgcccccggcccccagggccccaccggcgucaccggccccaagggcgcccgcggcgcccagggcccccccggcgccaccggcuuccccggcgccgccggccgcgucggcccccccggcuccaacggcaaccccggcccccccggcccccccggccccuccggcaaggacggccccaagggcgcccgcggcgacuccggcccccccggccgcgccggcgagcccggccuccagggccccgccggcccccccggcgagaagggcgagcccggcgacgacggccccuccggcgccgagggcccccccggcccccagggccucgccggccagcgcggcaucgucggccuccccggccagcgcggcgagcgcggcuuccccggccuccccggccccuccggcgagcccggcaagcagggcgcccccggcgccuccggcgaccgcggcccccccggccccgucggcccccccggccucaccggccccgccggcgagcccggccgcgagggcucccccggcgccgacggcccccccggccgcgacggcgccgccggcgucaagggcgaccgcggcgagaccggcgccgucggcgcccccggcgcccccggcccccccggcucccccggccccgccggccccaccggcaagcagggcgaccgcggcgaggccggcgcccagggccccaugggccccuccggccccgccggcgcccgcggcauccagggcccccagggcccccgcggcgacaagggcgaggccggcgagcccggcgagcgcggccucaagggccaccgcggcuucaccggccuccagggccuccccggcccccccggccccuccggcgaccagggcgccuccggccccgccggccccuccggcccccgcggcccccccggccccgucggccccuccggcaaggacggcgccaacggcauccccggccccaucggcccccccggcccccgcggccgcuccggcgagaccggccccgccggcccccccggcaaccccggcccccccggcccccccggcccccccggccccggcaucgacauguccgccuucgccggccucggcccccgcgagaagggccccgacccccuccaguacaugcgcgccgaccaggccgccggcggccuccgccagcacgacgccgaggucgacgccacccucaagucccucaacaaccagaucgaguccauccgcucccccgagggcucccgcaagaaccccgcccgcaccugccgcgaccucaagcucugccaccccgaguggaaguccggcgacuacuggaucgaccccaaccagggcugcacccucgacgccaugaaggucuucugcaacauggagaccggcgagaccugcgucuaccccaaccccgccaacguccccaagaagaacuggugguccuccaaguccaaggagaagaagcacaucugguucggcgagaccaucaacggcggcuuccacuucuccuacggcgacgacaaccucgcccccaacaccgccaacguccagaugaccuuccuccgccuccucuccaccgagggcucccagaacaucaccuaccacugcaagaacuccaucgccuaccucgacgaggccgccggcaaccucaagaaggcccuccucauccagggcuccaacgacgucgagauccgcgccgagggcaacucccgcuucaccuacaccgcccucaaggacggcugcaccaagcacaccggcaaguggggcaagaccgucaucgaguaccgcucccagaagaccucccgccuccccaucaucgacaucgcccccauggacaucggcggccccgagcaggaguucggcgucgacaucggccccgucugcuuccucuga

SEQ ID NO: 41586 - RNA, 4401 nt, Artificial Sequence
  derived and/or modified sequence opt2 from COL3A1__Homo_sapiens__NP_000081
augauguccuucguccagaagggcuccuggcuccuccucgcccuccuccaccccaccaucauccucgcccagcaggaggccgucgagggcggcugcucccaccucggccaguccuacgccgaccgcgacgucuggaagcccgagcccugccagaucugcgucugcgacuccggcuccguccucugcgacgacaucaucugcgacgaccaggagcucgacugccccaaccccgagauccccuucggcgagugcugcgccgucugcccccagccccccaccgcccccacccgcccccccaacggccagggcccccagggccccaagggcgaccccggcccccccggcauccccggccgcaacggcgaccccggcauccccggccagcccggcucccccggcucccccggcccccccggcaucugcgaguccugccccaccggcccccagaacuacuccccccaguacgacuccuacgacgucaaguccggcgucgccgucggcggccucgccggcuaccccggccccgccggcccccccggcccccccggcccccccggcaccuccggccaccccggcucccccggcucccccggcuaccagggcccccccggcgagcccggccaggccggccccuccggcccccccggcccccccggcgccaucggccccuccggccccgccggcaaggacggcgaguccggccgccccggccgccccggcgagcgcggccuccccggcccccccggcaucaagggccccgccggcauccccggcuuccccggcaugaagggccaccgcggcuucgacggccgcaacggcgagaagggcgagaccggcgcccccggccucaagggcgagaacggccuccccggcgagaacggcgcccccggccccaugggcccccgcggcgcccccggcgagcgcggccgccccggccuccccggcgccgccggcgcccgcggcaacgacggcgcccgcggcuccgacggccagcccggcccccccggcccccccggcaccgccggcuuccccggcucccccggcgccaagggcgaggucggccccgccggcucccccggcuccaacggcgcccccggccagcgcggcgagcccggcccccagggccacgccggcgcccagggcccccccggcccccccggcaucaacggcucccccggcggcaagggcgagaugggccccgccggcauccccggcgcccccggccucaugggcgcccgcggcccccccggccccgccggcgccaacggcgcccccggccuccgcggcggcgccggcgagcccggcaagaacggcgccaagggcgagcccggcccccgcggcgagcgcggcgaggccggcauccccggcguccccggcgccaagggcgaggacggcaaggacggcucccccggcgagcccggcgccaacggccuccccggcgccgccggcgagcgcggcgcccccggcuuccgcggccccgccggccccaacggcauccccggcgagaagggccccgccggcgagcgcggcgcccccggccccgccggcccccgcggcgccgccggcgagcccggccgcgacggcguccccggcggccccggcaugcgcggcaugcccggcucccccggcggccccggcuccgacggcaagcccggcccccccggcucccagggcgaguccggccgccccggcccccccggccccuccggcccccgcggccagcccggcgucaugggcuuccccggccccaagggcaacgacggcgcccccggcaagaacggcgagcgcggcggccccggcggccccggcccccagggcccccccggcaagaacggcgagaccggcccccagggcccccccggccccaccggccccggcggcgacaagggcgacaccggcccccccggcccccagggccuccagggccuccccggcaccggcggcccccccggcgagaacggcaagcccggcgagcccggccccaagggcgacgccggcgcccccggcgcccccggcggcaagggcgacgccggcgcccccggcgagcgcggcccccccggccucgccggcgcccccggccuccgcggcggcgccggcccccccggccccgagggcggcaagggcgccgccggcccccccggcccccccggcgccgccggcacccccggccuccagggcaugcccggcgagcgcggcggccucggcucccccggccccaagggcgacaagggcgagcccggcggccccggcgccgacggcguccccggcaaggacggcccccgcggccccaccggccccaucggcccccccggccccgccggccagcccggcgacaagggcgagggcggcgcccccggccuccccggcaucgccggcccccgcggcucccccggcgagcgcggcgagaccggcccccccggccccgccggcuuccccggcgcccccggccagaacggcgagcccggcggcaagggcgagcgcggcgcccccggcgagaagggcgagggcggcccccccggcgucgccggcccccccggcggcuccggccccgccggcccccccggcccccagggcgucaagggcgagcgcggcucccccggcggccccggcgccgccggcuuccccggcgcccgcggccuccccggcccccccggcuccaacggcaaccccggcccccccggccccuccggcucccccggcaaggacggcccccccggccccgccggcaacaccggcgcccccggcucccccggcgucuccggccccaagggcgacgccggccagcccggcgagaagggcucccccggcgcccagggcccccccggcgcccccggcccccucggcaucgccggcaucaccggcgcccgcggccucgccggcccccccggcaugcccggcccccgcggcucccccggcccccagggcgucaagggcgaguccggcaagcccggcgccaacggccucuccggcgagcgcggcccccccggcccccagggccuccccggccucgccggcaccgccggcgagcccggccgcgacggcaaccccggcuccgacggccuccccggccgcgacggcucccccggcggcaagggcgaccgcggcgagaacggcucccccggcgcccccggcgcccccggccaccccggcccccccggccccgucggccccgccggcaaguccggcgaccgcggcgaguccggccccgccggccccgccggcgcccccggccccgccggcucccgcggcgcccccggcccccagggcccccgcggcgacaagggcgagaccggcgagcgcggcgccgccggcaucaagggccaccgcggcuuccccggcaaccccggcgcccccggcucccccggccccgccggccagcagggcgccaucggcucccccggccccgccggcccccgcggccccgucggccccuccggcccccccggcaaggacggcaccuccggccaccccggccccaucggcccccccggcccccgcggcaaccgcggcgagcgcggcuccgagggcucccccggccaccccggccagcccggcccccccggcccccccggcgcccccggccccugcugcggcggcgucggcgccgccgccaucgccggcaucggcggcgagaaggccggcggcuucgcccccuacuacggcgacgagcccauggacuucaagaucaacaccgacgagaucaugaccucccucaaguccgucaacggccagaucgagucccucaucucccccgacggcucccgcaagaaccccgcccgcaacugccgcgaccucaaguucugccaccccgagcucaaguccggcgaguacugggucgaccccaaccagggcugcaagcucgacgccaucaaggucuucugcaacauggagaccggcgagaccugcaucuccgccaacccccucaacgucccccgcaagcacugguggaccgacuccuccgccgagaagaagcacgucugguucggcgaguccauggacggcggcuuccaguucuccuacggcaaccccgagcuccccgaggacguccucgacguccagcucgccuuccuccgccuccucuccucccgcgccucccagaacaucaccuaccacugcaagaacuccaucgccuacauggaccaggccuccggcaacgucaagaaggcccucaagcucaugggcuccaacgagggcgaguucaaggccgagggcaacuccaaguucaccuacaccguccucgaggacggcugcaccaagcacaccggcgagugguccaagaccgucuucgaguaccgcacccgcaaggccguccgccuccccaucgucgacaucgcccccuacgacaucggcggccccgaccaggaguucggcgucgacgucggccccgucugcuuccucuga

SEQ ID NO: 41587 - RNA, 1560 nt, Artificial Sequence
  derived and/or modified sequence opt2 from COL4A1__Homo_sapiens__NP_001290039
augggcccccgccucuccgucuggcuccuccuccuccccgccgcccuccuccuccacgaggagcacucccgcgccgccgccaagggcggcugcgccggcuccggcugcggcaagugcgacugccacggcgucaagggccagaagggcgagcgcggccuccccggccuccagggcgucaucggcuuccccggcaugcagggccccgagggcccccagggcccccccggccagaagggcgacaccggcgagcccggccuccccggcaccaagggcacccgcggcccccccggcgccuccggcuaccccggcaaccccggccuccccggcauccccggccaggacggcccccccggcccccccggcauccccggcugcaacggcaccaagggcgagcgcggcccccucggcccccccggccuccccggcuucgccggcaaccccggcccccccggccuccccggcaugaagggcgaccccggcgagauccucggccacguccccggcaugcuccucaagggcgagcgcggcuuccccggcauccccggcacccccggcccccccggccuccccggccuccagggccccgucggcccccccggcuucaccggcccccccggcccccccggcccccccggcccccccggcgagaagggccagaugggccucuccuuccagggccccaagggcgacaagggcgaccagggcgucuccggcccccccggcguccccggccaggcccagguccaggagaagggcgacuucgccaccaagggcgagaagggccagaagggcgagcccggcuuccagggcaugcccggcgucggcgagaagggcgagcccggcaagcccggcccccgcggcaagcccggcaaggacggcgacaagggcgagaagggcucccccggcuuccccggcgagcccggcuaccccggccucaucggccgccagggcccccagggcgagaagggcgaggccggcccccccggcccccccggcaucgucaucggcaccggcccccucggcgagaagggcgagcgcggcuaccccggcacccccggcccccgcggcgagcccggccccaagggcuuccccggccuccccggccagcccggcccccccggccuccccguccccggccaggccggcgcccccggcuuccccggcgagcgcggcgagaagggcgaccgcggcuuccccggcaccucccuccccggccccuccggccgcgacggccuccccggcccccccggcucccccggcccccccggccagcccggcuacaccaacggcaucgucgagugccagcccggcccccccggcgaccagggcccccccggcauccccggccagcccggcuucaucggcgagaucggcgagaagggccagaagggcgaguccugccucaucugcgacaucgacggcuaccgcggcccccccggcccccagggcccccccggcgagaucggcuuccccggccagcccggcgccaagggcgaccgcggccuccccggccgcgacggcgucgccggcgucccccuccucuuccagauccacaaguga

SEQ ID NO: 41588 - RNA, 5139 nt, Artificial Sequence
  derived and/or modified sequence opt2 from COL4A2__Homo_sapiens__NP_001837
augggccgcgaccagcgcgccgucgccggccccgcccuccgccgcuggcuccuccucggcaccgucaccgucggcuuccucgcccaguccguccucgccggcgucaagaaguucgacguccccugcggcggccgcgacugcuccggcggcugccagugcuaccccgagaagggcggccgcggccagcccggccccgucggcccccagggcuacaacggcccccccggccuccagggcuuccccggccuccagggccgcaagggcgacaagggcgagcgcggcgcccccggcgucaccggccccaagggcgacgucggcgcccgcggcgucuccggcuuccccggcgccgacggcauccccggccaccccggccagggcggcccccgcggccgccccggcuacgacggcugcaacggcacccagggcgacuccggcccccagggcccccccggcuccgagggcuucaccggcccccccggcccccagggccccaagggccagaagggcgagcccuacgcccuccccaaggaggagcgcgaccgcuaccgcggcgagcccggcgagcccggccucgucggcuuccagggcccccccggccgccccggccacgucggccagaugggccccgucggcgcccccggccgccccggcccccccggcccccccggccccaagggccagcagggcaaccgcggccucggcuucuacggcgucaagggcgagaagggcgacgucggccagcccggccccaacggcauccccuccgacacccuccaccccaucaucgcccccaccggcgucaccuuccaccccgaccaguacaagggcgagaagggcuccgagggcgagcccggcauccgcggcaucucccucaagggcgaggagggcaucaugggcuuccccggccuccgcggcuaccccggccucuccggcgagaagggcucccccggccagaagggcucccgcggccucgacggcuaccagggccccgacggcccccgcggccccaagggcgaggccggcgaccccggcccccccggccuccccgccuacuccccccaccccucccucgccaagggcgcccgcggcgaccccggcuuccccggcgcccagggcgagcccggcucccagggcgagcccggcgaccccggccuccccggcccccccggccucuccaucggcgacggcgaccagcgccgcggccuccccggcgagaugggccccaagggcuucaucggcgaccccggcauccccgcccucuacggcggcccccccggccccgacggcaagcgcggcccccccggcccccccggccuccccggcccccccggccccgacggcuuccucuucggccucaagggcgccaagggccgcgccggcuuccccggccuccccggcucccccggcgcccgcggccccaagggcuggaagggcgacgccggcgagugccgcugcaccgagggcgacgaggccaucaagggccuccccggccuccccggccccaagggcuucgccggcaucaacggcgagcccggccgcaagggcgaccgcggcgaccccggccagcacggccuccccggcuuccccggccucaagggcguccccggcaacaucggcgcccccggccccaagggcgccaagggcgacucccgcaccaucaccaccaagggcgagcgcggccagcccggcguccccggcguccccggcaugaagggcgacgacggcucccccggccgcgacggccucgacggcuuccccggccuccccggcccccccggcgacggcaucaagggcccccccggcgaccccggcuaccccggcauccccggcaccaagggcacccccggcgagaugggcccccccggccucggccuccccggccucaagggccagcgcggcuuccccggcgacgccggccuccccggcccccccggcuuccucggcccccccggccccgccggcacccccggccagaucgacugcgacaccgacgucaagcgcgccgucggcggcgaccgccaggaggccauccagcccggcugcaucggcggccccaagggccuccccggccuccccggcccccccggccccaccggcgccaagggccuccgcggcauccccggcuucgccggcgccgacggcggccccggcccccgcggccuccccggcgacgccggccgcgagggcuuccccggcccccccggcuucaucggcccccgcggcuccaagggcgccgucggccuccccggccccgacggcucccccggccccaucggccuccccggccccgacggcccccccggcgagcgcggccuccccggcgagguccucggcgcccagcccggcccccgcggcgacgccggcguccccggccagcccggccucaagggccuccccggcgaccgcggcccccccggcuuccgcggcucccagggcaugcccggcaugcccggccucaagggccagcccggccuccccggccccuccggccagcccggccucuacggcccccccggccuccacggcuuccccggcgcccccggccaggagggcccccucggccuccccggcauccccggccgcgagggccuccccggcgaccgcggcgaccccggcgacaccggcgcccccggccccgucggcaugaagggccucuccggcgaccgcggcgacgccggcuucaccggcgagcagggccaccccggcucccccggcuucaagggcaucgacggcaugcccggcacccccggccucaagggcgaccgcggcucccccggcauggacggcuuccagggcaugcccggccucaagggccgccccggcuuccccggcuccaagggcgaggccggcuucuucggcauccccggccucaagggccucgccggcgagcccggcuucaagggcucccgcggcgaccccggcccccccggccccccccccgucauccuccccggcaugaaggacaucaagggcgagaagggcgacgagggccccaugggccucaagggcuaccucggcgccaagggcauccagggcaugcccggcauccccggccucuccggcauccccggccuccccggccgccccggccacaucaagggcgucaagggcgacaucggcguccccggcauccccggccuccccggcuuccccggcgucgccggcccccccggcaucaccggcuuccccggcuucaucggcucccgcggcgacaagggcgcccccggccgcgccggccucuacggcgagaucggcgccaccggcgacuucggcgacaucggcgacaccaucaaccuccccggccgccccggccucaagggcgagcgcggcaccaccggcauccccggccucaagggcuucuucggcgagaagggcaccgagggcgacaucggcuuccccggcaucaccggcgucaccggcguccagggcccccccggccucaagggccagaccggcuuccccggccucaccggcccccccggcucccagggcgagcucggccgcaucggccuccccggcggcaagggcgacgacggcuggcccggcgcccccggccuccccggcuuccccggccuccgcggcauccgcggccuccacggccuccccggcaccaagggcuuccccggcucccccggcuccgacauccacggcgaccccggcuuccccggcccccccggcgagcgcggcgaccccggcgaggccaacacccuccccggccccgucggcguccccggccagaagggcgaccagggcgcccccggcgagcgcggcccccccggcucccccggccuccagggcuuccccggcaucaccccccccuccaacaucuccggcgcccccggcgacaagggcgcccccggcaucuucggccucaagggcuaccgcggcccccccggcccccccggcuccgccgcccuccccggcuccaagggcgacaccggcaaccccggcgcccccggcacccccggcaccaagggcugggccggcgacuccggcccccagggccgccccggcgucuucggccuccccggcgagaagggcccccgcggcgagcagggcuucaugggcaacaccggccccaccggcgccgucggcgaccgcggccccaagggccccaagggcgaccccggcuuccccggcgcccccggcaccgucggcgcccccggcaucgccggcaucccccagaagaucgccguccagcccggcaccgucggcccccagggccgccgcggcccccccggcgcccccggcgagaugggcccccagggcccccccggcgagcccggcuuccgcggcgcccccggcaaggccggcccccagggccgcggcggcgucuccgccguccccggcuuccgcggcgacgagggccccaucggccaccagggccccaucggccaggagggcgcccccggccgccccggcucccccggccuccccggcaugcccggccgcuccgucuccaucggcuaccuccucgucaagcacucccagaccgaccaggagcccaugugccccgucggcaugaacaagcucugguccggcuacucccuccucuacuucgagggccaggagaaggcccacaaccaggaccucggccucgccggcuccugccucgcccgcuucuccaccaugcccuuccucuacugcaaccccggcgacgucugcuacuacgccucccgcaacgacaaguccuacuggcucuccaccaccgccccccuccccaugaugcccgucgccgaggacgagaucaagcccuacaucucccgcugcuccgucugcgaggcccccgccaucgccaucgccguccacucccaggacgucuccaucccccacugccccgccggcuggcgcucccucuggaucggcuacuccuuccucaugcacaccgccgccggcgacgagggcggcggccagucccucgucucccccggcuccugccucgaggacuuccgcgccacccccuucaucgagugcaacggcggccgcggcaccugccacuacuacgccaacaaguacuccuucuggcucaccaccauccccgagcaguccuuccagggcucccccuccgccgacacccucaaggccggccucauccgcacccacaucucccgcugccaggucugcaugaagaaccucuga

SEQ ID NO: 41589 - RNA, 2259 nt, Artificial Sequence
  derived and/or modified sequence opt2 from COL4A3BP__Homo_sapiens__NP_001123577
augcagcacuccugcauccccaccccccccucccccuucuccgccccccccgccuuccuccccgucgucacccgcgagucccgccgcggccucuccuccggcggcuccgccggccgcaacgccggcgucaccgccaccgccgccgccgccgacggcuggaagggccgccuccccuccccccucguccuccucccccgcuccgcccgcugccaggcccgccgccgccgcggcggccgcaccuccucccuccuccuccucccccccacccccgagcgcgcccucuucgccucccccucccccgaccccuccccccgcggccucggcgccuccuccggcgccgccgagggcgccggcgccggccuccuccucggcugccgcgccuccauguccgacaaccaguccuggaacuccuccggcuccgaggaggaccccgagaccgaguccggcccccccgucgagcgcugcggcguccucuccaaguggaccaacuacauccacggcuggcaggaccgcugggucguccucaagaacaacgcccucuccuacuacaaguccgaggacgagaccgaguacggcugccgcggcuccaucugccucuccaaggccgucaucaccccccacgacuucgacgagugccgcuucgacaucuccgucaacgacuccgucugguaccuccgcgcccaggaccccgaccaccgccagcaguggaucgacgccaucgagcagcacaagaccgaguccggcuacggcuccgaguccucccuccgccgccacggcuccauggucucccucgucuccggcgccuccggcuacuccgccaccuccaccuccuccuucaagaagggccacucccuccgcgagaagcucgccgagauggagaccuuccgcgacauccucugccgccaggucgacacccuccagaaguacuucgacgccugcgccgacgccgucuccaaggacgagcuccagcgcgacaaggucgucgaggacgacgaggacgacuuccccaccacccgcuccgacggcgacuuccuccacuccaccaacggcaacaaggagaagcucuucccccacgucacccccaagggcaucaacggcaucgacuucaagggcgaggccaucaccuucaaggccaccaccgccggcauccucgccacccucucccacugcaucgagcucauggucaagcgcgaggacuccuggcagaagcgccucgacaaggagaccgagaagaagcgccgcaccgaggaggccuacaagaacgccaugaccgagcucaagaagaagucccacuucggcggccccgacuacgaggagggccccaacucccucaucaacgaggaggaguucuucgacgccgucgaggccgcccucgaccgccaggacaagaucgaggagcagucccaguccgagaagguccgccuccacuggcccaccucccuccccuccggcgacgccuucuccuccgucggcacccaccgcuucguccagaagcccuacucccgcuccuccuccauguccuccaucgaccucgucuccgccuccgacgacguccaccgcuucuccucccaggucgaggagaugguccagaaccacaugaccuacucccuccaggacgucggcggcgacgccaacuggcagcucgucgucgaggagggcgagaugaaggucuaccgccgcgaggucgaggagaacggcaucguccucgacccccucaaggccacccacgccgucaagggcgucaccggccacgaggucugcaacuacuucuggaacgucgacguccgcaacgacugggagaccaccaucgagaacuuccacgucgucgagacccucgccgacaacgccaucaucaucuaccagacccacaagcgcgucuggcccgccucccagcgcgacguccucuaccucuccgucauccgcaagauccccgcccucaccgagaacgaccccgagaccuggaucgucugcaacuucuccgucgaccacgacuccgccccccucaacaaccgcugcguccgcgccaagaucaacgucgccaugaucugccagacccucgucuccccccccgagggcaaccaggagaucucccgcgacaacauccucugcaagaucaccuacgucgccaacgucaaccccggcggcugggcccccgccuccguccuccgcgccgucgccaagcgcgaguaccccaaguuccucaagcgcuucaccuccuacguccaggagaagaccgccggcaagcccauccucuucuga

SEQ ID NO: 41590 - RNA, 5013 nt, Artificial Sequence
  derived and/or modified sequence opt2 from COL4A3__Homo_sapiens__NP_000082
auguccgcccgcaccgccccccgcccccagguccuccuccucccccuccuccucguccuccucgccgccgcccccgccgccuccaagggcugcgucugcaaggacaagggccagugcuucugcgacggcgccaagggcgagaagggcgagaagggcuuccccggcccccccggcucccccggccagaagggcuucaccggccccgagggccuccccggcccccagggccccaagggcuuccccggccuccccggccucaccggcuccaagggcguccgcggcaucuccggccuccccggcuucuccggcucccccggccuccccggcacccccggcaacaccggccccuacggccucgucggcguccccggcugcuccggcuccaagggcgagcagggcuuccccggccuccccggcacccucggcuaccccggcauccccggcgccgccggccucaagggccagaagggcgcccccgccaaggaggaggacaucgagcucgacgccaagggcgaccccggccuccccggcgcccccggcccccagggccuccccggcccccccggcuuccccggccccgucggcccccccggcccccccggcuucuucggcuuccccggcgccaugggcccccgcggccccaagggccacaugggcgagcgcgucaucggccacaagggcgagcgcggcgucaagggccucaccggcccccccggcccccccggcaccgucaucgucacccucaccggccccgacaaccgcaccgaccucaagggcgagaagggcgacaagggcgccaugggcgagcccggcccccccggccccuccggccuccccggcgaguccuacggcuccgagaagggcgcccccggcgaccccggccuccagggcaagcccggcaaggacggcguccccggcuuccccggcuccgagggcgucaagggcaaccgcggcuuccccggccucaugggcgaggacggcaucaagggccagaagggcgacaucggcccccccggcuuccgcggccccaccgaguacuacgacaccuaccaggagaagggcgacgagggcacccccggcccccccggcccccgcggcgcccgcggcccccagggccccuccggcccccccggcguccccggcucccccggcuccucccgccccggccuccgcggcgcccccggcuggcccggccucaagggcuccaagggcgagcgcggccgccccggcaaggacgccaugggcacccccggcucccccggcugcgccggcucccccggccuccccggcucccccggcccccccggcccccccggcgacaucgucuuccgcaagggcccccccggcgaccacggccuccccggcuaccucggcucccccggcauccccggcgucgacggccccaagggcgagcccggccuccucugcacccagugccccuacauccccggcccccccggccuccccggccuccccggccuccacggcgucaagggcauccccggccgccagggcgccgccggccucaagggcucccccggcucccccggcaacaccggccuccccggcuuccccggcuuccccggcgcccagggcgaccccggccucaagggcgagaagggcgagacccuccagcccgagggccaggucggcguccccggcgaccccggccuccgcggccagcccggccgcaagggccucgacggcauccccggcacccccggcgucaagggccuccccggccccaagggcgagcucgcccucuccggcgagaagggcgaccagggcccccccggcgaccccggcucccccggcucccccggccccgccggccccgccggcccccccggcuacggcccccagggcgagcccggccuccagggcacccagggcguccccggcgcccccggcccccccggcgaggccggcccccgcggcgagcucuccgucuccacccccguccccggcccccccggcccccccggcccccccggccaccccggcccccagggcccccccggcauccccggcucccucggcaagugcggcgaccccggccuccccggccccgacggcgagcccggcauccccggcaucggcuuccccggcccccccggccccaagggcgaccagggcuuccccggcaccaagggcucccucggcugccccggcaagaugggcgagcccggccuccccggcaagcccggccuccccggcgccaagggcgagcccgccgucgccaugcccggcggccccggcacccccggcuuccccggcgagcgcggcaacuccggcgagcacggcgagaucggccuccccggccuccccggccuccccggcacccccggcaacgagggccucgacggcccccgcggcgaccccggccagcccggcccccccggcgagcagggcccccccggccgcugcaucgagggcccccgcggcgcccagggccuccccggccucaacggccucaagggccagcagggccgccgcggcaagaccggccccaagggcgaccccggcauccccggccucgaccgcuccggcuuccccggcgagaccggcucccccggcauccccggccaccagggcgagaugggcccccucggccagcgcggcuaccccggcaaccccggcauccucggcccccccggcgaggacggcgucaucggcaugaugggcuuccccggcgccaucggcccccccggcccccccggcaaccccggcacccccggccagcgcggcucccccggcauccccggcgucaagggccagcgcggcacccccggcgccaagggcgagcagggcgacaagggcaaccccggccccuccgagaucucccacgucaucggcgacaagggcgagcccggccucaagggcuucgccggcaaccccggcgagaagggcaaccgcggcguccccggcaugcccggccucaagggccucaagggccuccccggccccgccggcccccccggcccccgcggcgaccucggcuccaccggcaaccccggcgagcccggccuccgcggcauccccggcuccaugggcaacaugggcaugcccggcuccaagggcaagcgcggcacccucggcuuccccggccgcgccggccgccccggccuccccggcauccacggccuccagggcgacaagggcgagcccggcuacuccgagggcacccgccccggcccccccggccccaccggcgaccccggccuccccggcgacaugggcaagaagggcgagaugggccagcccggcccccccggccaccucggccccgccggccccgagggcgcccccggcucccccggcucccccggccuccccggcaagcccggcccccacggcgaccucggcuucaagggcaucaagggccuccucggcccccccggcauccgcggcccccccggccuccccggcuuccccggcucccccggccccaugggcauccgcggcgaccagggccgcgacggcauccccggccccgccggcgagaagggcgagaccggccuccuccgcgccccccccggcccccgcggcaaccccggcgcccagggcgccaagggcgaccgcggcgcccccggcuuccccggccuccccggccgcaagggcgccaugggcgacgccggcccccgcggccccaccggcaucgagggcuuccccggcccccccggccuccccggcgccaucauccccggccagaccggcaaccgcggcccccccggcucccgcggcucccccggcgcccccggcccccccggcccccccggcucccacgucaucggcaucaagggcgacaagggcuccaugggccaccccggccccaagggcccccccggcaccgccggcgacaugggcccccccggccgccucggcgcccccggcacccccggccuccccggcccccgcggcgaccccggcuuccagggcuuccccggcgucaagggcgagaagggcaaccccggcuuccucggcuccaucggcccccccggccccaucggccccaagggcccccccggcguccgcggcgaccccggcacccucaagaucaucucccuccccggcucccccggcccccccggcacccccggcgagcccggcaugcagggcgagcccggcccccccggcccccccggcaaccucggccccugcggcccccgcggcaagcccggcaaggacggcaagcccggcacccccggccccgccggcgagaagggcaacaagggcuccaagggcgagcccggccccgccggcuccgacggccuccccggccucaagggcaagcgcggcgacuccggcucccccgccaccuggaccacccgcggcuucgucuucacccgccacucccagaccaccgccauccccuccugccccgagggcaccgucccccucuacuccggcuucuccuuccucuucguccagggcaaccagcgcgcccacggccaggaccucggcacccucggcuccugccuccagcgcuucaccaccaugcccuuccucuucugcaacgucaacgacgucugcaacuucgccucccgcaacgacuacuccuacuggcucuccacccccgcccucaugcccaugaacauggcccccaucaccggccgcgcccucgagcccuacaucucccgcugcaccgucugcgagggccccgccaucgccaucgccguccacucccagaccaccgacaucccccccugcccccacggcuggaucucccucuggaagggcuucuccuucaucauguucaccuccgccggcuccgagggcaccggccaggcccucgccucccccggcuccugccucgaggaguuccgcgccucccccuuccucgagugccacggccgcggcaccugcaacuacuacuccaacuccuacuccuucuggcucgccucccucaaccccgagcgcauguuccgcaagcccauccccuccaccgucaaggccggcgagcucgagaagaucaucucccgcugccaggucugcaugaagaagcgccacuga

SEQ ID NO: 41591 - RNA, 5073 nt, Artificial Sequence
  derived and/or modified sequence opt2 from COL4A4__Homo_sapiens__XP_005246338
auguggucccuccacaucguccucaugcgcugcuccuuccgccucaccaagucccucgccaccggccccuggucccucauccucauccucuucuccguccaguacgucuacggcuccggcaagaaguacaucggccccugcggcggccgcgacugcuccgucugccacugcguccccgagaagggcucccgcggcccccccggcccccccggcccccagggccccaucggcccccucggcgcccccggccccaucggccucuccggcgagaagggcaugcgcggcgaccgcggcccccccggcgccgccggcgacaagggcgacaagggccccaccggcguccccggcuuccccggccucgacggcauccccggccaccccggcccccccggcccccgcggcaagcccggcauguccggccacaacggcucccgcggcgaccccggcuuccccggcggccgcggcgcccucggccccggcggcccccucggccaccccggcgagaagggcgagaagggcaacuccgucuucauccucggcgccgucaagggcauccagggcgaccgcggcgaccccggccuccccggccuccccggcuccuggggcgccggcggccccgccggccccaccggcuaccccggcgagcccggccucgucggcccccccggccagcccggccgccccggccucaagggcaaccccggcgucggcgucaagggccagaugggcgaccccggcgaggucggccagcagggcucccccggccccacccuccucgucgagccccccgacuucugccucuacaagggcgagaagggcaucaagggcauccccggcauggucggccuccccggcccccccggccgcaagggcgaguccggcaucggcgccaagggcgagaagggcauccccggcuuccccggcccccgcggcgaccccggcuccuacggcucccccggcuuccccggccucaagggcgagcucggccucgucggcgaccccggccucuucggccucaucggccccaagggcgaccccggcaaccgcggccaccccggcccccccggcguccucgucacccccccccucccccucaagggcccccccggcgaccccggcuuccccggccgcuacggcgagaccggcgacgucggcccccccggcccccccggccuccucggccgccccggcgaggccugcgccggcaugaucggcccccccggcccccagggcuuccccggccuccccggccuccccggcgaggccggcauccccggccgccccgacuccgcccccggcaagcccggcaagcccggcucccccggccuccccggcgcccccggccuccagggccuccccggcuccuccgucaucuacugcuccgucggcaaccccggcccccagggcaucaagggcaaggucggcccccccggcggccgcggccccaagggcgagaagggcaacgagggccucugcgccugcgagcccggccccaugggcccccccggcccccccggccuccccggccgccagggcuccaagggcgaccucggccuccccggcuggcucggcaccaagggcgaccccggcccccccggcgccgagggcccccccggccuccccggcaagcacggcgccuccggcccccccggcaacaagggcgccaagggcgacauggucgucucccgcgucaagggccacaagggcgagcgcggccccgacggcccccccggcuuccccggccagcccggcucccacggccgcgacggccacgccggcgagaagggcgaccccggcccccccggcgaccacgaggacgccacccccggcggcaagggcuuccccggcccccucggcccccccggcaaggccggccccgucggcccccccggccucggcuuccccggcccccccggcgagcgcggccaccccggcguccccggccaccccggcguccgcggccccgacggccucaagggccagaagggcgacaccaucuccugcaacgucaccuaccccggccgccacggcccccccggcuucgacggcccccccggccccaagggcuuccccggcccccagggcgcccccggccucuccggcuccgacggccacaagggccgccccggcacccccggcaccgccgagauccccggcccccccggcuuccgcggcgacaugggcgaccccggcuucggcggcgagaagggcuccucccccgucggcccccccggcccccccggcucccccggcgucaacggccagaagggcauccccggcgaccccgccuucggccaccucggcccccccggcaagcgcggccucuccggcguccccggcaucaagggcccccgcggcgaccccggcugccccggcgccgagggccccgccggcauccccggcuuccucggccucaagggccccaagggccgcgagggccacgccggcuuccccggcguccccggcccccccggccacuccugcgagcgcggcgcccccggcauccccggccagcccggccuccccggcuaccccggcucccccggcgcccccggcggcaagggccagcccggcgacgucggcccccccggccccgccggcaugaagggccuccccggccuccccggccgccccggcgcccacggcccccccggccuccccggcauccccggccccuucggcgacgacggccuccccggcccccccggccccaagggcccccgcggccuccccggcuuccccggcuuccccggcgagcgcggcaagcccggcgccgagggcugccccggcgccaagggcgagcccggcgagaagggcauguccggccuccccggcgaccgcggccuccgcggcgccaagggcgccaucggcccccccggcgacgagggcgagauggccaucaucucccagaagggcacccccggcgagcccggcccccccggcgacgacggcuuccccggcgagcgcggcgacaagggcacccccggcaugcagggccgccgcggcgagcccggccgcuacggcccccccggcuuccaccgcggcgagcccggcgagaagggccagcccggcccccccggcccccccggcccccccggcuccaccggccuccgcggcuucaucggcuuccccggccuccccggcgaccagggcgagcccggcucccccggcccccccggcuucuccggcaucgacggcgcccgcggccccaagggcaacaagggcgaccccgccucccacuucggcccccccggccccaagggcgagcccggcucccccggcugccccggccacuucggcgccuccggcgagcagggccuccccggcauccagggcccccgcggcucccccggccgccccggcccccccggcuccuccggcccccccggcugccccggcgaccacggcaugcccggccuccgcggccagcccggcgagaugggcgaccccggcccccgcggccuccagggcgaccccggcauccccggcccccccggcaucaagggccccuccggcucccccggccucaacggccuccacggccucaagggccagaagggcaccaagggcgccuccggccuccacgacgucggcccccccggccccgucggcauccccggccucaagggcgagcgcggcgaccccggcucccccggcaucuccccccccggcccccgcggcaagaagggcccccccggcccccccggcuccuccggcccccccggccccgccggcgccaccggccgcgcccccaaggacauccccgaccccggcccccccggcgaccagggcccccccggccccgacggcccccgcggcgcccccggcccccccggccuccccggcuccgucgaccuccuccgcggcgagcccggcgacugcggccuccccggcccccccggcccccccggcccccccggcccccccggcuacaagggcuuccccggcugcgacggcaaggacggccagaagggccccgucggcuuccccggcccccagggcccccacggcuuccccggcccccccggcgagaagggccuccccggcccccccggccgcaagggccccaccggccuccccggcccccgcggcgagcccggcccccccgccgacgucgacgacugcccccgcauccccggccuccccggcgcccccggcaugcgcggccccgagggcgccaugggccuccccggcaugcgcggccccuccggccccggcugcaagggcgagcccggccucgacggccgccgcggcgucgacggcguccccggcucccccggcccccccggccgcaagggcgacaccggcgaggacggcuaccccggcggccccggcccccccggccccaucggcgaccccggccccaagggcuucggccccggcuaccucggcggcuuccuccucguccuccacucccagaccgaccaggagcccaccugcccccucggcaugccccgccucuggaccggcuacucccuccucuaccucgagggccaggagaaggcccacaaccaggaccucggccucgccggcuccugccuccccgucuucuccacccuccccuucgccuacugcaacauccaccaggucugccacuacgcccagcgcaacgaccgcuccuacuggcucgccuccgccgccccccuccccaugaugccccucuccgaggaggccauccgccccuacgucucccgcugcgccgucugcgaggcccccgcccaggccgucgccguccacucccaggaccaguccaucccccccugcccccagaccuggcgcucccucuggaucggcuacuccuuccucaugcacaccggcgccggcgaccagggcggcggccaggcccucaugucccccggcuccugccucgaggacuuccgcgccgcccccuuccucgagugccagggccgccagggcaccugccacuucuucgccaacaaguacuccuucuggcucaccaccgucaaggccgaccuccaguucuccuccgcccccgcccccgacacccucaaggagucccaggcccagcgccagaagaucucccgcugccaggucugcgucaaguacuccuga

SEQ ID NO: 41592 - RNA, 5058 nt, Artificial Sequence
  derived and/or modified sequence opt2 from COL4A5__Homo_sapiens__NP_000486
augaagcuccgcggcgucucccucgccgccggccucuuccuccucgcccucucccucuggggccagcccgccgaggccgccgccugcuacggcugcucccccggcuccaagugcgacugcuccggcaucaagggcgagaagggcgagcgcggcuuccccggccucgagggccaccccggccuccccggcuuccccggccccgagggcccccccggcccccgcggccagaagggcgacgacggcauccccggcccccccggccccaagggcauccgcggcccccccggccuccccggcuuccccggcacccccggccuccccggcaugcccggccacgacggcgcccccggcccccagggcauccccggcugcaacggcaccaagggcgagcgcggcuuccccggcucccccggcuuccccggccuccagggcccccccggcccccccggcauccccggcaugaagggcgagcccggcuccaucaucauguccucccuccccggccccaagggcaaccccggcuaccccggcccccccggcauccagggccuccccggccccaccggcauccccggccccaucggcccccccggcccccccggccucaugggcccccccggcccccccggccuccccggccccaagggcaacaugggccucaacuuccagggccccaagggcgagaagggcgagcagggccuccagggcccccccggcccccccggccagaucuccgagcagaagcgccccaucgacgucgaguuccagaagggcgaccagggccuccccggcgaccgcggcccccccggcccccccggcauccgcggcccccccggcccccccggcggcgagaagggcgagaagggcgagcagggcgagcccggcaagcgcggcaagcccggcaaggacggcgagaacggccagcccggcauccccggccuccccggcgaccccggcuaccccggcgagcccggccgcgacggcgagaagggccagaagggcgacaccggcccccccggcccccccggccucgucaucccccgccccggcaccggcaucaccaucggcgagaagggcaacaucggccuccccggccuccccggcgagaagggcgagcgcggcuuccccggcauccagggcccccccggccuccccggcccccccggcgccgccgucaugggcccccccggcccccccggcuuccccggcgagcgcggccagaagggcgacgagggcccccccggcaucuccauccccggcccccccggccucgacggccagcccggcgcccccggccuccccggcccccccggccccgccggcccccacaucccccccuccgacgagaucugcgagcccggcccccccggcccccccggcucccccggcgacaagggccuccagggcgagcagggcgucaagggcgacaagggcgacaccugcuucaacugcaucggcaccggcaucuccggcccccccggccagcccggccuccccggccuccccggcccccccggcucccucggcuuccccggccagaagggcgagaagggccaggccggcgccaccggccccaagggccuccccggcauccccggcgcccccggcgcccccggcuuccccggcuccaagggcgagcccggcgacauccucaccuuccccggcaugaagggcgacaagggcgagcucggcucccccggcgcccccggccuccccggccuccccggcacccccggccaggacggccuccccggccuccccggccccaagggcgagcccggcggcaucaccuucaagggcgagcgcggcccccccggcaaccccggccuccccggccuccccggcaacaucggccccaugggcccccccggcuucggcccccccggccccgucggcgagaagggcauccagggcgucgccggcaaccccggccagcccggcauccccggccccaagggcgaccccggccagaccaucacccagcccggcaagcccggccuccccggcaaccccggccgcgacggcgacgucggccuccccggcgaccccggccuccccggccagcccggccuccccggcauccccggcuccaagggcgagcccggcauccccggcaucggccuccccggcccccccggccccaagggcuuccccggcauccccggcccccccggcgcccccggcacccccggccgcaucggccucgagggcccccccggcccccccggcuuccccggccccaagggcgagcccggcuucgcccuccccggcccccccggcccccccggccuccccggcuucaagggcgcccucggccccaagggcgaccgcggcuuccccggcccccccggcccccccggccgcaccggccucgacggccuccccggccccaagggcgacgucggccccaacggccagcccggccccaugggcccccccggccuccccggcaucggcguccagggcccccccggcccccccggcauccccggccccaucggccagcccggccuccacggcauccccggcgagaagggcgaccccggcccccccggccucgacguccccggcccccccggcgagcgcggcucccccggcauccccggcgcccccggccccaucggcccccccggcucccccggccuccccggcaaggccggcgccuccggcuuccccggcaccaagggcgagaugggcaugaugggcccccccggcccccccggcccccucggcauccccggccgcuccggcguccccggccucaagggcgacgacggccuccagggccagcccggccuccccggccccaccggcgagaagggcuccaagggcgagcccggccuccccggcccccccggccccauggaccccaaccuccucggcuccaagggcgagaagggcgagcccggccuccccggcauccccggcgucuccggccccaagggcuaccagggccuccccggcgaccccggccagcccggccucuccggccagcccggccuccccggcccccccggccccaagggcaaccccggccuccccggccagcccggccucaucggcccccccggccucaagggcaccaucggcgacaugggcuuccccggcccccagggcgucgagggcccccccggccccuccggcguccccggccagcccggcucccccggccuccccggccagaagggcgacaagggcgaccccggcaucuccuccaucggccuccccggccuccccggccccaagggcgagcccggccuccccggcuaccccggcaaccccggcaucaagggcuccgucggcgaccccggccuccccggccuccccggcacccccggcgccaagggccagcccggccuccccggcuuccccggcacccccggcccccccggccccaagggcaucuccggcccccccggcaaccccggccuccccggcgagcccggccccgucggcggcggcggccaccccggccagcccggcccccccggcgagaagggcaagcccggccaggacggcauccccggccccgccggccagaagggcgagcccggccagcccggcuucggcaaccccggcccccccggccuccccggccucuccggccagaagggcgacggcggccuccccggcauccccggcaaccccggccuccccggccccaagggcgagcccggcuuccacggcuuccccggcguccagggcccccccggcccccccggcucccccggccccgcccucgagggccccaagggcaaccccggcccccagggcccccccggccgccccggccuccccggccccgagggcccccccggccuccccggcaacggcggcaucaagggcgagaagggcaaccccggccagcccggccuccccggccuccccggccucaagggcgaccagggcccccccggccuccagggcaaccccggccgccccggccucaacggcaugaagggcgaccccggccuccccggcguccccggcuuccccggcaugaagggccccuccggcguccccggcuccgccggccccgagggcgagcccggccucaucggcccccccggcccccccggccuccccggccccuccggccaguccaucaucaucaagggcgacgccggcccccccggcauccccggccagcccggccucaagggccuccccggcccccagggcccccagggccuccccggccccaccggcccccccggcgaccccggccgcaacggccuccccggcuucgacggcgccggcggccgcaagggcgaccccggccuccccggccagcccggcacccgcggccucgacggcccccccggccccgacggccuccagggcccccccggcccccccggcaccuccuccgucgcccacggcuuccucaucacccgccacucccagaccaccgacgccccccagugcccccagggcacccuccaggucuacgagggcuucucccuccucuacguccagggcaacaagcgcgcccacggccaggaccucggcaccgccggcuccugccuccgccgcuucuccaccaugcccuucauguucugcaacaucaacaacgucugcaacuucgccucccgcaacgacuacuccuacuggcucuccacccccgagcccaugcccauguccaugcagccccucaagggccaguccauccagcccuucaucucccgcugcgccgucugcgaggcccccgccgucgucaucgccguccacucccagaccauccagaucccccacugcccccagggcugggacucccucuggaucggcuacuccuucaugaugcacaccuccgccggcgccgagggcuccggccaggcccucgccucccccggcuccugccucgaggaguuccgcuccgcccccuucaucgagugccacggccgcggcaccugcaacuacuacgccaacuccuacuccuucuggcucgccaccgucgacgucuccgacauguucuccaagccccaguccgagacccucaaggccggcgaccuccgcacccgcaucucccgcugccaggucugcaugaagcgcaccuga

SEQ ID NO: 41593 - RNA, 5001 nt, Artificial Sequence
  derived and/or modified sequence opt2 from COL4A6__Homo_sapiens__NP_001274688
augcaccccggccucuggcuccuccucgucacccucugccucaccgaggagcucgccgccgccggcgagaaguccuacggcaagcccugcggcggccaggacugcuccggcuccugccagugcuuccccgagaagggcgcccgcggccgccccggccccaucggcauccagggccccaccggcccccagggcuucaccggcuccaccggccucuccggccucaagggcgagcgcggcuuccccggccuccucggccccuacggccccaagggcgacaagggccccaugggcguccccggcuuccucggcaucaacggcauccccggccaccccggccagcccggcccccgcggcccccccggccucgacggcugcaacggcacccagggcgccgucggcuuccccggccccgacggcuaccccggccuccucggcccccccggccuccccggccagaagggcuccaagggcgaccccguccucgcccccggcuccuucaagggcaugaagggcgaccccggccuccccggccucgacggcaucaccggcccccagggcgcccccggcuuccccggcgccgucggccccgccggcccccccggccuccagggcccccccggcccccccggcccccucggccccgacggcaacaugggccucggcuuccagggcgagaagggcgucaagggcgacgucggccuccccggccccgccggccccccccccuccaccggcgagcucgaguucaugggcuuccccaagggcaagaagggcuccaagggcgagcccggccccaagggcuuccccggcaucuccggcccccccggcuuccccggccucggcaccaccggcgagaagggcgagaagggcgagaagggcauccccggccuccccggcccccgcggccccaugggcuccgagggcguccagggcccccccggccagcagggcaagaagggcacccucggcuuccccggccucaacggcuuccagggcaucgagggccagaagggcgacaucggccuccccggccccgacgucuucaucgacaucgacggcgccgucaucuccggcaaccccggcgaccccggcguccccggccuccccggccucaagggcgacgagggcauccagggccuccgcggccccuccggcguccccggccuccccgcccucuccggcguccccggcgcccucggcccccagggcuuccccggccucaagggcgaccagggcaaccccggccgcaccaccaucggcgccgccggccuccccggccgcgacggccuccccggcccccccggcccccccggcccccccucccccgaguucgagaccgagacccuccacaacaaggaguccggcuuccccggccuccgcggcgagcagggccccaagggcaaccucggccucaagggcaucaagggcgacuccggcuucugcgccugcgacggcggcguccccaacaccggcccccccggcgagcccggcccccccggccccuggggccucaucggccuccccggccucaagggcgcccgcggcgaccgcggcuccggcggcgcccagggccccgccggcgcccccggccucgucggcccccucggccccuccggccccaagggcaagaagggcgagcccauccucuccaccauccagggcaugcccggcgaccgcggcgacuccggcucccagggcuuccgcggcgucaucggcgagcccggcaaggacggcguccccggccuccccggccuccccggccuccccggcgacggcggccagggcuuccccggcgagaagggccuccccggccuccccggcgagaagggccaccccggcccccccggccuccccggcaacggccuccccggccuccccggcccccgcggccuccccggcgacaagggcaaggacggccuccccggccagcagggccuccccggcuccaagggcaucacccuccccugcaucauccccggcuccuacggccccuccggcuuccccggcacccccggcuuccccggccccaagggcucccgcggccuccccggcacccccggccagcccggcuccuccggcuccaagggcgagcccggcucccccggccucguccaccuccccgagcuccccggcuuccccggcccccgcggcgagaagggccuccccggcuuccccggccuccccggcaaggacggccuccccggcaugaucggcucccccggccuccccggcuccaagggcgccaccggcgacaucuucggcgccgagaacggcgcccccggcgagcagggccuccagggccucaccggccacaagggcuuccucggcgacuccggccuccccggccucaagggcguccacggcaagcccggccuccucggccccaagggcgagcgcggcucccccggcacccccggccaggucggccagcccggcacccccggcuccuccggccccuacggcaucaagggcaaguccggccuccccggcgcccccggcuuccccggcaucuccggccaccccggcaagaagggcacccgcggcaagaagggcccccccggcuccaucgucaagaagggccuccccggccucaagggccuccccggcaaccccggccucgucggccucaagggcucccccggcucccccggcgucgccggccuccccgcccucuccggccccaagggcgagaagggcuccgucggcuucgucggcuuccccggcauccccggccuccccggcauccccggcacccgcggccucaagggcauccccggcuccaccggcaagaugggccccuccggccgcgccggcacccccggcgagaagggcgaccgcggcaaccccggccccgucggcauccccuccccccgccgccccauguccaaccucuggcucaagggcgacaagggcucccagggcuccgccggcuccaacggcuuccccggcccccgcggcgacaagggcgaggccggccgccccggcccccccggccuccccggcgcccccggccuccccggcaucaucaagggcgucuccggcaagcccggcccccccggcuucaugggcauccgcggccuccccggccucaagggcuccuccggcaucaccggcuuccccggcaugcccggcgaguccggcucccagggcauccgcggcucccccggccuccccggcgccuccggccuccccggccucaagggcgacaacggccagaccgucgagaucuccggcucccccggccccaagggccagcccggcgaguccggcuucaagggcaccaagggccgcgacggccucaucggcaacaucggcuuccccggcaacaagggcgaggacggcaaggucggcgucuccggcgacgucggccuccccggcgcccccggcuuccccggcgucgccggcaugcgcggcgagcccggccuccccggcuccuccggccaccagggcgccaucggcccccucggcucccccggccucaucggccccaagggccccuccaucaccggcguccccggccccgccggccuccccggccccaagggcgagaagggcuaccccggcaucggcaucggcgcccccggcaagcccggccuccgcggccagaagggcgaccgcggcuuccccggccuccagggccccgccggccuccccggcgcccccggcaucucccuccccucccucaucgccggccagcccggcgaccccggccgccccggccucgacggcgagcgcggccgccccggccccgccggcccccccggcccccccggccccuccuccaaccagggcgacaccggcgaccccggcuuccccggcauccccggccccaagggccccaagggcgaccagggcauccccggcuucuccggccuccccggcgagcucggccucaagggcaugcgcggcgagcccggcuucaugggcacccccggcaaggucggcccccccggcgaccccggcuuccccggcaugaagggcaaggccggcccccgcggcuccuccggccuccagggcgaccccggccagacccccaccgccgaggccguccaggucccccccggcccccucggccuccccggcaucgacggcauccccggccucaccggcgaccccggcgcccagggccccgucggccuccagggcuccaagggccuccccggcauccccggcaaggacggccccuccggccuccccggcccccccggcgcccucggcgaccccggccuccccggccuccagggcccccccggcuucgagggcgcccccggccagcagggccccuucggcaugcccggcaugcccggccaguccaugcgcgucggcuacacccucgucaagcacucccaguccgagcaggucccccccugccccaucggcaugucccagcucugggucggcuacucccuccucuucgucgagggccaggagaaggcccacaaccaggaccucggcuucgccggcuccugccucccccgcuucuccaccaugcccuucaucuacugcaacaucaacgaggucugccacuacgcccgccgcaacgacaaguccuacuggcucuccaccaccgcccccauccccaugaugcccgucucccagacccagaucccccaguacaucucccgcugcuccgucugcgaggcccccucccaggccaucgccguccacucccaggacaucaccaucccccagugcccccucggcuggcgcucccucuggaucggcuacuccuuccucaugcacaccgccgccggcgccgagggcggcggccagucccucgucucccccggcuccugccucgaggacuuccgcgccacccccuucaucgagugcuccggcgcccgcggcaccugccacuacuucgccaacaaguacuccuucuggcucaccaccgucgaggagcgccagcaguucggcgagcuccccgucuccgagacccucaaggccggccagcuccacacccgcgucucccgcugccaggucugcaugaagucccucuga

SEQ ID NO: 41594 - RNA, 5517 nt, Artificial Sequence
  derived and/or modified sequence opt2 from COL5A1__Homo_sapiens__NP_000084
auggacguccacacccgcuggaaggcccgcuccgcccuccgccccggcgccccccuccuccccccccuccuccuccuccuccucugggcccccccccccucccgcgccgcccagcccgccgaccuccucaagguccucgacuuccacaaccuccccgacggcaucaccaagaccaccggcuucugcgccacccgccgcuccuccaagggccccgacgucgccuaccgcgucaccaaggacgcccagcucuccgcccccaccaagcagcucuaccccgccuccgccuuccccgaggacuucuccauccucaccaccgucaaggccaagaagggcucccaggccuuccucgucuccaucuacaacgagcagggcauccagcagaucggccucgagcucggccgcucccccgucuuccucuacgaggaccacaccggcaagcccggccccgaggacuacccccucuuccgcggcaucaaccucuccgacggcaaguggcaccgcaucgcccucuccguccacaagaagaacgucacccucauccucgacugcaagaagaagaccaccaaguuccucgaccgcuccgaccaccccaugaucgacaucaacggcaucaucgucuucggcacccgcauccucgacgaggaggucuucgagggcgacauccagcagcuccucuucgucuccgaccaccgcgccgccuacgacuacugcgagcacuacucccccgacugcgacaccgccguccccgacaccccccagucccaggaccccaaccccgacgaguacuacaccgagggcgacggcgagggcgagaccuacuacuacgaguaccccuacuacgaggaccccgaggaccucggcaaggagcccacccccuccaagaagcccgucgaggccgccaaggagaccaccgagguccccgaggagcucacccccacccccaccgaggccgcccccaugcccgagaccuccgagggcgccggcaaggaggaggacgucggcaucggcgacuacgacuacguccccuccgaggacuacuacacccccucccccuacgacgaccucaccuacggcgagggcgaggagaaccccgaccagcccaccgaccccggcgccggcgccgagauccccaccuccaccgccgacaccuccaacuccuccaaccccgcccccccccccggcgagggcgccgacgaccucgagggcgaguucaccgaggagaccauccgcaaccucgacgagaacuacuacgaccccuacuacgaccccaccuccucccccuccgagaucggccccggcaugcccgccaaccaggacaccaucuacgagggcaucggcggcccccgcggcgagaagggccagaagggcgagcccgccaucaucgagcccggcaugcucaucgagggcccccccggccccgagggccccgccggccuccccggcccccccggcaccaugggccccaccggccaggucggcgaccccggcgagcgcggcccccccggccgccccggccuccccggcgccgacggccuccccggcccccccggcaccaugcucaugcuccccuuccgcuucggcggcggcggcgacgccggcuccaagggccccauggucuccgcccaggagucccaggcccaggccauccuccagcaggcccgccucgcccuccgcggccccgccggccccaugggccucaccggccgccccggccccgucggcccccccggcuccggcggccucaagggcgagcccggcgacgucggcccccagggcccccgcggcguccagggcccccccggccccgccggcaagcccggccgccgcggccgcgccggcuccgacggcgcccgcggcaugcccggccagaccggccccaagggcgaccgcggcuucgacggccucgccggccuccccggcgagaagggccaccgcggcgaccccggccccuccggcccccccggcccccccggcgacgacggcgagcgcggcgacgacggcgaggucggcccccgcggccuccccggcgagcccggcccccgcggccuccucggccccaagggcccccccggcccccccggcccccccggcgucaccggcauggacggccagcccggccccaagggcaacgucggcccccagggcgagcccggcccccccggccagcagggcaaccccggcgcccagggccuccccggcccccagggcgccaucggcccccccggcgagaagggcccccucggcaagcccggccuccccggcaugcccggcgccgacggcccccccggccaccccggcaaggagggcccccccggcgagaagggcggccagggcccccccggcccccagggccccaucggcuaccccggcccccgcggcgucaagggcgccgacggcauccgcggccucaagggcaccaagggcgagaagggcgaggacggcuuccccggcuucaagggcgacaugggcaucaagggcgaccgcggcgagaucggcccccccggcccccgcggcgaggacggccccgagggccccaagggccgcggcggccccaacggcgaccccggcccccucggcccccccggcgagaagggcaagcucggcguccccggccuccccggcuaccccggccgccagggccccaagggcuccaucggcuuccccggcuuccccggcgccaacggcgagaagggcggccgcggcacccccggcaagcccggcccccgcggccagcgcggccccaccggcccccgcggcgagcgcggcccccgcggcaucaccggcaagcccggccccaagggcaacuccggcggcgacggccccgccggcccccccggcgagcgcggccccaacggcccccagggccccaccggcuuccccggccccaagggcccccccggcccccccggcaaggacggccuccccggccaccccggccagcgcggcgagaccggcuuccagggcaagaccggcccccccggcccccccggcgucgucggcccccagggccccaccggcgagaccggccccaugggcgagcgcggccaccccggcccccccggcccccccggcgagcagggccuccccggccucgccggcaaggagggcaccaagggcgaccccggccccgccggccuccccggcaaggacggcccccccggccuccgcggcuuccccggcgaccgcggccuccccggccccgucggcgcccucggccucaagggcaacgagggcccccccggcccccccggccccgccggcucccccggcgagcgcggccccgccggcgccgccggccccaucggcauccccggccgccccggcccccagggcccccccggccccgccggcgagaagggcgcccccggcgagaagggcccccagggccccgccggccgcgacggccuccagggccccgucggccuccccggccccgccggccccgucggcccccccggcgaggacggcgacaagggcgagaucggcgagcccggccagaagggcuccaagggcgacaagggcgagcagggcccccccggccccaccggcccccagggccccaucggccagcccggccccuccggcgccgacggcgagcccggcccccgcggccagcagggccucuucggccagaagggcgacgagggcccccgcggcuuccccggcccccccggccccgucggccuccagggccuccccggcccccccggcgagaagggcgagaccggcgacgucggccagaugggcccccccggcccccccggcccccgcggccccuccggcgcccccggcgccgacggcccccagggcccccccggcggcaucggcaaccccggcgccgucggcgagaagggcgagcccggcgaggccggcgagcccggccuccccggcgagggcggcccccccggccccaagggcgagcgcggcgagaagggcgaguccggccccuccggcgccgccggcccccccggccccaagggcccccccggcgacgacggccccaagggcucccccggccccgucggcuuccccggcgaccccggcccccccggcgagcccggccccgccggccaggacggcccccccggcgacaagggcgacgacggcgagcccggccagaccggcucccccggccccaccggcgagcccggccccuccggcccccccggcaagcgcggcccccccggccccgccggccccgagggccgccagggcgagaagggcgccaagggcgaggccggccucgagggcccccccggcaagaccggccccaucggcccccagggcgcccccggcaagcccggccccgacggccuccgcggcauccccggccccgucggcgagcagggccuccccggcucccccggccccgacggcccccccggccccaugggcccccccggccuccccggccucaagggcgacuccggccccaagggcgagaagggccaccccggccucaucggccucaucggcccccccggcgagcagggcgagaagggcgaccgcggccuccccggcccccagggcuccuccggccccaagggcgagcagggcaucaccggccccuccggccccaucggcccccccggcccccccggccuccccggcccccccggccccaagggcgccaagggcuccuccggccccaccggccccaagggcgaggccggccaccccggcccccccggcccccccggcccccccggcgaggucauccagccccuccccauccaggccucccgcacccgccgcaacaucgacgccucccagcuccucgacgacggcaacggcgagaacuacgucgacuacgccgacggcauggaggagaucuucggcucccucaacucccucaagcucgagaucgagcagaugaagcgcccccucggcacccagcagaaccccgcccgcaccugcaaggaccuccagcucugccaccccgacuuccccgacggcgaguacugggucgaccccaaccagggcugcucccgcgacuccuucaaggucuacugcaacuucaccgccggcggcuccaccugcgucuuccccgacaagaaguccgagggcgcccgcaucaccuccuggcccaaggagaaccccggcuccugguucuccgaguucaagcgcggcaagcuccucuccuacgucgacgccgagggcaaccccgucggcgucguccagaugaccuuccuccgccuccucuccgccuccgcccaccagaacgucaccuaccacugcuaccaguccgucgccuggcaggacgccgccaccggcuccuacgacaaggcccuccgcuuccucggcuccaacgacgaggagauguccuacgacaacaaccccuacauccgcgcccucgucgacggcugcgccaccaagaagggcuaccagaagaccguccucgagaucgacacccccaaggucgagcagguccccaucgucgacaucauguucaacgacuucggcgaggccucccagaaguucggcuucgaggucggccccgccugcuucaugggcuga

SEQ ID NO: 41595 - RNA, 4500 nt, Artificial Sequence
  derived and/or modified sequence opt2 from COL5A2__Homo_sapiens__NP_000384
augauggccaacugggccgaggcccgcccccuccucauccucaucguccuccucggccaguucgucuccaucaaggcccaggaggaggacgaggacgagggcuacggcgaggagaucgccugcacccagaacggccagauguaccucaaccgcgacaucuggaagcccgcccccugccagaucugcgucugcgacaacggcgccauccucugcgacaagaucgagugccaggacguccucgacugcgccgaccccgucaccccccccggcgagugcugccccgucugcucccagacccccggcggcggcaacaccaacuucggccgcggccgcaagggccagaagggcgagcccggccucguccccgucgucaccggcauccgcggccgccccggccccgccggcccccccggcucccagggcccccgcggcgagcgcggccccaagggccgccccggcccccgcggcccccagggcaucgacggcgagcccggcguccccggccagcccggcgcccccggcccccccggccaccccucccaccccggccccgacggccucucccgccccuucuccgcccagauggccggccucgacgagaaguccggccucggcucccaggucggccucaugcccggcuccgucggccccgucggcccccgcggcccccagggccuccagggccagcagggcggcgccggccccaccggcccccccggcgagcccggcgaccccggccccaugggccccaucggcucccgcggccccgagggcccccccggcaagcccggcgaggacggcgagcccggccgcaacggcaaccccggcgaggucggcuucgccggcucccccggcgcccgcggcuuccccggcgcccccggccuccccggccucaagggccaccgcggccacaagggccucgagggccccaagggcgaggucggcgcccccggcuccaagggcgaggccggccccaccggccccaugggcgccaugggcccccucggcccccgcggcaugcccggcgagcgcggccgccucggcccccagggcgcccccggccagcgcggcgcccacggcaugcccggcaagcccggccccaugggcccccucggcauccccggcuccuccggcuuccccggcaaccccggcaugaagggcgaggccggccccaccggcgcccgcggccccgagggcccccagggccagcgcggcgagaccggcccccccggccccgucggcucccccggccuccccggcgccaucggcaccgacggcacccccggcgccaagggccccaccggcucccccggcaccuccggcccccccggcuccgccggcccccccggcucccccggcccccagggcuccaccggcccccagggcauccgcggccagcccggcgaccccggcguccccggcuucaagggcgaggccggccccaagggcgagcccggcccccacggcauccagggccccaucggcccccccggcgaggagggcaagcgcggcccccgcggcgaccccggcaccgucggcccccccggccccgucggcgagcgcggcgcccccggcaaccgcggcuuccccggcuccgacggccuccccggccccaagggcgcccagggcgagcgcggccccgucggcuccuccggccccaagggcucccagggcgaccccggccgccccggcgagcccggccuccccggcgcccgcggccucaccggcaaccccggcguccagggccccgagggcaagcucggcccccucggcgcccccggcgaggacggccgccccggcccccccggcuccaucggcauccgcggccagcccggcuccaugggccuccccggccccaagggcuccuccggcgaccccggcaagcccggcgaggccggcaacgccggcguccccggccagcgcggcgcccccggcaaggacggcgaggucggccccuccggccccgucggcccccccggccucgccggcgagcgcggcgagcagggcccccccggccccaccggcuuccagggccuccccggcccccccggcccccccggcgagggcggcaagcccggcgaccagggcguccccggcgaccccggcgccgucggcccccucggcccccgcggcgagcgcggcaaccccggcgagcgcggcgagcccggcaucaccggccuccccggcgagaagggcauggccggcggccacggccccgacggccccaagggcucccccggccccuccggcacccccggcgacaccggcccccccggccuccagggcaugcccggcgagcgcggcaucgccggcacccccggccccaagggcgaccgcggcggcaucggcgagaagggcgccgagggcaccgccggcaacgacggcgcccgcggccuccccggcccccucggcccccccggccccgccggccccaccggcgagaagggcgagcccggcccccgcggccucgucggcccccccggcucccgcggcaaccccggcucccgcggcgagaacggccccaccggcgccgucggcuucgccggcccccagggccccgacggccagcccggcgucaagggcgagcccggcgagcccggccagaagggcgacgccggcucccccggcccccagggccucgccggcucccccggcccccacggccccaacggcguccccggccucaagggcggccgcggcacccagggcccccccggcgccaccggcuuccccggcuccgccggccgcgucggcccccccggccccgccggcgcccccggccccgccggcccccucggcgagcccggcaaggagggcccccccggccuccgcggcgaccccggcucccacggccgcgucggcgaccgcggccccgccggcccccccggcggccccggcgacaagggcgaccccggcgaggacggccagcccggccccgacggcccccccggccccgccggcaccaccggccagcgcggcaucgucggcaugcccggccagcgcggcgagcgcggcaugcccggccuccccggccccgccggcacccccggcaaggucggccccaccggcgccaccggcgacaagggcccccccggccccgucggcccccccggcuccaacggccccgucggcgagcccggccccgagggccccgccggcaacgacggcacccccggccgcgacggcgccgucggcgagcgcggcgaccgcggcgaccccggccccgccggccuccccggcucccagggcgcccccggcacccccggccccgucggcgcccccggcgacgccggccagcgcggcgaccccggcucccgcggccccaucggcccccccggccgcgccggcaagcgcggccuccccggcccccagggcccccgcggcgacaagggcgaccacggcgaccgcggcgaccgcggccagaagggccaccgcggcuucaccggccuccagggccuccccggcccccccggccccaacggcgagcagggcuccgccggcauccccggccccuucggcccccgcggcccccccggccccgucggccccuccggcaaggagggcaaccccggcccccucggccccaucggcccccccggcguccgcggcuccgucggcgaggccggccccgagggcccccccggcgagcccggcccccccggcccccccggcccccccggccaccucaccgccgcccucggcgacaucaugggccacuacgacgaguccaugcccgacccccuccccgaguucaccgaggaccaggccgcccccgacgacaagaacaagaccgaccccggcguccacgccacccucaagucccucuccucccagaucgagaccaugcgcucccccgacggcuccaagaagcaccccgcccgcaccugcgacgaccucaagcucugccacuccgccaagcaguccggcgaguacuggaucgaccccaaccagggcuccgucgaggacgccaucaaggucuacugcaacauggagaccggcgagaccugcaucuccgccaaccccuccuccgucccccgcaagaccuggugggccuccaagucccccgacaacaagcccgucugguacggccucgacaugaaccgcggcucccaguucgccuacggcgaccaccagucccccaacaccgccaucacccagaugaccuuccuccgccuccucuccaaggaggccucccagaacaucaccuacaucugcaagaacuccgucggcuacauggacgaccaggccaagaaccucaagaaggccgucguccucaagggcgccaacgaccucgacaucaaggccgagggcaacauccgcuuccgcuacaucguccuccaggacaccugcuccaagcgcaacggcaacgucggcaagaccgucuucgaguaccgcacccagaacgucgcccgccuccccaucaucgaccucgcccccgucgacgucggcggcaccgaccaggaguucggcgucgagaucggccccgucugcuucgucuga

SEQ ID NO: 41596 - RNA, 5238 nt, Artificial Sequence
  derived and/or modified sequence opt2 from COL5A3__Homo_sapiens__NP_056534
augggcaaccgccgcgaccucggccagccccgcgccggccucugccuccuccucgccgcccuccagcuccuccccggcacccaggccgaccccgucgacguccucaaggcccucggcguccagggcggccaggccggcguccccgagggccccggcuucugcccccagcgcacccccgagggcgaccgcgccuuccgcaucggccaggccuccacccucggcauccccaccugggagcucuuccccgagggccacuuccccgagaacuucucccuccucaucacccuccgcggccagcccgccaaccaguccguccuccucuccaucuacgacgagcgcggcgcccgccagcucggccucgcccucggccccgcccucggccuccucggcgaccccuuccgcccccucccccagcaggucaaccucaccgacggccgcuggcaccgcgucgccgucuccaucgacggcgagauggucacccucgucgccgacugcgaggcccagccccccguccucggccacggcccccgcuucaucuccaucgccggccucaccguccucggcacccaggaccucggcgagaagaccuucgagggcgacauccaggagcuccucaucucccccgacccccaggccgccuuccaggccugcgagcgcuaccuccccgacugcgacaaccucgcccccgccgccaccgucgccccccagggcgagcccgagaccccccgcccccgccgcaagggcaagggcaagggccgcaagaagggccgcggccgcaagggcaagggccgcaagaagaacaaggagaucuggaccuccucccccccccccgacuccgccgagaaccagaccuccaccgacauccccaagaccgagacccccgcccccaaccucccccccacccccaccccccucgucgucaccuccaccgucaccaccggccucaacgccaccauccucgagcgcucccucgaccccgacuccggcaccgagcucggcacccucgagaccaaggccgcccgcgaggacgaggagggcgacgacuccaccaugggccccgacuuccgcgccgccgaguaccccucccgcacccaguuccagaucuuccccggcgccggcgagaagggcgccaagggcgagcccgccgucaucgagaagggccagcaguucgagggcccccccggcgcccccggcccccagggcgucgucggccccuccggcccccccggcccccccggcuuccccggcgaccccggcccccccggccccgccggccuccccggcauccccggcaucgacggcauccgcggcccccccggcaccgucaucaugaugcccuuccaguucgccggcggcuccuucaagggcccccccgucuccuuccagcaggcccaggcccaggccguccuccagcagacccagcucuccaugaagggcccccccggccccgucggccucaccggccgccccggccccgucggccuccccggccaccccggccucaagggcgaggagggcgccgagggcccccagggcccccgcggccuccagggcccccacggcccccccggccgcgucggcaagaugggccgccccggcgccgacggcgcccgcggccuccccggcgacaccggccccaagggcgaccgcggcuucgacggccuccccggccuccccggcgagaagggccagcgcggcgacuucggccacgucggccagcccggcccccccggcgaggacggcgagcgcggcgccgagggcccccccggccccaccggccaggccggcgagcccggcccccgcggccuccucggcccccgcggcucccccggccccaccggccgccccggcgucaccggcaucgacggcgcccccggcgccaagggcaacgucggcccccccggcgagcccggcccccccggccagcagggcaaccacggcucccagggccuccccggcccccagggccucaucggcacccccggcgagaagggcccccccggcaaccccggcauccccggccuccccggcuccgacggcccccucggccaccccggccacgagggccccaccggcgagaagggcgcccagggcccccccggcuccgccggcccccccggcuaccccggcccccgcggcgucaagggcaccuccggcaaccgcggccuccagggcgagaagggcgagaagggcgaggacggcuuccccggcuucaagggcgacgucggccucaagggcgaccagggcaagcccggcgcccccggcccccgcggcgaggacggccccgagggccccaagggccaggccggccaggccggcgaggagggcccccccggcuccgccggcgagaagggcaagcucggcguccccggccuccccggcuaccccggccgccccggccccaagggcuccaucggcuuccccggcccccucggccccaucggcgagaagggcaaguccggcaagaccggccagcccggccucgagggcgagcgcggcccccccggcucccgcggcgagcgcggccagcccggcgccaccggccagcccggccccaagggcgacgucggccaggacggcgcccccggcauccccggcgagaagggccuccccggccuccagggcccccccggcuuccccggccccaagggcccccccggccaccagggcaaggacggccgccccggccaccccggccagcgcggcgagcucggcuuccagggccagaccggcccccccggccccgccggcguccucggcccccagggcaagaccggcgaggucggcccccucggcgagcgcggcccccccggcccccccggcccccccggcgagcagggccuccccggccucgagggccgcgagggcgccaagggcgagcucggcccccccggcccccucggcaaggagggccccgccggccuccgcggcuuccccggccccaagggcggccccggcgaccccggccccaccggccucaagggcgacaagggcccccccggccccgucggcgccaacggcucccccggcgagcgcggcccccucggccccgccggcggcaucggccuccccggccaguccggcuccgagggccccgucggccccgccggcaagaagggcucccgcggcgagcgcggcccccccggccccaccggcaaggacggcauccccggcccccucggcccccucggcccccccggcgccgccggccccuccggcgaggagggcgacaagggcgacgucggcgcccccggccacaagggcuccaagggcgacaagggcgacgccggcccccccggccagcccggcauccgcggccccgccggccaccccggcccccccggcgccgacggcgcccagggccgccgcggcccccccggccucuucggccagaagggcgacgacggcguccgcggcuucgucggcgucaucggcccccccggccuccagggccuccccggcccccccggcgagaagggcgaggucggcgacgucggcuccaugggcccccacggcgcccccggcccccgcggcccccagggccccaccggcuccgagggcacccccggccuccccggcggcgucggccagcccggcgccgucggcgagaagggcgagcgcggcgacgccggcgaccccggcccccccggcgcccccggcauccccggccccaagggcgacaucggcgagaagggcgacuccggccccuccggcgccgccggcccccccggcaagaagggcccccccggcgaggacggcgccaagggcuccgucggccccaccggccuccccggcgaccucggcccccccggcgaccccggcgucuccggcaucgacggcucccccggcgagaagggcgaccccggcgacgucggcggccccggcccccccggcgccuccggcgagcccggcgcccccggcccccccggcaagcgcggccccuccggccacaugggccgcgagggccgcgagggcgagaagggcgccaagggcgagcccggccccgacggcccccccggccgcaccggccccaugggcgcccgcggcccccccggccgcgucggccccgagggccuccgcggcauccccggccccgucggcgagcccggccuccucggcgcccccggccagaugggcccccccggcccccucggccccuccggccuccccggccucaagggcgacaccggccccaagggcgagaagggccacaucggccucaucggccucaucggcccccccggcgaggccggcgagaagggcgaccagggccuccccggcguccagggcccccccggccccaagggcgaccccggcccccccggccccaucggcucccucggccaccccggcccccccggcgucgccggcccccucggccagaagggcuccaagggcucccccggcuccaugggcccccgcggcgacaccggccccgccggcccccccggcccccccggcgcccccgccgagcuccacggccuccgccgccgccgccgcuucguccccgucccccuccccgucgucgagggcggccucgaggagguccucgccucccucaccucccucucccucgagcucgagcagcuccgccgcccccccggcaccgccgagcgccccggccucgucugccacgagcuccaccgcaaccacccccaccuccccgacggcgaguacuggaucgaccccaaccagggcugcgcccgcgacuccuuccgcgucuucugcaacuucaccgccggcggcgagaccugccucuaccccgacaagaaguucgagaucgucaagcucgccuccugguccaaggagaagcccggcggcugguacuccaccuuccgccgcggcaagaaguucuccuacgucgacgccgacggcucccccgucaacgucguccagcucaacuuccucaagcuccucuccgccaccgcccgccagaacuucaccuacuccugccagaacgccgccgccuggcucgacgaggccaccggcgacuacucccacuccgcccgcuuccucggcaccaacggcgaggagcucuccuucaaccagaccaccgccgccaccgucuccgucccccaggacggcugccgccuccgcaagggccagaccaagacccucuucgaguucuccuccucccgcgccggcuuccucccccucugggacgucgccgccaccgacuucggccagaccaaccagaaguucggcuucgagcucggccccgucugcuucuccuccuga

SEQ ID NO: 41597 - RNA, 3087 nt, Artificial Sequence
  derived and/or modified sequence opt2 from COL6A1__Homo_sapiens__NP_001839
augcgcgccgcccgcgcccuccucccccuccuccuccaggccugcuggaccgccgcccaggacgagcccgagaccccccgcgccgucgccuuccaggacugccccgucgaccucuucuucguccucgacaccuccgaguccgucgcccuccgccucaagcccuacggcgcccucgucgacaaggucaaguccuucaccaagcgcuucaucgacaaccuccgcgaccgcuacuaccgcugcgaccgcaaccucgucuggaacgccggcgcccuccacuacuccgacgaggucgagaucauccagggccucacccgcaugcccggcggccgcgacgcccucaaguccuccgucgacgccgucaaguacuucggcaagggcaccuacaccgacugcgccaucaagaagggccucgagcagcuccucgucggcggcucccaccucaaggagaacaaguaccucaucgucgucaccgacggccacccccucgagggcuacaaggagcccugcggcggccucgaggacgccgucaacgaggccaagcaccucggcgucaaggucuucuccgucgccaucacccccgaccaccucgagccccgccucuccaucaucgccaccgaccacaccuaccgccgcaacuucaccgccgccgacuggggccagucccgcgacgccgaggaggccaucucccagaccaucgacaccaucgucgacaugaucaagaacaacgucgagcaggucugcugcuccuucgagugccagcccgcccgcggcccccccggccuccgcggcgaccccggcuucgagggcgagcgcggcaagcccggccuccccggcgagaagggcgaggccggcgaccccggccgccccggcgaccucggccccgucggcuaccagggcaugaagggcgagaagggcucccgcggcgagaagggcucccgcggccccaagggcuacaagggcgagaagggcaagcgcggcaucgacggcgucgacggcgucaagggcgagaugggcuaccccggccuccccggcugcaagggcucccccggcuucgacggcauccagggcccccccggccccaagggcgaccccggcgccuucggccucaagggcgagaagggcgagcccggcgccgacggcgaggccggccgccccggcuccuccggccccuccggcgacgagggccagcccggcgagcccggcccccccggcgagaagggcgaggccggcgacgagggcaaccccggccccgacggcgcccccggcgagcgcggcggccccggcgagcgcggcccccgcggcacccccggcacccgcggcccccgcggcgaccccggcgaggccggcccccagggcgaccagggccgcgagggccccgucggcguccccggcgaccccggcgaggccggccccaucggccccaagggcuaccgcggcgacgagggcccccccggcuccgagggcgcccgcggcgcccccggccccgccggcccccccggcgaccccggccucaugggcgagcgcggcgaggacggccccgccggcaacggcaccgagggcuuccccggcuuccccggcuaccccggcaaccgcggcgcccccggcaucaacggcaccaagggcuaccccggccucaagggcgacgagggcgaggccggcgaccccggcgacgacaacaacgacaucgccccccgcggcgucaagggcgccaagggcuaccgcggccccgagggcccccagggcccccccggccaccagggcccccccggccccgacgagugcgagauccucgacaucaucaugaagaugugcuccugcugcgagugcaagugcggccccaucgaccuccucuucguccucgacuccuccgaguccaucggccuccagaacuucgagaucgccaaggacuucgucgucaaggucaucgaccgccucucccgcgacgagcucgucaaguucgagcccggccaguccuacgccggcgucguccaguacucccacucccagaugcaggagcacgucucccuccgcucccccuccauccgcaacguccaggagcucaaggaggccaucaagucccuccaguggauggccggcggcaccuucaccggcgaggcccuccaguacacccgcgaccagcuccucccccccucccccaacaaccgcaucgcccucgucaucaccgacggccgcuccgacacccagcgcgacaccaccccccucaacguccucugcucccccggcauccaggucgucuccgucggcaucaaggacgucuucgacuucauccccggcuccgaccagcucaacgucaucuccugccagggccucgcccccucccagggccgccccggccucucccucgucaaggagaacuacgccgagcuccucgaggacgccuuccucaagaacgucaccgcccagaucugcaucgacaagaagugccccgacuacaccugccccaucaccuucuccucccccgccgacaucaccauccuccucgacggcuccgccuccgucggcucccacaacuucgacaccaccaagcgcuucgccaagcgccucgccgagcgcuuccucaccgccggccgcaccgaccccgcccacgacguccgcgucgccgucguccaguacuccggcaccggccagcagcgccccgagcgcgccucccuccaguuccuccagaacuacaccgcccucgccuccgccgucgacgccauggacuucaucaacgacgccaccgacgucaacgacgcccucggcuacgucacccgcuucuaccgcgaggccuccuccggcgccgccaagaagcgccuccuccucuucuccgacggcaacucccagggcgccacccccgccgccaucgagaaggccguccaggaggcccagcgcgccggcaucgagaucuucgucgucgucgucggccgccaggucaacgagccccacauccgcguccucgucaccggcaagaccgccgaguacgacgucgccuacggcgagucccaccucuuccgcguccccuccuaccaggcccuccuccgcggcgucuuccaccagaccgucucccgcaaggucgcccucggcuga

SEQ ID NO: 41598 - RNA, 2757 nt, Artificial Sequence
  derived and/or modified sequence opt2 from COL6A2__Homo_sapiens__NP_478054
augcuccagggcaccugcuccguccuccuccucuggggcauccucggcgccauccaggcccagcagcaggaggucaucucccccgacaccaccgagcgcaacaacaacugccccgagaagaccgacugccccauccacgucuacuucguccucgacaccuccgaguccgucaccaugcagucccccaccgacauccuccucuuccacaugaagcaguucgucccccaguucaucucccagcuccagaacgaguucuaccucgaccaggucgcccucuccuggcgcuacggcggccuccacuucuccgaccaggucgaggucuucuccccccccggcuccgaccgcgccuccuucaucaagaaccuccagggcaucuccuccuuccgccgcggcaccuucaccgacugcgcccucgccaacaugaccgagcagauccgccaggaccgcuccaagggcaccguccacuucgccgucgucaucaccgacggccacgucaccggcucccccugcggcggcaucaagcuccaggccgagcgcgcccgcgaggagggcauccgccucuucgccgucgcccccaaccagaaccucaaggagcagggccuccgcgacaucgccuccaccccccacgagcucuaccgcaacgacuacgccaccaugcuccccgacuccaccgagaucgaccaggacaccaucaaccgcaucaucaaggucaugaagcacgaggccuacggcgagugcuacaaggucuccugccucgagauccccggccccuccggccccaagggcuaccgcggccagaagggcgccaagggcaacaugggcgagcccggcgagcccggccagaagggccgccagggcgaccccggcaucgagggccccaucggcuuccccggccccaagggcguccccggcuucaagggcgagaagggcgaguucggcgccgacggccgcaagggcgcccccggccucgccggcaagaacggcaccgacggccagaagggcaagcucggccgcaucggcccccccggcugcaagggcgaccccggcaaccgcggccccgacggcuaccccggcgaggccggcucccccggcgagcgcggcgaccagggcggcaagggcgaccccggccgccccggccgccgcggcccccccggcgagaucggcgccaagggcuccaagggcuaccagggcaacuccggcgcccccggcucccccggcgucaagggcgccaagggcggccccggcccccgcggccccaagggcgagcccggccgccgcggcgaccccggcaccaagggcucccccggcuccgacggccccaagggcgagaagggcgaccccggccccgagggcccccgcggccucgccggcgaggucggcaacaagggcgccaagggcgaccgcggccuccccggcccccgcggcccccagggcgcccucggcgagcccggcaagcagggcucccgcggcgaccccggcgacgccggcccccgcggcgacuccggccagcccggccccaagggcgaccccggccgccccggcuucuccuaccccggcccccgcggcgcccccggcgagaagggcgagcccggcccccgcggccccgagggcggccgcggcgacuucggccucaagggcgagcccggccgcaagggcgagaagggcgagcccgccgaccccggcccccccggcgagcccggcccccgcggcccccgcggcguccccggccccgagggcgagcccggcccccccggcgaccccggccucaccgagugcgacgucaugaccuacguccgcgagaccugcggcugcugcgacugcgagaagcgcugcggcgcccucgacgucgucuucgucaucgacuccuccgaguccaucggcuacaccaacuucacccucgagaagaacuucgucaucaacgucgucaaccgccucggcgccaucgccaaggaccccaaguccgagaccggcacccgcgucggcgucguccaguacucccacgagggcaccuucgaggccauccagcucgacgacgagcgcaucgacucccucuccuccuucaaggaggccgucaagaaccucgaguggaucgccggcggcaccuggacccccuccgcccucaaguucgccuacgaccgccucaucaaggagucccgccgccagaagacccgcgucuucgccgucgucaucaccgacggccgccacgacccccgcgacgacgaccucaaccuccgcgcccucugcgaccgcgacgucaccgucaccgccaucggcaucggcgacauguuccacgagaagcacgaguccgagaaccucuacuccaucgccugcgacaagccccagcagguccgcaacaugacccucuucuccgaccucgucgccgagaaguucaucgacgacauggaggacguccucugccccgacccccagaucgucugccccgaccuccccugccagaccgacgcccccuggcccggcggcgagccccccgucaccuuccuccgcaccgaggagggccccgacgccaccuucccccgcaccaucccccucauccagcagcuccucaacgccaccgagcucacccaggaccccgccgccuacucccagcucgucgccguccucgucuacaccgccgagcgcgccaaguucgccaccggcgucgagcgccaggacuggauggagcucuucaucgacaccuucaagcucguccaccgcgacaucgucggcgaccccgagaccgcccucgcccucugcuga

SEQ ID NO: 41599 - RNA, 9534 nt, Artificial Sequence
  derived and/or modified sequence opt2 from COL6A3__Homo_sapiens__NP_004360
augcgcaagcaccgccaccucccccucgucgccgucuucugccucuuccucuccggcuuccccaccacccacgcccagcagcagcaggccgacgucaagaacggcgccgccgccgacaucaucuuccucgucgacuccuccuggaccaucggcgaggagcacuuccagcucguccgcgaguuccucuacgacgucgucaagucccucgccgucggcgagaacgacuuccacuucgcccucguccaguucaacggcaacccccacaccgaguuccuccucaacaccuaccgcaccaagcaggagguccucucccacaucuccaacauguccuacaucggcggcaccaaccagaccggcaagggccucgaguacaucaugcagucccaccucaccaaggccgccggcucccgcgccggcgacggcgucccccaggucaucgucguccucaccgacggccacuccaaggacggccucgcccuccccuccgccgagcucaaguccgccgacgucaacgucuucgccaucggcgucgaggacgccgacgagggcgcccucaaggagaucgccuccgagccccucaacaugcacauguucaaccucgagaacuucaccucccuccacgacaucgucggcaaccucgucuccugcguccacuccuccgucucccccgagcgcgccggcgacaccgagacccucaaggacaucaccgcccaggacuccgccgacaucaucuuccucaucgacggcuccaacaacaccggcuccgucaacuucgccgucauccucgacuuccucgucaaccuccucgagaagcuccccaucggcacccagcagauccgcgucggcgucguccaguucuccgacgagccccgcaccauguucucccucgacaccuacuccaccaaggcccagguccucggcgccgucaaggcccucggcuucgccggcggcgagcucgccaacaucggccucgcccucgacuucgucgucgagaaccacuucacccgcgccggcggcucccgcgucgaggagggcgucccccagguccucguccucaucuccgccggccccuccuccgacgagauccgcuacggcgucgucgcccucaagcaggccuccgucuucuccuucggccucggcgcccaggccgccucccgcgccgagcuccagcacaucgccaccgacgacaaccucgucuucaccguccccgaguuccgcuccuucggcgaccuccaggagaagcuccuccccuacaucgucggcgucgcccagcgccacaucguccucaagccccccaccaucgucacccaggucaucgaggucaacaagcgcgacaucgucuuccucgucgacggcuccuccgcccucggccucgccaacuucaacgccauccgcgacuucaucgccaaggucauccagcgccucgagaucggccaggaccucauccaggucgccgucgcccaguacgccgacaccguccgccccgaguucuacuucaacacccaccccaccaagcgcgaggucaucaccgccguccgcaagaugaagccccucgacggcuccgcccucuacaccggcuccgcccucgacuucguccgcaacaaccucuucaccuccuccgccggcuaccgcgccgccgagggcauccccaagcuccucguccucaucaccggcggcaagucccucgacgagaucucccagcccgcccaggagcucaagcgcuccuccaucauggccuucgccaucggcaacaagggcgccgaccaggccgagcucgaggagaucgccuucgacuccucccucgucuucauccccgccgaguuccgcgccgccccccuccagggcaugcuccccggccuccucgccccccuccgcacccucuccggcacccccgagguccacuccaacaagcgcgacaucaucuuccuccucgacggcuccgccaacgucggcaagaccaacuuccccuacguccgcgacuucgucaugaaccucgucaacucccucgacaucggcaacgacaacauccgcgucggccucguccaguucuccgacacccccgucaccgaguucucccucaacaccuaccagaccaaguccgacauccucggccaccuccgccagcuccagcuccagggcggcuccggccucaacaccggcuccgcccucuccuacgucuacgccaaccacuucaccgaggccggcggcucccgcauccgcgagcacgucccccagcuccuccuccuccucaccgccggccaguccgaggacuccuaccuccaggccgccaacgcccucacccgcgccggcauccucaccuucugcgucggcgccucccaggccaacaaggccgagcucgagcagaucgccuucaaccccucccucgucuaccucauggacgacuucuccucccuccccgcccucccccagcagcucauccagccccucaccaccuacgucuccggcggcgucgaggaggucccccucgcccagcccgaguccaagcgcgacauccucuuccucuucgacggcuccgccaaccucgucggccaguuccccgucguccgcgacuuccucuacaagaucaucgacgagcucaacgucaagcccgagggcacccgcaucgccgucgcccaguacuccgacgacgucaaggucgagucccgcuucgacgagcaccaguccaagcccgagauccucaaccucgucaagcgcaugaagaucaagaccggcaaggcccucaaccucggcuacgcccucgacuacgcccagcgcuacaucuucgucaaguccgccggcucccgcaucgaggacggcguccuccaguuccucguccuccucgucgccggccgcuccuccgaccgcgucgacggccccgccuccaaccucaagcaguccggcgucguccccuucaucuuccaggccaagaacgccgaccccgccgagcucgagcagaucguccucucccccgccuucauccucgccgccgagucccuccccaagaucggcgaccuccacccccagaucgucaaccuccucaaguccguccacaacggcgcccccgcccccgucuccggcgagaaggacgucgucuuccuccucgacggcuccgagggcguccgcuccggcuucccccuccucaaggaguucguccagcgcgucgucgagucccucgacgucggccaggaccgcguccgcgucgccgucguccaguacuccgaccgcacccgccccgaguucuaccucaacuccuacaugaacaagcaggacgucgucaacgccguccgccagcucacccuccucggcggccccacccccaacaccggcgccgcccucgaguucguccuccgcaacauccucgucuccuccgccggcucccgcaucaccgagggcgucccccagcuccucaucguccucaccgccgaccgcuccggcgacgacguccgcaaccccuccgucgucgucaagcgcggcggcgccguccccaucggcaucggcaucggcaacgccgacaucaccgagaugcagaccaucuccuucauccccgacuucgccgucgccauccccaccuuccgccagcucggcaccguccagcaggucaucuccgagcgcgucacccagcucacccgcgaggagcucucccgccuccagcccguccuccagccccuccccucccccggcgucggcggcaagcgcgacgucgucuuccucaucgacggcucccaguccgccggccccgaguuccaguacguccgcacccucaucgagcgccucgucgacuaccucgacgucggcuucgacaccacccgcgucgccgucauccaguucuccgacgaccccaaggucgaguuccuccucaacgcccacuccuccaaggacgagguccagaacgccguccagcgccuccgccccaagggcggccgccagaucaacgucggcaacgcccucgaguacgucucccgcaacaucuucaagcgcccccucggcucccgcaucgaggagggcgucccccaguuccucguccucaucuccuccggcaaguccgacgacgaggucgacgaccccgccgucgagcucaagcaguucggcgucgcccccuucaccaucgcccgcaacgccgaccaggaggagcucgucaagaucucccucucccccgaguacgucuucuccgucuccaccuuccgcgagcuccccucccucgagcagaagcuccucacccccaucaccacccucaccuccgagcagauccagaagcuccucgccuccacccgcuaccccccccccgccgucgaguccgacgccgccgacaucgucuuccucaucgacuccuccgagggcguccgccccgacggcuucgcccacauccgcgacuucgucucccgcaucguccgccgccucaacaucggccccuccaagguccgcgucggcgucguccaguucuccaacgacgucuuccccgaguucuaccucaagaccuaccgcucccaggcccccguccucgacgccauccgccgccuccgccuccgcggcggcuccccccucaacaccggcaaggcccucgaguucgucgcccgcaaccucuucgucaaguccgccggcucccgcaucgaggacggcgucccccagcaccucguccucguccucggcggcaagucccaggacgacgucucccgcuucgcccaggucauccgcuccuccggcaucgucucccucggcgucggcgaccgcaacaucgaccgcaccgagcuccagaccaucaccaacgacccccgccucgucuucaccguccgcgaguuccgcgagcuccccaacaucgaggagcgcaucaugaacuccuucggccccuccgccgccacccccgccccccccggcgucgacacccccccccccucccgccccgagaagaagaaggccgacaucgucuuccuccucgacggcuccaucaacuuccgccgcgacuccuuccaggagguccuccgcuucgucuccgagaucgucgacaccgucuacgaggacggcgacuccauccaggucggccucguccaguacaacuccgaccccaccgacgaguucuuccucaaggacuucuccaccaagcgccagaucaucgacgccaucaacaaggucgucuacaagggcggccgccacgccaacaccaaggucggccucgagcaccuccgcgucaaccacuucguccccgaggccggcucccgccucgaccagcgcgucccccagaucgccuucgucaucaccggcggcaaguccgucgaggacgcccaggacgucucccucgcccucacccagcgcggcgucaaggucuucgccgucggcguccgcaacaucgacuccgaggaggucggcaagaucgccuccaacuccgccaccgccuuccgcgucggcaacguccaggagcucuccgagcucuccgagcagguccucgagacccuccacgacgccaugcacgagacccucugccccggcgucaccgacgccgccaaggccugcaaccucgacgucauccucggcuucgacggcucccgcgaccagaacgucuucgucgcccagaagggcuucgaguccaaggucgacgccauccucaaccgcaucucccagaugcaccgcgucuccugcuccggcggccgcucccccaccguccgcgucuccgucgucgccaacacccccuccggccccgucgaggccuucgacuucgacgaguaccagcccgagaugcucgagaaguuccgcaacaugcgcucccagcaccccuacguccucaccgaggacacccucaaggucuaccucaacaaguuccgccaguccucccccgacuccgucaaggucgucauccacuucaccgacggcgccgacggcgaccucgccgaccuccaccgcgccuccgagaaccuccgccaggagggcguccgcgcccucauccucgucggccucgagcgcgucgucaaccucgagcgccucaugcaccucgaguucggccgcggcuucauguacgaccgcccccuccgccucaaccuccucgaccucgacuacgagcucgccgagcagcucgacaacaucgccgagaaggccugcugcggcguccccugcaagugcuccggccagcgcggcgaccgcggccccaucggcuccaucggccccaagggcauccccggcgaggacggcuaccgcggcuaccccggcgacgagggcggccccggcgagcgcggcccccccggcgucaacggcacccagggcuuccagggcugccccggccagcgcggcgucaagggcucccgcggcuuccccggcgagaagggcgaggucggcgagaucggccucgacggccucgacggcgaggacggcgacaagggccuccccggcuccuccggcgagaagggcaaccccggccgccgcggcgacaagggcccccgcggcgagaagggcgagcgcggcgacgucggcauccgcggcgaccccggcaaccccggccaggacucccaggagcgcggccccaagggcgagaccggcgaccucggccccaugggcguccccggccgcgacggcguccccggcggccccggcgagaccggcaagaacggcggcuucggccgccgcggcccccccggcgccaagggcaacaagggcggccccggccagcccggcuucgagggcgagcagggcacccgcggcgcccagggccccgccggccccgccggcccccccggccucaucggcgagcagggcaucuccggcccccgcggcuccggcggcgccgccggcgcccccggcgagcgcggccgcaccggcccccucggccgcaagggcgagcccggcgagcccggccccaagggcggcaucggcaaccgcggcccccgcggcgagaccggcgacgacggccgcgacggcgucggcuccgagggccgccgcggcaagaagggcgagcgcggcuuccccggcuaccccggccccaagggcaaccccggcgagcccggccucaacggcaccaccggccccaagggcauccgcggccgccgcggcaacuccggcccccccggcaucgucggccagaagggcgaccccggcuaccccggccccgccggccccaagggcaaccgcggcgacuccaucgaccagugcgcccucauccaguccaucaaggacaagugccccugcugcuacggcccccucgagugccccgucuuccccaccgagcucgccuucgcccucgacaccuccgagggcgucaaccaggacaccuucggccgcaugcgcgacgucguccucuccaucgucaacgaccucaccaucgccgaguccaacugcccccgcggcgcccgcgucgccgucgucaccuacaacaacgaggucaccaccgagauccgcuucgccgacuccaagcgcaaguccguccuccucgacaagaucaagaaccuccaggucgcccucaccuccaagcagcagucccucgagaccgccauguccuucgucgcccgcaacaccuucaagcgcguccgcaacggcuuccucaugcgcaaggucgccgucuucuucuccaacacccccacccgcgccuccccccagcuccgcgaggccguccucaagcucuccgacgccggcaucaccccccucuuccucacccgccaggaggaccgccagcucaucaacgcccuccagaucaacaacaccgccgucggccacgcccucguccuccccgccggccgcgaccucaccgacuuccucgagaacguccucaccugccacgucugccucgacaucugcaacaucgaccccuccugcggcuucggcuccuggcgccccuccuuccgcgaccgccgcgccgccggcuccgacgucgacaucgacauggccuucauccucgacuccgccgagaccaccacccucuuccaguucaacgagaugaagaaguacaucgccuaccucguccgccagcucgacaugucccccgaccccaaggccucccagcacuucgcccgcgucgccgucguccagcacgcccccuccgaguccgucgacaacgccuccaugccccccgucaaggucgaguucucccucaccgacuacggcuccaaggagaagcucgucgacuuccucucccgcggcaugacccagcuccagggcacccgcgcccucggcuccgccaucgaguacaccaucgagaacgucuucgaguccgcccccaacccccgcgaccucaagaucgucguccucaugcucaccggcgagguccccgagcagcagcucgaggaggcccagcgcgucauccuccaggccaagugcaagggcuacuucuucgucguccucggcaucggccgcaaggucaacaucaaggaggucuacaccuucgccuccgagcccaacgacgucuucuucaagcucgucgacaaguccaccgagcucaacgaggagccccucaugcgcuucggccgccuccuccccuccuucgucuccuccgagaacgccuucuaccucucccccgacauccgcaagcagugcgacugguuccagggcgaccagcccaccaagaaccucgucaaguucggccacaagcaggucaacguccccaacaacgucaccuccucccccaccuccaaccccgucaccaccaccaagcccgucaccaccaccaagcccgucaccaccaccaccaagcccgucaccaccaccaccaagcccgucaccaucaucaaccagcccuccgucaagcccgccgccgccaagcccgcccccgccaagcccgucgccgccaagcccgucgccaccaagauggccaccguccgcccccccgucgccgucaagcccgccaccgccgccaagcccgucgccgccaagcccgccgccguccgcccccccgccgccgccgccgccaagcccgucgccaccaagcccgaggucccccgcccccaggccgccaagcccgccgccaccaagcccgccaccaccaagcccauggucaagaugucccgcgagguccaggucuucgagaucaccgagaacuccgccaagcuccacugggagcgcgccgagccccccggccccuacuucuacgaccucaccgucaccuccgcccacgaccagucccucguccucaagcagaaccucaccgucaccgaccgcgucaucggcggccuccucgccggccagaccuaccacgucgccgucgucugcuaccuccgcucccagguccgcgccaccuaccacggcuccuucuccaccaagaagucccagcccccccccccccagcccgcccgcuccgccuccuccuccaccaucaaccucauggucuccaccgagccccucgcccucaccgagaccgacaucugcaagcuccccaaggacgagggcaccugccgcgacuucauccucaagugguacuacgaccccaacaccaaguccugcgcccgcuucugguacggcggcugcggcggcaacgagaacaaguucggcucccagaaggagugcgagaaggucugcgcccccguccucgccaagcccggcgucaucuccgucaugggcaccuga

SEQ ID NO: 41600 - RNA, 7845 nt, Artificial Sequence
  derived and/or modified sequence opt2 from COL6A5__Homo_sapiens__NP_001265227
augaagauccuccucaucaucuucguccucaucaucuggaccgagacccucgccgaccagucccccggccccggccccgucuacgccgacgucgucuuccucgucgacuccuccgaccaccucggccccaaguccuuccccuucgucaagaccuucaucaacaagaugaucaacucccuccccaucgaggccaacaaguaccgcgucgcccucgcccaguacuccgacgaguuccacuccgaguuccaccucuccaccuucaagggccgcucccccaugcucaaccaccucaagaagaacuuccaguucaucggcggcucccuccagaucggcaaggcccuccaggaggcccaccgcaccuacuucuccgcccccaucaacggccgcgaccgcaagcaguucccccccauccucgucguccucgccuccgccgaguccgaggacgaggucgaggaggccuccaaggcccuccagaaggacggcgucaagaucaucuccgucggcguccagaaggccuccgaggagaaccucaaggccauggccaccucccacuuccacuucaaccuccgcaccauccgcgaccucuccaccuucucccagaacaugacccagaucaucaaggacgucaccaaguacaaggagggcgccgucgacgccgacaugcagguccacuuccccaucuccugccagaaggacucccucgccgaccucgucuuccucgucgacgagucccucggcaccggcggcaaccuccgccaccuccagaccuuccucgagaacaucaccuccuccauggacgucaaggagaacugcaugcgccucggccucauguccuacuccaacuccgccaagaccaucuccuuccucaaguccuccaccacccaguccgaguuccagcagcagaucaagaaccucuccauccaggucggcaaguccaacaccggcgccgccaucgaccagaugcgccgcgacggcuucuccgaguccuacggcucccgccgcgcccagggcgucccccagaucgccguccucgucacccaccgccccuccgacgacgagguccacgacgccgcccucaaccuccgccucgaggacgucaacgucuucgcccucuccauccagggcgccaacaacacccagcucgaggagaucgucuccuacccccccgagcagaccaucuccacccucaaguccuacgccgaccucgagaccuacuccaccaaguuccucaagaagcuccagaacgagaucuggucccagaucuccaccuacgccgagcagcgcaaccucgacaagaccggcugcgucgacaccaaggaggccgacauccacuuccucaucgacggcuccuccuccauccaggagaagcaguucgagcagaucaagcgcuucaugcucgaggucaccgagauguucuccaucggccccgacaagguccgcgucggcgucguccaguacuccgacgacaccgaggucgaguucuacaucaccgacuacuccaacgacaucgaccuccgcaaggccaucuucaacaucaagcagcucaccggcggcaccuacaccggcaaggcccucgacuacauccuccagaucaucaagaacggcaugaaggaccgcauguccaagguccccugcuaccucaucguccucaccgacggcauguccaccgaccgcgucgucgagcccgccaagcgccuccgcgccgagcagaucaccguccacgccgucggcaucggcgccgccaacaagaucgagcuccaggagaucgccggcaaggaggagcgcgucuccuucggccagaacuucgacgcccucaaguccaucaagaacgaggucguccgcgagaucugcgccgagaagggcugcgaggacaugaaggccgacaucauguuccucgucgacuccuccugguccaucggcaacgagaacuuccgcaagaugaagaucuucaugaagaaccuccucaccaagauccagaucggcgccgacaagacccagaucggcgucguccaguucuccgacaagaccaaggaggaguuccagcucaaccgcuacuucacccagcaggagaucuccgacgccaucgaccgcaugucccucaucaacgagggcacccucaccggcaaggcccucaacuucgucggccaguacuucacccacuccaagggcgcccgccucggcgccaagaaguuccucauccucaucaccgacggcgucgcccaggacgacguccgcgaccccgcccgcauccuccgcggcaaggacgucaccaucuucuccgucggcgucuacaacgccaaccgcucccagcucgaggagaucuccggcgacuccucccucgucuuccacgucgagaacuucgaccaccucaaggcccucgagcgcaagcucaucuuccgcgucugcgcccuccacgacugcaagcgcaucacccuccucgacgucgucuucguccucgaccacuccggcuccaucaagaagcaguaccaggaccacaugaucaaccucaccauccaccucgucaagaaggccgacgucggccgcgaccgcguccaguucggcgcccucaaguacuccgaccagcccaacauccucuucuaccucaacaccuacuccaaccgcuccgccaucaucgagaaccuccgcaagcgccgcgacaccggcggcaacaccuacaccgccaaggcccucaagcacgccaacgcccucuucaccgaggagcacggcucccgcaucaagcagaacgucaagcagaugcucaucgucaucaccgacggcgagucccacgaccacgaccagcucaacgacaccgcccucgagcuccgcaacaagggcaucaccaucuucgccgucggcgucggcaaggccaaccagaaggagcucgagggcauggccggcaacaagaacaacaccaucuacgucgacaacuucgacaagcucaaggacgucuucacccucguccaggagcgcaugugcaccgaggcccccgaggucugccaccuccaggaggccgacgucaucuuccucugcgacggcuccgaccgcgucuccaacuccgacuucgucaccaugaccaccuuccucuccgaccucaucgacaacuucgacauccagucccagcgcaugaagaucggcauggcccaguucggcuccaacuaccaguccaucaucgagcucaagaacucccucaccaagacccaguggaagacccagauccagaacgucuccaaguccggcggcuucccccgcaucgacuucgcccucaagaaggucuccaacauguucaaccuccacgccggcggccgccgcaacgccggcgucccccagacccucgucgucaucaccuccggcgacccccgcuacgacgucgccgacgccgucaagacccucaaggaccucggcaucugcguccucguccucggcaucggcgacgucuacaaggagcaccuccuccccaucaccggcaacuccgagaagaucaucaccuuccaggacuucgacaagcucaagaacgucgacgucaagaagcgcaucauccgcgagaucugccaguccugcggcaagaccaacugcuucauggacaucgucgucggcuucgacaucuccacccacguccagggccagccccucuuccagggccacccccagcucgaguccuaccuccccggcauccucgaggacaucuccuccaucaagggcgucuccugcggcgccggcaccgaggcccaggucucccucgccuucaaggucaacuccgaccagggcuuccccgccaaguuccagaucuaccagaaggccgucuucgacucccuccuccaggucaacgucuccggccccacccaccucaacgcccaguuccuccgcucccucugggacaccuucaaggacaaguccgccucccgcggccagguccuccucaucuucuccgacggccuccaguccgaguccaacaucaugcucgagaaccaguccgaccgccuccgcgaggccggccucgacgcccuccucgucgucucccucaacaccaccgcccaccacgaguucuccuccuucgaguucggcaagcgcuucgacuaccgcacccaccucaccaucggcaugcgcgagcucggcaagaagcucucccaguaccucggcaacaucgccgagcgcaccugcugcugcaccuucugcaagugccccggcauccccggcccccacggcacccgcggccuccaggccaugaagggcucccagggccucaagggcucccgcggccaccgcggcgaggacggcaaccccggcguccgcggcgacaccggcccccagggcgacaagggcaucgccggcugccccggcgccuggggccagaagggccucaagggcuucuccggccccaagggcggccacggcgacgacggcaucgacggccucgacggcgaggagggcugccacggcuuccccggcaucaagggcgagaagggcgaccccggcucccagggcucccccggcucccgcggcgcccccggccaguacggcgagaagggcuuccccggcgaccccggcaaccccggccagaacaacaacaucaagggccagaagggcuccaagggcgagcagggccgccagggccgcuccggccagaagggcguccagggcucccccuccucccgcggcucccgcggccgcgagggccagcgcggccuccgcggcgucuccggcgagcccggcaaccccggccccaccggcacccucggcgccgagggccuccagggcccccagggcucccagggcaaccccggccgcaagggcgagaagggcucccagggccagaagggcccccagggcucccccggccucaugggcgccaagggcuccaccggccgccccggccuccucggcaagaagggcgagcccggccuccccggcgaccucggccccgucggccagaccggccagcgcggccgccagggcgacuccggcauccccggcuacggccagaugggccgcaagggcgucaagggcccccgcggcuuccccggcgacgccggccagaagggcgacaucggcaaccccggcauccccggcggccccggccccaagggcuuccgcggccucgcccucaccgucggccucaagggcgaggagggcucccgcggccuccccggcccccccggccagcgcggcaucaagggcauggccggccagcccgucuacucccagugcgaccucauccgcuuccuccgcgagcacucccccugcuggaaggagaagugccccgccuaccccaccgagcucgucuucgcccucgacaacuccuacgacgucaccgaggaguccuucaacaagacccgcgacaucaucaccuccaucgucaacgaccucaacauccgcgagaacaacugccccgucggcgcccgcgucgccauggucuccuacaacuccggcaccuccuaccucauccgcugguccgacuacaaccgcaagaagcagcuccuccagcagcucucccagaucaaguaccaggacaccaccgagccccgcgacgucggcaacgccaugcgcuucgucacccgcaacgucuucaagcgcaccuacgccggcgccaacguccgccgcgucgccgucuucuucuccaacggccagaccgccucccgcuccuccaucaucaccgccaccauggaguucuccgcccucgacaucucccccaccgucuucgccuucgacgagcgcgucuuccucgaggccuucggcuucgacaacaccggcaccuuccaggucauccccgucccccccaacggcgagaaccagacccucgagcgccuccgccgcugcgcccucugcuacgacaagugcuuccccaacgccugcauccgcgaggccuuccuccccgaggacuccuacauggacgucgucuuccucaucgacaacucccgcaacaucgccaaggacgaguucaaggccgucaaggcccucgucuccuccgucaucgacaacuucaacaucgccuccgacccccucaucuccgacuccggcgaccgcaucgcccuccucuccuacucccccugggaguccucccgccgcaagaugggcaccgucaagaccgaguucgacuucaucaccuacgacaaccagcuccucaugaagaaccacauccagaccuccuuccagcagcucaacggcgaggccaccaucggccgcgcccuccucuggaccaccgagaaccucuuccccgagacccccuaccuccgcaagcacaaggucaucuucgucgucuccgccggcgagaacuacgagcgcaaggaguucgucaagaugauggcccuccgcgccaagugccagggcuacgucaucuucgucaucucccucggcuccacccgcaaggacgacauggaggagcucgccuccuacccccucgaccagcaccucauccagcucggccgcauccacaagcccgaccucaacuacaucgccaaguuccucaagcccuuccucuacuccguccgccgcggcuucaaccaguaccccccccccaugcucgaggacgccugccgccucaucaaccucggcggcgagaacauccagaacgacggcuuccaguucgucaccgagcuccaggaggacuuccucggcggcaacggcuucaucggccaggagcucaacuccggccgcgagucccccuucgucaagaccgaggacaacggcuccgacuaccucgucuaccuccccucccagauguucgagccccagaagcucaugaucaacuacgagaaggaccagaaguccgccgagaucgccucccucaccuccggccacgagaacuacggccgcaaggaggagcccgaccacaccuacgagcccggcgacgucucccuccaggaguacuacauggacgucgccuuccucaucgacgccucccagcgcgucggcuccgacgaguucaaggaggucaaggccuucaucaccuccguccucgacuacuuccacaucgcccccaccccccucaccuccacccucggcgaccgcgucgccguccucuccuacuccccccccggcuacaugcccaacaccgaggagugccccgucuaccucgaguucgaccucgucaccuacaacuccauccaccagaugaagcaccaccuccaggacucccagcagcucaacggcgacgucuucaucggccacgcccuccaguggaccaucgacaacgucuucgucggcacccccaaccuccgcaagaacaaggucaucuucgucaucuccgccggcgagaccaacucccucgacaaggacguccuccgcaacgucucccuccgcgccaagugccagggcuacuccaucuucgucuucuccuucggccccaagcacaacgacaaggagcucgaggagcucgccucccacccccucgaccaccaccucguccagcucggccgcacccacaagcccgacuggaacuacaucaucaaguucgucaagcccuucguccaccucauccgccgcgccaucaacaaguaccccaccgaggacaugaaggccaccugcgucaacaugaccucccccaaccccgagaacggcggcaccgagaacaccguccuccuccuccccggcaucuacgagaucaagaccgagaacggcgaccucuucgacgaguucgacucccaggcccagcaccuccucguccucggcaacaaccacuccuccggcuccgagaccgccaccgaccucaugcagaagcucuaccuccucuucuccaccgagaagcucgccaugaaggacaaggagaaggcccaccucgaggagaucuccgcccucgucgucgacaagcagcaggagaaggaggacggcgaggacacccgcuccuccuga

SEQ ID NO: 41601 - RNA, 8835 nt, Artificial Sequence
  derived and/or modified sequence opt2 from COL7A1__Homo_sapiens__NP_000085
augacccuccgccuccucgucgccgcccucugcgccggcauccucgccgaggccccccgcguccgcgcccagcaccgcgagcgcgucaccugcacccgccucuacgccgccgacaucgucuuccuccucgacggcuccuccuccaucggccgcuccaacuuccgcgagguccgcuccuuccucgagggccucguccuccccuucuccggcgccgccuccgcccagggcguccgcuucgccaccguccaguacuccgacgacccccgcaccgaguucggccucgacgcccucggcuccggcggcgacgucauccgcgccauccgcgagcucuccuacaagggcggcaacacccgcaccggcgccgccauccuccacgucgccgaccacgucuuccucccccagcucgcccgccccggcguccccaaggucugcauccucaucaccgacggcaagucccaggaccucgucgacaccgccgcccagcgccucaagggccagggcgucaagcucuucgccgucggcaucaagaacgccgaccccgaggagcucaagcgcgucgccucccagcccaccuccgacuucuucuucuucgucaacgacuucuccauccuccgcacccuccucccccucgucucccgccgcgucugcaccaccgccggcggcguccccgucacccgcccccccgacgacuccaccuccgccccccgcgaccucguccucuccgagcccuccucccagucccuccgcguccaguggaccgccgccuccggccccgucaccggcuacaagguccaguacaccccccucaccggccucggccagccccuccccuccgagcgccaggaggucaacguccccgccggcgagaccuccguccgccuccgcggccuccgcccccucaccgaguaccaggucaccgucaucgcccucuacgccaacuccaucggcgaggccgucuccggcaccgcccgcaccaccgcccucgagggccccgagcucaccauccagaacaccaccgcccacucccuccucgucgccuggcgcuccguccccggcgccaccggcuaccgcgucaccuggcgcguccucuccggcggccccacccagcagcaggagcucggccccggccagggcuccguccuccuccgcgaccucgagcccggcaccgacuacgaggucaccgucuccacccucuucggccgcuccgucggccccgccaccucccucauggcccgcaccgacgccuccgucgagcagacccuccgccccgucauccucggccccaccuccauccuccucuccuggaaccucguccccgaggcccgcggcuaccgccucgaguggcgccgcgagaccggccucgagcccccccagaaggucguccuccccuccgacgucacccgcuaccagcucgacggccuccagcccggcaccgaguaccgccucacccucuacacccuccucgagggccacgaggucgccacccccgccaccgucguccccaccggccccgagcuccccgucucccccgucaccgaccuccaggccaccgagcuccccggccagcgcguccgcgucuccuggucccccguccccggcgccacccaguaccgcaucaucguccgcuccacccagggcgucgagcgcacccucguccuccccggcucccagaccgccuucgaccucgacgacguccaggccggccucuccuacaccguccgcgucuccgcccgcgucggcccccgcgagggcuccgccuccguccucaccguccgccgcgagcccgagaccccccucgccguccccggccuccgcgucgucgucuccgacgccacccgcguccgcgucgccuggggccccguccccggcgccuccggcuuccgcaucuccugguccaccggcuccggccccgaguccucccagacccucccccccgacuccaccgccaccgacaucaccggccuccagcccggcaccaccuaccaggucgccgucuccguccuccgcggccgcgaggagggccccgccgccgucaucgucgcccgcaccgacccccucggccccguccgcaccguccacgucacccaggccuccuccuccuccgucaccaucaccuggacccgcguccccggcgccaccggcuaccgcgucuccuggcacuccgcccacggccccgagaagucccagcucgucuccggcgaggccaccgucgccgagcucgacggccucgagcccgacaccgaguacaccguccacguccgcgcccacgucgccggcgucgacggcccccccgccuccgucgucguccgcaccgcccccgagcccgucggccgcgucucccgccuccagauccucaacgccuccuccgacguccuccgcaucaccugggucggcgucaccggcgccaccgccuaccgccucgccuggggccgcuccgagggcggccccaugcgccaccagauccuccccggcaacaccgacuccgccgagauccgcggccucgagggcggcgucuccuacuccguccgcgucaccgcccucgucggcgaccgcgagggcacccccgucuccaucgucgucaccaccccccccgaggccccccccgcccucggcacccuccacgucguccagcgcggcgagcacucccuccgccuccgcugggagcccgucccccgcgcccagggcuuccuccuccacuggcagcccgagggcggccaggagcagucccgcguccucggccccgagcucuccuccuaccaccucgacggccucgagcccgccacccaguaccgcguccgccucuccguccucggccccgccggcgagggccccuccgccgaggucaccgcccgcaccgaguccccccgcguccccuccaucgagcuccgcgucgucgacaccuccaucgacuccgucacccucgccuggacccccgucucccgcgccuccuccuacauccucuccuggcgcccccuccgcggccccggccaggagguccccggcuccccccagacccuccccggcaucuccuccucccagcgcgucaccggccucgagcccggcgucuccuacaucuucucccucacccccguccucgacggcguccgcggccccgaggccuccgucacccagacccccgucugcccccgcggccucgccgacgucgucuuccucccccacgccacccaggacaacgcccaccgcgccgaggccacccgccgcguccucgagcgccucguccucgcccucggcccccucggcccccaggccguccaggucggccuccucuccuacucccaccgccccuccccccucuucccccucaacggcucccacgaccucggcaucauccuccagcgcauccgcgacaugcccuacauggaccccuccggcaacaaccucggcaccgccgucgucaccgcccaccgcuacaugcucgcccccgacgcccccggccgccgccagcacguccccggcgucaugguccuccucgucgacgagccccuccgcggcgacaucuucucccccauccgcgaggcccaggccuccggccucaacgucgucaugcucggcauggccggcgccgaccccgagcagcuccgccgccucgcccccggcauggacuccguccagaccuucuucgccgucgacgacggccccucccucgaccaggccgucuccggccucgccaccgcccucugccaggccuccuucaccacccagccccgccccgagcccugccccgucuacugccccaagggccagaagggcgagcccggcgagaugggccuccgcggccaggucggcccccccggcgaccccggccuccccggccgcaccggcgcccccggcccccagggcccccccggcuccgccaccgccaagggcgagcgcggcuuccccggcgccgacggccgccccggcucccccggccgcgccggcaaccccggcacccccggcgcccccggccucaagggcucccccggccuccccggcccccgcggcgaccccggcgagcgcggcccccgcggccccaagggcgagcccggcgcccccggccaggucaucggcggcgagggccccggccuccccggccgcaagggcgaccccggccccuccggcccccccggcccccgcggcccccucggcgaccccggcccccgcggcccccccggccuccccggcaccgccaugaagggcgacaagggcgaccgcggcgagcgcggcccccccggccccggcgagggcggcaucgcccccggcgagcccggccuccccggccuccccggcucccccggcccccagggccccgucggcccccccggcaagaagggcgagaagggcgacuccgaggacggcgcccccggccuccccggccagcccggcucccccggcgagcagggcccccgcggcccccccggcgccaucggccccaagggcgaccgcggcuuccccggcccccucggcgaggccggcgagaagggcgagcgcggcccccccggccccgccggcucccgcggccuccccggcgucgccggccgccccggcgccaagggccccgagggcccccccggccccaccggccgccagggcgagaagggcgagcccggccgccccggcgaccccgccgucgucggccccgccgucgccggccccaagggcgagaagggcgacgucggccccgccggcccccgcggcgccaccggcguccagggcgagcgcggcccccccggccucguccuccccggcgaccccggccccaagggcgaccccggcgaccgcggccccaucggccucaccggccgcgccggcccccccggcgacuccggcccccccggcgagaagggcgaccccggccgccccggcccccccggccccgucggcccccgcggccgcgacggcgaggucggcgagaagggcgacgagggcccccccggcgaccccggccuccccggcaaggccggcgagcgcggccuccgcggcgcccccggcguccgcggccccgucggcgagaagggcgaccagggcgaccccggcgaggacggccgcaacggcucccccggcuccuccggccccaagggcgaccgcggcgagcccggcccccccggcccccccggccgccucgucgacaccggccccggcgcccgcgagaagggcgagcccggcgaccgcggccaggagggcccccgcggccccaagggcgaccccggccuccccggcgcccccggcgagcgcggcaucgagggcuuccgcggcccccccggcccccagggcgaccccggcguccgcggccccgccggcgagaagggcgaccgcggcccccccggccucgacggccgcuccggccucgacggcaagcccggcgccgccggccccuccggccccaacggcgccgccggcaaggccggcgaccccggccgcgacggccuccccggccuccgcggcgagcagggccuccccggccccuccggcccccccggccuccccggcaagcccggcgaggacggcaagcccggccucaacggcaagaacggcgagcccggcgaccccggcgaggacggccgcaagggcgagaagggcgacuccggcgccuccggccgcgagggccgcgacggccccaagggcgagcgcggcgcccccggcauccucggcccccagggcccccccggccuccccggccccgucggcccccccggccagggcuuccccggcguccccggcggcaccggccccaagggcgaccgcggcgagaccggcuccaagggcgagcagggccuccccggcgagcgcggccuccgcggcgagcccggcuccguccccaacgucgaccgccuccucgagaccgccggcaucaaggccuccgcccuccgcgagaucgucgagaccugggacgaguccuccggcuccuuccuccccguccccgagcgccgccgcggccccaagggcgacuccggcgagcagggcccccccggcaaggagggccccaucggcuuccccggcgagcgcggccucaagggcgaccgcggcgaccccggcccccagggcccccccggccucgcccucggcgagcgcggcccccccggccccuccggccucgccggcgagcccggcaagcccggcauccccggccuccccggccgcgccggcggcgucggcgaggccggccgccccggcgagcgcggcgagcgcggcgagaagggcgagcgcggcgagcagggccgcgacggcccccccggccuccccggcacccccggcccccccggcccccccggccccaaggucuccgucgacgagcccggccccggccucuccggcgagcagggcccccccggccucaagggcgccaagggcgagcccggcuccaacggcgaccagggccccaagggcgaccgcggcguccccggcaucaagggcgaccgcggcgagcccggcccccgcggccaggacggcaaccccggccuccccggcgagcgcggcauggccggccccgagggcaagcccggccuccagggcccccgcggcccccccggccccgucggcggccacggcgaccccggcccccccggcgcccccggccucgccggccccgccggcccccagggccccuccggccucaagggcgagcccggcgagaccggcccccccggccgcggccucaccggccccaccggcgccgucggccuccccggcccccccggccccuccggccucgucggcccccagggcucccccggccuccccggccaggucggcgagaccggcaagcccggcgcccccggccgcgacggcgccuccggcaaggacggcgaccgcggcucccccggcguccccggcucccccggccuccccggccccgucggccccaagggcgagcccggccccaccggcgcccccggccaggccgucgucggccuccccggcgccaagggcgagaagggcgcccccggcggccucgccggcgaccucgucggcgagcccggcgccaagggcgaccgcggccuccccggcccccgcggcgagaagggcgaggccggccgcgccggcgagcccggcgaccccggcgaggacggccagaagggcgcccccggccccaagggcuucaagggcgaccccggcgucggcguccccggcucccccggcccccccggcccccccggcgucaagggcgaccucggccuccccggccuccccggcgcccccggcgucgucggcuuccccggccagaccggcccccgcggcgagaugggccagcccggccccuccggcgagcgcggccucgccggcccccccggccgcgagggcauccccggcccccucggcccccccggcccccccggcuccgucggcccccccggcgccuccggccucaagggcgacaagggcgaccccggcgucggccuccccggcccccgcggcgagcgcggcgagcccggcauccgcggcgaggacggccgccccggccaggagggcccccgcggccucaccggcccccccggcucccgcggcgagcgcggcgagaagggcgacgucggcuccgccggccucaagggcgacaagggcgacuccgccgucauccucggcccccccggcccccgcggcgccaagggcgacaugggcgagcgcggcccccgcggccucgacggcgacaagggcccccgcggcgacaacggcgaccccggcgacaagggcuccaagggcgagcccggcgacaagggcuccgccggccuccccggccuccgcggccuccucggcccccagggccagcccggcgccgccggcauccccggcgaccccggcucccccggcaaggacggcguccccggcauccgcggcgagaagggcgacgucggcuucaugggcccccgcggccucaagggcgagcgcggcgucaagggcgccugcggccucgacggcgagaagggcgacaagggcgaggccggcccccccggccgccccggccucgccggccacaagggcgagaugggcgagcccggcguccccggccaguccggcgcccccggcaaggagggccucaucggccccaagggcgaccgcggcuucgacggccagcccggccccaagggcgaccagggcgagaagggcgagcgcggcacccccggcaucggcggcuuccccggccccuccggcaacgacggcuccgccggcccccccggcccccccggcuccgucggcccccgcggccccgagggccuccagggccagaagggcgagcgcggcccccccggcgagcgcgucgucggcgcccccggcguccccggcgcccccggcgagcgcggcgagcagggccgccccggccccgccggcccccgcggcgagaagggcgaggccgcccucaccgaggacgacauccgcggcuucguccgccaggagaugucccagcacugcgccugccagggccaguucaucgccuccggcucccgcccccuccccuccuacgccgccgacaccgccggcucccagcuccacgccguccccguccuccgcgucucccacgccgaggaggaggagcgcgucccccccgaggacgacgaguacuccgaguacuccgaguacuccgucgaggaguaccaggaccccgaggcccccugggacuccgacgaccccugcucccucccccucgacgagggcuccugcaccgccuacacccuccgcugguaccaccgcgccgucaccggcuccaccgaggccugccaccccuucgucuacggcggcugcggcggcaacgccaaccgcuucggcacccgcgaggccugcgagcgccgcugccccccccgcgucguccagucccagggcaccggcaccgcccaggacuga

SEQ ID NO: 41602 - RNA, 2235 nt, Artificial Sequence
  derived and/or modified sequence opt2 from COL8A1__Homo_sapiens__NP_065084
auggccguccuccccggcccccuccagcuccucggcguccuccucaccaucucccucuccuccauccgccucauccaggccggcgccuacuacggcaucaagccccuccccccccagauccccccccagaugcccccccagaucccccaguaccagccccucggccagcaggucccccacaugccccucgccaaggacggccucgccaugggcaaggagaugccccaccuccaguacggcaaggaguacccccaccucccccaguacaugaaggagauccagcccgccccccgcaugggcaaggaggccguccccaagaagggcaaggagaucccccucgccucccuccgcggcgagcagggcccccgcggcgagcccggcccccgcggcccccccggcccccccggccuccccggccacggcauccccggcaucaagggcaagcccggcccccagggcuaccccggcgucggcaagcccggcaugcccggcaugcccggcaagcccggcgccaugggcaugcccggcgccaagggcgagaucggccagaagggcgagaucggccccaugggcauccccggcccccagggcccccccggcccccacggccuccccggcaucggcaagcccggcggccccggccuccccggccagcccggccccaagggcgaccgcggccccaagggccuccccggcccccagggccuccgcggccccaagggcgacaagggcuucggcaugcccggcgcccccggcgucaagggcccccccggcaugcacggcccccccggccccgucggccuccccggcgucggcaagcccggcgucaccggcuuccccggcccccagggcccccucggcaagcccggcgcccccggcgagcccggcccccagggccccaucggcguccccggcguccagggcccccccggcauccccggcaucggcaagcccggccaggacggcauccccggccagcccggcuuccccggcggcaagggcgagcagggccuccccggccuccccggcccccccggccuccccggcaucggcaagcccggcuuccccggccccaagggcgaccgcggcaugggcggcguccccggcgcccucggcccccgcggcgagaagggccccaucggcgcccccggcaucggcggcccccccggcgagcccggccuccccggcauccccggccccaugggcccccccggcgccaucggcuuccccggccccaagggcgagggcggcaucgucggcccccagggcccccccggccccaagggcgagcccggccuccagggcuuccccggcaagcccggcuuccucggcgaggucggcccccccggcaugcgcggccuccccggccccaucggccccaagggcgaggccggccagaagggcguccccggccuccccggcguccccggccuccucggccccaagggcgagcccggcauccccggcgaccagggccuccagggcccccccggcauccccggcaucggcggccccuccggccccaucggcccccccggcauccccggccccaagggcgagcccggccuccccggcccccccggcuuccccggcaucggcaagcccggcgucgccggccuccacggcccccccggcaagcccggcgcccucggcccccagggccagcccggccuccccggcccccccggcccccccggcccccccggcccccccgccgucaugccccccaccccccccccccagggcgaguaccuccccgacaugggccucggcaucgacggcgucaagcccccccacgccuacggcgccaagaagggcaagaacggcggccccgccuacgagaugcccgccuucaccgccgagcucaccgcccccuucccccccgucggcgcccccgucaaguucaacaagcuccucuacaacggccgccagaacuacaacccccagaccggcaucuucaccugcgagguccccggcgucuacuacuucgccuaccacguccacugcaagggcggcaacgucugggucgcccucuucaagaacaacgagcccgucauguacaccuacgacgaguacaagaagggcuuccucgaccaggccuccggcuccgccguccuccuccuccgccccggcgaccgcgucuuccuccagaugcccuccgagcaggccgccggccucuacgccggccaguacguccacuccuccuucuccggcuaccuccucuaccccauguga

SEQ ID NO: 41603 - RNA, 1917 nt, Artificial Sequence
  derived and/or modified sequence opt2 from COL8A2__Homo_sapiens__NP_001281276
augccccucccccuccuccccauggaccucaagggcgagcccggcccccccggcaagcccggcccccgcggcccccccggcccccccggcuuccccggcaagcccggcaugggcaagcccggccuccacggccagcccggccccgccggcccccccggcuucucccgcaugggcaaggccggcccccccggccuccccggcaaggucggcccccccggccagcccggccuccgcggcgagcccggcauccgcggcgaccagggccuccgcggcccccccggcccccccggccuccccggccccuccggcaucaccauccccggcaagcccggcgcccagggcguccccggcccccccggcuuccagggcgagcccggcccccagggcgagcccggcccccccggcgaccgcggccucaagggcgacaacggcgucggccagcccggccuccccggcgcccccggccagggcggcgcccccggcccccccggccuccccggccccgccggccucggcaagcccggccucgacggccuccccggcgcccccggcgacaagggcgaguccggcccccccggcguccccggcccccgcggcgagcccggcgccgucggccccaagggcccccccggcgucgacggcgucggcguccccggcgccgccggccuccccggcccccagggccccuccggcgccaagggcgagcccggcacccgcggcccccccggccucaucggccccaccggcuacggcaugcccggccuccccggccccaagggcgaccgcggccccgccggcguccccggccuccucggcgaccgcggcgagcccggcgaggacggcgagcccggcgagcagggcccccagggccucggcggcccccccggccuccccggcuccgccggccuccccggccgccgcggcccccccggccccaagggcgaggccggccccggcggcccccccggcguccccggcauccgcggcgaccagggccccuccggccucgccggcaagcccggcguccccggcgagcgcggccuccccggcgcccacggcccccccggccccaccggccccaagggcgagcccggcuucaccggccgccccggcggccccggcgucgccggcgcccucggccagaagggcgaccucggccuccccggccagcccggccuccgcggccccuccggcauccccggccuccagggccccgccggccccaucggcccccagggccuccccggccucaagggcgagcccggccuccccggcccccccggcgagggccgcgccggcgagcccggcaccgccggccccaccggcccccccggcguccccggcucccccggcaucaccggcccccccggcccccccggcccccccggcccccccggcgcccccggcgccuucgacgagaccggcaucgccggccuccaccuccccaacggcggcgucgagggcgccguccucggcaagggcggcaagccccaguucggccucggcgagcucuccgcccacgccacccccgccuucaccgccguccucaccucccccuuccccgccuccggcaugcccgucaaguucgaccgcacccucuacaacggccacuccggcuacaaccccgccaccggcaucuucaccugccccgucggcggcgucuacuacuucgccuaccacguccacgucaagggcaccaacgucugggucgcccucuacaagaacaacguccccgccaccuacaccuacgacgaguacaagaagggcuaccucgaccaggccuccggcggcgccguccuccagcuccgccccaacgaccaggucuggguccagaugcccuccgaccaggccaacggccucuacuccaccgaguacauccacuccuccuucuccggcuuccuccucugccccaccuga

SEQ ID NO: 41604 - RNA, 2766 nt, Artificial Sequence
  derived and/or modified sequence opt2 from COL9A1__Homo_sapiens__NP_001842
augaagaccugcuggaagauccccgucuucuucuucgucugcuccuuccucgagcccugggccuccgccgccgucaagcgccgcccccgcuuccccgucaacuccaacuccaacggcggcaacgagcucugccccaagauccgcaucggccaggacgaccuccccggcuucgaccucaucucccaguuccaggucgacaaggccgccucccgccgcgccauccagcgcgucgucggcuccgccacccuccaggucgccuacaagcucggcaacaacgucgacuuccgcauccccacccgcaaccucuaccccuccggccuccccgaggaguacuccuuccucaccaccuuccgcaugaccggcuccacccucaagaagaacuggaacaucuggcagauccaggacuccuccggcaaggagcaggucggcaucaagaucaacggccagacccaguccgucgucuucuccuacaagggccucgacggcucccuccagaccgccgccuucuccaaccucuccucccucuucgacucccaguggcacaagaucaugaucggcgucgagcgcuccuccgccacccucuucgucgacugcaaccgcaucgagucccuccccaucaagccccgcggccccaucgacaucgacggcuucgccguccucggcaagcucgccgacaacccccaggucuccguccccuucgagcuccaguggaugcucauccacugcgacccccuccgcccccgccgcgagaccugccacgagcuccccgcccgcaucacccccucccagaccaccgacgagcgcggcccccccggcgagcagggcccccccggcccccccggcccccccggcguccccggcaucgacggcaucgacggcgaccgcggccccaagggcccccccggcccccccggccccgccggcgagcccggcaagcccggcgcccccggcaagcccggcacccccggcgccgacggccucaccggccccgacggcucccccggcuccaucggcuccaagggccagaagggcgagcccggcguccccggcucccgcggcuuccccggccgcggcauccccggcccccccggcccccccggcaccgccggccuccccggcgagcucggccgcgucggccccgucggcgaccccggccgccgcggcccccccggcccccccggcccccccggcccccgcggcaccaucggcuuccacgacggcgacccccucugccccaacgccugcccccccggccgcuccggcuaccccggccuccccggcaugcgcggccacaagggcgccaagggcgagaucggcgagcccggccgccagggccacaagggcgaggagggcgaccagggcgagcucggcgaggucggcgcccagggcccccccggcgcccagggccuccgcggcaucaccggcaucgucggcgacaagggcgagaagggcgcccgcggccucgacggcgagcccggcccccagggccuccccggcgcccccggcgaccagggccagcgcggcccccccggcgaggccggccccaagggcgaccgcggcgccgagggcgcccgcggcauccccggccuccccggccccaagggcgacaccggccuccccggcgucgacggccgcgacggcauccccggcaugcccggcaccaagggcgagcccggcaagcccggcccccccggcgacgccggccuccagggccuccccggcguccccggcauccccggcgccaagggcgucgccggcgagaagggcuccaccggcgcccccggcaagcccggccagaugggcaacuccggcaagcccggccagcagggcccccccggcgaggucggcccccgcggcccccagggccuccccggcucccgcggcgagcucggccccgucggcucccccggccuccccggcaagcucggcucccucggcucccccggccuccccggccuccccggcccccccggccuccccggcaugaagggcgaccgcggcgucgucggcgagcccggccccaagggcgagcagggcgccuccggcgaggagggcgaggccggcgagcgcggcgagcucggcgacaucggccuccccggccccaagggcuccgccggcaaccccggcgagcccggccuccgcggccccgagggcucccgcggccuccccggcgucgagggcccccgcggcccccccggcccccgcggcguccagggcgagcagggcgccaccggccuccccggcguccagggcccccccggccgcgcccccaccgaccagcacaucaagcaggucugcaugcgcgucauccaggagcacuucgccgagauggccgccucccucaagcgccccgacuccggcgccaccggccuccccggccgccccggcccccccggcccccccggcccccccggcgagaacggcuuccccggccagaugggcauccgcggccuccccggcaucaagggcccccccggcgcccucggccuccgcggccccaagggcgaccucggcgagaagggcgagcgcggcccccccggccgcggccccaacggccuccccggcgccaucggccuccccggcgaccccggccccgccuccuacggccgcaacggccgcgacggcgagcgcggcccccccggcgucgccggcauccccggcguccccggcccccccggcccccccggccuccccggcuucugcgagcccgccuccugcaccaugcaggccggccagcgcgccuucaacaagggccccgaccccuga

SEQ ID NO: 41605 - RNA, 1215 nt, Artificial Sequence
  derived and/or modified sequence opt2 from COL9A2__Homo_sapiens__XP_011539020
auggccgccgccaccgccuccccccgcucccuccucguccuccuccaggucgucguccucgcccucgcccagauccgcggcccccccggcgagcgcggcccccccggcccccccggcccccccggcguccccggcuccgacggcaucgacggcgacaacggcccccccggcaaggccggcccccccggccccaagggcgagcccggcaaggccggccccgacggccccgacggcaagcccggcaucgacggccucaccggcgccaagggcgagcccggccccaugggcauccccggcgucaagggccagcccggccuccccggcccccccggccuccccggccccggcuucgccggcccccccggcccccccggccccgucggccuccccggcgagaucggcauccgcggccccaagggcgaccccggccccgacggccccuccggcccccccggcccccccggcaagcccggccgccccggcaccauccagggccucgagggcuccgccgacuuccucguccgcgacgagugccccaccaacugcccccccggcaugaagggcccccccggccuccagggcgucaagggccacgccggcaagcgcggcauccucggcgaccccggccaccagggcaagcccggccccaagggcgacgucggcgccuccggcgagcagggcauccccggcccccccggcccccagggcauccgcggcuaccccggcauggccggccccaagggcgagaccggcccccacggcuacaagggcauggucggcgccaucggcgccaccggcccccccggcgaggagggcccccgcggcccccccggccgcgccggcgagaagggcgacgagggcucccccggcauccgcggcccccagggcaucaccggccccaagggcgccaccggcccccccggcaucaacggcaaggacggcacccccggcacccccggcaugaagggcuccgccggccaggccggccagcccggcucccccggccaccagggccucgccacccccggccccggccgccaggccauccucugcgccccccuccucugccaccacugcggcaacguccagcucuccuccuccugccgcggcuggaccuucugcugcuccgcccccaccggcggcggcaaccucgacuggggcugggaggccaagcagcagguccacggcgcccccuccugccagggccgcaacuga

SEQ ID NO: 41606 - RNA, 2055 nt, Artificial Sequence
  derived and/or modified sequence opt2 from COL9A3__Homo_sapiens__NP_001844
auggccggcccccgcgccugcgccccccuccuccuccuccuccuccucggcgagcuccucgccgccgccggcgcccagcgcgucggccuccccggcccccccggcccccccggcccccccggcaagcccggccaggacggcaucgacggcgaggccggcccccccggccuccccggcccccccggccccaagggcgcccccggcaagcccggcaagcccggcgaggccggccuccccggccuccccggcgucgacggccucaccggccgcgacggcccccccggccccaagggcgcccccggcgagcgcggcucccucggcccccccggcccccccggccucggcggcaagggccuccccggcccccccggcgaggccggcgucuccggcccccccggcggcaucggccuccgcggcccccccggccccuccggccuccccggccuccccggcccccccggcccccccggcccccccggccaccccggcguccuccccgagggcgccaccgaccuccagugccccuccaucugcccccccggcccccccggcccccccggcaugcccggcuucaagggccccaccggcuacaagggcgagcagggcgaggucggcaaggacggcgagaagggcgaccccggcccccccggccccgccggccuccccggcuccgucggccuccagggcccccgcggccuccgcggccuccccggcccccucggcccccccggcgaccgcggccccaucggcuuccgcggcccccccggcauccccggcgcccccggcaaggccggcgaccgcggcgagcgcggccccgagggcuuccgcggccccaagggcgaccucggccgccccggccccaagggcacccccggcgucgccggccccuccggcgagcccggcaugcccggcaaggacggccagaacggcguccccggccucgacggccagaagggcgaggccggccgcaacggcgcccccggcgagaagggccccaacggccuccccggccuccccggccgcgccggcuccaagggcgagaagggcgagcgcggccgcgccggcgagcucggcgaggccggccccuccggcgagcccggcguccccggcgacgccggcaugcccggcgagcgcggcgaggccggccaccgcggcuccgccggcgcccucggcccccagggcccccccggcgcccccggcguccgcggcuuccagggccagaagggcuccaugggcgaccccggccuccccggcccccagggccuccgcggcgacgucggcgaccgcggccccggcggcgccgccggccccaagggcgaccagggcaucgccggcuccgacggccuccccggcgacaagggcgagcucggccccuccggccucgucggccccaagggcgaguccggcucccgcggcgagcucggccccaagggcacccagggccccaacggcaccuccggcguccagggcguccccggcccccccggcccccucggccuccagggcguccccggcguccccggcaucaccggcaagcccggcguccccggcaaggaggccuccgagcagcgcauccgcgagcucugcggcggcaugaucuccgagcagaucgcccagcucgccgcccaccuccgcaagccccucgcccccggcuccaucggccgccccggccccgccggcccccccggcccccccggcccccccggcuccaucggccaccccggcgcccgcggcccccccggcuaccgcggccccaccggcgagcucggcgaccccggcccccgcggcaaccagggcgaccgcggcgacaagggcgccgccggcgccggccucgacggccccgagggcgaccagggcccccagggcccccagggcguccccggcaccuccaaggacggccaggacggcgcccccggcgagcccggcccccccggcgaccccggccuccccggcgccaucggcgcccagggcacccccggcaucugcgacaccuccgccugccagggcgccguccucggcggcgucggcgagaaguccggcucccgcuccuccuga

SEQ ID NO: 41607 - RNA, 375 nt, Artificial Sequence
  derived and/or modified sequence opt2 from COLCA1__Homo_sapiens__NP_001289574
auggaguccugcuccgucgcccaggccggcguccucaccucccccuucauguggcgcuggaccggcauggccggcgcccucuccgcccucgacaacaccaucgaggacgacgccgacgaccagcuccccugcggcgagggccgccccggcuggguccgcggcgagcuccucggcucccagggcgucugcaaggacuccaaggaccucuucguccccaccuccuccucccucuacggcugcuucugcgucggccucgucuccggcauggccaucuccguccuccuccucgccuccgacuuccgcaagcucgacuucucccgccccgagcccugcuucgagaaggaggccucccucugguucgucgcccagcacuga

SEQ ID NO: 41608 - RNA, 465 nt, Artificial Sequence
  derived and/or modified sequence opt2 from COLCA2__Homo_sapiens__NP_001258386
augcaccccgagccccuccucaacuccacccaguccgccccccaccacuuccccgacuccuuccaggccacccccuucugcuucaaccagucccucauccccggcucccccuccaacuccuccauccucuccggcucccucgacuacuccuacucccccguccagcuccccuccuacgcccccgagaacuacaacucccccgccucccucgacacccgcaccugcggcuacccccccgaggaccacuccuaccagcaccucuccucccacgcccaguacuccugcuucuccuccgccaccaccuccaucugcuacugcgccuccugcgaggccgaggaccucgacgcccuccaggccgccgaguacuucuaccccuccaccgacugcgucgacuucgcccccuccgccgccgccaccuccgacuucuacaagcgcgagaccaacugcgacaucugcuacuccuga

SEQ ID NO: 41609 - RNA, 834 nt, Artificial Sequence
  derived and/or modified sequence opt2 from COLEC10__Homo_sapiens__NP_006429
augaacggcuucgccucccuccuccgccgcaaccaguucauccuccucguccucuuccuccuccagauccagucccucggccucgacaucgacucccgccccaccgccgaggucugcgccacccacaccaucucccccggccccaagggcgacgacggcgagaagggcgaccccggcgaggagggcaagcacggcaaggucggccgcaugggccccaagggcaucaagggcgagcucggcgacaugggcgaccagggcaacaucggcaagaccggccccaucggcaagaagggcgacaagggcgagaagggccuccucggcauccccggcgagaagggcaaggccggcaccgucugcgacugcggccgcuaccgcaaguucgucggccagcucgacaucuccaucgcccgccucaagaccuccaugaaguucgucaagaacgucaucgccggcauccgcgagaccgaggagaaguucuacuacaucguccaggaggagaagaacuaccgcgagucccucacccacugccgcauccgcggcggcaugcucgccaugcccaaggacgaggccgccaacacccucaucgccgacuacgucgccaaguccggcuucuuccgcgucuucaucggcgucaacgaccucgagcgcgagggccaguacauguucaccgacaacaccccccuccagaacuacuccaacuggaacgagggcgagcccuccgaccccuacggccacgaggacugcgucgagaugcucuccuccggccgcuggaacgacaccgagugccaccucaccauguacuucgucugcgaguucaucaagaagaagaaguga

SEQ ID NO: 41610 - RNA, 744 nt, Artificial Sequence
  derived and/or modified sequence opt2 from COLEC11__Homo_sapiens__NP_001242912
augcgcggcaaccucgcccucgucggcguccucaucucccucgccuuccucucccuccuccccuccggccacccccagcccgccggcgacgacgccugcuccguccagauccucguccccggccucaagggcgacgccggcgagaagggcgacaagggcgcccccggccgccccggccgcgucggccccaccggcgagaagggcgagaagggcgacuccggcgacaucggcccccccggccccaacggcgagcccggccuccccugcgagugcucccagcuccgcaaggccaucggcgagauggacaaccaggucucccagcucaccuccgagcucaaguucaucaagaacgccgucgccggcguccgcgagaccgaguccaagaucuaccuccucgucaaggaggagaagcgcuacgccgacgcccagcucuccugccagggccgcggcggcacccucuccaugcccaaggacgaggccgccaacggccucauggccgccuaccucgcccaggccggccucgcccgcgucuucaucggcaucaacgaccucgagaaggagggcgccuucgucuacuccgaccacucccccaugcgcaccuucaacaaguggcgcuccggcgagcccaacaacgccuacgacgaggaggacugcgucgagauggucgccuccggcggcuggaacgacgucgccugccacaccaccauguacuucaugugcgaguucgacaaggagaacauguga

SEQ ID NO: 41611 - RNA, 2229 nt, Artificial Sequence
  derived and/or modified sequence opt2 from COLEC12__Homo_sapiens__NP_569057
augaaggacgacuucgccgaggaggaggagguccaguccuucggcuacaagcgcuucggcauccaggagggcacccagugcaccaagugcaagaacaacugggcccucaaguucuccaucauccuccucuacauccucugcgcccuccucaccaucaccgucgccauccucggcuacaaggucgucgagaagauggacaacgucaccggcggcauggagaccucccgccagaccuacgacgacaagcucaccgccgucgaguccgaccucaagaagcucggcgaccagaccggcaagaaggccaucuccaccaacuccgagcucuccaccuuccgcuccgacauccucgaccuccgccagcagcuccgcgagaucaccgagaagaccuccaagaacaaggacacccucgagaagcuccaggccuccggcgacgcccucgucgaccgccagucccagcucaaggagacccucgagaacaacuccuuccucaucaccaccgucaacaagacccuccaggccuacaacggcuacgucaccaaccuccagcaggacaccuccguccuccagggcaaccuccagaaccagauguacucccacaacgucgucaucaugaaccucaacaaccucaaccucacccagguccagcagcgcaaccucaucaccaaccuccagcgcuccgucgacgacaccucccaggccauccagcgcaucaagaacgacuuccagaaccuccagcaggucuuccuccaggccaagaaggacaccgacuggcucaaggagaagguccagucccuccagacccucgccgccaacaacuccgcccucgccaaggccaacaacgacacccucgaggacaugaacucccagcucaacuccuucaccggccagauggagaacaucaccaccaucucccaggccaacgagcagaaccucaaggaccuccaggaccuccacaaggacgccgagaaccgcaccgccaucaaguucaaccagcucgaggagcgcuuccagcucuucgagaccgacaucgucaacaucaucuccaacaucuccuacaccgcccaccaccuccgcacccucaccuccaaccucaacgagguccgcaccaccugcaccgacacccucaccaagcacaccgacgaccucaccucccucaacaacacccucgccaacauccgccucgacuccgucucccuccgcaugcagcaggaccucaugcgcucccgccucgacaccgaggucgccaaccucuccgucaucauggaggagaugaagcucgucgacuccaagcacggccagcucaucaagaacuucaccauccuccagggcccccccggcccccgcggcccccgcggcgaccgcggcucccagggcccccccggccccaccggcaacaagggccagaagggcgagaagggcgagcccggcccccccggccccgccggcgagcgcggccccaucggccccgccggcccccccggcgagcgcggcggcaagggcuccaagggcucccagggccccaagggcucccgcggcucccccggcaagcccggcccccagggccccuccggcgaccccggcccccccggcccccccggcaaggagggccuccccggcccccagggcccccccggcuuccagggccuccagggcaccgucggcgagcccggcguccccggcccccgcggccuccccggccuccccggcguccccggcaugcccggccccaagggcccccccggcccccccggccccuccggcgccgucgucccccucgcccuccagaacgagcccacccccgcccccgaggacaacggcugccccccccacuggaagaacuucaccgacaagugcuacuacuucuccgucgagaaggagaucuucgaggacgccaagcucuucugcgaggacaaguccucccaccucgucuucaucaacacccgcgaggagcagcaguggaucaagaagcagauggucggccgcgagucccacuggaucggccucaccgacuccgagcgcgagaacgaguggaaguggcucgacggcaccucccccgacuacaagaacuggaaggccggccagcccgacaacuggggccacggccacggccccggcgaggacugcgccggccucaucuacgccggccaguggaacgacuuccagugcgaggacgucaacaacuucaucugcgagaaggaccgcgagaccguccucuccuccgcccucuga

SEQ ID NO: 41612 - RNA, 1665 nt, Artificial Sequence
  derived and/or modified sequence opt2 from COLGALT2__Homo_sapiens__NP_001290349
auggccgcccgccccgccgccacccucgccuggucccuccuccuccucuccuccgcccuccuccgcgagggcugccgcgcccgcuucgucgccgagcgcgacuccgaggacgacggcgaggagcccgucgucuuccccgaguccccccuccagucccccaccguccucgucgccguccucgcccgcaacgccgcccacacccucccccacuuccucggcugccucgagcgccucgacuaccccaagucccgcauggccaucugggccgccaccgaccacaacgucgacaacaccaccgagaucuuccgcgaguggcucaagaacguccagcgccucuaccacuacgucgaguggcgccccauggacgagcccgaguccuaccccgacgagaucggccccaagcacuggcccaccucccgcuucgcccacgucaugaagcuccgccaggccgcccuccgcaccgcccgcgagaagugguccgacuacauccucuucaucgacgucgacaacuuccucaccaacccccagacccucaaccuccucaucgccgagaacaagaccaucgucgcccccaugcucgagucccgcggccucuacuccaacuucuggugcggcaucacccccaagggcuucuacaagcgcacccccgacuacguccagauccgcgaguggaagcgcaccggcugcuuccccguccccaugguccacuccaccuuccucaucgaccuccgcaaggaggccuccgacaagcucaccuucuaccccccccaccaggacuacaccuggaccuucgacgacaucaucgucuucgccuucuccucccgccaggccggcauccagauguaccucugcaaccgcgagcacuacggcuaccuccccaucccccucaagccccaccagacccuccaggaggacaucgagaaccucauccacguccagaucgaggccaugaucgaccgcccccccauggagcccucccaguacgucuccgucguccccaaguaccccgacaagaugggcuucgacgagaucuucaugaucaaccucaagcgccgcaaggaccgccgcgaccgcaugcuccgcacccucuacgagcaggagaucgaggucaagaucgucgaggccgucgacggcaaggcccucaacaccucccagcucaaggcccucaacaucgagaugcuccccggcuaccgcgaccccuacuccucccgcccccucacccgcggcgagaucggcugcuuccucucccacuacuccgucuggaaggaggucaucgaccgcgagcucgagaagacccucgucaucgaggacgacguccgcuucgagcaccaguucaagaagaagcucaugaagcucauggacaacaucgaccaggcccagcucgacugggagcucaucuacaucggccgcaagcgcaugcaggucaaggagcccgagaaggccguccccaacgucgccaaccucgucgaggccgacuacuccuacuggacccucggcuacgucaucucccucgagggcgcccagaagcucgucggcgccaaccccuucggcaagaugcuccccgucgacgaguuccuccccgucauguacaacaagcaccccguccuccucuccuccccccacugccaccucuuccagacccucuccgacgacugccagcgcuga

SEQ ID NO: 41613 - RNA, 1368 nt, Artificial Sequence
  derived and/or modified sequence opt2 from COLQ__Homo_sapiens__NP_005668
auggucguccucaaccccaugacccucggcaucuaccuccagcucuucuuccucuccaucgucucccagcccaccuucaucaacuccguccuccccaucuccgccgcccuccccucccucgaccagaagaagcgcggcggccacaaggccugcugccuccucaccccccccccccccccccucuuccccccccccuucuuccgcggcggccgcuccccccuccucucccccgacaugaagaaccucaugcucgagcucgagaccucccagucccccugcaugcagggcucccucggcucccccggcccccccggcccccagggcccccccggccuccccggcaagaccggccccaagggcgagaagggcgagcucggccgccccggccgcaagggccgccccggcccccccggcguccccggcaugcccggccccaucggcuggcccggccccgagggcccccgcggcgagaagggcgaccucggcaugaugggccuccccggcucccgcggccccaugggcuccaagggcuaccccggcucccgcggcgagaagggcucccgcggcgagaagggcgaccucggccccaagggcgagaagggcuuccccggcuuccccggcaugcucggccagaagggcgagaugggccccaagggcgagcccggcaucgccggccaccgcggccccaccggccgccccggcaagcgcggcaagcagggccagaagggcgacuccggcgucaugggcccccccggcaagcccggccccuccggccagcccggccgccccggcccccccggccccccccccgccggccagcucaucaugggccccaagggcgagcgcggcuuccccggcccccccggccgcugccucugcggccccaccaugaacgucaacaaccccuccuacggcgaguccgucuacggccccuccuccccccgcguccccgucaucuucgucgucaacaaccaggaggagcucgagcgccucaacacccagaacgccaucgccuuccgccgcgaccagcgcucccucuacuucaaggacucccucggcuggcuccccauccagcucacccccuucuaccccgucgacuacaccgccgaccagcacggcaccugcggcgacggccuccuccagcccggcgaggagugcgacgacggcaacuccgacgucggcgacgacugcauccgcugccaccgcgccuacugcggcgacggccaccgccacgagggcgucgaggacugcgacggcuccgacuucggcuaccucaccugcgagaccuaccuccccggcuccuacggcgaccuccagugcacccaguacugcuacaucgacuccacccccugccgcuacuucaccuga

SEQ ID NO: 41614 - RNA, 609 nt, Artificial Sequence
  derived and/or modified sequence opt2 from COMMD10__Homo_sapiens__NP_057228
auggccguccccgccgcccucauccuccgcgagucccccuccaugaagaaggccgucucccucaucaacgccaucgacaccggccgcuucccccgccuccucacccgcauccuccagaagcuccaccucaaggccgaguccuccuucuccgaggaggaggaggagaagcuccaggccgccuucucccucgagaagcaggaccuccaccucguccucgagaccaucuccuucauccucgagcaggccgucuaccacaacgucaagcccgccgcccuccagcagcagcucgagaacauccaccuccgccaggacaaggccgaggccuucgucaacaccugguccuccaugggccaggagaccgucgagaaguuccgccagcgcauccucgcccccugcaagcucgagaccgucggcuggcagcucaaccuccagauggcccacuccgcccaggccaagcucaaguccccccaggccguccuccagcucggcgucaacaacgaggacuccaagucccucgagaagguccucgucgaguucucccacaaggagcucuucgacuucuacaacaagcucgagaccauccaggcccagcucgacucccucaccuga

SEQ ID NO: 41615 - RNA, 573 nt, Artificial Sequence
  derived and/or modified sequence opt2 from COMMD1__Homo_sapiens__NP_689729
auggccgccggcgagcucgagggcggcaagccccucuccggccuccucaacgcccucgcccaggacaccuuccacggcuaccccggcaucaccgaggagcuccuccgcucccagcucuaccccgaggucccccccgaggaguuccgccccuuccucgccaagaugcgcggcauccucaaguccaucgccuccgccgacauggacuucaaccagcucgaggccuuccucaccgcccagaccaagaagcagggcggcaucaccuccgaccaggccgccgucaucuccaaguucuggaagucccacaagaccaagauccgcgagucccucaugaaccagucccgcuggaacuccggccuccgcggccucuccuggcgcgucgacggcaagucccagucccgccacuccgcccagauccacacccccgucgccaucaucgagcucgagcucggcaaguacggccaggaguccgaguuccucugccucgaguucgacgaggucaaggucaaccagauccucaagacccucuccgaggucgaggaguccaucuccacccucaucucccagcccaacuga

SEQ ID NO: 41616 - RNA, 1410 nt, Artificial Sequence
  derived and/or modified sequence opt2 from COMMD3-BMI1__Homo_sapiens__NP_001190991
auggagcucuccgaguccguccagaagggcuuccagaugcucgccgacccccgcuccuucgacuccaacgccuucacccuccuccuccgcgccgccuuccagucccuccucgacgcccaggccgacgaggccguccucgaccaccccgaccucaagcacaucgaccccgucguccucaagcacugccacgccgccgccgccaccuacauccucgaggccggcaagcaccgcgccgacaaguccacccucuccaccuaccucgaggacugcaaguucgaccgcgagcgcaucgagcucuucugcaccgaguaccagaacaacaagaacucccucgagauccuccucggccgcacccucaucccccaccccauccagcgccucguccucgucgccgccuggaacaacuaccgcaucuucuaccaggccgagaugcaccgcaccacccgcaucaagaucaccgagcucaacccccaccucaugugcguccucugcggcggcuacuucaucgacgccaccaccaucaucgagugccuccacuccuucugcaagaccugcaucguccgcuaccucgagaccuccaaguacugccccaucugcgacguccagguccacaagacccgcccccuccucaacauccgcuccgacaagacccuccaggacaucgucuacaagcucguccccggccucuucaagaacgagaugaagcgccgccgcgacuucuacgccgcccaccccuccgccgacgccgccaacggcuccaacgaggaccgcggcgaggucgccgacgaggacaagcgcaucaucaccgacgacgagaucaucucccucuccaucgaguucuucgaccagaaccgccucgaccgcaaggucaacaaggacaaggagaaguccaaggaggaggucaacgacaagcgcuaccuccgcugccccgccgccaugaccgucaugcaccuccgcaaguuccuccgcuccaagauggacauccccaacaccuuccagaucgacgucauguacgaggaggagccccucaaggacuacuacacccucauggacaucgccuacaucuacaccuggcgccgcaacggcccccucccccucaaguaccgcguccgccccaccugcaagcgcaugaagaucucccaccagcgcgacggccucaccaacgccggcgagcucgaguccgacuccggcuccgacaaggccaacucccccgccggcggcauccccuccaccuccuccugccuccccucccccuccacccccguccaguccccccacccccaguucccccacaucuccuccaccaugaacggcaccuccaacucccccuccggcaaccaccaguccuccuucgccaaccgcccccgcaaguccuccgucaacggcuccuccgccaccuccuccggcuga

SEQ ID NO: 41617 - RNA, 675 nt, Artificial Sequence
  derived and/or modified sequence opt2 from COMMD5__Homo_sapiens__NP_054785
auguccgccgucggcgccgccacccccuaccuccaccaccccggcgacucccacuccggccgcgucuccuuccucggcgcccagcucccccccgaggucgccgccauggcccgccuccucggcgaccucgaccgcuccaccuuccgcaagcuccucaaguucgucgucuccucccuccagggcgaggacugccgcgaggccguccagcgccucggcgucuccgccaaccuccccgaggagcagcucggcgcccuccucgccggcaugcacacccuccuccagcaggcccuccgccucccccccaccucccucaagcccgacaccuuccgcgaccagcuccaggagcucugcaucccccaggaccucgucggcgaccucgccuccgucgucuucggcucccagcgcccccuccucgacuccgucgcccagcagcagggcgccuggcucccccacgucgccgacuuccgcuggcgcgucgacgucgccaucuccaccuccgcccucgcccgcucccuccagcccuccguccucaugcagcucaagcucuccgacggcuccgccuaccgcuucgagguccccaccgccaaguuccaggagcuccgcuacuccgucgcccucguccucaaggagauggccgaccucgagaagcgcugcgagcgccgccuccaggacuga

SEQ ID NO: 41618 - RNA, 600 nt, Artificial Sequence
  derived and/or modified sequence opt2 from COMMD7__Homo_sapiens__NP_001092809
augggccgccuccacugcaccgaggaccccguccccgaggccgucggcggcgacaugcagcagcucaaccagcucggcgcccaguucuccgcccucaccgagguccucuuccacuuccucaccgagcccaaggaggucgagcgcuuccucgcccagcucuccgaguucgccaccaccaaccagaucucccucggcucccuccgcuccaucgucaagucccuccuccucguccccaacggcgcccucaagaagucccucaccgccaagcagguccaggccgacuucaucacccucggccucuccgaggagaaggccaccuacuucuccgagaaguggaagcagaacgcccccacccucgcccgcugggccaucggccagacccucaugaucaaccagcucaucgacauggaguggaaguucggcgucaccuccggcuccuccgagcucgagaaggucggcuccaucuuccuccagcucaagcucgucgucaagaagggcaaccagaccgagaacgucuacaucgagcucacccucccccaguucuacuccuuccuccacgagauggagcgcguccgcaccuccauggagugcuucugcuga

SEQ ID NO: 41619 - RNA, 2274 nt, Artificial Sequence
  derived and/or modified sequence opt2 from COMP__Homo_sapiens__NP_000086
augguccccgacaccgccugcguccuccuccucacccucgccgcccucggcgccuccggccagggccaguccccccucggcuccgaccucggcccccagaugcuccgcgagcuccaggagaccaacgccgcccuccaggacguccgcgagcuccuccgccagcagguccgcgagaucaccuuccucaagaacaccgucauggagugcgacgccugcggcaugcagcaguccguccgcaccggccuccccuccguccgcccccuccuccacugcgcccccggcuucugcuuccccggcgucgccugcauccagaccgaguccggcgcccgcugcggccccugccccgccggcuucaccggcaacggcucccacugcaccgacgucaacgagugcaacgcccaccccugcuucccccgcguccgcugcaucaacaccucccccggcuuccgcugcgaggccugcccccccggcuacuccggccccacccaccagggcgucggccucgccuucgccaaggccaacaagcaggucugcaccgacaucaacgagugcgagaccggccagcacaacugcguccccaacuccgucugcaucaacacccgcggcuccuuccagugcggccccugccagcccggcuucgucggcgaccaggccuccggcugccagcgccgcgcccagcgcuucugccccgacggcucccccuccgagugccacgagcacgccgacugcguccucgagcgcgacggcucccgcuccugcgucugcgccgucggcugggccggcaacggcauccucugcggccgcgacaccgaccucgacggcuuccccgacgagaagcuccgcugccccgagcgccagugccgcaaggacaacugcgucaccguccccaacuccggccaggaggacgucgaccgcgacggcaucggcgacgccugcgaccccgacgccgacggcgacggcguccccaacgagaaggacaacugcccccucguccgcaaccccgaccagcgcaacaccgacgaggacaaguggggcgacgccugcgacaacugccgcucccagaagaacgacgaccagaaggacaccgaccaggacggccgcggcgacgccugcgacgacgacaucgacggcgaccgcauccgcaaccaggccgacaacugcccccgcguccccaacuccgaccagaaggacuccgacggcgacggcaucggcgacgccugcgacaacugcccccagaaguccaaccccgaccaggccgacgucgaccacgacuucgucggcgacgccugcgacuccgaccaggaccaggacggcgacggccaccaggacucccgcgacaacugccccaccguccccaacuccgcccaggaggacuccgaccacgacggccagggcgacgccugcgacgacgacgacgacaacgacggcguccccgacucccgcgacaacugccgccucguccccaaccccggccaggaggacgccgaccgcgacggcgucggcgacgucugccaggacgacuucgacgccgacaaggucgucgacaagaucgacgucugccccgagaacgccgaggucacccucaccgacuuccgcgccuuccagaccgucguccucgaccccgagggcgacgcccagaucgaccccaacugggucguccucaaccagggccgcgagaucguccagaccaugaacuccgaccccggccucgccgucggcuacaccgccuucaacggcgucgacuucgagggcaccuuccacgucaacaccgucaccgacgacgacuacgccggcuucaucuucggcuaccaggacuccuccuccuucuacgucgucauguggaagcagauggagcagaccuacuggcaggccaaccccuuccgcgccgucgccgagcccggcauccagcucaaggccgucaaguccuccaccggccccggcgagcagcuccgcaacgcccucuggcacaccggcgacaccgagucccagguccgccuccucuggaaggacccccgcaacgucggcuggaaggacaagaaguccuaccgcugguuccuccagcaccgcccccaggucggcuacauccgcguccgcuucuacgagggccccgagcucgucgccgacuccaacgucguccucgacaccaccaugcgcggcggccgccucggcgucuucugcuucucccaggagaacaucaucugggccaaccuccgcuaccgcugcaacgacaccauccccgaggacuacgagacccaccagcuccgccaggccuga

SEQ ID NO: 41620 - RNA, 816 nt, Artificial Sequence
  derived and/or modified sequence opt2 from COMT__Homo_sapiens__NP_001128634
augcccgaggcccccccccuccuccucgccgccguccuccucggccucguccuccucgucguccuccuccuccuccuccgccacuggggcuggggccucugccucaucggcuggaacgaguucauccuccagcccauccacaaccuccucaugggcgacaccaaggagcagcgcauccucaaccacguccuccagcacgccgagcccggcaacgcccaguccguccucgaggccaucgacaccuacugcgagcagaaggagugggccaugaacgucggcgacaagaagggcaagaucgucgacgccgucauccaggagcaccagcccuccguccuccucgagcucggcgccuacugcggcuacuccgccguccgcauggcccgccuccucucccccggcgcccgccucaucaccaucgagaucaaccccgacugcgccgccaucacccagcgcauggucgacuucgccggcgucaaggacaaggucacccucgucgucggcgccucccaggacaucaucccccagcucaagaagaaguacgacgucgacacccucgacauggucuuccucgaccacuggaaggaccgcuaccuccccgacacccuccuccucgaggagugcggccuccuccgcaagggcaccguccuccucgccgacaacgucaucugccccggcgcccccgacuuccucgcccacguccgcggcuccuccugcuucgagugcacccacuaccaguccuuccucgaguaccgcgaggucgucgacggccucgagaaggccaucuacaagggccccggcuccgaggccggccccuga

SEQ ID NO: 41621 - RNA, 3702 nt, Artificial Sequence
  derived and/or modified sequence opt2 from COPA__Homo_sapiens__NP_001091868
augcucaccaaguucgagaccaaguccgcccgcgucaagggccucuccuuccaccccaagcgccccuggauccucaccucccuccacaacggcgucauccagcucugggacuaccgcaugugcacccucaucgacaaguucgacgagcacgacggccccguccgcggcaucgacuuccacaagcagcagccccucuucgucuccggcggcgacgacuacaagaucaaggucuggaacuacaagcuccgccgcugccucuucacccuccucggccaccucgacuacauccgcaccaccuucuuccaccacgaguaccccuggauccucuccgccuccgacgaccagaccauccgcgucuggaacuggcagucccgcaccugcgucugcguccucaccggccacaaccacuacgucaugugcgcccaguuccaccccaccgaggaccucgucgucuccgccucccucgaccagaccguccgcgucugggacaucuccggccuccgcaagaagaaccucucccccggcgccgucgaguccgacguccgcggcaucaccggcgucgaccucuucggcaccaccgacgccgucgucaagcacguccucgagggccacgaccgcggcgucaacugggccgccuuccaccccaccaugccccucaucgucuccggcgccgacgaccgccaggucaagaucuggcgcaugaacgaguccaaggccugggaggucgacaccugccgcggccacuacaacaacgucuccugcgccgucuuccacccccgccaggagcucauccucuccaacuccgaggacaaguccauccgcgucugggacauguccaagcgcaccggcguccagaccuuccgccgcgaccacgaccgcuucuggguccucgccgcccaccccaaccucaaccucuucgccgccggccacgacggcggcaugaucgucuucaagcucgagcgcgagcgccccgccuacgccguccacggcaacaugcuccacuacgucaaggaccgcuuccuccgccagcucgacuucaacuccuccaaggacgucgccgucaugcagcuccgcuccggcuccaaguuccccgucuucaacauguccuacaaccccgccgagaacgccguccuccucugcacccgcgccuccaaccucgagaacuccaccuacgaccucuacaccauccccaaggacgccgacucccagaaccccgacgcccccgagggcaagcgcuccuccggccucaccgccgucugggucgcccgcaaccgcuucgccguccucgaccgcaugcacucccuccucaucaagaaccucaagaacgagaucaccaagaagguccagguccccaacugcgacgagaucuucuacgccggcaccggcaaccuccuccuccgcgacgccgacuccaucacccucuucgacguccagcagaagcgcacccucgccuccgucaagaucuccaaggucaaguacgucaucugguccgccgacaugucccacgucgcccuccucgccaagcacgagcacuccugcccccucccccucaccgccaucgucaucugcaaccgcaagcucgacgcccucugcaacauccacgagaacauccgcgucaaguccggcgccugggacgaguccggcgucuucaucuacaccaccuccaaccacaucaaguacgccgucaccaccggcgaccacggcaucauccgcacccucgaccuccccaucuacgucacccgcgucaagggcaacaacgucuacugccucgaccgcgagugccgcccccgcguccucaccaucgaccccaccgaguucaaguucaagcucgcccucaucaaccgcaaguacgacgagguccuccacaugguccgcaacgccaagcucgucggccaguccaucaucgccuaccuccagaagaagggcuaccccgaggucgcccuccacuucgucaaggacgagaagacccgcuucucccucgcccucgagugcggcaacaucgagaucgcccucgaggccgccaaggcccucgacgacaagaacugcugggagaagcucggcgaggucgcccuccuccagggcaaccaccagaucgucgagaugugcuaccagcgcaccaagaacuucgacaagcucuccuuccucuaccucaucaccggcaaccucgagaagcuccgcaagaugaugaagaucgccgagauccgcaaggacauguccggccacuaccagaacgcccucuaccucggcgacgucuccgagcgcguccgcauccucaagaacugcggccagaagucccucgccuaccucaccgccgccacccacggccucgacgaggaggccgagucccucaaggagaccuucgaccccgagaaggagaccauccccgacaucgaccccaacgccaagcuccuccagccccccgcccccaucaugccccucgacaccaacuggccccuccucaccgucuccaagggcuucuucgagggcaccaucgccuccaagggcaagggcggcgcccucgccgccgacaucgacaucgacaccgucggcaccgagggcuggggcgaggacgccgagcuccagcucgacgaggacggcuucgucgaggccaccgagggccucggcgacgacgcccucggcaagggccaggaggagggcggcggcugggacgucgaggaggaccucgagcucccccccgagcucgacaucucccccggcgccgccggcggcgccgaggacggcuucuucgucccccccaccaagggcaccucccccacccagaucuggugcaacaacucccagcuccccgucgaccacauccucgccggcuccuucgagaccgccaugcgccuccuccacgaccaggucggcgucauccaguucggccccuacaagcagcucuuccuccagaccuacgcccgcggccgcaccaccuaccaggcccuccccugccuccccuccauguacggcuaccccaaccgcaacuggaaggacgccggccucaagaacggcguccccgccgucggccucaagcucaacgaccucauccagcgccuccagcucugcuaccagcucaccaccgucggcaaguucgaggaggccgucgagaaguuccgcuccauccuccucuccgucccccuccucgucgucgacaacaagcaggagaucgccgaggcccagcagcucaucaccaucugccgcgaguacaucgucggccucuccgucgagaccgagcgcaagaagcuccccaaggagacccucgagcagcagaagcgcaucugcgagauggccgccuacuucacccacuccaaccuccagcccguccacaugauccucguccuccgcaccgcccucaaccucuucuucaagcucaagaacuucaagaccgccgccaccuucgcccgccgccuccucgagcucggccccaagcccgaggucgcccagcagacccgcaagauccucuccgccugcgagaagaaccccaccgacgccuaccagcucaacuacgacaugcacaaccccuucgacaucugcgccgccuccuaccgccccaucuaccgcggcaagcccgucgagaagugcccccucuccggcgccugcuacucccccgaguucaagggccagaucugccgcgucaccaccgucaccgagaucggcaaggacgucaucggccuccgcaucuccccccuccaguuccgcuga

SEQ ID NO: 41622 - RNA, 2862 nt, Artificial Sequence
  derived and/or modified sequence opt2 from COPB1__Homo_sapiens__NP_057535
augaccgccgccgagaacgucugcuacacccucaucaacguccccauggacuccgagccccccuccgagaucucccucaagaacgaccucgagaagggcgacgucaaguccaagaccgaggcccucaagaaggucaucaucaugauccucaacggcgagaagcuccccggccuccucaugaccaucauccgcuucguccucccccuccaggaccacaccaucaagaagcuccuccucgucuucugggagaucguccccaagaccacccccgacggccgccuccuccacgagaugauccucgucugcgacgccuaccgcaaggaccuccagcaccccaacgaguucauccgcggcuccacccuccgcuuccucugcaagcucaaggaggccgagcuccucgagccccucaugcccgccauccgcgccugccucgagcaccgccacuccuacguccgccgcaacgccguccucgccaucuacaccaucuaccgcaacuucgagcaccucauccccgacgcccccgagcucauccacgacuuccucgucaacgagaaggacgccuccugcaagcgcaacgccuucaugaugcucauccacgccgaccaggaccgcgcccucgacuaccucuccaccugcaucgaccagguccagaccuucggcgacauccuccagcucgucaucgucgagcucaucuacaaggucugccacgccaaccccuccgagcgcgcccgcuucauccgcugcaucuacaaccuccuccaguccuccucccccgccgucaaguacgaggccgccggcacccucgucacccucuccuccgcccccaccgccaucaaggccgccgcccagugcuacaucgaccucaucaucaaggaguccgacaacaacgucaagcucaucguccucgaccgccucaucgagcucaaggagcaccccgcccacgagcgcguccuccaggaccucgucauggacauccuccgcguccucuccacccccgaccucgagguccgcaagaagacccuccagcucgcccucgaccucgucuccucccgcaacgucgaggagcucgucaucguccucaagaaggaggucaucaagaccaacaacgucuccgagcacgaggacaccgacaaguaccgccagcuccucguccgcacccuccacuccugcuccguccgcuuccccgacauggccgccaacgucauccccguccucauggaguuccucuccgacaacaacgaggccgccgccgccgacguccucgaguucguccgcgaggccauccagcgcuucgacaaccuccgcaugcucaucgucgagaagaugcucgaggucuuccacgccaucaaguccgucaagaucuaccgcggcgcccucuggauccucggcgaguacugcuccaccaaggaggacauccaguccgucaugaccgagauccgccgcucccucggcgagauccccaucgucgaguccgagaucaagaaggaggccggcgagcucaagcccgaggaggagaucaccgucggccccguccagaagcucgucaccgagaugggcaccuacgccacccaguccgcccucuccuccucccgccccaccaagaaggaggaggaccgccccccccuccgcggcuuccuccucgacggcgacuucuucgucgccgccucccucgccaccacccucaccaagaucgcccuccgcuacgucgcccucguccaggagaagaagaagcagaacuccuucgucgccgaggccaugcuccucauggccaccauccuccaccucggcaaguccucccuccccaagaagcccaucaccgacgacgacgucgaccgcaucucccucugccucaagguccucuccgagugcuccccccucaugaacgacaucuucaacaaggagugccgccagucccucucccacaugcucuccgccaagcucgaggaggagaagcucucccagaagaaggaguccgagaagcgcaacgucaccguccagcccgacgaccccaucuccuucaugcagcucaccgccaagaacgagaugaacugcaaggaggaccaguuccagcucucccuccucgccgccaugggcaacacccagcgcaaggaggccgccgacccccucgccuccaagcucaacaaggucacccagcucaccggcuucuccgaccccgucuacgccgaggccuacguccacgucaaccaguacgacaucguccucgacguccucgucgucaaccagaccuccgacacccuccagaacugcacccucgagcucgccacccucggcgaccucaagcucgucgagaagcccuccccccucacccucgccccccacgacuucgccaacaucaaggccaacgucaaggucgccuccaccgagaacggcaucaucuucggcaacaucgucuacgacgucuccggcgccgccuccgaccgcaacugcgucguccucuccgacauccacaucgacaucauggacuacauccagcccgccaccugcaccgacgccgaguuccgccagaugugggccgaguucgagugggagaacaaggucaccgucaacaccaacauggucgaccucaacgacuaccuccagcacauccucaaguccaccaacaugaagugccucacccccgagaaggcccucuccggcuacugcggcuucauggccgccaaccucuacgcccgcuccaucuucggcgaggacgcccucgccaacgucuccaucgagaagcccauccaccagggccccgacgccgccgucaccggccacauccgcauccgcgccaagucccagggcauggcccucucccucggcgacaagaucaaccucucccagaagaagaccuccaucuga

SEQ ID NO: 41623 - RNA, 2721 nt, Artificial Sequence
  derived and/or modified sequence opt2 from COPB2__Homo_sapiens__NP_004757
augccccuccgccucgacaucaagcgcaagcucaccgcccgcuccgaccgcgucaaguccgucgaccuccaccccaccgagcccuggaugcucgccucccucuacaacggcuccgucugcgucuggaaccacgagacccagacccucgucaagaccuucgaggucugcgaccuccccguccgcgccgccaaguucgucgcccgcaagaacugggucgucaccggcgccgacgacaugcagauccgcgucuucaacuacaacacccucgagcgcguccacauguucgaggcccacuccgacuacauccgcugcaucgccguccaccccacccagcccuucauccucaccuccuccgacgacaugcucaucaagcucugggacugggacaagaagugguccugcucccaggucuucgagggccacacccacuacgucaugcagaucgucaucaaccccaaggacaacaaccaguucgccuccgccucccucgaccgcaccaucaaggucuggcagcucggcuccuccucccccaacuucacccucgagggccacgagaagggcgucaacugcaucgacuacuacuccggcggcgacaagcccuaccucaucuccggcgccgacgaccgccucgucaagaucugggacuaccagaacaagaccugcguccagacccucgagggccacgcccagaacgucuccugcgccuccuuccaccccgagcuccccaucaucaucaccggcuccgaggacggcaccguccgcaucuggcacuccuccaccuaccgccucgaguccacccucaacuacggcauggagcgcgucuggugcgucgccucccuccgcggcuccaacaacgucgcccucggcuacgacgagggcuccaucaucgucaagcucggccgcgaggagcccgccauguccauggacgccaacggcaagaucaucugggccaagcacuccgagguccagcaggccaaccucaaggccaugggcgacgccgagaucaaggacggcgagcgccucccccucgccgucaaggacaugggcuccugcgagaucuacccccagaccauccagcacaaccccaacggccgcuucgucgucgucugcggcgacggcgaguacaucaucuacaccgccauggcccuccgcaacaaguccuucggcuccgcccaggaguucgccugggcccacgacuccuccgaguacgccauccgcgaguccaacuccaucgucaagaucuucaagaacuucaaggagaagaaguccuucaagcccgacuucggcgccgaguccaucuacggcggcuuccuccucggcguccgcuccgucaacggccucgccuucuacgacugggacaacaccgagcucauccgccgcaucgagauccagcccaagcacaucuucugguccgacuccggcgagcucgucugcaucgccaccgaggaguccuucuucauccucaaguaccucuccgagaagguccucgccgcccaggagacccacgagggcgucaccgaggacggcaucgaggacgccuucgagguccucggcgagauccaggagaucgucaagaccggccucugggucggcgacugcuucaucuacaccuccuccgucaaccgccucaacuacuacgucggcggcgagaucgucaccaucgcccaccucgaccgcaccauguaccuccucggcuacauccccaaggacaaccgccucuaccucggcgacaaggagcucaacaucaucuccuacucccuccucgucuccguccucgaguaccagaccgccgucaugcgccgcgacuucuccauggccgacaagguccuccccaccauccccaaggagcagcgcacccgcgucgcccacuuccucgagaagcagggcuucaagcagcaggcccucaccgucuccaccgaccccgagcaccgcuucgagcucgcccuccagcucggcgagcucaagaucgccuaccagcucgccgucgaggccgaguccgagcagaaguggaagcagcucgccgagcucgccaucuccaagugccaguucggccucgcccaggagugccuccaccacgcccaggacuacggcggccuccuccuccucgccaccgccuccggcaacgccaacauggucaacaagcucgccgagggcgccgagcgcgacggcaagaacaacgucgccuucauguccuacuuccuccagggcaaggucgacgccugccucgagcuccucauccgcaccggccgccuccccgaggccgccuuccucgcccgcaccuaccuccccucccaggucucccgcgucgucaagcucuggcgcgagaaccucuccaaggucaaccagaaggccgccgagucccucgccgaccccaccgaguacgagaaccucuuccccggccucaaggaggccuucgucgucgaggagugggucaaggagacccacgccgaccucuggcccgccaagcaguacccccucgucacccccaacgaggagcgcaacgucauggaggagggcaaggacuuccagcccucccgcuccaccgcccagcaggagcucgacggcaagcccgccucccccacccccgucaucgucgccucccacaccgccaacaaggaggagaagucccuccucgagcucgaggucgaccucgacaaccucgagcucgaggacaucgacaccaccgacaucaaccucgacgaggacauccucgacgacuga

SEQ ID NO: 41624 - RNA, 927 nt, Artificial Sequence
  derived and/or modified sequence opt2 from COPE__Homo_sapiens__NP_009194
auggccccccccgcccccggccccgccuccggcggcuccggcgaggucgacgagcucuucgacgucaagaacgccuucuacaucggcuccuaccagcagugcaucaacgaggcccagcgcgucaagcucuccucccccgagcgcgacgucgagcgcgacgucuuccucuaccgcgccuaccucgcccagcgcaaguucggcgucguccucgacgagaucaagcccuccuccgcccccgagcuccaggccguccgcauguucgccgacuaccucgcccacgagucccgccgcgacuccaucgucgccgagcucgaccgcgagaugucccgcuccgucgacgucaccaacaccaccuuccuccucauggccgccuccaucuaccuccacgaccagaaccccgacgccgcccuccgcgcccuccaccagggcgacucccucgagugcaccgccaugaccguccagauccuccucaagcucgaccgccucgaccucgcccgcaaggagcucaagcgcaugcaggaccucgacgaggacgccacccucacccagcucgccaccgccugggucucccucgccaccggcggcgagaagcuccaggacgccuacuacaucuuccaggagauggccgacaagugcucccccacccuccuccuccucaacggccaggccgccugccacauggcccagggccgcugggaggccgccgagggccuccuccaggaggcccucgacaaggacuccggcuaccccgagacccucgucaaccucaucguccucucccagcaccucggcaagccccccgaggucaccaaccgcuaccucucccagcucaaggacgcccaccgcucccaccccuucaucaaggaguaccaggccaaggagaacgacuucgaccgccucguccuccaguacgcccccuccgccuga

SEQ ID NO: 41625 - RNA, 2181 nt, Artificial Sequence
  derived and/or modified sequence opt2 from COPG2__Homo_sapiens__NP_001276962
augaucaagaaguucgacaagaaggacgaggaguccggcuccggcuccaaccccuuccagcaccucgagaaguccgccguccuccaggaggcccgcaucuucaacgagacccccaucaacccccgccgcugccuccacauccucaccaagauccucuaccuccucaaccagggcgagcacuucggcaccaccgaggccaccgaggccuucuucgccaugacccgccucuuccaguccaacgaccagacccuccgccgcaugugcuaccucaccaucaaggagauggccaccaucuccgaggacgucaucaucgucaccuccucccucaccaaggacaugaccggcaaggaggacgucuaccgcggccccgccauccgcgcccucugccgcaucaccgacggcaccaugcuccaggccaucgagcgcuacaugaagcaggccaucgucgacaaggucuccuccgucuccuccuccgcccucgucuccucccuccacaugaugaagaucuccuacgacgucgucaagcgcuggaucaacgaggcccaggaggccgccuccuccgacaacaucaugguccaguaccacgcccucggcguccucuaccaccuccgcaagaacgaccgccucgccgucuccaagaugcucaacaaguucaccaaguccggccucaagucccaguucgccuacugcaugcucauccgcaucgccucccgccuccucaaggagaccgaggacggccacgaguccccccucuucgacuucaucgaguccugccuccgcaacaagcacgagauggucaucuacgaggccgccuccgccaucauccaccuccccaacugcaccgcccgcgagcucgcccccgccgucuccguccuccagcucuucugcuccucccccaagcccgcccuccgcuacgccgccguccgcacccucaacaaggucgccaugaagcaccccuccgccgucaccgccugcaaccucgaccucgagaaccucaucaccgacuccaaccgcuccaucgccacccucgccaucaccacccuccucaagaccggcuccgaguccuccgucgaccgccucaugaagcagaucuccuccuucgucuccgagaucuccgacgaguucaaggucgucgucguccaggccaucuccgcccucugccagaaguacccccgcaagcacuccgucaugaugaccuuccucuccaacaugcuccgcgacgacggcggcuucgaguacaagcgcgccaucgucgacugcaucaucuccaucgucgaggagaaccccgaguccaaggaggccggccucgcccaccucugcgaguucaucgaggacugcgagcacaccguccucgccaccaagauccuccaccuccucggcaaggagggcccccgcacccccguccccuccaaguacauccgcuucaucuucaaccgcgucguccucgagaacgaggccguccgcgccgccgccgucuccgcccucgccaaguucggcgcccagaacgagucccuccuccccuccauccucguccuccuccagcgcugcaugauggacaccgacgacgagguccgcgaccgcgccaccuucuaccucaacguccuccagcagcgccagauggcccucaacgccaccuacaucuucaacggccucaccgucuccguccccggcauggagaaggcccuccaccaguacacccucgagcccuccgagaagcccuucgacaugaaguccaucccccucgccauggcccccgucuucgagcagaaggccgagaucacccucgucgccaccaagcccgagaagcucgcccccucccgccaggacaucuuccaggagcagcucgccgccauccccgaguuccucaacaucggcccccucuucaaguccuccgagcccguccagcucaccgaggccgagaccgaguacuucguccgcugcaucaagcacauguucaccaaccacaucgucuuccaguucgacugcaccaacacccucaacgaccagcuccucgagaaggucaccguccagauggagcccuccgacuccuacgagguccucuccugcauccccgcccccucccuccccuacaaccagcccggcaucugcuacacccucguccgccuccccgacgacgaccccaccgccggcaccaacccccagaagggcggcgacaccuga

SEQ ID NO: 41626 - RNA, 555 nt, Artificial Sequence
  derived and/or modified sequence opt2 from COPRS__Homo_sapiens__NP_060875
auggaccuccaggccgccggcgcccaggcccagggcgccgccgagcccucccgcggccccccccuccccuccgcccgcggcgccccccccucccccgaggccggcuucgccaccgccgaccacuccucccaggagcgcgagaccgagaaggccauggaccgccucgcccgcggcacccaguccauccccaacgacucccccgcccgcggcgagggcacccacuccgaggaggagggcuucgccauggacgaggaggacuccgacggcgagcucaacaccugggagcucuccgagggcaccaacugcccccccaaggagcagcccggcgaccucuucaacgaggacugggacuccgagcucaaggccgaccagggcaaccccuacgacgccgacgacauccaggaguccaucucccaggagcucaagcccugggucugcugcgccccccagggcgacaugaucuacgaccccuccuggcaccacccccccccccucauccccuacuacuccaagauggucuucgagaccggccaguucgacgacgccgaggacuga

SEQ ID NO: 41627 - RNA, 1353 nt, Artificial Sequence
  derived and/or modified sequence opt2 from COPS2__Homo_sapiens__NP_001137359
auguccgacauggaggacgacuucaugugcgacgacgaggaggacuacgaccucgaguacuccgaggacuccaacuccgagcccaacgucgaccucgagaaccaguacuacaacuccaaggcccucaaggaggacgaccccaaggccgcccucuccuccuuccagaagguccucgagcucgagggcgagaagggcgaguggggcuucaaggcccucaagcagaugaucaagaucaacuucaagcucaccaacuuccccgagaugaugaaccgcuacaagcagcuccucaccuacauccgcuccgccgucacccgcaacuacuccgagaaguccaucaacuccauccucgacuacaucuccaccuccaagcagaacuccgacuuccucugccagauggaccuccuccaggaguucuacgagaccacccucgaggcccucaaggacgccaagaacgaccgccucugguucaagaccaacaccaagcucggcaagcucuaccucgagcgcgaggaguacggcaagcuccagaagauccuccgccagcuccaccaguccugccagaccgacgacggcgaggacgaccucaagaagggcacccagcuccucgagaucuacgcccucgagauccagauguacaccgcccagaagaacaacaagaagcucaaggcccucuacgagcagucccuccacaucaaguccgccaucccccacccccucaucaugggcgucauccgcgagugcggcggcaagaugcaccuccgcgagggcgaguucgagaaggcccacaccgacuucuucgaggccuucaagaacuacgacgaguccggcuccccccgccgcaccaccugccucaaguaccucguccucgccaacaugcucaugaaguccggcaucaaccccuucgacucccaggaggccaagcccuacaagaacgaccccgagauccucgccaugaccaaccucgucuccgccuaccagaacaacgacaucaccgaguucgagaagauccucaagaccaaccacuccaacaucauggacgaccccuucauccgcgagcacaucgaggagcuccuccgcaacauccgcacccagguccucaucaagcucaucaagcccuacacccgcauccacauccccuucaucuccaaggagcucaacaucgacgucgccgacgucgagucccuccucguccagugcauccucgacaacaccauccacggccgcaucgaccaggucaaccagcuccucgagcucgaccaccagaagcgcggcggcgcccgcuacaccgcccucgacaaguggaccaaccagcucaacucccucaaccaggccgucgucuccaagcucgccuga

SEQ ID NO: 41628 - RNA, 1212 nt, Artificial Sequence
  derived and/or modified sequence opt2 from COPS3__Homo_sapiens__NP_001186054
augacccagcucugcgagcucaucaacaaguccggcgagcuccucgccaagaaccucucccaccucgacaccguccucggcgcccucgacguccaggagcacucccucggcguccucgccguccucuucgucaaguucuccaugcccuccguccccgacuucgagacccucuucucccagguccagcucuucaucuccaccugcaacggcgagcacauccgcuacgccaccgacaccuucgccggccucugccaccagcucaccaacgcccucgucgagcgcaagcagccccuccgcggcaucggcauccucaagcaggccaucgacaagaugcagaugaacaccaaccagcucaccuccauccacgccgaccucugccagcucugccuccucgccaagugcuucaagcccgcccuccccuaccucgacgucgacaugauggacaucugcaaggagaacggcgccuacgacgccaagcacuuccucugcuacuacuacuacggcggcaugaucuacaccggccucaagaacuucgagcgcgcccucuacuucuacgagcaggccaucaccacccccgccauggccgucucccacaucaugcucgaguccuacaagaaguacauccucgucucccucauccuccucggcaagguccagcagcuccccaaguacaccucccagaucgucggccgcuucaucaagccccucuccaacgccuaccacgagcucgcccaggucuacuccaccaacaaccccuccgagcuccgcaaccucgucaacaagcacuccgagaccuucacccgcgacaacaacaugggccucgucaagcagugccucuccucccucuacaagaagaacauccagcgccucaccaagaccuuccucacccucucccuccaggacauggccucccgcguccagcucuccggcccccaggaggccgagaaguacguccuccacaugaucgaggacggcgagaucuucgccuccaucaaccagaaggacggcauggucuccuuccacgacaaccccgagaaguacaacaaccccgccaugcuccacaacaucgaccaggagaugcucaagugcaucgagcucgacgagcgccucaaggccauggaccaggagaucaccgucaacccccaguucguccagaaguccaugggcucccaggaggacgacuccggcaacaagcccuccuccuacuccuga

SEQ ID NO: 41629 - RNA, 1059 nt, Artificial Sequence
  derived and/or modified sequence opt2 from COPS4__Homo_sapiens__NP_001244935
auggccgccgccguccgccaggaccucgcccagcucaugaacuccuccggcucccacaaggaccucgccggcaaguaccgccagauccucgagaaggccauccagcucuccggcgccgagcagcucgaggcccucaaggccuucgucgaggccauggucaacgagaacgucucccucgucaucucccgccagcuccucaccgacuucugcacccaccuccccaaccuccccgacuccaccgccaaggagaucuaccacuucacccucgagaagauccagccccgcgucaucuccuucgaggagcaggucgccuccauccgccagcaccucgccuccaucuacgagaaggaggaggacuggcgcaacgccgcccagguccucgucggcaucccccucgagaccggccagaagcaguacaacgucgacuacaagcucgagaccuaccucaagaucgcccgccucuaccucgaggacgacgaccccguccaggccgaggccuacaucaaccgcgccucccuccuccagaacgaguccaccaacgagcagcuccagauccacuacaaggucugcuacgcccgcguccucgacuaccgccgcaaguucaucgaggccgcccagcgcuacaacgagcucuccuacaagaccaucguccacgaguccgagcgccucgaggcccucaagcacgcccuccacugcaccauccucgccuccgccggccagcagcgcucccgcaugcucgccacccucuucaaggacgagcgcugccagcagcucgccgccuacggcauccucgagaagauguaccucgaccgcaucauccgcggcaaccagcuccaggaguucgccgccaugcucaugccccaccagaaggccaccaccgccgacggcuccuccauccucgaccgcgccgucaucgagcacaaccuccucuccgccuccaagcucuacaacaacaucaccuucgaggagcucggcgcccuccucgagauccccgccgccaagcacgagaagcccugccagcgcggcaucucccgcuccaaccacuucgucuccaaguga

SEQ ID NO: 41630 - RNA, 1005 nt, Artificial Sequence
  derived and/or modified sequence opt2 from COPS5__Homo_sapiens__NP_006828
auggccgccuccggcuccggcauggcccagaagaccugggagcucgccaacaacaugcaggaggcccaguccaucgacgagaucuacaaguacgacaagaagcagcagcaggagauccucgccgccaagcccuggaccaaggaccaccacuacuucaaguacugcaagaucuccgcccucgcccuccucaagauggucaugcacgcccgcuccggcggcaaccucgaggucaugggccucaugcucggcaaggucgacggcgagaccaugaucaucauggacuccuucgcccuccccgucgagggcaccgagacccgcgucaacgcccaggccgccgccuacgaguacauggccgccuacaucgagaacgccaagcaggucggccgccucgagaacgccaucggcugguaccacucccaccccggcuacggcugcuggcucuccggcaucgacgucuccacccagaugcucaaccagcaguuccaggagcccuucgucgccgucgucaucgaccccacccgcaccaucuccgccggcaaggucaaccucggcgccuuccgcaccuaccccaagggcuacaagccccccgacgagggccccuccgaguaccagaccaucccccucaacaagaucgaggacuucggcguccacugcaagcaguacuacgcccucgaggucuccuacuucaaguccucccucgaccgcaagcuccucgagcuccucuggaacaaguacugggucaacacccucuccuccuccucccuccucaccaacgccgacuacaccaccggccaggucuucgaccucuccgagaagcucgagcaguccgaggcccagcucggccgcggcuccuucaugcucggccucgagacccacgaccgcaaguccgaggacaagcucgccaaggccacccgcgacuccugcaagaccaccaucgaggccauccacggccucaugucccaggucaucaaggacaagcucuucaaccagaucaacaucuccuga

SEQ ID NO: 41631 - RNA, 984 nt, Artificial Sequence
  derived and/or modified sequence opt2 from COPS6__Homo_sapiens__NP_006824
auggccgccgccgccgccgccgccgccgccaccaacggcaccggcggcuccuccggcauggaggucgacgccgccgucguccccuccgucauggccugcggcgucaccggcuccgucuccgucgcccuccacccccucgucauccucaacaucuccgaccacuggauccgcaugcgcucccaggagggccgccccguccaggucaucggcgcccucaucggcaagcaggagggccgcaacaucgaggucaugaacuccuucgagcuccucucccacaccgucgaggagaagaucaucaucgacaaggaguacuacuacaccaaggaggagcaguucaagcaggucuucaaggagcucgaguuccucggcugguacaccaccggcggcccccccgaccccuccgacauccacguccacaagcaggucugcgagaucaucgaguccccccucuuccucaagcucaaccccaugaccaagcacaccgaccuccccgucuccgucuucgaguccgucaucgacaucaucaacggcgaggccaccaugcucuucgccgagcucaccuacacccucgccaccgaggaggccgagcgcaucggcgucgaccacgucgcccgcaugaccgccaccggcuccggcgagaacuccaccgucgccgagcaccucaucgcccagcacuccgccaucaagaugcuccacucccgcgucaagcucauccucgaguacgucaaggccuccgaggccggcgagguccccuucaaccacgagauccuccgcgaggccuacgcccucugccacugccuccccguccucuccaccgacaaguucaagaccgacuucuacgaccagugcaacgacgucggccucauggccuaccucggcaccaucaccaagaccugcaacaccaugaaccaguucgucaacaaguucaacguccucuacgaccgccagggcaucggccgccgcaugcgcggccucuucuucuga

SEQ ID NO: 41632 - RNA, 828 nt, Artificial Sequence
  derived and/or modified sequence opt2 from COPS7A__Homo_sapiens__XP_005253752
auguccgccgaggucaaggucaccggccagaaccaggagcaguuccuccuccucgccaaguccgccaagggcgccgcccucgccacccucauccaccagguccucgaggcccccggcgucuacgucuucggcgagcuccucgacaugcccaacguccgcgagcucgccgaguccgacuucgccuccaccuuccgccuccucaccgucuucgccuacggcaccuacgccgacuaccucgccgaggcccgcaaccuccccccccucaccgaggcccagaagaacaagcuccgccaccucuccgucgucacccucgccgccaaggucaagugcauccccuacgccguccuccucgaggcccucgcccuccgcaacguccgccagcucgaggaccucgucaucgaggccgucuacgccgacguccuccgcggcucccucgaccagcgcaaccagcgccucgaggucgacuacuccaucggccgcgacauccagcgccaggaccucuccgccaucgcccgcacccuccaggaguggugcgucggcugcgaggucguccucuccggcaucgaggagcaggucucccgcgccaaccagcacaaggagcagcagcucggccucaagcagcagaucgaguccgaggucgccaaccucaagaagaccaucaaggucaccaccgccgccgccgccgccgccaccucccaggaccccgagcagcaccucaccgagcuccgcgagcccgcccccggcaccaaccagcgccagcccuccaagaaggccuccaagggcaagggccuccgcggcuccgccaagaucugguccaaguccaacuga

SEQ ID NO: 41633 - RNA, 630 nt, Artificial Sequence
  derived and/or modified sequence opt2 from COPS8__Homo_sapiens__NP_006701
augcccgucgccgucauggccgaguccgccuucuccuucaagaagcuccucgaccagugcgagaaccaggagcucgaggcccccggcggcaucgccaccccccccgucuacggccagcuccucgcccucuaccuccuccacaacgacaugaacaacgcccgcuaccucuggaagcgcaucccccccgccaucaaguccgccaacuccgagcucggcggcaucugguccgucggccagcgcaucuggcagcgcgacuuccccggcaucuacaccaccaucaacgcccaccagugguccgagaccguccagcccaucauggaggcccuccgcgacgccacccgccgccgcgccuucgcccucgucucccaggccuacaccuccaucaucgccgacgacuucgccgccuucgucggccuccccgucgaggaggccgucaagggcauccucgagcagggcuggcaggccgacuccaccacccgcaugguccucccccgcaagcccgucgccggcgcccucgacgucuccuucaacaaguucaucccccucuccgagcccgcccccgucccccccauccccaacgagcagcagcucgcccgccucaccgacuacgucgccuuccucgagaacuga

SEQ ID NO: 41634 - RNA, 633 nt, Artificial Sequence
  derived and/or modified sequence opt2 from COPZ2__Homo_sapiens__NP_057513
augcagcgccccgaggccuggccccgcccccaccccggcgagggcgccgccgccgcccaggccggcggccccgccccccccgcccgcgccggcgagcccuccggccuccgccuccaggagcccucccucuacaccaucaaggccgucuucauccucgacaacgacggccgccgccuccucgccaaguacuacgacgacaccuuccccuccaugaaggagcagauggucuucgagaagaacgucuucaacaagaccucccgcaccgaguccgagaucgccuucuucggcggcaugaccaucgucuacaagaacuccaucgaccucuuccucuacgucgucggcuccuccuacgagaacgagcucaugcucauguccguccucaccugccucuucgagucccucaaccacaugcuccgcaagaacgucgagaagcgcuggcuccucgagaacauggacggcgccuuccucguccucgacgagaucgucgacggcggcgucauccucgaguccgacccccagcaggucauccagaaggucaacuuccgcgccgacgacggcggccucaccgagcaguccgucgcccagguccuccaguccgccaaggagcagaucaaguggucccuccucaaguga

SEQ ID NO: 41635 - RNA, 1266 nt, Artificial Sequence
  derived and/or modified sequence opt2 from COQ2__Homo_sapiens__NP_056512
augacccccaucucccagguccgcaugcgcaagggcuccgcccacaccgccgcccagcccggccgccucggccuccaccccgccggcgccaccgcccacgccugccgcggcaugaccuccauccgcgcccgccccggccucaccuccgccaugcucggcucccgcgccgccggcuucgcccgcggccuccgcgccgucgcccucgccuggcuccccggcuggcgcggccgcuccuucgcccucgcccgcgccgccggcgccccccacggcggcgaccuccagccccccgccugccccgagccccgcggccgccagcucucccucuccgccgccgccgucgucgacuccgccccccgcccccuccagcccuaccuccgccucaugcgccucgacaagcccaucggcaccuggcuccucuaccuccccugcaccugguccaucggccucgccgccgagcccggcugcuuccccgacugguacaugcucucccucuucggcaccggcgccauccucaugcgcggcgccggcugcaccaucaacgacaugugggaccaggacuacgacaagaaggucacccgcaccgccaaccgccccaucgccgccggcgacaucuccaccuuccaguccuucgucuuccucggcggccagcucacccucgcccucggcguccuccucugccucaacuacuacuccaucgcccucggcgccggcucccuccuccucgucaucaccuacccccucaugaagcgcaucuccuacuggccccagcucgcccucggccucaccuucaacuggggcgcccuccucggcugguccgccaucaagggcuccugcgaccccuccgucugccucccccucuacuucuccggcgucauguggacccucaucuacgacaccaucuacgcccaccaggacaagcgcgacgacguccucaucggccucaaguccaccgcccuccgcuucggcgagaacaccaagcccuggcucuccggcuucuccgucgccaugcucggcgcccucucccucgucggcgucaacuccggccagaccgcccccuacuacgccgcccucggcgccgucggcgcccaccucacccaccagaucuacacccucgacauccaccgccccgaggacugcuggaacaaguucaucuccaaccgcacccucggccucaucgucuuccucggcaucguccucggcaaccucuggaaggagaagaagaccgacaagaccaagaagggcaucgagaacaagaucgagaacuga

SEQ ID NO: 41636 - RNA, 1110 nt, Artificial Sequence
  derived and/or modified sequence opt2 from COQ3__Homo_sapiens__NP_059117
augugguccggccgcaagcucggcuccuccggcggcugguuccuccgcguccucggccccggcggcugcaacaccaaggccgcccgcccccucaucuccuccgccgucuacgucaagaaccagcucuccggcacccuccagaucaagcccggcgucuucaacgaguaccgcaccaucugguucaaguccuaccgcaccaucuucuccugccucaaccgcaucaaguccuuccgcuaccccugggcccgccucuacuccaccucccagaccaccgucgacuccggcgaggucaagaccuuccucgcccucgcccacaaguggugggacgagcagggcgucuacgccccccuccacuccaugaacgaccuccgcguccccuucauccgcgacaaccuccucaagaccauccccaaccaccagcccggcaagccccuccucggcaugaagauccucgacgucggcugcggcggcggccuccucaccgagccccucggccgccucggcgccuccgucaucggcaucgaccccgucgacgagaacaucaagaccgcccagugccacaaguccuucgaccccguccucgacaagcgcaucgaguaccgcgucugcucccucgaggagaucgucgaggagaccgccgagaccuucgacgccgucgucgccuccgaggucgucgagcacgucaucgaccucgagaccuuccuccagugcugcugccagguccucaagcccggcggcucccucuucaucaccaccaucaacaagacccagcucuccuacgcccucggcaucgucuucuccgagcagaucgccuccaucguccccaagggcacccacaccugggagaaguucgucucccccgagacccucgaguccauccucgaguccaacggccucuccguccagaccgucgucggcaugcucuacaaccccuucuccggcuacuggcacugguccgagaacaccucccucaacuacgccgccuacgccgucaagucccgcguccaggagcaccccgccuccgccgaguucguccucaagggcgagaccgaggagcuccaggccaacgccugcaccaaccccgccguccacgagaagcucaagaaguga

SEQ ID NO: 41637 - RNA, 798 nt, Artificial Sequence
  derived and/or modified sequence opt2 from COQ4__Homo_sapiens__NP_057119
auggccacccuccuccgccccguccuccgccgccucugcggccuccccggccuccagcgccccgccgccgagaugccccuccgcgcccgcuccgacggcgccggcccccucuacucccaccaccuccccaccuccccccuccagaaggcccuccucgccgccggcuccgccgccauggcccucuacaaccccuaccgccacgacauggucgccguccucggcgagaccaccggccaccgcacccucaagguccuccgcgaccagaugcgccgcgaccccgagggcgcccagauccuccaggagcgcccccgcaucuccaccuccacccucgaccucggcaagcuccagucccuccccgagggcucccucggccgcgaguaccuccgcuuccucgacgucaaccgcgucucccccgacacccgcgcccccacccgcuucgucgacgacgaggagcucgccuacgucauccagcgcuaccgcgagguccacgacaugcuccacacccuccucggcaugcccaccaacauccucggcgagaucgucgucaagugguucgaggccguccagaccggccuccccaugugcauccucggcgccuucuucggccccauccgccucggcgcccagucccuccagguccucgucuccgagcucauccccugggccguccagaacggccgccgcgcccccugcguccucaaccucuacuacgagcgccgcugggagcagucccuccgcgcccuccgcgaggagcucggcaucaccgccccccccaugcacguccagggccucgccuga

SEQ ID NO: 41638 - RNA, 984 nt, Artificial Sequence
  derived and/or modified sequence opt2 from COQ5__Homo_sapiens__NP_115690
auggccgcccccggcuccugcgcccucugguccuacugcggccgcggcuggucccgcgccaugcgcggcugccagcuccucggccuccgcuccuccuggcccggcgaccuccucuccgcccgccuccucucccaggagaagcgcgccgccgagacccacuucggcuucgagaccgucuccgaggaggagaagggcggcaaggucuaccaggucuucgaguccgucgccaagaaguacgacgucaugaacgacaugaugucccucggcauccaccgcgucuggaaggaccuccuccucuggaagaugcacccccuccccggcacccagcuccucgacgucgccggcggcaccggcgacaucgccuuccgcuuccucaacuacguccagucccagcaccagcgcaagcagaagcgccagcuccgcgcccagcagaaccucuccugggaggagaucgccaaggaguaccagaacgaggaggacucccucggcggcucccgcgucgucgucugcgacaucaacaaggagaugcucaaggucggcaagcagaaggcccucgcccagggcuaccgcgccggccucgccuggguccucggcgacgccgaggagcuccccuucgacgacgacaaguucgacaucuacaccaucgccuucggcauccgcaacgucacccacaucgaccaggcccuccaggaggcccaccgcguccucaagcccggcggccgcuuccucugccucgaguucucccaggucaacaacccccucaucucccgccucuacgaccucuacuccuuccaggucauccccguccucggcgaggucaucgccggcgacuggaaguccuaccaguaccucgucgaguccauccgccgcuuccccucccaggaggaguucaaggacaugaucgaggacgccggcuuccacaaggucaccuacgagucccucaccuccggcaucgucgccauccacuccggcuucaagcucuga

SEQ ID NO: 41639 - RNA, 1407 nt, Artificial Sequence
  derived and/or modified sequence opt2 from COQ6__Homo_sapiens__NP_872282
auggccgcccgccucgucucccgcugcggcgccguccgcgccgccccccacuccggcccccucgucuccuggcgccgcugguccggcgccuccaccgacaccgucuacgacgucgucgucuccggcggcggccucgucggcgccgccauggccugcgcccucggcuacgacauccacuuccacgacaagaagauccuccuccucgaggccggccccaagaagguccucgagaagcucuccgagaccuacuccaaccgcgucuccuccaucucccccggcuccgccacccuccucuccuccuucggcgccugggaccacaucugcaacaugcgcuaccgcgccuuccgccgcaugcaggucugggacgccugcuccgaggcccucaucauguucgacaaggacaaccucgacgacaugggcuacaucgucgagaacgacgucaucaugcacgcccucaccaagcagcucgaggccgucuccgaccgcgucaccguccucuaccgcuccaaggccauccgcuacaccuggcccugccccuuccccauggccgacuccucccccuggguccacaucacccucggcgacggcuccaccuuccagaccaagcuccucaucggcgccgacggccacaacuccggcguccgccaggccgucggcauccagaacgucuccuggaacuacgaccaguccgccgucgucgccacccuccaccucuccgaggccaccgagaacaacgucgccuggcagcgcuuccuccccuccggccccaucgcccuccucccccucuccgacacccucuccucccucgucugguccaccucccacgagcacgccgccgagcucgucuccauggacgaggagaaguucgucgacgccgucaacuccgccuucugguccgacgccgaccacaccgacuucaucgacaccgccggcgccaugcuccaguacgccgucucccuccucaagcccaccaaggucuccgcccgccagcucccccccuccgucgcccgcgucgacgccaagucccgcguccucuucccccucggccucggccacgccgccgaguacguccgcccccgcgucgcccucaucggcgacgccgcccaccgcguccacccccucgccggccagggcgucaacaugggcuucggcgacaucuccucccucgcccaccaccucuccaccgccgccuucaacggcaaggaccucggcuccgucucccaccucaccggcuacgagaccgagcgccagcgccacaacaccgcccuccucgccgccaccgaccuccucaagcgccucuacuccaccuccgccuccccccucguccuccuccgcaccuggggccuccaggccaccaacgccgucuccccccucaaggagcagaucauggccuucgccuccaaguga

SEQ ID NO: 41640 - RNA, 540 nt, Artificial Sequence
  derived and/or modified sequence opt2 from COQ7__Homo_sapiens__NP_001177912
augacccucgacaacaucucccgcgccgccgucgaccgcaucauccgcgucgaccacgccggcgaguacggcgccaaccgcaucuacgccggccagauggccguccucggccgcaccuccgucggccccgucauccagaagaugugggaccaggagaaggaccaccucaagaaguucaacgagcucauggucaccuuccgcguccgccccaccguccucaugccccucuggaacguccucggcuucgcccucggcgccggcaccgcccuccucggcaaggagggcgccauggccugcaccgucgccgucgaggaguccaucgcccaccacuacaacaaccagauccgcacccucauggaggaggaccccgagaaguacgaggagcuccuccagcucaucaagaaguuccgcgacgaggagcucgagcaccacgacaucggccucgaccacgacgccgagcucgcccccgccuacgccguccucaaguccaucauccaggccggcugccgcgucgccaucuaccucuccgagcgccucuga

SEQ ID NO: 41641 - RNA, 957 nt, Artificial Sequence
  derived and/or modified sequence opt2 from COQ9__Homo_sapiens__NP_064708
auggccgccgccgccgucuccggcgcccucggccgcgccggcuggcgccuccuccagcuccgcugccuccccgucgcccgcugccgccaggcccucgucccccgcgccuuccacgccuccgccgucggccuccgcuccuccgacgagcagaagcagcagccccccaacuccuucucccagcagcacuccgagacccagggcgccgagaagcccgaccccgaguccucccacucccccccccgcuacaccgaccagggcggcgaggaggaggaggacuacgaguccgaggagcagcuccagcaccgcauccucaccgccgcccucgaguucguccccgcccacggcuggaccgccgaggccaucgccgagggcgcccagucccucggccucuccuccgccgccgccuccauguucggcaaggacggcuccgagcucauccuccacuucgucacccagugcaacacccgccucacccgcguccucgaggaggagcagaagcucguccagcucggccaggccgagaagcgcaagaccgaccaguuccuccgcgacgccgucgagacccgccuccgcaugcucauccccuacaucgagcacuggccccgcgcccucuccauccucaugcucccccacaacauccccuccucccucucccuccucaccuccauggucgacgacauguggcacuacgccggcgaccaguccaccgacuucaacugguacacccgccgcgccaugcucgccgccaucuacaacaccaccgagcucgucaugaugcaggacuccucccccgacuucgaggacaccuggcgcuuccucgagaaccgcgucaacgacgccaugaacaugggccacaccgccaagcaggucaaguccaccggcgaggcccucguccagggccucaugggcgccgccgucacccucaagaaccucaccggccucaaccagcgccgcuga

SEQ ID NO: 41642 - RNA, 3129 nt, Artificial Sequence
  derived and/or modified sequence opt2 from CORIN__Homo_sapiens__NP_006578
augaagcagucccccgcccucgcccccgaggagcgcugccgccgcgccggcucccccaagcccguccuccgcgccgacgacaacaacaugggcaacggcugcucccagaagcucgccaccgccaaccuccuccgcuuccuccuccucguccucauccccugcaucugcgcccucguccuccuccucgucauccuccucuccuacgucggcacccuccagaaggucuacuucaaguccaacggcuccgagccccucgucaccgacggcgagauccagggcuccgacgucauccucaccaacaccaucuacaaccaguccaccgucgucuccaccgcccaccccgaccagcacguccccgccuggaccaccgacgccucccuccccggcgaccagucccaccgcaacaccuccgccugcaugaacaucacccacucccagugccagaugcuccccuaccacgccacccucaccccccuccucuccgucguccgcaacauggagauggagaaguuccucaaguucuucaccuaccuccaccgccucuccugcuaccagcacaucaugcucuucggcugcacccucgccuuccccgagugcaucaucgacggcgacgacucccacggccuccuccccugccgcuccuucugcgaggccgccaaggagggcugcgaguccguccucggcauggucaacuacuccuggcccgacuuccuccgcugcucccaguuccgcaaccagaccgaguccuccaacgucucccgcaucugcuucuccccccagcaggagaacggcaagcagcuccucugcggccgcggcgagaacuuccucugcgccuccggcaucugcauccccggcaagcuccagugcaacggcuacaacgacugcgacgacugguccgacgaggcccacugcaacugcuccgagaaccucuuccacugccacaccggcaagugccucaacuacucccucgucugcgacggcuacgacgacugcggcgaccucuccgacgagcagaacugcgacugcaaccccaccaccgagcaccgcugcggcgacggccgcugcaucgccauggagugggucugcgacggcgaccacgacugcgucgacaaguccgacgaggucaacugcuccugccacucccagggccucgucgagugccgcaacggccagugcauccccuccaccuuccagugcgacggcgacgaggacugcaaggacggcuccgacgaggagaacugcuccgucauccagaccuccugccaggagggcgaccagcgcugccucuacaaccccugccucgacuccugcggcggcuccucccucugcgaccccaacaacucccucaacaacugcucccagugcgagcccaucacccucgagcucugcaugaaccuccccuacaacuccaccuccuaccccaacuacuucggccaccgcacccagaaggaggccuccaucuccugggaguccucccucuuccccgcccucguccagaccaacugcuacaaguaccucauguucuucuccugcaccauccucguccccaagugcgacgucaacaccggcgagcacaucccccccugccgcgcccucugcgagcacuccaaggagcgcugcgaguccguccucggcaucgucggccuccaguggcccgaggacaccgacugcucccaguuccccgaggagaacuccgacaaccagaccugccucaugcccgacgaguacgucgaggagugcucccccucccacuucaagugccgcuccggccagugcguccucgccucccgccgcugcgacggccaggccgacugcgacgacgacuccgacgaggagaacugcggcugcaaggagcgcgaccucugggagugccccuccaacaagcagugccucaagcacaccgucaucugcgacggcuuccccgacugccccgacuacauggacgagaagaacugcuccuucugccaggacgacgagcucgagugcgccaaccacgccugcgucucccgcgaccucuggugcgacggcgaggccgacugcuccgacuccuccgacgagugggacugcgucacccucuccaucaacgucaacuccuccuccuuccucaugguccaccgcgccgccaccgagcaccacgucugcgccgacggcuggcaggagauccucucccagcucgccugcaagcagaugggccucggcgagcccuccgucaccaagcucauccaggagcaggagaaggagccccgcuggcucacccuccacuccaacugggagucccucaacggcaccacccuccacgagcuccucgucaacggccaguccugcgagucccgcuccaagaucucccuccucugcaccaagcaggacugcggccgccgccccgccgcccgcaugaacaagcgcauccucggcggccgcaccucccgccccggccgcuggcccuggcagugcucccuccaguccgagcccuccggccacaucugcggcugcguccucaucgccaagaaguggguccucaccgucgcccacugcuucgagggccgcgagaacgccgccgucuggaaggucguccucggcaucaacaaccucgaccaccccuccgucuucaugcagacccgcuucgucaagaccaucauccuccacccccgcuacucccgcgccgucgucgacuacgacaucuccaucgucgagcucuccgaggacaucuccgagaccggcuacguccgccccgucugccuccccaaccccgagcaguggcucgagcccgacaccuacugcuacaucaccggcuggggccacaugggcaacaagaugcccuucaagcuccaggagggcgagguccgcaucaucucccucgagcacugccaguccuacuucgacaugaagaccaucaccacccgcaugaucugcgccggcuacgaguccggcaccgucgacuccugcaugggcgacuccggcggcccccucgucugcgagaagcccggcggccgcuggacccucuucggccucaccuccuggggcuccgucugcuucuccaagguccucggccccggcgucuacuccaacgucuccuacuucgucgaguggaucaagcgccagaucuacauccagaccuuccuccucaacuga

SEQ ID NO: 41643 - RNA, 1386 nt, Artificial Sequence
  derived and/or modified sequence opt2 from CORO1A__Homo_sapiens__XP_011544016
augucccgccaggucguccgcuccuccaaguuccgccacgucuucggccagcccgccaaggccgaccagugcuacgaggacguccgcgucucccagaccaccugggacuccggcuucugcgccgucaaccccaaguucgucgcccucaucugcgaggccuccggcggcggcgccuuccucguccucccccucggcaagaccggccgcgucgacaagaacgcccccaccgucugcggccacaccgcccccguccucgacaucgccuggugcccccacaacgacaacgucaucgccuccggcuccgaggacugcaccgucauggucugggagauccccgacggcggccucaugcucccccuccgcgagcccgucgucacccucgagggccacaccaagcgcgucggcaucgucgccuggcacaccaccgcccagaacguccuccucuccgccggcugcgacaacgucaucauggucugggacgucggcaccggcgccgccaugcucacccucggccccgagguccaccccgacaccaucuacuccgucgacuggucccgcgacggcggccucaucugcaccuccugccgcgacaagcgcguccgcaucaucgagccccgcaagggcaccgucgucgccgagaaggaccgcccccacgagggcacccgccccguccgcgccgucuucgucuccgagggcaagauccucaccaccggcuucucccgcauguccgagcgccaggucgcccucugggacaccaagcaccucgaggagccccucucccuccaggagcucgacaccuccuccggcguccuccuccccuucuucgaccccgacaccaacaucgucuaccucugcggcaagggcgacuccuccauccgcuacuucgagaucaccuccgaggcccccuuccuccacuaccucuccauguucuccuccaaggagucccagcgcggcaugggcuacaugcccaagcgcggccucgaggucaacaagugcgagaucgcccgcuucuacaagcuccacgagcgccgcugcgagcccaucgccaugaccgucccccgcaaguccgaccucuuccaggaggaccucuacccccccaccgccggccccgaccccgcccucaccgccgaggaguggcucggcggccgcgacgccggcccccuccucaucucccucaaggacggcuacgucccccccaagucccgcgagcuccgcgucaaccgcggccucgacaccggccgccgccgcgccgcccccgaggccuccggcacccccuccuccgacgccgucucccgccucgaggaggagaugcgcaagcuccaggccaccguccaggagcuccagaagcgccucgaccgccucgaggagaccguccaggccaaguga

SEQ ID NO: 41644 - RNA, 1470 nt, Artificial Sequence
  derived and/or modified sequence opt2 from CORO1B__Homo_sapiens__NP_001018080
auguccuuccgcaaggucguccgccaguccaaguuccgccacgucuucggccagcccgucaagaacgaccagugcuacgaggacauccgcgucucccgcgucaccugggacuccaccuucugcgccgucaaccccaaguuccucgccgucaucgucgaggccuccggcggcggcgccuuccucguccucccccucuccaagaccggccgcaucgacaaggccuaccccaccgucugcggccacaccggccccguccucgacaucgacuggugcccccacaacgacgaggucaucgccuccggcuccgaggacugcaccgucauggucuggcagauccccgagaacggccucaccuccccccucaccgagcccgucgucguccucgagggccacaccaagcgcgucggcaucaucgccuggcaccccaccgcccgcaacguccuccucuccgccggcugcgacaacgucguccucaucuggaacgucggcaccgccgaggagcucuaccgccucgacucccuccaccccgaccucaucuacaacgucuccuggaaccacaacggcucccucuucugcuccgccugcaaggacaaguccguccgcaucaucgacccccgccgcggcacccucgucgccgagcgcgagaaggcccacgagggcgcccgccccaugcgcgccaucuuccucgccgacggcaaggucuucaccaccggcuucucccgcauguccgagcgccagcucgcccucugggaccccgagaaccucgaggagcccauggcccuccaggagcucgacuccuccaacggcgcccuccuccccuucuacgaccccgacaccuccgucgucuacgucugcggcaagggcgacuccuccauccgcuacuucgagaucaccgaggagccccccuacauccacuuccucaacaccuucaccuccaaggagccccagcgcggcaugggcuccaugcccaagcgcggccucgaggucuccaagugcgagaucgcccgcuucuacaagcuccacgagcgcaagugcgagcccaucgucaugaccgucccccgcaaguccgaccucuuccaggacgaccucuaccccgacaccgccggccccgaggccgcccucgaggccgaggagugggucuccggccgcgacgccgaccccauccucaucucccuccgcgaggccuacguccccuccaagcagcgcgaccucaagaucucccgccgcaacguccucuccgacucccgccccgccauggcccccggcuccucccaccucggcgcccccgccuccaccaccaccgccgccgacgccacccccuccggcucccucgcccgcgccggcgaggccggcaagcucgaggaggucaugcaggagcuccgcgcccuccgcgcccucgucaaggagcagggcgaccgcaucugccgccucgaggagcagcucggccgcauggagaacggcgacgccuga

SEQ ID NO: 41645 - RNA, 1584 nt, Artificial Sequence
  derived and/or modified sequence opt2 from CORO1C__Homo_sapiens__NP_001098707
auguacggccccggcucccagcucggcaaguccggcaacaacuccugggccaaggagcgcggcugcuccaucgccugccagggcucccucaccuccgcccgccuccacgcccccuccaucggcgagcgcccccucucccacaugcgcuggaaggacaccaugcgccgcgucguccgccaguccaaguuccgccacgucuucggccaggccgucaagaacgaccagugcuacgacgacauccgcgucucccgcgucaccugggacuccuccuucugcgccgucaacccccgcuucgucgccaucaucaucgaggccuccggcggcggcgccuuccucguccucccccuccacaagaccggccgcaucgacaaguccuaccccaccgucugcggccacaccggccccguccucgacaucgacuggugcccccacaacgaccaggucaucgccuccggcuccgaggacugcaccgucauggucuggcagauccccgagaacggccucacccucucccucaccgagcccgucgucauccucgagggccacuccaagcgcgucggcaucgucgccuggcaccccaccgcccgcaacguccuccucuccgccggcugcgacaacgccaucaucaucuggaacgucggcaccggcgaggcccucaucaaccucgacgacaugcacuccgacaugaucuacaacgucuccuggaaccgcaacggcucccucaucugcaccgccuccaaggacaagaagguccgcgucaucgacccccgcaagcaggagaucgucgccgagaaggagaaggcccacgagggcgcccgccccaugcgcgccaucuuccucgccgacggcaacgucuucaccaccggcuucucccgcauguccgagcgccagcucgcccucuggaaccccaagaacaugcaggagcccaucgcccuccacgagauggacaccuccaacggcguccuccuccccuucuacgaccccgacaccuccaucaucuaccucugcggcaagggcgacuccuccauccgcuacuucgagaucaccgacgagucccccuacguccacuaccucaacaccuucuccuccaaggagccccagcgcggcaugggcuacaugcccaagcgcggccucgacgucaacaagugcgagaucgcccgcuucuucaagcuccacgagcgcaagugcgagcccaucaucaugaccgucccccgcaaguccgaccucuuccaggacgaccucuaccccgacaccgccggccccgaggccgcccucgaggccgaggagugguucgagggcaagaacgccgaccccauccucaucucccucaagcacggcuacauccccggcaagaaccgcgaccucaaggucgucaagaagaacauccucgacuccaagcccaccgccaacaagaagugcgaccucaucuccauccccaagaagaccaccgacaccgccuccguccagaacgaggccaagcucgacgagauccucaaggagaucaaguccaucaaggacaccaucugcaaccaggacgagcgcaucuccaagcucgagcagcagauggccaagaucgccgccuga

SEQ ID NO: 41646 - RNA, 1578 nt, Artificial Sequence
  derived and/or modified sequence opt2 from CORO2A__Homo_sapiens__XP_011517288
auguccuggcacccccaguaccgcuccuccaaguuccgccacgucuucggcaagcccgccuccaaggagaacugcuacgacuccguccccaucacccgcuccguccacgacaaccacuucugcgccgucaacccccacuucaucgccgucgucaccgagugcgccggcggcggcgccuuccucgucaucccccuccaccagaccggcaagcucgacccccacuaccccaaggucugcggccaccgcggcaacguccucgacgucaaguggaaccccuucgacgacuucgagaucgccuccugcuccgaggacgccaccaucaagaucugguccauccccaagcagcuccucacccgcaaccucaccgccuaccgcaaggagcucgucggccacgcccgccgcgucggccucgucgaguggcaccccaccgccgccaacauccucuucuccgccggcuacgacuacaaggucaugaucuggaaccucgacaccaaggaguccgucaucaccucccccauguccaccaucuccugccaccaggacgucauccucuccauguccuucaacaccaacggcucccuccucgccaccaccugcaaggaccgcaagauccgcgucaucgacccccgcgccggcaccguccuccaggaggccuccuacaagggccaccgcgccuccaagguccucuuccucggcaaccucaagaagcucauguccaccggcaccucccgcuggaacaaccgccaggucgcccucugggaccaggacaaccucuccgucccccucauggaggaggaccucgacggcuccuccggcguccucuuccccuucuacgacgccgacaccuccaugcucuacgucgucggcaagggcgacggcaacauccgcuacuacgaggucuccgccgacaagccccaccucuccuaccucaccgaguaccgcuccuacaacccccagaagggcaucggcgucaugcccaagcgcggccucgacgucuccuccugcgagaucuuccgcuucuacaagcucaucaccaccaagucccucaucgagcccaucuccaugaucgucccccgccgcuccgaguccuaccaggaggacaucuacccccccaccgccggcgcccagcccucccucaccgcccaggaguggcucuccggcaugaaccgcgaccccauccucgucucccuccgccccggcuccgagcuccuccgcccccacccccuccccgccgagcgccccaucuucaacuccauggcccccgccuccccccgccuccucaaccagaccgagaagcucgccgccgaggacggcuggcgcuccuccucccuccucgaggagaagaugccccgcugggccgccgagcaccgccucgaggagaagaagaccuggcucaccaacggcuucgacgucuucgagugccccccccccaagaccgagaacgagcuccuccagauguucuaccgccagcaggaggagauccgccgccuccgcgagcuccucacccagcgcgagguccaggccaagcagcucgagcucgagaucaagaaccuccgcaugggcuccgagcagcucuga

SEQ ID NO: 41647 - RNA, 1428 nt, Artificial Sequence
  derived and/or modified sequence opt2 from CORO2B__Homo_sapiens__NP_001177385
auguccuggcgcccccaguaccgcuccuccaaguuccgcaacgucuacggcaaggucgccaaccgcgagcacugcuucgacggcauccccaucaccaagaacguccacgacaaccacuucugcgccgucaacacccgcuuccucgccaucgucaccgaguccgccggcggcggcuccuuccucgucaucccccucgagcagaccggccgcaucgagcccaacuaccccaaggucugcggccaccagggcaacguccucgacaucaaguggaaccccuucaucgacaacaucaucgccuccugcuccgaggacaccuccguccgcaucugggagauccccgagggcggccucaagcgcaacaugaccgaggcccuccucgagcuccacggccacucccgccgcgucggccucgucgaguggcaccccaccaccaacaacauccucuucuccgccggcuacgacuacaagguccucaucuggaaccucgacgucggcgagcccgucaagaugaucgacugccacaccgacgucauccucugcauguccuucaacaccgacggcucccuccucaccaccaccugcaaggacaagaagcuccgcgucaucgagccccgcuccggccgcguccuccaggaggccaacugcaagaaccaccgcgucaaccgcgucgucuuccucggcaacaugaagcgccuccucaccaccggcgucucccgcuggaacacccgccagaucgcccucugggaccaggaggaccucuccaugccccucaucgaggaggagaucgacggccucuccggccuccucuuccccuucuacgacgccgacacccacaugcucuaccucgccggcaagggcgacggcaacauccgcuacuacgagaucuccaccgagaagcccuaccucuccuaccucauggaguuccgcucccccgccccccagaagggccucggcgucaugcccaagcacggccucgacgucuccgccugcgaggucuuccgcuucuacaagcucgucacccucaagggccucaucgagcccaucuccaugaucgucccccgccgcuccgacuccuaccaggaggacaucuaccccaugacccccggcaccgagcccgcccucacccccgacgaguggcucggcggcaucaaccgcgaccccguccucaugucccucaaggagggcuacaagaaguccuccaagauggucuucaaggcccccaucaaggagaagaaguccgucgucgucaacggcaucgaccuccucgagaacguccccccccgcaccgagaacgagcuccuccgcauguucuuccgccagcaggacgagauccgccgccucaaggaggagcucgcccagaaggacauccgcauccgccagcuccagcucgagcucaagaaccuccgcaacucccccaagaacugcuga

SEQ ID NO: 41648 - RNA, 1419 nt, Artificial Sequence
  derived and/or modified sequence opt2 from CORO6__Homo_sapiens__NP_116243
augucccgccgcgucguccgccaguccaaguuccgccacgucuucggccaggccgccaaggccgaccaggccuacgaggacauccgcgucuccaaggucaccugggacuccuccuucugcgccgucaaccccaaguuccucgccaucaucgucgaggccggcggcggcggcgccuucaucguccucccccucgccaagaccggccgcgucgacaagaacuacccccucgucaccggccacaccgcccccguccucgacaucgacuggugcccccacaacgacaacgucaucgccuccgccuccgacgacaccaccaucauggucuggcagauccccgacuacacccccaugcgcaacaucaccgagcccaucaucacccucgagggccacuccaagcgcgucggcauccucuccuggcaccccaccgcccgcaacguccuccucuccgccggcggcgacaacgucaucaucaucuggaacgucggcaccggcgagguccuccucucccucgacgacaugcaccccgacgucauccacuccgucugcuggaacuccaacggcucccuccucgccaccaccugcaaggacaagacccuccgcaucaucgacccccgcaagggccaggucgucgccgagcgcuucgccgcccacgagggcaugcgccccaugcgcgccgucuucacccgccagggccacaucuucaccaccggcuucacccgcaugucccagcgcgagcucggccucugggaccccaacaacuucgaggagcccgucgcccuccaggagauggacaccuccaacggcguccuccuccccuucuacgaccccgacuccuccaucgucuaccucugcggcaagggcgacuccuccauccgcuacuucgagaucaccgacgagccccccuucguccacuaccucaacaccuucuccuccaaggagccccagcgcggcaugggcuucaugcccaagcgcggccucgacgucuccaagugcgagaucgcccgcuucuacaagcuccacgagcgcaagugcgagcccaucaucaugaccgucccccgcaaguccgaccucuuccaggacgaccucuaccccgacacccccggccccgagcccgcccucgaggccgacgaguggcucuccggccaggacgccgagcccguccucaucucccuccgcgacggcuacgucccccccaagcaccgcgagcuccgcgucaccaagcgcaacauccucgacguccgcccccccuccggcccccgccgcucccaguccgccuccgacgccccccucucccagcagcacacccucgagacccuccucgaggagaucaaggcccuccgcgagcgcguccaggcccaggagcagcgcaucaccgcccucgagaacaugcucugcgagcucgucgacggcaccgacuga

SEQ ID NO: 41649 - RNA, 2523 nt, Artificial Sequence
  derived and/or modified sequence opt2 from CORO7__Homo_sapiens__NP_001188402
augaaccgcuuccgcgucuccaaguuccgccacaccgaggcccgccccccccgccgcgaguccuggaucuccgacauccgcgccggcaccgcccccuccugccgcaaccacaucaaguccuccugcucccucaucgccuucaacuccgaccgccccggcguccucggcaucgucccccuccagggccagggcgaggacaagcgccgcgucgcccaccucggcugccacuccgagcucgccgcccacggcgaccucguccaguccgccgucuggucccgcgacggcgcccucgucggcaccgccugcaaggacaagcagcuccgcaucuucgacccccgcaccaagccccgcgccucccaguccacccaggcccacgagaacucccgcgacucccgccucgccuggaugggcaccugggagcaccucgucuccaccggcuucaaccagaugcgcgagcgcgaggucaagcucugggacacccgcuucuucuccuccgcccucgccucccucacccucgacaccucccucggcugccucgucccccuccucgaccccgacuccggccuccucguccucgccggcaagggcgagcgccagcucuacugcuacgaggucgucccccagcagcccgcccucucccccgucacccagugcguccucgaguccguccuccgcggcgccgcccucgucccccgccaggcccucgccgucauguccugcgagguccuccgcguccuccagcucuccgacaccgccaucguccccaucggcuaccacgucccccgcaaggccgucgaguuccacgaggaccucuuccccgacaccgccggcugcguccccgccaccgacccccacuccuggugggccggcgacaaccagcagguccagaaggucucccucaaccccgccugccgcccccaccccuccuucaccuccugccucgucccccccgccgagccccuccccgacaccgcccagcccgccgucauggagacccccgucggcgacgccgacgccuccgagggcuucuccuccccccccuccucccucaccucccccuccacccccuccucccucggccccucccucuccuccaccuccggcaucggcaccucccccucccuccgcucccuccagucccuccucggccccuccuccaaguuccgccacgcccagggcaccguccuccaccgcgacucccacaucaccaaccucaagggccucaaccucaccacccccggcgaguccgacggcuucugcgccaacaagcuccgcgucgccgucccccuccucuccuccggcggccaggucgccguccucgagcuccgcaagcccggccgccuccccgacaccgcccuccccacccuccagaacggcgccgccgucaccgaccucgccugggaccccuucgacccccaccgccucgccgucgccggcgaggacgcccgcauccgccucuggcgcguccccgccgagggccucgaggagguccucaccacccccgagaccguccucaccggccacaccgagaagaucugcucccuccgcuuccacccccucgccgccaacguccucgccuccuccuccuacgaccucaccguccgcaucugggaccuccaggccggcgccgaccgccucaagcuccagggccaccaggaccagaucuucucccucgccuggucccccgacggccagcagcucgccaccgucugcaaggacggccgcguccgcgucuaccgcccccgcuccggccccgagccccuccaggagggccccggccccaagggcggccgcggcgcccgcaucgucugggucugcgacggccgcugccuccucgucuccggcuucgacucccaguccgagcgccagcuccuccucuacgaggccgaggcccucgccggcggcccccucgccguccucggccucgacgucgcccccuccacccuccuccccuccuacgaccccgacaccggccucguccuccucaccggcaagggcgacacccgcgucuuccucuacgagcuccuccccgagucccccuucuuccucgagugcaacuccuucaccucccccgacccccacaagggccucguccuccuccccaagaccgagugcgacguccgcgaggucgagcucaugcgcugccuccgccuccgccaguccucccucgagcccgucgccuuccgccucccccgcguccgcaaggaguucuuccaggacgacgucuuccccgacaccgccgucaucugggagcccguccucuccgccgaggccuggcuccagggcgccaacggccagcccuggcuccucucccuccagccccccgacaugucccccgucucccaggccccccgcgaggcccccgcccgccgcgcccccuccuccgcccaguaccucgaggagaaguccgaccagcagaagaaggaggagcuccucaacgccauggucgccaagcucggcaaccgcgaggacccccucccccaggacuccuucgagggcgucgacgaggacgagugggacuga

SEQ ID NO: 41650 - RNA, 3147 nt, Artificial Sequence
  derived and/or modified sequence opt2 from CORO7-PAM16__Homo_sapiens__NP_001188408
augaaccgcuuccgcgucuccaaguuccgccacaccgaggcccgccccccccgccgcgaguccuggaucuccgacauccgcgccggcaccgcccccuccugccgcaaccacaucaaguccuccugcucccucaucgccuucaacuccgaccgccccggcguccucggcaucgucccccuccagggccagggcgaggacaagcgccgcgucgcccaccucggcugccacuccgaccucgucaccgaccucgacuucucccccuucgacgacuuccuccucgccaccggcuccgccgaccgcaccgucaagcucuggcgccuccccggccccggccaggcccuccccuccgcccccggcgucguccucggccccgaggaccuccccgucgagguccuccaguuccaccccaccuccgacggcauccucgucuccgccgccggcaccaccgucaaggucugggacgccgccaagcagcagccccucaccgagcucgccgcccacggcgaccucguccaguccgccgucuggucccgcgacggcgcccucgucggcaccgccugcaaggacaagcagcuccgcaucuucgacccccgcaccaagccccgcgccucccaguccacccaggcccacgagaacucccgcgacucccgccucgccuggaugggcaccugggagcaccucgucuccaccggcuucaaccagaugcgcgagcgcgaggucaagcucugggacacccgcuucuucuccuccgcccucgccucccucacccucgacaccucccucggcugccucgucccccuccucgaccccgacuccggccuccucguccucgccggcaagggcgagcgccagcucuacugcuacgaggucgucccccagcagcccgcccucucccccgucacccagugcguccucgaguccguccuccgcggcgccgcccucgucccccgccaggcccucgccgucauguccugcgagguccuccgcguccuccagcucuccgacaccgccaucguccccaucggcuaccacgucccccgcaaggccgucgaguuccacgaggaccucuuccccgacaccgccggcugcguccccgccaccgacccccacuccuggugggccggcgacaaccagcagguccagaaggucucccucaaccccgccugccgcccccaccccuccuucaccuccugccucgucccccccgccgagccccuccccgacaccgcccagcccgccgucauggagacccccgucggcgacgccgacgccuccgagggcuucuccuccccccccuccucccucaccucccccuccacccccuccucccucggccccucccucuccuccaccuccggcaucggcaccucccccucccuccgcucccuccagucccuccucggccccuccuccaaguuccgccacgcccagggcaccguccuccaccgcgacucccacaucaccaaccucaagggccucaaccucaccacccccggcgaguccgacggcuucugcgccaacaagcuccgcgucgccgucccccuccucuccuccggcggccaggucgccguccucgagcuccgcaagcccggccgccuccccgacaccgcccuccccacccuccagaacggcgccgccgucaccgaccucgccugggaccccuucgacccccaccgccucgccgucgccggcgaggacgcccgcauccgccucuggcgcguccccgccgagggccucgaggagguccucaccacccccgagaccguccucaccggccacaccgagaagaucugcucccuccgcuuccacccccucgccgccaacguccucgccuccuccuccuacgaccucaccguccgcaucugggaccuccaggccggcgccgaccgccucaagcuccagggccaccaggaccagaucuucucccucgccuggucccccgacggccagcagcucgccaccgucugcaaggacggccgcguccgcgucuaccgcccccgcuccggccccgagccccuccaggagggccccggccccaagggcggccgcggcgcccgcaucgucugggucugcgacggccgcugccuccucgucuccggcuucgacucccaguccgagcgccagcuccuccucuacgaggccgaggcccucgccggcggcccccucgccguccucggccucgacgucgcccccuccacccuccuccccuccuacgaccccgacaccggccucguccuccucaccggcaagggcgacacccgcgucuuccucuacgagcuccuccccgagucccccuucuuccucgagugcaacuccuucaccucccccgacccccacaagggccucguccuccuccccaagaccgagugcgacguccgcgaggucgagcucaugcgcugccuccgccuccgccaguccucccucgagcccgucgccuuccgccucccccgcguccgcaaggaguucuuccaggacgacgucuuccccgacaccgccgucaucugggagcccguccucuccgccgaggccuggcuccagggcgccaacggccagcccuggcuccucucccuccagccccccgacaugucccccgucucccaggccccccgcgaggcccccgcccgccgcgcccccuccuccgcccaguaccucgaggagaaguccgaccagcagaagaaggaggagcuccucaacgccauggucgccaagcucggcaaccgcgaggacccccucccccaggacuccuucgagggcgucgacgaggacgagugggccaaguaccucgcccagaucaucgucaugggcguccaggucgucggccgcgccuucgcccgcgcccuccgccaggaguucgccgccucccgcgccgccgccgacgcccgcggccgcgccggccaccgcuccgccgccgccuccaaccucuccggccucucccuccaggaggcccagcagauccucaacgucuccaagcucucccccgaggagguccagaagaacuacgagcaccucuucaaggucaacgacaaguccgucggcggcuccuucuaccuccaguccaaggucguccgcgccaaggagcgccucgacgaggagcucaagauccaggcccaggaggaccgcgagaagggccagaugccccacaccuga

SEQ ID NO: 41651 - RNA, 429 nt, Artificial Sequence
  derived and/or modified sequence opt2 from COTL1__Homo_sapiens__NP_066972
auggccaccaagaucgacaaggaggccugccgcgccgccuacaaccucguccgcgacgacggcuccgccgucaucugggucaccuucaaguacgacggcuccaccaucguccccggcgagcagggcgccgaguaccagcacuucauccagcagugcaccgacgacguccgccucuucgccuucguccgcuucaccaccggcgacgccauguccaagcgcuccaaguucgcccucaucaccuggaucggcgagaacgucuccggccuccagcgcgccaagaccggcaccgacaagacccucgucaaggaggucguccagaacuucgccaaggaguucgucaucuccgaccgcaaggagcucgaggaggacuucaucaaguccgagcucaagaaggccggcggcgccaacuacgacgcccagaccgaguga

SEQ ID NO: 41652 - RNA, 720 nt, Artificial Sequence
  derived and/or modified sequence opt2 from COX10__Homo_sapiens__XP_005256515
auggccgccuccccccacacccucuccucccgccuccucaccggcugcgucggcggcuccgucugguaccucgagcgccgcaccauccaggacuccccccacaaguuccuccaccuccuccgcaacgucaacaagcaguggaucaccuuccagcacuucuccuuccucaagcgcauguacgucacccagcucaaccgcucccacaaccagcagguccgccccaagcccgagcccgucgccucccccuuccucgagaagaccuccuccggccaggccaaggccgagaucuacgagaugcgcccccucuccccccccucccucucccucucccgcaagcccaacgagaaggagcucaucgagcucgagcccgacuccgucaucgaggacuccaucgacgucggcaaggagaccaaggaggagaagcgcuggaaggagaugaagcuccaggucuacgaccuccccggcauccucgcccgccucuccaagaucaagcucaccgcccucgucgucuccaccaccgccgccggcuucgcccucgcccccggccccuucgacuggcccugcuuccuccucaccuccgucggcaccggccucgccuccugcgccgccaacuccaucaaccaguucuucgagguccccuucgacuccaacaugaaccgcaccaagaaccgcccccucguccgcggccagauccgccaguccuucuucuccuccuucuga

SEQ ID NO: 41653 - RNA, 693 nt, Artificial Sequence
  derived and/or modified sequence opt2 from COX11__Homo_sapiens__NP_001156333
augggcggccucuggcgccccggcuggcgcugcguccccuucugcggcuggcgcuggauccaccccggcucccccacccgcgccgccgagcgcgucgagcccuuccuccgccccgagugguccggcaccggcggcgccgagcgcggccuccgcuggcucggcaccuggaagcgcugcucccuccgcgcccgccaccccgcccuccagcccccccgccgccccaaguccuccaaccccuucacccgcgcccaggaggaggagcgccgccgccagaacaagaccacccucaccuacgucgccgccgucgccgucggcaugcucggcgccuccuacgccgccgucccccucuaccgccucuacugccagaccaccggccucggcggcuccgccgucgccggccacgccuccgacaagaucgagaacaugguccccgucaaggaccgcaucaucaagaucuccuucaacgccgacguccacgccucccuccaguggaacuuccgcccccagcagaccgagaucuacgucguccccggcgagaccgcccucgccuucuaccgcgccaagaaccccaccgacaagcccgucaucggcaucuccaccuacaacaucguccccuucgaggccggccaguacuucaacaagauccagguccucuccucccgccuccaguccugcaccgaguccaccuucuga

SEQ ID NO: 41654 - RNA, 174 nt, Artificial Sequence
  derived and/or modified sequence opt2 from COX14__Homo_sapiens__NP_001244062
augcccaccggcaagcagcucgccgacaucggcuacaagaccuucuccaccuccaugaugcuccucaccgucuacggcggcuaccucugcuccguccgcgucuaccacuacuuccaguggcgccgcgcccagcgccaggccgccgaggagcagaagaccuccggcaucauguga

SEQ ID NO: 41655 - RNA, 1167 nt, Artificial Sequence
  derived and/or modified sequence opt2 from COX15__Homo_sapiens__NP_004367
augcagcgccuccucuuccccccccuccgcgcccucaagggccgccaguaccucccccuccucgccccccgcgccgccccccgcgcccagugcgacugcauccgccgcccccuccgccccggccaguacuccaccaucuccgaggucgcccuccaguccggccgcggcaccgucucccuccccuccaaggccgccgagcgcgucgucggccgcuggcuccucgucugcuccggcaccgucgccggcgccgucauccucggcggcgucacccgccucaccgaguccggccucuccauggucgacuggcaccucaucaaggagaugaagccccccaccucccaggaggagugggaggccgaguuccagcgcuaccagcaguuccccgaguucaagauccucaaccacgacaugacccucaccgaguucaaguucaucugguacauggaguacucccaccgcauguggggccgccucgucggccucgucuacauccuccccgccgccuacuucuggcgcaagggcuggcucucccgcggcaugaagggccgcguccucgcccucugcggccucgucugcuuccagggccuccucggcugguacauggucaaguccggccucgaggagaaguccgacucccacgacaucccccgcgucucccaguaccgccucgccgcccaccucggcuccgcccucguccucuacugcgccucccucuggaccucccucucccuccuccuccccccccacaagcuccccgagacccaccagcuccuccagcuccgccgcuucgcccacggcaccgccggccucgucuuccucaccgcccucuccggcgccuucgucgccggccucgacgccggccucgucuacaacuccuuccccaagaugggcgaguccuggauccccgaggaccucuucaccuucucccccauccuccgcaacgucuucgagaaccccaccaugguccaguucgaccaccgcauccucggcaucaccuccgucaccgccaucaccguccucuacuuccucucccgccgcaucccccucccccgccgcaccaagauggccgccgucacccuccucgcccucgccuacacccagggccccguccucuucaacuucaccuucaagaucuccgaccucgacgagggcauccgcaacaucuga

SEQ ID NO: 41656 - RNA, 321 nt, Artificial Sequence
  derived and/or modified sequence opt2 from COX16__Homo_sapiens__NP_057552
auguucgcccccgccgucaugcgcgccuuccgcaagaacaagacccucggcuacggcguccccaugcuccuccucaucgucggcggcuccuucggccuccgcgaguucucccagauccgcuacgacgccgucaaguccaagauggaccccgagcucgagaagaagcucaaggagaacaagaucucccucgaguccgaguacgagaagaucaaggacuccaaguucgacgacuggaagaacauccgcggcccccgccccugggaggaccccgaccuccuccagggccgcaaccccgagucccucaagaccaagaccaccuga

SEQ ID NO: 41657 - RNA, 192 nt, Artificial Sequence
  derived and/or modified sequence opt2 from COX17__Homo_sapiens__NP_005685
augcccggccucgucgacuccaaccccgccccccccgagucccaggagaagaagccccucaagcccugcugcgccugccccgagaccaagaaggcccgcgacgccugcaucaucgagaagggcgaggagcacugcggccaccucaucgaggcccacaaggagugcaugcgcgcccucggcuucaagaucuga

SEQ ID NO: 41658 - RNA, 1005 nt, Artificial Sequence
  derived and/or modified sequence opt2 from COX18__Homo_sapiens__NP_001284661
augcucugccgccucggcggccgcuggcuccgcccccuccccgcccuccagcucugggcccgcgaccucccccucgcccccguccccaccuccggcgccaagcgccccacccuccccgucugggccgucgcccccgucuccgccguccacgccaacggcugguacgaggcccucgccgccuccucccccguccgcgucgccgaggagguccuccucggcguccacgccgccaccggccuccccugguggggcuccauccuccucuccaccgucgcccuccgcggcgccgucacccucccccucgccgccuaccagcacuacauccucgccaaggucgagaaccuccagcccgagaucaagaccaucgcccgccaccucaaccaggaggucgccguccgcgccaaccagcucggcugguccaagcgcgacgcccgccucaccuaccucaagaacaugcgccgccucaucuccgagcucuacguccgcgacaacugccaccccuucaaggccaccguccucgucuggauccagcuccccauguggaucuucauguccuucgcccuccgcaaccucuccaccggcgccgcccacuccgaggccggcuucuccguccaggagcagcucgccaccggcggcauccucugguuccccgaccucaccgcccccgacuccaccuggauccuccccaucuccgucggcgucaucaaccuccucaucgucgagaucugcgcccuccagaagaucggcaugucccgcuuccagaccuacaucaccuacuucguccgcgccauguccguccucaugauccccaucgccgccaccguccccuccuccaucguccucuacuggcucugcuccuccuucgucggccucucccagaaccuccuccuccgcucccccggcuuccgccagcucugccgcauccccuccaccaaguccgacuccgagacccccuacaaggacaucuucgccgccuucaacaccaaguucaucucccgcaaguga

SEQ ID NO: 41659 - RNA, 273 nt, Artificial Sequence
  derived and/or modified sequence opt2 from COX19__Homo_sapiens__NP_001026788
auguccaccgccaugaacuucggcaccaaguccuuccagccccgcccccccgacaagggcuccuucccccucgaccaccucggcgagugcaaguccuucaaggagaaguucaugaagugccuccacaacaacaacuucgagaacgcccucugccgcaaggaguccaaggaguaccucgagugccgcauggagcgcaagcucaugcuccaggagccccucgagaagcucggcuucggcgaccucaccuccggcaaguccgaggccaagaaguga

SEQ ID NO: 41660 - RNA, 510 nt, Artificial Sequence
  derived and/or modified sequence opt2 from COX4I1__Homo_sapiens__NP_001852
augcucgccacccgcgucuucucccucgucggcaagcgcgccaucuccaccuccgucugcguccgcgcccacgaguccgucgucaaguccgaggacuucucccuccccgccuacauggaccgccgcgaccacccccuccccgaggucgcccacgucaagcaccucuccgccucccagaaggcccucaaggagaaggagaaggccuccugguccucccucuccauggacgagaaggucgagcucuaccgcaucaaguucaaggaguccuucgccgagaugaaccgcggcuccaacgaguggaagaccgucgucggcggcgccauguucuucaucggcuucaccgcccucgucaucauguggcagaagcacuacgucuacggcccccucccccaguccuucgacaaggagugggucgccaagcagaccaagcgcaugcucgacaugaaggucaaccccauccagggccucgccuccaagugggacuacgagaagaacgaguggaagaaguga

SEQ ID NO: 41661 - RNA, 516 nt, Artificial Sequence
  derived and/or modified sequence opt2 from COX4I2__Homo_sapiens__NP_115998
augcucccccgcgccgccuggucccucguccuccgcaagggcggcggcggccgccgcggcaugcacuccuccgagggcaccacccgcggcggcggcaagaugucccccuacaccaacugcuacgcccagcgcuacuaccccaugcccgaggagcccuucugcaccgagcucaacgccgaggagcaggcccucaaggagaaggagaagggcuccuggacccagcucacccacgccgagaaggucgcccucuaccgccuccaguucaacgagaccuucgccgagaugaaccgccgcuccaacgaguggaagaccgucaugggcugcgucuucuucuucaucggcuucgccgcccucgucaucugguggcagcgcgucuacgucuucccccccaagcccaucacccucaccgacgagcgcaaggcccagcagcuccagcgcaugcucgacaugaaggucaaccccguccagggccucgccucccgcugggacuacgagaagaagcaguggaagaaguga

SEQ ID NO: 41662 - RNA, 453 nt, Artificial Sequence
  derived and/or modified sequence opt2 from COX5A__Homo_sapiens__NP_004246
augcucggcgccgcccuccgccgcugcgccgucgccgccaccacccgcgccgacccccgcggccuccuccacuccgcccgcacccccggccccgccgucgccauccaguccguccgcugcuacucccacggcucccaggagaccgacgaggaguucgacgcccgcugggucaccuacuucaacaagcccgacaucgacgccugggagcuccgcaagggcaucaacacccucgucaccuacgacaugguccccgagcccaagaucaucgacgccgcccuccgcgccugccgccgccucaacgacuucgccuccaccguccgcauccucgaggucgucaaggacaaggccggcccccacaaggagaucuaccccuacgucauccaggagcuccgccccacccucaacgagcucggcaucuccacccccgaggagcucggccucgacaaggucuga

SEQ ID NO: 41663 - RNA, 390 nt, Artificial Sequence
  derived and/or modified sequence opt2 from COX5B__Homo_sapiens__NP_001853
auggccucccgccuccuccgcggcgccggcacccucgccgcccaggcccuccgcgcccgcggccccuccggcgccgccgccaugcgcuccauggccuccggcggcggcguccccaccgacgaggagcaggccaccggccucgagcgcgagaucaugcucgccgccaagaagggccucgaccccuacaacguccucgcccccaagggcgccuccggcacccgcgaggaccccaaccucguccccuccaucuccaacaagcgcaucgucggcugcaucugcgaggaggacaacaccuccgucgucugguucuggcuccacaagggcgaggcccagcgcugcccccgcugcggcgcccacuacaagcucgucccccagcagcucgcccacuga

SEQ ID NO: 41664 - RNA, 330 nt, Artificial Sequence
  derived and/or modified sequence opt2 from COX6A1__Homo_sapiens__NP_004364
auggccgucgucggcgucuccuccgucucccgccuccucggccgcucccgcccccagcucggccgccccauguccuccggcgcccacggcgaggagggcuccgcccgcauguggaagacccucaccuucuucgucgcccuccccggcgucgccgucuccaugcucaacgucuaccucaagucccaccacggcgagcacgagcgccccgaguucaucgccuacccccaccuccgcauccgcaccaagcccuuccccuggggcgacggcaaccacacccucuuccacaacccccacgucaacccccuccccaccggcuacgaggacgaguga

SEQ ID NO: 41665 - RNA, 294 nt, Artificial Sequence
  derived and/or modified sequence opt2 from COX6A2__Homo_sapiens__NP_005196
auggcccucccccuccgcccccucacccgcggccucgccuccgccgccaagggcggccacggcggcgccggcgcccgcaccuggcgccuccucaccuucguccucgcccuccccuccgucgcccucugcaccuucaacuccuaccuccacuccggccaccgcccccgccccgaguuccgccccuaccagcaccuccgcauccgcaccaagcccuaccccuggggcgacggcaaccacacccucuuccacaacucccacgucaacccccuccccaccggcuacgagcaccccuga

SEQ ID NO: 41666 - RNA, 261 nt, Artificial Sequence
  derived and/or modified sequence opt2 from COX6B1__Homo_sapiens__NP_001854
auggccgaggacauggagaccaagaucaagaacuacaagaccgcccccuucgacucccgcuuccccaaccagaaccagacccgcaacugcuggcagaacuaccucgacuuccaccgcugccagaaggccaugaccgccaagggcggcgacaucuccgucugcgagugguaccagcgcgucuaccagucccucugccccaccuccugggucaccgacugggacgagcagcgcgccgagggcaccuuccccggcaagaucuga

SEQ ID NO: 41667 - RNA, 228 nt, Artificial Sequence
  derived and/or modified sequence opt2 from COX6C__Homo_sapiens__NP_004365
auggcccccgagguccuccccaagccccgcaugcgcggccuccucgcccgccgccuccgcaaccacauggccgucgccuucguccucucccucggcgucgccgcccucuacaaguuccgcgucgccgaccagcgcaagaaggccuacgccgacuucuaccgcaacuacgacgucaugaaggacuucgaggagaugcgcaaggccggcaucuuccaguccgucaaguga

SEQ ID NO: 41668 - RNA, 240 nt, Artificial Sequence
  derived and/or modified sequence opt2 from COX7A1__Homo_sapiens__NP_001855
augcaggcccuccgcgucucccaggcccucauccgcuccuucuccuccaccgcccgcaaccgcuuccagaaccgcguccgcgagaagcagaagcucuuccaggaggacaacgacaucccccucuaccucaagggcggcaucgucgacaacauccucuaccgcgucaccaugacccucugccucggcggcaccgucuacucccucuacucccucggcugggccuccuucccccgcaacuga

SEQ ID NO: 41669 - RNA, 348 nt, Artificial Sequence
  derived and/or modified sequence opt2 from COX7A2__Homo_sapiens__XP_011533748
augcacacccaggacuccgaggucguccccguccccgccuggcccuucucccucgucgucuucuccugcggcggcugcugguccgucaccgccaagaugcuccgcaaccuccucgcccuccgccagaucggccagcgcaccaucuccaccgccucccgccgccacuucaagaacaagguccccgagaagcagaagcucuuccaggaggacgacgagaucccccucuaccucaagggcggcgucgccgacgcccuccucuaccgcgccaccaugauccucaccgucggcggcaccgccuacgccaucuacgagcucgccgucgccuccuuccccaagaagcaggaguga

SEQ ID NO: 41670 - RNA, 345 nt, Artificial Sequence
  derived and/or modified sequence opt2 from COX7A2L__Homo_sapiens__NP_001305965
auguacuacaaguucuccggcuucacccagaagcucgccggcgccugggccuccgaggccuacuccccccagggccucaagcccgucgucuccaccgaggccccccccaucaucuucgccacccccaccaagcucaccuccgacuccaccgucuacgacuacgccggcaagaacaagguccccgagcuccagaaguucuuccagaaggccgacggcguccccgucuaccucaagcgcggccuccccgaccagaugcucuaccgcaccaccauggcccucaccgucggcggcaccaucuacugccucaucgcccucuacauggccucccagcccaagaacaaguga

SEQ ID NO: 41671 - RNA, 246 nt, Artificial Sequence
  derived and/or modified sequence opt2 from COX7B2__Homo_sapiens__XP_005248113
augauguucccccucgcccgcaacgcccucuccucccucaagauccaguccauccuccaguccauggcccgccacucccacgucaagcacucccccgacuuccacgacaaguacggcaacgccguccucgccuccggcaccgccuucugcgucgccaccugggucuucaccgccacccagaucggcaucgaguggaaccucucccccgucggccgcgucacccccaaggaguggaagcaccaguga

SEQ ID NO: 41672 - RNA, 243 nt, Artificial Sequence
  derived and/or modified sequence opt2 from COX7B__Homo_sapiens__NP_001857
auguucccccucgucaaguccgcccucaaccgccuccagguccgcuccauccagcagaccauggcccgccagucccaccagaagcgcacccccgacuuccacgacaaguacggcaacgccguccucgccuccggcgccaccuucugcaucgucaccuggaccuacgucgccacccaggucggcaucgaguggaaccucucccccgucggccgcgucacccccaaggaguggcgcaaccaguga

SEQ ID NO: 41673 - RNA, 192 nt, Artificial Sequence
  derived and/or modified sequence opt2 from COX7C__Homo_sapiens__NP_001858
augcucggccaguccauccgccgcuucaccaccuccgucguccgccgcucccacuacgaggagggccccggcaagaaccuccccuucuccgucgagaacaaguggucccuccucgccaagaugugccucuacuucggcuccgccuucgccacccccuuccucgucguccgccaccagcuccucaagaccuga

SEQ ID NO: 41674 - RNA, 210 nt, Artificial Sequence
  derived and/or modified sequence opt2 from COX8A__Homo_sapiens__NP_004065
auguccguccucaccccccuccuccuccgcggccucaccggcuccgcccgccgccuccccgucccccgcgccaagauccacucccucccccccgagggcaagcucggcaucauggagcucgccgucggccucaccuccugcuucgucaccuuccuccuccccgccggcuggauccucucccaccucgagaccuaccgccgccccgaguga

SEQ ID NO: 41675 - RNA, 1260 nt, Artificial Sequence
  derived and/or modified sequence opt2 from CPA1__Homo_sapiens__NP_001859
augcgcggccuccucguccucuccguccuccucggcgccgucuucggcaaggaggacuucgucggccaccagguccuccgcaucuccgucgccgacgaggcccagguccagaaggucaaggagcucgaggaccucgagcaccuccagcucgacuucuggcgcggccccgcccaccccggcucccccaucgacguccgcguccccuuccccuccauccaggccgucaagaucuuccucgagucccacggcaucuccuacgagaccaugaucgaggacguccagucccuccucgacgaggagcaggagcagauguucgccuuccgcucccgcgcccgcuccaccgacaccuucaacuacgccaccuaccacacccucgaggagaucuacgacuuccucgaccuccucgucgccgagaacccccaccucgucuccaagauccagaucggcaacaccuacgagggccgccccaucuacguccucaaguucuccaccggcggcuccaagcgccccgccaucuggaucgacaccggcauccacucccgcgagugggucacccaggccuccggcgucugguucgccaagaagaucacccaggacuacggccaggacgccgccuucaccgccauccucgacacccucgacaucuuccucgagaucgucaccaaccccgacggcuucgccuucacccacuccaccaaccgcauguggcgcaagacccgcucccacaccgccggcucccucugcaucggcgucgaccccaaccgcaacugggacgccggcuucggccucuccggcgccuccuccaaccccugcuccgagaccuaccacggcaaguucgccaacuccgaggucgaggucaaguccaucgucgacuucgucaaggaccacggcaacaucaaggccuucaucuccauccacuccuacucccagcuccucauguaccccuacggcuacaagaccgagcccguccccgaccaggacgagcucgaccagcucuccaaggccgccgucaccgcccucgccucccucuacggcaccaaguucaacuacggcuccaucaucaaggccaucuaccaggccuccggcuccaccaucgacuggaccuacucccagggcaucaaguacuccuucaccuucgagcuccgcgacaccggccgcuacggcuuccuccuccccgccucccagaucauccccaccgccaaggagaccuggcucgcccuccucaccaucauggagcacacccucaaccaccccuacuga

SEQ ID NO: 41676 - RNA, 1260 nt, Artificial Sequence
  derived and/or modified sequence opt2 from CPA2__Homo_sapiens__NP_001860
auggccaugcgccucauccucuucuucggcgcccucuucggccacaucuacugccucgagaccuucgucggcgaccagguccucgagaucguccccuccaacgaggagcagaucaagaaccuccuccagcucgaggcccaggagcaccuccagcucgacuucuggaagucccccaccacccccggcgagaccgcccacguccgcguccccuucgucaacguccaggccgucaaggucuuccucgagucccagggcaucgccuacuccaucaugaucgaggacguccagguccuccucgacaaggagaacgaggagaugcucuucaaccgccgccgcgagcgcuccggcaacuucaacuucggcgccuaccacacccucgaggagaucucccaggagauggacaaccucgucgccgagcaccccggccucgucuccaaggucaacaucggcuccuccuucgagaaccgccccaugaacguccucaaguucuccaccggcggcgacaagcccgccaucuggcucgacgccggcauccacgcccgcgagugggucacccaggccaccgcccucuggaccgccaacaagaucgucuccgacuacggcaaggaccccuccaucaccuccauccucgacgcccucgacaucuuccuccuccccgucaccaaccccgacggcuacgucuucucccagaccaagaaccgcauguggcgcaagacccgcuccaaggucuccggcucccucugcgucggcgucgaccccaaccgcaacugggacgccggcuucggcggccccggcgccuccuccaaccccugcuccgacuccuaccacggccccuccgccaacuccgaggucgaggucaaguccaucgucgacuucaucaagucccacggcaaggucaaggccuucaucacccuccacuccuacucccagcuccucauguuccccuacggcuacaagugcaccaagcucgacgacuucgacgagcucuccgaggucgcccagaaggccgcccagucccuccgcucccuccacggcaccaaguacaaggucggccccaucugcuccgucaucuaccaggccuccggcggcuccaucgacugguccuacgacuacggcaucaaguacuccuucgccuucgagcuccgcgacaccggccgcuacggcuuccuccuccccgcccgccagauccuccccaccgccgaggagaccuggcucggccucaaggccaucauggagcacguccgcgaccaccccuacuga

SEQ ID NO: 41677 - RNA, 1254 nt, Artificial Sequence
  derived and/or modified sequence opt2 from CPA3__Homo_sapiens__NP_001861
augcgccucauccuccccgucggccucaucgccaccacccucgccaucgcccccguccgcuucgaccgcgagaaggucuuccgcgucaagccccaggacgagaagcaggccgacaucaucaaggaccucgccaagaccaacgagcucgacuucugguaccccggcgccacccaccacgucgccgccaacaugauggucgacuuccgcgucuccgagaaggagucccaggccauccaguccgcccucgaccagaacaagaugcacuacgagauccucauccacgaccuccaggaggagaucgagaagcaguucgacgucaaggaggacauccccggccgccacuccuacgccaaguacaacaacugggagaagaucgucgccuggaccgagaagaugauggacaaguaccccgagauggucucccgcaucaagaucggcuccaccgucgaggacaacccccucuacguccucaagaucggcgagaagaacgagcgccgcaaggccaucuucaccgacugcggcauccacgcccgcgagugggucucccccgccuucugccagugguucgucuaccaggccaccaagaccuacggccgcaacaagaucaugaccaagcuccucgaccgcaugaacuucuacauccuccccgucuucaacgucgacggcuacaucugguccuggaccaagaaccgcauguggcgcaagaaccgcuccaagaaccagaacuccaagugcaucggcaccgaccucaaccgcaacuucaacgccuccuggaacuccauccccaacaccaacgaccccugcgccgacaacuaccgcggcuccgcccccgaguccgagaaggagaccaaggccgucaccaacuucauccgcucccaccucaacgagaucaaggucuacaucaccuuccacuccuacucccagaugcuccucuuccccuacggcuacaccuccaagcucccccccaaccacgaggaccucgccaaggucgccaagaucggcaccgacguccucuccacccgcuacgagacccgcuacaucuacggccccaucgaguccaccaucuaccccaucuccggcuccucccucgacugggccuacgaccucggcaucaagcacaccuucgccuucgagcuccgcgacaagggcaaguucggcuuccuccuccccgagucccgcaucaagcccaccugccgcgagaccaugcucgccgucaaguucaucgccaaguacauccucaagcacaccuccuga

SEQ ID NO: 41678 - RNA, 1167 nt, Artificial Sequence
  derived and/or modified sequence opt2 from CPA4__Homo_sapiens__NP_001156918
augcgcuggauccucuucaucggcgcccucaucggcuccuccaucugcggccaggagaaguucuucggcgaccagguccuccgcaucaacguccgcaacggcgacgagaucuccaagcucucccagcucgucaacuccaacaaccucaagcucaacuucuggaagucccccuccuccuucaaccgccccgucgacguccucguccccuccgucucccuccaggccuucaaguccuuccuccgcucccagggccucgaguacgccgucaccaucgaggaccuccagaucuaccacgagauggacaacaucgccgccgacuuccccgaccucgcccgccgcgucaagaucggccacuccuucgagaaccgccccauguacguccucaaguucuccaccggcaagggcguccgccgccccgccgucuggcucaacgccggcauccacucccgcgaguggaucucccaggccaccgccaucuggaccgcccgcaagaucgucuccgacuaccagcgcgaccccgccaucaccuccauccucgagaagauggacaucuuccuccuccccgucgccaaccccgacggcuacgucuacacccagacccagaaccgccucuggcgcaagacccgcucccgcaaccccggcuccuccugcaucggcgccgaccccaaccgcaacuggaacgccuccuucgccggcaagggcgccuccgacaaccccugcuccgaggucuaccacggcccccacgccaacuccgaggucgaggucaaguccgucgucgacuucauccagaagcacggcaacuucaagggcuucaucgaccuccacuccuacucccagcuccucauguaccccuacggcuacuccgucaagaaggcccccgacgccgaggagcucgacaaggucgcccgccucgccgccaaggcccucgccuccgucuccggcaccgaguaccaggucggccccaccugcaccaccgucuaccccgccuccggcuccuccaucgacugggccuacgacaacggcaucaaguucgccuucaccuucgagcuccgcgacaccggcaccuacggcuuccuccuccccgccaaccagaucauccccaccgccgaggagaccuggcucggccucaagaccaucauggagcacguccgcgacaaccucuacuga

SEQ ID NO: 41679 - RNA, 1314 nt, Artificial Sequence
  derived and/or modified sequence opt2 from CPA6__Homo_sapiens__NP_065094
augaagugccucggcaagcgccgcggccaggccgccgccuuccucccccucugcuggcucuuccucaagauccuccagcccggccacucccaccucuacaacaaccgcuacgccggcgacaaggucauccgcuucauccccaagaccgaggaggaggccuacgcccucaagaagaucuccuaccagcucaaggucgaccucuggcagcccuccuccaucuccuacgucuccgagggcaccgucaccgacguccacaucccccagaacggcucccgcgcccuccucgccuuccuccaggaggccaacauccaguacaagguccucaucgaggaccuccagaagacccucgagaagggcuccucccuccacacccagcgcaaccgccgcucccucuccggcuacaacuacgaggucuaccacucccucgaggagauccagaacuggaugcaccaccucaacaagacccacuccggccucauccacauguucuccaucggccgcuccuacgagggccgcucccucuucauccucaagcucggccgccgcucccgccucaagcgcgccgucuggaucgacugcggcauccacgcccgcgaguggaucggccccgccuucugccagugguucgucaaggaggcccuccucaccuacaaguccgaccccgccaugcgcaagaugcucaaccaccucuacuucuacaucaugcccgucuucaacgucgacggcuaccacuucuccuggaccaacgaccgcuucuggcgcaagacccgcucccgcaacucccgcuuccgcugccgcggcgucgacgccaaccgcaacuggaaggucaaguggugcgacgagggcgccuccaugcaccccugcgacgacaccuacugcggccccuuccccgaguccgagcccgaggucaaggccgucgccaacuuccuccgcaagcaccgcaagcacauccgcgccuaccucuccuuccacgccuacgcccagaugcuccucuaccccuacuccuacaaguacgccaccauccccaacuuccgcugcgucgaguccgccgccuacaaggccgucaacgcccuccaguccgucuacggcguccgcuaccgcuacggccccgccuccaccacccucuacgucuccuccggcuccuccauggacugggccuacaagaacggcauccccuacgccuucgccuucgagcuccgcgacaccggcuacuucggcuuccuccuccccgagaugcucaucaagcccaccugcaccgagaccaugcucgccgucaagaacaucaccaugcaccuccucaagaagugccccuga

SEQ ID NO: 41680 - RNA, 5799 nt, Artificial Sequence
  derived and/or modified sequence opt2 from CPAMD8__Homo_sapiens__NP_056507
auggcccccggcgcccuccgcggcggcugcgagcagcgcgcccccggcggcggcgcccgcaccgccgcccucggccccuggcccuggcccucccccggccccgcccccucccccggcgccgcccccccccgcucccgcaagauguccggcgcccuccucuggccccuccucccccuccuccuccuccuccucuccgcccgcgacggcguccgcgccgcccagccccaggcccccggcuaccucaucgccgcccccuccgucuuccgcgccggcgucgaggaggucaucuccgucaccaucuucaacuccccccgcgaggucaccguccaggcccagcucgucgcccagggcgagcccgucguccagucccagggcgccauccucgacaagggcaccaucaagcucaagguccccaccggccuccgcggccaggcccuccucaaggucuggggccgcggcuggcaggccgaggagggcccccucuuccacaaccagaccuccgucaccgucgacggccgcggcgccuccgucuucauccagaccgacaagcccgucuaccgcccccagcaccgcguccucaucuccaucuucaccgucucccccaaccuccgccccgucaacgagaagcucgaggccuacauccucgacccccgcggcucccgcaugaucgaguggcgccaccucaagcccuucugcugcggcaucaccaacauguccuucccccucuccgaccagcccguccucggcgagugguucaucuucgucgagaugcagggccacgccuacaacaaguccuucgagguccagaaguacguccuccccaaguucgagcuccucaucgaccccccccgcuacauccaggaccucgacgccugcgagaccggcaccguccgcgcccgcuacaccuucggcaagcccgucgccggcgcccucaugaucaacaugaccgucaacggcgucggcuacuacucccacgaggucggccgccccguccuccgcaccaccaagauccucggcucccgcgacuucgacaucugcguccgcgacaugauccccgccgacguccccgagcacuuccgcggccgcgucuccaucugggccauggucaccuccgucgacggcucccagcaggucgccuucgacgacuccacccccguccagcgccagcucgucgacauccgcuacuccaaggacacccgcaagcaguucaagcccggccucgccuacgucggcaaggucgagcucuccuaccccgacggcucccccgccgagggcgucaccguccagaucaaggccgagcucacccccaaggacaacaucuacaccuccgaggucgucucccagcgcggccucgucggcuucgagauccccuccauccccaccuccgcccagcacgucuggcucgagaccaaggucauggcccucaacggcaagcccgucggcgcccaguaccuccccuccuaccucucccucggcuccugguacucccccucccagugcuaccuccagcuccagccccccucccacccccuccaggucggcgaggaggccuacuucuccgucaaguccaccugccccugcaacuucacccucuacuacgaggucgccgcccgcggcaacaucguccucuccggccagcagcccgcccacaccacccagcagcgcuccaagcgcgccgcccccgcccucgagaagcccauccgccucacccaccucuccgagaccgagcccccccccgcccccgaggccgaggucgacgucugcgucaccucccuccaccucgccgucacccccuccauggucccccucggccgccuccucgucuucuacguccgcgagaacggcgagggcgucgccgacucccuccaguucgccgucgagaccuucuucgagaaccaggucuccgucaccuacuccgccaacgagacccagcccggcgaggucgucgaccuccgcauccgcgccgcccgcggcuccugcgucugcgucgccgccgucgacaaguccgucuaccuccuccgcuccggcuuccgccucacccccgcccaggucuuccaggagcucgaggacuacgacgucuccgacuccuucggcgucucccgcgaggacggccccuucuggugggccggccucaccgcccagcgccgccgccgcuccuccgucuuccccuggcccuggggcaucaccaaggacuccggcuucgccuucaccgagaccggccucgucgucaugaccgaccgcgucucccucaaccaccgccaggacggcggccucuacaccgacgaggccguccccgccuuccagccccacaccggcucccucgucgccgucgcccccucccgccaccccccccgcaccgagaagcgcaagcgcaccuucuuccccgagaccuggaucuggcacugccucaacaucuccgaccccuccggcgagggcacccucuccgucaagguccccgacuccaucaccuccugggucggcgaggccgucgcccucuccaccucccagggccucggcaucgccgagcccucccuccucaagaccuucaagcccuucuucgucgacuucaugcuccccgcccucaucauccgcggcgagcaggucaagaucccccucuccgucuacaacuacaugggcaccugcgccgaggucuacaugaagcucuccguccccaagggcauccaguucgucggccaccccggcaagcgccacgucaccaagaagaugugcgucgcccccggcgaggccgagcccaucugggucguccucuccuucuccgaccucggccucaacaacaucaccgccaaggcccucgccuacggcgacaccaacugcugccgcgacggccgcuccuccaagcaccccgaggagaaccacgccgaccgccgcguccccaucggcgucgaccacguccgccgcuccgucauggucgaggccgagggcgucccccgcgccuacaccuacuccgccuucuucugccccuccgagcgcguccacaucuccacccccaacaaguacgaguuccaguacguccagcgcccccuccgccucacccgcuucgacgucgccguccgcgcccacaacgacgcccgcgucgcccucuccuccggcccccaggacaccgccggcaugaucgagaucguccucggcggccaccagaacacccgcuccuggaucuccaccuccaagaugggcgagcccgucgccuccgcccacaccgccaagauccucuccugggacgaguuccgcaccuucuggaucuccuggcgcggcggccucauccaggucggccacggccccgagcccuccaacgaguccgucaucgucgccuggacccucccccgcccccccgagguccaguucaucggcuucuccaccggcuggggcuccaugggcgaguuccgcaucuggcgcaagauggaggucgacgaguccuacuccgaggccuucacccucggcgucccccacggcgccauccccggcuccgagcgcgccaccgccuccaucaucggcgacgucaugggccccacccucaaccaccucaacaaccuccuccgccuccccuucggcugcggcgagcagaacaugauccacuucgcccccaacgucuucguccucaaguaccuccagaagacccagcagcucucccccgaggucgagcgcgagaccaccgacuaccucguccagggcuaccagcgccagcucaccuacaagcgccaggacggcuccuacuccgccuucggcgagcgcgacgccuccggcuccauguggcucaccgccuucguccucaaguccuucgcccaggcccgcuccuucaucuucgucgacccccgcgagcucgccgccgccaaguccuggaucauccagcagcagcaggccgacggcuccuuccucgccgucggccgcguccucaacaaggacauccagggcggcauccacggcaccgucccccucaccgccuacgucgucgucgcccuccucgagaccggcaccgccuccgaggaggagcgcggcuccaccgacaaggcccgccacuuccucgaguccgccgccccccucgccauggaccccuacuccugcgcccucaccaccuacgcccucacccuccuccgcucccccgccgcccccgaggcccuccgcaagcuccgcucccucgccaucaugcgcgacggcgucacccacuggucccucuccaacuccugggacgucgacaagggcaccuuccucuccuucuccgaccgcgucucccaguccgucgucuccgccgaggucgagaugaccgccuacgcccuccucaccuacacccuccucggcgacgucgccgccgcccuccccgucgucaaguggcucucccagcagcgcaacgcccucggcggcuucuccuccacccaggacaccugcgucgcccuccaggcccucgccgaguacgccauccucuccuacgccggcggcaucaaccucaccgucucccucgccuccaccaaccucgacuaccaggagaccuucgagcuccaccgcaccaaccagaagguccuccagaccgccgccauccccucccuccccaccggccucuucgucuccgccaagggcgacggcugcugccucaugcagaucgacgucaccuacaacguccccgaccccgucgccaagcccgccuuccagcuccucgucucccuccaggagcccgaggcccagggccgccccccccccaugcccgccuccgccgccgagggcucccgcggcgacuggccccccgccgacgacgacgaccccgccgccgaccagcaccaccaggaguacaaggucaugcucgaggucugcacccgcuggcuccacgccggcuccuccaacauggccguccucgaggucccccuccucuccggcuuccgcgccgacaucgagucccucgagcagcuccuccucgacaagcacaugggcaugaagcgcuacgaggucgccggccgccgcguccucuucuacuucgacgagauccccucccgcugccucaccugcguccgcuuccgcgcccuccgcgagugcgucgucggccgcaccuccgcccuccccgucuccgucuacgacuacuacgagcccgccuucgaggccacccgcuucuacaacgucuccacccacuccccccucgcccgcgagcucugcgccggccccgccugcaacgaggucgagcgcgcccccgcccgcggccccggcugguuccccggcgaguccggccccgccgucgcccccgaggagggcgccgccaucgcccgcugcggcugcgaccacgacugcggcgcccagggcaaccccgucugcggcuccgacggcgucgucuacgccuccgccugccgccuccgcgaggccgccugccgccaggccgccccccucgagcccgccccccccuccugcugcgcccucgagcagcgccuccccgccuccuccuccuccaccuacggcgacgaccucgccuccgucgcccccggcccccuccagcaggacgucaagcucaacggcgccggccucgaggucgaggacuccgaccccgagcccgagggcgaggccgaggaccgcgucaccgccggcccccgcccccccgucuccuccggcaaccucgaguccuccacccaguccgccucccccuuccaccgcuggggccagacccccgccccccagcgccacuccggccgcgucgucggcgcccaccgccccggccuccucucccccgucuucgucuacucccccgccuuccaguccggcggcgaggagggccucuggauguccaacaccugcacccuccgcuga

SEQ ID NO: 41681 - RNA, 1254 nt, Artificial Sequence
  derived and/or modified sequence opt2 from CPB1__Homo_sapiens__NP_001862
augcucgcccuccucguccucgucaccgucgcccucgccuccgcccaccacggcggcgagcacuucgagggcgagaaggucuuccgcgucaacgucgaggacgagaaccacaucaacaucauccgcgagcucgccuccaccacccagaucgacuucuggaagcccgacuccgucacccagaucaagccccacuccaccgucgacuuccgcgucaaggccgaggacaccgucaccgucgagaacguccucaagcagaacgagcuccaguacaagguccucaucuccaaccuccgcaacgucgucgaggcccaguucgacucccgcguccgcgccaccggccacuccuacgagaaguacaacaagugggagaccaucgaggccuggacccagcaggucgccaccgagaaccccgcccucaucucccgcuccgucaucggcaccaccuucgagggccgcgccaucuaccuccucaaggucggcaaggccggccagaacaagcccgccaucuucauggacugcggcuuccacgcccgcgaguggaucucccccgccuucugccagugguucguccgcgaggccguccgcaccuacggccgcgagauccaggucaccgagcuccucgacaagcucgacuucuacguccuccccguccucaacaucgacggcuacaucuacaccuggaccaagucccgcuucuggcgcaagacccgcuccacccacaccggcuccuccugcaucggcaccgaccccaaccgcaacuucgacgccggcuggugcgagaucggcgccucccgcaaccccugcgacgagaccuacugcggccccgccgccgaguccgagaaggagaccaaggcccucgccgacuucauccgcaacaagcucuccuccaucaaggccuaccucaccauccacuccuacucccagaugaugaucuaccccuacuccuacgccuacaagcucggcgagaacaacgccgagcucaacgcccucgccaaggccaccgucaaggagcucgccucccuccacggcaccaaguacaccuacggccccggcgccaccaccaucuaccccgccgccggcggcuccgacgacugggccuacgaccagggcauccgcuacuccuucaccuucgagcuccgcgacaccggccgcuacggcuuccuccuccccgagucccagauccgcgccaccugcgaggagaccuuccucgccaucaaguacgucgccuccuacguccucgagcaccucuacuga

SEQ ID NO: 41682 - RNA, 1161 nt, Artificial Sequence
  derived and/or modified sequence opt2 from CPB2__Homo_sapiens__NP_001265470
augaagcucugcucccucgccguccucguccccaucguccucuucugcgagcagcacgucuucgccuuccaguccggccagguccucgccgcccucccccgcaccucccgccagguccagguccuccagaaccucaccaccaccuacgagaucguccucuggcagcccgucaccgccgaccucaucgucaagaagaagcagguccacuucuucgucaacgccuccgacgucgacaacgucaaggcccaccucaacgucuccggcauccccugcuccguccuccucgccgacgucgaggaccucauccagcagcagaucuccaacgacaccgucuccccccgcgccuccgccuccuacuacgagcaguaccacucccucaacgagaucuacuccuggaucgaguucaucaccgagcgccaccccgacaugcucaccaagauccacaucggcuccuccuucgagaaguacccccucuacguccucaaggucuccggcaaggagcaggccgccaagaacgccaucuggaucgacugcggcauccacgcccgcgaguggaucucccccgccuucugccucugguucaucggccacaaccgcauguggcgcaagaaccgcuccuucuacgccaacaaccacugcaucggcaccgaccucaaccgcaacuucgccuccaagcacuggugcgaggagggcgccuccuccuccuccugcuccgagaccuacugcggccucuaccccgaguccgagcccgaggucaaggccgucgccuccuuccuccgccgcaacaucaaccagaucaaggccuacaucuccaugcacuccuacucccagcacaucgucuuccccuacuccuacacccgcuccaaguccaaggaccacgaggagcucucccucgucgccuccgaggccguccgcgccaucgagaagaucuccaagaacacccgcuacacccacggccacggcuccgagacccucuaccucgcccccggcggcggcgacgacuggaucuacgaccucggcaucaaguacuccuucaccaucgagcuccgcgacaccggcaccuacggcuuccuccuccccgagcgcuacaucaagcccaccugccgcgaggccuucgccgccgucuccaagaucgccuggcacgucauccgcaacgucuga

SEQ ID NO: 41683 - RNA, 3402 nt, Artificial Sequence
  derived and/or modified sequence opt2 from CPD__Homo_sapiens__NP_001186704
augcgcuucguccucuccggcaaccuccacggcggcuccgucgucgccuccuaccccuucgacgacucccccgagcacaaggccaccggcaucuacuccaagaccuccgacgacgaggucuucaaguaccucgccaaggccuacgccuccaaccaccccaucaugaagaccggcgagccccacugccccggcgacgaggacgagaccuucaaggacggcaucaccaacggcgcccacugguacgacgucgagggcggcaugcaggacuacaacuacgucugggccaacugcuucgagaucacccucgagcucuccugcugcaaguacccccccgccucccagcuccgccaggagugggagaacaaccgcgagucccucaucacccucaucgagaagguccacaucggcgucaagggcuucgucaaggacuccaucaccggcuccggccucgagaacgccaccaucuccgucgccggcaucaaccacaacaucaccaccggccgcuucggcgacuucuaccgccuccucguccccggcaccuacaaccucaccgucguccucaccggcuacaugccccucaccgucaccaacgucgucgucaaggagggccccgccaccgaggucgacuucucccuccgccccaccgucaccuccgucauccccgacaccaccgaggccgucuccaccgccuccaccgucgccauccccaacauccucuccggcaccuccuccuccuaccagcccauccagcccaaggacuuccaccaccaccacuuccccgacauggagaucuuccuccgccgcuucgccaacgaguaccccaacaucacccgccucuacucccucggcaaguccgucgagucccgcgagcucuacgucauggagaucuccgacaaccccggcguccacgagcccggcgagcccgaguucaaguacaucggcaacaugcacggcaacgaggucgucggccgcgagcuccuccucaaccucaucgaguaccucugcaagaacuucggcaccgaccccgaggucaccgaccucguccacaacacccgcauccaccucaugcccuccaugaaccccgacggcuacgagaagucccaggagggcgacuccaucuccgucaucggccgcaacaacuccaacaacuucgaccucaaccgcaacuuccccgaccaguucguccagaucaccgaccccacccagcccgagaccaucgccgucauguccuggaugaaguccuaccccuucguccucuccgccaaccuccacggcggcucccucgucgucaacuaccccuucgacgacgacgagcagggccucgccaccuacuccaagucccccgacgacgccgucuuccagcagaucgcccucuccuacuccaaggagaacucccagauguuccagggccgccccugcaagaacauguaccccaacgaguacuucccccacggcaucaccaacggcgccuccugguacaacguccccggcggcaugcaggacuggaacuaccuccagaccaacugcuucgaggucaccaucgagcucggcugcgucaaguacccccucgagaaggagcuccccaacuucugggagcagaaccgccgcucccucauccaguucaugaagcagguccaccagggcguccgcggcuucguccucgacgccaccgacggccgcggcauccucaacgccaccaucuccgucgccgagaucaaccaccccgucaccaccuacaagaccggcgacuacuggcgccuccucguccccggcaccuacaagaucaccgccuccgcccgcggcuacaaccccgucaccaagaacgucaccgucaaguccgagggcgccauccaggucaacuucacccucguccgcuccuccaccgacuccaacaacgaguccaagaagggcaagggcgccuccuccuccaccaacgacgccuccgaccccaccaccaaggaguucgagacccucaucaaggaccucuccgccgagaacggccucgagucccucaugcuccgcuccuccuccaaccucgcccucgcccucuaccgcuaccacuccuacaaggaccucuccgaguuccuccgcggccucgucaugaacuacccccacaucaccaaccucaccaaccucggccaguccaccgaguaccgccacaucuggucccucgagaucuccaacaagcccaacgucuccgagcccgaggagcccaagauccgcuucgucgccggcauccacggcaacgcccccgucggcaccgagcuccuccucgcccucgccgaguuccucugccucaacuacaagaagaaccccgccgucacccagcucgucgaccgcacccgcaucgucaucguccccucccucaaccccgacggccgcgagcgcgcccaggagaaggacugcaccuccaagaucggccagaccaacgcccgcggcaaggaccucgacaccgacuucaccaacaacgccucccagcccgagaccaaggccaucaucgagaaccucauccagaagcaggacuucucccucuccgucgcccucgacggcggcuccaugcucgucaccuaccccuacgacaagcccguccagaccgucgagaacaaggagacccucaagcaccucgccucccucuacgccaacaaccaccccuccaugcacaugggccagcccuccugccccaacaaguccgacgagaacauccccggcggcgucaugcgcggcgccgaguggcacucccaccucggcuccaugaaggacuacuccgucaccuacggccacugccccgagaucaccgucuacaccuccugcugcuacuuccccuccgccgcccgccuccccucccucugggccgacaacaagcgcucccuccucuccaugcucgucgagguccacaagggcguccacggcuucgucaaggacaagaccggcaagcccaucuccaaggccgucaucguccucaacgagggcaucaagguccagaccaaggagggcggcuacuuccacguccuccucgcccccggcguccacaacaucaucgccaucgccgacggcuaccagcagcagcacucccaggucuucguccaccacgacgccgccuccuccgucgucaucgucuucgacaccgacaaccgcaucuucggccucccccgcgagcucgucgucaccgucuccggcgccaccauguccgcccucauccucaccgccugcaucaucuggugcaucugcuccaucaaguccaaccgccacaaggacggcuuccaccgccuccgccagcaccacgacgaguacgaggacgagauccgcaugauguccaccggcuccaagaagucccuccucucccacgaguuccaggacgagaccgacaccgaggaggagacccucuacuccuccaagcacuga

SEQ ID NO: 41684 - RNA, 1476 nt, Artificial Sequence
  derived and/or modified sequence opt2 from CPEB1__Homo_sapiens__NP_001073001
augcucuuccccaccuccgcccaggaguccucccgcggccuccccgacgccaacgaccucugccucggccuccagucccucucccucaccggcugggaccgccccugguccacccaggacuccgacuccuccgcccaguccuccacccacuccguccucuccaugcuccacaacccccucggcaacguccucggcaagcccccccucuccuuccucccccucgacccccucggcuccgaccucgucgacaaguuccccgcccccuccguccgcggcucccgccucgacacccgccccauccucgacucccgcuccuccucccccuccgacuccgacaccuccggcuucuccuccggcuccgaccaccucuccgaccucaucuccucccuccgcaucucccccccccuccccuuccucucccucuccggcggcggcccccgcgacccccucaagaugggcgucggcucccgcauggaccaggagcaggccgcccucgccgccgucacccccucccccaccuccgccuccaagcgcuggcccggcgccuccgucuggcccuccugggaccuccucgaggcccccaaggaccccuucuccaucgagcgcgaggcccgccuccaccgccaggccgccgccgucaacgaggccaccugcaccugguccggccagcuccccccccgcaacuacaagaaccccaucuacuccugcaaggucuuccucggcggcguccccugggacaucaccgaggccggccucgucaacaccuuccgcgucuucggcucccucuccgucgaguggcccggcaaggacggcaagcacccccgcugcccccccaagggcaacaugcccaagggcuacgucuaccucgucuucgagcucgagaaguccguccgcucccuccuccaggccugcucccacgacccccucucccccgacggccucuccgaguacuacuucaagauguccucccgccgcaugcgcugcaaggagguccaggucauccccuggguccucgccgacuccaacuucguccgcucccccucccagcgccucgaccccucccgcaccgucuucgucggcgcccuccacggcaugcucaacgccgaggcccucgccgccauccucaacgaccucuucggcggcgucgucuacgccggcaucgacaccgacaagcacaaguaccccaucggcuccggccgcgucaccuucaacaaccagcgcuccuaccucaaggccgucuccgccgccuucgucgagaucaagaccaccaaguucaccaagaagguccagaucgaccccuaccucgaggacucccucugccacaucugcuccucccagcccggccccuucuucugccgcgaccaggucugcuucaaguacuucugccgcuccugcuggcacuggcgccacuccauggagggccuccgccaccacuccccccucaugcgcaaccagaagaaccgcgacuccuccuga

SEQ ID NO: 41685 - RNA, 2055 nt, Artificial Sequence
  derived and/or modified sequence opt2 from CPEB3__Homo_sapiens__NP_001171608
augcaggacgaccuccucauggacaaguccaagacccagccccagccccagcagcagcagcgccagcagcagcagccccagcccgaguccuccgucuccgaggcccccuccaccccccucuccuccgagacccccaagcccgaggagaacuccgccguccccgcccucucccccgccgccgccccccccgcccccaacggccccgacaagaugcagauggaguccccccuccuccccggccucuccuuccaccagcccccccagcagcccccccccccccaggagcccgccgcccccggcgccucccucucccccuccuucggcuccaccugguccaccggcaccaccaacgccgucgaggacuccuucuuccagggcaucacccccgucaacggcaccaugcucuuccagaacuucccccaccacgucaaccccgucuucggcggcaccuucuccccccagaucggccucgcccagacccagcaccaccagcagccccccccccccgcccccgccccccagcccgcccagcccgcccagcccccccaggcccagcccccccagcagcgccgcucccccgccucccccucccaggcccccuacgcccagcgcuccgccgccgccgccuacggccaccagcccaucaugaccuccaagcccuccuccuccuccgccgucgccgccgccgccgccgccgccgccgccuccuccgccuccuccuccuggaacacccaccaguccgucaacgccgccugguccgcccccuccaaccccuggggcggccuccaggccggccgcgacccccgccgcgccgucggcgucggcgucggcgucggcgucggcguccccuccccccucaaccccaucuccccccucaagaagcccuucuccuccaacgucaucgccccccccaaguucccccgcgccgccccccucaccuccaaguccuggauggaggacaacgccuuccgcaccgacaacggcaacaaccuccuccccuuccaggaccgcucccgccccuacgacaccuucaaccuccacucccucgagaacucccucauggacaugauccgcaccgaccacgagccccucaagggccgcaugggcaucaacuuccaccaccccggcaccgacaacaucauggcccucaacucccgcuccucccucuuccccuucgaggacgccuuccucgacgacucccacggcgaccaggcccucuccuccggccucuccucccccacccgcugccagaacggcgagcgcgucgagcgcuacucccgcaaggucuucgucggcggccucccccccgacaucgacgaggacgagaucaccgccuccuuccgccgcuucggcccccucgucgucgacuggccccacaaggccgaguccaaguccuacuucccccccaagggcuacgccuuccuccucuuccaggaggaguccuccguccaggcccucaucgacgccugccucgaggaggacggcaagcucuaccucugcgucuccucccccaccaucaaggacaagcccguccagauccgccccuggaaccucuccgacuccgacuucgucauggacggcucccagccccucgacccccgcaagaccaucuucgucggcggcgucccccgcccccuccgcgccgucgagcucgccaugaucauggaccgccucuacggcggcgucugcuacgccggcaucgacaccgaccccgagcucaaguaccccaagggcgccggccgcgucgccuucuccaaccagcaguccuacaucgccgccaucuccgcccgcuucguccagcuccagcacaacgacaucgacaagcgcgucgaggucaagcccuacguccucgacgaccagaugugcgacgagugccagggcacccgcugcggcggcaaguucgcccccuucuucugcgccaacgucaccugccuccaguacuacugcgaguacugcugggccuccauccacucccgcgccggccgcgaguuccacaagccccucgucaaggagggcggcgaccgcccccgccacguccccuuccgcugguccuga

SEQ ID NO: 41686 - RNA, 2190 nt, Artificial Sequence
  derived and/or modified sequence opt2 from CPEB4__Homo_sapiens__NP_085130
augggcgacuacggcuucggcguccucguccaguccaacaccggcaacaaguccgccuuccccguccgcuuccacccccaccuccagcccccccaccaccaccagaacgccacccccucccccgccgccuucaucaacaacaacaccgccgccaacggcuccuccgccggcuccgccuggcucuuccccgcccccgccacccacaacauccaggacgagauccucggcuccgagaaggccaagucccagcagcaggagcagcaggacccccucgagaagcagcagcucucccccucccccggccaggaggccggcauccuccccgagaccgagaaggccaaguccgaggagaaccagggcgacaacuccuccgagaacggcaacggcaaggagaagauccgcaucgagucccccguccucaccggcuucgacuaccaggaggccaccggccucggcaccuccacccagccccucaccuccuccgccuccucccucaccggcuucuccaacugguccgccgccaucgcccccuccuccuccaccaucaucaacgaggacgccuccuucuuccaccagggcggcguccccgccgccuccgccaacaacggcgcccuccucuuccagaacuucccccaccacgucucccccggcuucggcggcuccuucuccccccagaucggcccccucucccagcaccacccccaccacccccacuuccagcaccaccacucccagcaccagcagcagcgccgcucccccgccuccccccaccccccccccuucacccaccgcaacgccgccuucaaccagcucccccaccucgccaacaaccucaacaagccccccucccccugguccuccuaccagucccccucccccacccccuccuccuccuggucccccggcggcggcggcuacggcggcuggggcggcucccagggccgcgaccaccgccgcggccucaacggcggcaucaccccccucaacuccaucuccccccucaagaagaacuucgccuccaaccacauccagcuccagaaguacgcccgccccuccuccgccuucgcccccaaguccuggauggaggacucccucaaccgcgccgacaacaucuuccccuuccccgaccgcccccgcaccuucgacaugcacucccucgaguccucccucaucgacaucaugcgcgccgagaacgacaccaucaagggccgccucaacuacuccuaccccggcuccgacuccucccuccucaucaacgcccgcaccuacggccgccgccgcggccaguccucccucuuccccauggaggacggcuuccucgacgacggccgcggcgaccagccccuccacuccggccucggcuccccccacugcuucucccaccagaacggcgagcgcgucgagcgcuacucccgcaaggucuucgucggcggccucccccccgacaucgacgaggacgagaucaccgccuccuuccgccgcuucggcccccucaucgucgacuggccccacaaggccgaguccaaguccuacuucccccccaagggcuacgccuuccuccucuuccaggacgaguccuccguccaggcccucaucgacgccugcaucgaggaggacggcaagcucuaccucugcgucuccucccccaccaucaaggacaagcccguccagauccgccccuggaaccucuccgacuccgacuucgucauggacggcucccagccccucgacccccgcaagaccaucuucgucggcggcgucccccgcccccuccgcgccgucgagcucgccaugaucauggaccgccucuacggcggcgucugcuacgccggcaucgacaccgaccccgagcucaaguaccccaagggcgccggccgcgucgccuucuccaaccagcaguccuacaucgccgccaucuccgcccgcuucguccagcuccagcacggcgagaucgacaagcgcgucgaggucaagcccuacguccucgacgaccagcucugcgacgagugccagggcgcccgcugcggcggcaaguucgcccccuucuucugcgccaacgucaccugccuccaguacuacugcgaguacugcugggccgccauccacucccgcgccggccgcgaguuccacaagccccucgucaaggagggcggcgaccgcccccgccacaucuccuuccgcuggaacuga

SEQ ID NO: 41687 - RNA, 2352 nt, Artificial Sequence
  derived and/or modified sequence opt2 from CPED1__Homo_sapiens__NP_001099003
auggucugccgccccgucuuccccugccgccgccgcuucugcccccgccccuuccucgucggccucgucgucgccaucugccucuucuaccagacccucacccuccgcggcucccgcaagcucaccgccgccgcccccggcgccgucccccacaccuccaccgagacccaggccucccgcugcaagaagggcuucucccaggacaagcagugcuuccuccucuccggcaacgcccaggagacccgcaaggucaaggaguccauggagacccacuucggcucccacggccgccgcgccauccucuaccgcccccccuucuacuccaagaccgagcuccagcuccaccagcacauccucacccagcacggcuacaccgucgucaucgccgaggagcgccucaacgccggccucggccccggccuccucgagcagggcgaccucggcuccugggaccuccucaucugccucuccuccaagaaggccgagggcacccccugcaucuccaaggaggucaugugccagcucggccuccaccagaaggccaaccgccuccccgagauccagcagccccucugccgcaaggagggccucugccagaucguccgccgcuuccccgagcuccagcuccccgucucccccuccgucugccucgaccagggcaugcagcucaagcccuccaccuccucccaccuccucaagaccgucaagccccgcgucuggaagcccggcgacuggucccgcgagcagcucaacgagaccaccguccucgccccccacgagaccaucuuccgcgccgaggaccucuccgucauccucaaggccuacguccucgucaccucccucaccccccuccgcgccuucauccacuccaccggcaccgucuggaacccccccaagaagaagcgcuucaccgucaagcuccagaccuucuucgagaccuuccuccgcgccuccuccccccagcaggccuucgacaucaugaaggaggccaucggcaagcuccuccucgccgccgaggucuucuccgagaccuccacccucggccccaagaccuuccaccgcugccgcuucugcuuccagcuccucaccuucgacaucggcuacggcuccuucauguaccccgucguccuccagguccacgagcaccucaacuuccaggacuacgacaacauggacuucgaggaccagaacaccgaggaguuccuccucaacgacaccuucaacuuccucuuccccaacgaguccucccucuccaucuucuccgagaucuuccagcgccucuaccgcuccgacgucuucaagggcgagaacuaccagaaggagcucaaccagugccucucccucgaggagaucaacuccaucaugaccuucaucaaggagcucggcucccucggccaguuccagcuccucuuccccuccaccacccccggcauccagucccucaugcacgaguucuacgacgucgccaaccccgucggcaaccccggcuccguccucacccaguacuggucccuccucaacgucuucgagcaguuccaguucaugaacaagaagacccagccccacccccucgaguggaacuccuucaccgaggacaagaacaucgagaagccccagguccccuucgacgccaucgagaacaagaaggccgccgucccccagaucaagaacgagaacaaggagauccacugcuccgacgacgagaacacccccugccacaucaagcagaucuucacccacccccaccucgagcucaaccccgacuuccaccccaagaucaaggacuacuacugcgagguccccuucgacgucgucaccgucaccaucggcgucgagacccccaagugccucugcaagguccaccucuacgagcaggccggccccuccuucgccuccuacccccucggccucggcaugaacaagaucuccaucuucgucgucgacgagucccccgcccacggcgagacccucaucaccuacaagcucaccaucuaccgcgaggaccgccccucccucccccucuucgaggccuucaccgccugcggcuucguccaggacugcggccuccucauccaccccgaggagaccugcggccuccagcccaucuccuccgacuacaucgaggccauccuccaguccgagcucaagcgcugccccuccggcgacaugaagggccaguggaucguccccugccucuccugcuccgacaaccgcaccugcgacuggcgcgagaucaccuggcagccccacaacugccaguacggcguccucaccaagccccagcuccagcagugccucggcggccgcaagcucggcgucgacguccagcgcgucccccgcucccgcaacuga

SEQ ID NO: 41688 - RNA, 1431 nt, Artificial Sequence
  derived and/or modified sequence opt2 from CPE__Homo_sapiens__NP_001864
auggccggccgcggcggcuccgcccuccucgcccucugcggcgcccucgccgccugcggcuggcuccucggcgccgaggcccaggagcccggcgcccccgccgccggcaugcgccgccgccgccgccuccagcaggaggacggcaucuccuucgaguaccaccgcuaccccgagcuccgcgaggcccucgucuccgucuggcuccagugcaccgccaucucccgcaucuacaccgucggccgcuccuucgagggccgcgagcuccucgucaucgagcucuccgacaaccccggcguccacgagcccggcgagcccgaguucaaguacaucggcaacaugcacggcaacgaggccgucggccgcgagcuccucaucuuccucgcccaguaccucugcaacgaguaccagaagggcaacgagaccaucgucaaccucauccacuccacccgcauccacaucaugcccucccucaaccccgacggcuucgagaaggccgccucccagcccggcgagcucaaggacugguucgucggccgcuccaacgcccagggcaucgaccucaaccgcaacuuccccgaccucgaccgcaucgucuacgucaacgagaaggagggcggccccaacaaccaccuccucaagaacaugaagaagaucgucgaccagaacaccaagcucgcccccgagaccaaggccgucauccacuggaucauggacauccccuucguccucuccgccaaccuccacggcggcgaccucgucgccaacuaccccuacgacgagacccgcuccggcuccgcccacgaguacuccuccucccccgacgacgccaucuuccagucccucgcccgcgccuacuccuccuucaaccccgccauguccgaccccaaccgcccccccugccgcaagaacgacgacgacuccuccuucgucgacggcaccaccaacggcggcgccugguacuccguccccggcggcaugcaggacuucaacuaccucuccuccaacugcuucgagaucaccgucgagcucuccugcgagaaguucccccccgaggagacccucaagaccuacugggaggacaacaagaacucccucaucuccuaccucgagcagauccaccgcggcgucaagggcuucguccgcgaccuccagggcaaccccaucgccaacgccaccaucuccgucgagggcaucgaccacgacgucaccuccgccaaggacggcgacuacuggcgccuccucauccccggcaacuacaagcucaccgccuccgcccccggcuaccucgccaucaccaagaaggucgccguccccuacucccccgccgccggcgucgacuucgagcucgaguccuucuccgagcgcaaggaggaggagaaggaggagcucauggagugguggaagaugauguccgagacccucaacuucuga

SEQ ID NO: 41689 - RNA, 3198 nt, Artificial Sequence
  derived and/or modified sequence opt2 from CP__Homo_sapiens__NP_000087
augaagauccucauccucggcaucuuccucuuccucugcuccacccccgccugggccaaggagaagcacuacuacaucggcaucaucgagaccaccugggacuacgccuccgaccacggcgagaagaagcucaucuccgucgacaccgagcacuccaacaucuaccuccagaacggccccgaccgcaucggccgccucuacaagaaggcccucuaccuccaguacaccgacgagaccuuccgcaccaccaucgagaagcccgucuggcucggcuuccucggccccaucaucaaggccgagaccggcgacaaggucuacguccaccucaagaaccucgccucccgccccuacaccuuccacucccacggcaucaccuacuacaaggagcacgagggcgccaucuaccccgacaacaccaccgacuuccagcgcgccgacgacaaggucuaccccggcgagcaguacaccuacaugcuccucgccaccgaggagcagucccccggcgagggcgacggcaacugcgucacccgcaucuaccacucccacaucgacgcccccaaggacaucgccuccggccucaucggcccccucaucaucugcaagaaggacucccucgacaaggagaaggagaagcacaucgaccgcgaguucgucgucauguucuccgucgucgacgagaacuucuccugguaccucgaggacaacaucaagaccuacugcuccgagcccgagaaggucgacaaggacaacgaggacuuccaggaguccaaccgcauguacuccgucaacggcuacaccuucggcucccuccccggccucuccaugugcgccgaggaccgcgucaagugguaccucuucggcaugggcaacgaggucgacguccacgccgccuucuuccacggccaggcccucaccaacaagaacuaccgcaucgacaccaucaaccucuuccccgccacccucuucgacgccuacauggucgcccagaaccccggcgaguggaugcucuccugccagaaccucaaccaccucaaggccggccuccaggccuucuuccagguccaggagugcaacaaguccuccuccaaggacaacauccgcggcaagcacguccgccacuacuacaucgccgccgaggagaucaucuggaacuacgcccccuccggcaucgacaucuucaccaaggagaaccucaccgcccccggcuccgacuccgccgucuucuucgagcagggcaccacccgcaucggcggcuccuacaagaagcucgucuaccgcgaguacaccgacgccuccuucaccaaccgcaaggagcgcggccccgaggaggagcaccucggcauccucggccccgucaucugggccgaggucggcgacaccauccgcgucaccuuccacaacaagggcgccuacccccucuccaucgagcccaucggcguccgcuucaacaagaacaacgagggcaccuacuacucccccaacuacaacccccagucccgcuccgucccccccuccgccucccacgucgcccccaccgagaccuucaccuacgaguggaccguccccaaggaggucggccccaccaacgccgaccccgucugccucgccaagauguacuacuccgccgucgaccccaccaaggacaucuucaccggccucaucggccccaugaagaucugcaagaagggcucccuccacgccaacggccgccagaaggacgucgacaaggaguucuaccucuuccccaccgucuucgacgagaacgagucccuccuccucgaggacaacauccgcauguucaccaccgcccccgaccaggucgacaaggaggacgaggacuuccaggaguccaacaagaugcacuccaugaacggcuucauguacggcaaccagcccggccucaccaugugcaagggcgacuccgucgucugguaccucuucuccgccggcaacgaggccgacguccacggcaucuacuucuccggcaacaccuaccucuggcgcggcgagcgccgcgacaccgccaaccucuucccccagaccucccucacccuccacauguggcccgacaccgagggcaccuucaacgucgagugccucaccaccgaccacuacaccggcggcaugaagcagaaguacaccgucaaccagugccgccgccaguccgaggacuccaccuucuaccucggcgagcgcaccuacuacaucgccgccgucgaggucgagugggacuacuccccccagcgcgagugggagaaggagcuccaccaccuccaggagcagaacgucuccaacgccuuccucgacaagggcgaguucuacaucggcuccaaguacaagaaggucgucuaccgccaguacaccgacuccaccuuccgcguccccgucgagcgcaaggccgaggaggagcaccucggcauccucggcccccagcuccacgccgacgucggcgacaaggucaagaucaucuucaagaacauggccacccgccccuacuccauccacgcccacggcguccagaccgaguccuccaccgucacccccacccuccccggcgagacccucaccuacgucuggaagauccccgagcgcuccggcgccggcaccgaggacuccgccugcauccccugggccuacuacuccaccgucgaccaggucaaggaccucuacuccggccucaucggcccccucaucgucugccgccgccccuaccucaaggucuucaacccccgccgcaagcucgaguucgcccuccucuuccucgucuucgacgagaacgaguccugguaccucgacgacaacaucaagaccuacuccgaccaccccgagaaggucaacaaggacgacgaggaguucaucgaguccaacaagaugcacgccaucaacggccgcauguucggcaaccuccagggccucaccaugcacgucggcgacgaggucaacugguaccucaugggcaugggcaacgagaucgaccuccacaccguccacuuccacggccacuccuuccaguacaagcaccgcggcgucuacuccuccgacgucuucgacaucuuccccggcaccuaccagacccucgagauguucccccgcacccccggcaucuggcuccuccacugccacgucaccgaccacauccacgccggcauggagaccaccuacaccguccuccagaacgaggacaccaaguccggcuga

SEQ ID NO: 41690 - RNA, 405 nt, Artificial Sequence
  derived and/or modified sequence opt2 from CPLX1__Homo_sapiens__NP_006642
auggaguucgucaugaagcaggcccucggcggcgccaccaaggacaugggcaagaugcucggcggcgacgaggagaaggaccccgacgccgccaagaaggaggaggagcgccaggaggcccuccgccaggccgaggaggagcgcaaggccaaguacgccaagauggaggccgagcgcgaggccguccgccagggcauccgcgacaaguacggcaucaagaagaaggaggagcgcgaggccgaggcccaggccgccauggaggccaacuccgagggcucccucacccgccccaagaaggccaucccccccggcugcggcgacgaggucgaggaggaggacgaguccauccucgacaccgucaucaaguaccuccccggcccccuccaggacaugcucaagaaguga

SEQ ID NO: 41691 - RNA, 405 nt, Artificial Sequence
  derived and/or modified sequence opt2 from CPLX2__Homo_sapiens__XP_011532721
auggacuucgucaugaagcaggcccucggcggcgccaccaaggacaugggcaagaugcucggcggcgaggaggagaaggaccccgacgcccagaagaaggaggaggagcgccaggaggcccuccgccagcaggaggaggagcgcaaggccaagcacgcccgcauggaggccgagcgcgagaagguccgccagcagauccgcgacaaguacggccucaagaagaaggaggagaaggaggccgaggagaaggccgcccucgagcagcccugcgagggcucccucacccgccccaagaaggccauccccgccggcugcggcgacgaggaggaggaggaggaggaguccauccucgacaccguccucaaguaccuccccggcccccuccaggacauguucaagaaguga

SEQ ID NO: 41692 - RNA, 477 nt, Artificial Sequence
  derived and/or modified sequence opt2 from CPLX3__Homo_sapiens__NP_001025176
auggccuucauggucaagaccauggucggcggccagcucaagaaccucaccggcucccucggcggcggcgaggacaagggcgacggcgacaaguccgccgccgaggcccagggcaugucccgcgaggaguacgaggaguaccagaagcagcucgucgaggagaagauggagcgcgacgcccaguucacccagcgcaaggccgagcgcgccacccuccgcucccacuuccgcgacaaguaccgccuccccaagaacgagaccgacgagucccagauccagauggccggcggcgacgucgagcucccccgcgagcucgccaagaugaucgaggaggacaccgaggaggaggaggagaaggccuccguccucggccagcucgccucccuccccggccucaaccucggcucccucaaggacaaggcccaggccacccucggcgaccucaagcaguccgccgagaagugccacgucauguga

SEQ ID NO: 41693 - RNA, 483 nt, Artificial Sequence
  derived and/or modified sequence opt2 from CPLX4__Homo_sapiens__NP_857637
auggccuuccucaugaaguccaugaucuccaaccaggucaagaaccucggcuucggcggcggcuccgaggagaacaaggaggagggcggcgccuccgaccccgccgccgcccagggcaugacccgcgaggaguacgaggaguaccagaagcagaugaucgaggagaagauggagcgcgacgccgccuucacccagaagaaggccgagcgcgccugccuccgcguccaccuccgcgagaaguaccgccuccccaaguccgagauggacgagaaccagauccagauggccggcgacgacgucgaccuccccgaggaccuccgcaagauggucgacgaggaccaggaggaggaggaggacaaggacuccauccucggccagauccagaaccuccagaacauggaccucgacaccaucaaggagaaggcccaggccaccuucaccgagaucaagcagaccgccgagcagaagugcuccgucauguga

SEQ ID NO: 41694 - RNA, 1332 nt, Artificial Sequence
  derived and/or modified sequence opt2 from CPM__Homo_sapiens__NP_001005502
auggacuuccccugccucuggcucggccuccuccucccccucgucgccgcccucgacuucaacuaccaccgccaggagggcauggaggccuuccucaagaccgucgcccagaacuacuccuccgucacccaccuccacuccaucggcaaguccgucaagggccgcaaccucuggguccucgucgucggccgcuuccccaaggagcaccgcaucggcauccccgaguucaaguacgucgccaacaugcacggcgacgagaccgucggccgcgagcuccuccuccaccucaucgacuaccucgucaccuccgacggcaaggaccccgagaucaccaaccucaucaacuccacccgcauccacaucaugcccuccaugaaccccgacggcuucgaggccgucaagaagcccgacugcuacuacuccaucggccgcgagaacuacaaccaguacgaccucaaccgcaacuuccccgacgccuucgaguacaacaacgucucccgccagcccgagaccgucgccgucaugaaguggcucaagaccgagaccuucguccucuccgccaaccuccacggcggcgcccucgucgccuccuaccccuucgacaacggcguccaggccaccggcgcccucuacucccgcucccucacccccgacgacgacgucuuccaguaccucgcccacaccuacgccucccgcaaccccaacaugaagaagggcgacgagugcaagaacaagaugaacuuccccaacggcgucaccaacggcuacuccugguacccccuccagggcggcaugcaggacuacaacuacaucugggcccagugcuucgagaucacccucgagcucuccugcugcaaguacccccgcgaggagaagcuccccuccuucuggaacaacaacaaggccucccucaucgaguacaucaagcagguccaccucggcgucaagggccaggucuucgaccagaacggcaacccccuccccaacgucaucgucgagguccaggaccgcaagcacaucugccccuaccgcaccaacaaguacggcgaguacuaccuccuccuccuccccggcuccuacaucaucaacgucaccguccccggccacgacccccacaucaccaaggucaucauccccgagaagucccagaacuucuccgcccucaagaaggacauccuccuccccuuccagggccagcucgacuccauccccgucuccaaccccuccugccccaugaucccccucuaccgcaaccuccccgaccacuccgccgccaccaagcccucccucuuccucuuccucgucucccuccuccacaucuucuucaaguga

SEQ ID NO: 41695 - RNA, 1419 nt, Artificial Sequence
  derived and/or modified sequence opt2 from CPN1__Homo_sapiens__XP_011537601
auguccgaccuccucuccgucuuccuccaccuccuccuccucuucaagcucgucgcccccgucaccuuccgccaccaccgcuacgacgaccucguccgcacccucuacaagguccagaacgagugccccggcaucacccgcgucuacuccaucggccgcuccgucgagggccgccaccucuacguccucgaguucuccgaccaccccggcauccacgagccccucgagcccgaggucaaguacgucggcaacaugcacggcaacgaggcccucggccgcgagcucaugcuccagcucuccgaguuccucugcgaggaguuccgcaaccgcaaccagcgcaucguccagcucauccaggacacccgcauccacauccuccccuccaugaaccccgacggcuacgaggucgccgccgcccagggccccaacaagcccggcuaccucgucggccgcaacaacgccaacggcgucgaccucaaccgcaacuuccccgaccucaacaccuacaucuacuacaacgagaaguacggcggccccaaccaccaccucccccuccccgacaacuggaagucccagccccagcucgcccuccaccgccagccccucgccuccucccaggucgagcccgagacccgcgccgucauccgcuggaugcacuccuucaacuucguccucuccgccaaccuccacggcggcgccgucgucgccaacuaccccuacgacaaguccuucgagcaccgcguccgcggcguccgccgcaccgccuccacccccacccccgacgacaagcucuuccagaagcucgccaaggucuacuccuacgcccacggcuggauguuccagggcuggaacugcggcgacuacuuccccgacggcaucaccaacggcgccuccugguacucccucuccaagggcaugcaggacuucaacuaccuccacaccaacugcuucgagaucacccucgagcucuccugcgacaaguucccccccgaggaggagcuccagcgcgaguggcucggcaaccgcgaggcccucauccaguuccucgagcagguccaccagggcaucaagggcaugguccucgacgagaacuacaacaaccucgccaacgccgucaucuccgucuccggcaucaaccacgacgucaccuccggcgaccacggcgacuacuuccgccuccuccuccccggcaucuacaccgucuccgccaccgcccccggcuacgaccccgagaccgucaccgucaccgucggccccgccgagcccacccucgucaacuuccaccucaagcgcuccaucccccaggucucccccguccgccgcgcccccucccgccgccacggcguccgcgccaagguccagccccaggcccgcaagaaggagauggagaugcgccagcuccagcgcggccccgccuga

SEQ ID NO: 41696 - RNA, 1638 nt, Artificial Sequence
  derived and/or modified sequence opt2 from CPN2__Homo_sapiens__NP_001278917
augcuccccggcgccuggcuccucuggaccucccuccuccuccucgcccgccccgcccagcccugccccaugggcugcgacugcuucguccaggaggucuucugcuccgacgaggagcucgccaccgucccccucgacaucccccccuacaccaagaacaucaucuucgucgagaccuccuucaccacccucgagacccgcgccuucggcuccaaccccaaccucaccaaggucgucuuccucaacacccagcucugccaguuccgccccgacgccuucggcggccucccccgccucgaggaccucgaggucaccggcuccuccuuccucaaccucuccaccaacaucuucuccaaccucaccucccucggcaagcucacccucaacuucaacaugcucgaggcccuccccgagggccucuuccagcaccucgccgcccucgagucccuccaccuccagggcaaccagcuccaggcccucccccgccgccucuuccagccccucacccaccucaagacccucaaccucgcccagaaccuccucgcccagcuccccgaggagcucuuccacccccucaccucccuccagacccucaagcucuccaacaacgcccucuccggccucccccagggcgucuucggcaagcucggcucccuccaggagcucuuccucgacuccaacaacaucuccgagcuccccccccaggucuucucccagcucuucugccucgagcgccucuggcuccagcgcaacgccaucacccaccucccccucuccaucuucgccucccucggcaaccucaccuuccucucccuccaguggaacaugcuccgcguccuccccgccggccucuucgcccacacccccugccucgucggccucucccucacccacaaccagcucgagaccgucgccgagggcaccuucgcccaccucuccaaccuccgcucccucaugcucuccuacaacgccaucacccaccuccccgccggcaucuuccgcgaccucgaggagcucgucaagcucuaccucggcuccaacaaccucaccgcccuccaccccgcccucuuccagaaccucuccaagcucgagcuccucucccucuccaagaaccagcucaccacccuccccgagggcaucuucgacaccaacuacaaccucuucaaccucgcccuccacggcaaccccuggcagugcgacugccaccucgccuaccucuucaacuggcuccagcaguacaccgaccgccuccucaacauccagaccuacugcgccggccccgccuaccucaagggccaggucguccccgcccucaacgagaagcagcucgucugccccgucacccgcgaccaccucggcuuccaggucaccuggcccgacgaguccaaggccggcggcuccugggaccucgccguccaggagcgcgccgcccgcucccagugcaccuacuccaaccccgagggcaccgucguccucgccugcgaccaggcccagugccgcuggcucaacguccagcucuccccccagcagggcucccucggccuccaguacaacgccucccaggagugggaccuccgcuccuccugcggcucccuccgccucaccgucuccaucgaggcccgcgccgccggccccuga

SEQ ID NO: 41697 - RNA, 1611 nt, Artificial Sequence
  derived and/or modified sequence opt2 from CPNE1__Homo_sapiens__NP_001185792
auggcccacugcgucacccucguccagcucuccaucuccugcgaccaccucaucgacaaggacaucggcuccaaguccgacccccucugcguccuccuccaggacgucggcggcggcuccugggccgagcucggccgcaccgagcgcguccgcaacugcuccucccccgaguucuccaagacccuccagcucgaguaccgcuucgagaccguccagaagcuccgcuucggcaucuacgacaucgacaacaagacccccgagcuccgcgacgacgacuuccucggcggcgccgagugcucccucggccagaucgucuccucccagguccucacccucccccucaugcucaagcccggcaagcccgccggccgcggcaccaucaccgucuccgcccaggagcucaaggacaaccgcgucgucaccauggaggucgaggcccgcaaccucgacaagaaggacuuccucggcaaguccgaccccuuccucgaguucuuccgccagggcgacggcaaguggcaccucgucuaccgcuccgaggucaucaagaacaaccucaaccccaccuggaagcgcuucuccguccccguccagcacuucugcggcggcaaccccuccacccccauccagguccagugcuccgacuacgacuccgacggcucccacgaccucaucggcaccuuccacaccucccucgcccagcuccaggccguccccgccgaguucgagugcauccaccccgagaagcagcagaagaagaaguccuacaagaacuccggcaccauccgcgucaagaucugccgcgucgagaccgaguacuccuuccucgacuacgucaugggcggcugccagaucaacuucaccgucggcgucgacuucaccggcuccaacggcgaccccuccucccccgacucccuccacuaccucucccccaccggcgucaacgaguaccucauggcccucugguccgucggcuccgucguccaggacuacgacuccgacaagcucuuccccgccuucggcuucggcgcccaggucccccccgacuggcaggucucccacgaguucgcccucaacuucaaccccuccaaccccuacugcgccggcauccagggcaucgucgacgccuaccgccaggcccucccccagguccgccucuacggccccaccaacuucgcccccaucaucaaccacgucgcccgcuucgccgcccaggccgcccaccagggcaccgccuccuacuucaugcuccuccuccucaccgacggcgccgucaccgacgucgaggccacccgcgaggccgucguccgcgccuccaaccuccccauguccgucaucaucgucggcgucggcggcgccgacuucgaggccauggagcagcucgacgccgacggcggcccccuccacacccgcuccggccaggccgccgcccgcgacaucguccaguucguccccuaccgccgcuuccagaacgccccccgcgaggcccucgcccagaccguccucgccgagguccccacccagcucgucuccuacuuccgcgcccagggcugggccccccucaagccccucccccccuccgccaaggaccccgcccaggccccccaggccuga

SEQ ID NO: 41698 - RNA, 1647 nt, Artificial Sequence
  derived and/or modified sequence opt2 from CPNE2__Homo_sapiens__NP_689940
auggcccacauccccuccggcggcgcccccgccgccggcgccgcccccaugggcccccaguacugcgucugcaaggucgagcucuccgucuccggccagaaccuccucgaccgcgacgucaccuccaaguccgaccccuucugcguccucuucaccgagaacaacggccgcuggaucgaguacgaccgcaccgagaccgccaucaacaaccucaaccccgccuucuccaagaaguucguccucgacuaccacuucgaggagguccagaagcucaaguucgcccucuucgaccaggacaaguccuccaugcgccucgacgagcacgacuuccucggccaguucuccugcucccucggcaccaucgucuccuccaagaagaucacccgcccccuccuccuccucaacgacaagcccgccggcaagggccucaucaccaucgccgcccaggagcucuccgacaaccgcgucaucacccucucccucgccggccgccgccucgacaagaaggaccucuucggcaaguccgaccccuuccucgaguucuacaagcccggcgacgacggcaaguggaugcucguccaccgcaccgaggucaucaaguacacccucgaccccgucuggaagcccuucaccgucccccucgucucccucugcgacggcgacauggagaagcccauccaggucaugugcuacgacuacgacaacgacggcggccacgacuucaucggcgaguuccagaccuccgucucccagaugugcgaggcccgcgacuccgucccccucgaguucgagugcaucaaccccaagaagcagcgcaagaagaagaacuacaagaacuccggcaucaucauccuccgcuccugcaagaucaaccgcgacuacuccuuccucgacuacauccucggcggcugccagcucauguucaccgucggcaucgacuucaccgccuccaacggcaacccccucgaccccuccucccuccacuacaucaaccccaugggcaccaacgaguaccucuccgccaucugggccgucggccagaucauccaggacuacgacuccgacaagauguuccccgcccucggcuucggcgcccagcucccccccgacuggaaggucucccacgaguucgccaucaacuucaaccccaccaaccccuucugcuccggcgucgacggcaucgcccaggccuacuccgccugccucccccacauccgcuucuacggccccaccaacuucucccccaucgucaaccacgucgcccgcuucgccgcccaggccacccagcagcgcaccgccacccaguacuucauccuccucaucaucaccgacggcgucaucuccgacauggaggagacccgccacgccgucguccaggccuccaagcuccccauguccaucaucaucgucggcgucggcaacgccgacuucgccgccauggaguuccucgacggcgacucccgcaugcuccgcucccacaccggcgaggaggccgcccgcgacaucguccaguucguccccuuccgcgaguuccgcaacgccgccaaggagacccucgccaaggccguccucgccgagcucccccagcaggucguccaguacuucaagcacaagaaccucccccccaccaacuccgagcccgccuga

SEQ ID NO: 41699 - RNA, 1614 nt, Artificial Sequence
  derived and/or modified sequence opt2 from CPNE3__Homo_sapiens__NP_003900
auggccgcccagugcgucaccaaggucgcccucaacgucuccugcgccaaccuccucgacaaggacaucggcuccaaguccgacccccucugcguccucuuccucaacaccuccggccagcagugguacgaggucgagcgcaccgagcgcaucaagaacugccucaacccccaguucuccaagaccuucaucaucgacuacuacuucgaggucguccagaagcucaaguucggcgucuacgacaucgacaacaagaccaucgagcucuccgacgacgacuuccucggcgagugcgagugcacccucggccagaucgucuccuccaagaagcucacccgcccccucgucaugaagaccggccgccccgccggcaagggcuccaucaccaucuccgccgaggagaucaaggacaaccgcgucguccucuucgagauggaggcccgcaagcucgacaacaaggaccucuucggcaaguccgaccccuaccucgaguuccacaagcagaccuccgacggcaacuggcucaugguccaccgcaccgaggucgucaagaacaaccucaaccccgucuggcgccccuucaagaucucccucaacucccucugcuacggcgacauggacaagaccaucaaggucgagugcuacgacuacgacaacgacggcucccacgaccucaucggcaccuuccagaccaccaugaccaagcucaaggaggccucccgcuccucccccgucgaguucgagugcaucaacgagaagaagcgccagaagaagaaguccuacaagaacuccggcgucaucuccgucaagcagugcgagaucaccgucgagugcaccuuccucgacuacaucaugggcggcugccagcucaacuucaccgucggcgucgacuucaccggcuccaacggcgacccccgcucccccgacucccuccacuacaucucccccaacggcgucaacgaguaccucaccgcccucugguccgucggccucgucauccaggacuacgacgccgacaagauguuccccgccuucggcuucggcgcccagauccccccccaguggcaggucucccacgaguuccccaugaacuucaaccccuccaaccccuacugcaacggcauccagggcaucgucgaggccuaccgcuccugccucccccagaucaagcucuacggccccaccaacuucucccccaucaucaaccacgucgcccgcuucgccgccgccgccacccagcagcagaccgccucccaguacuucguccuccucaucaucaccgacggcgucaucaccgaccucgacgagacccgccaggccaucgucaacgccucccgccuccccauguccaucaucaucgucggcgucggcggcgccgacuucuccgccauggaguuccucgacggcgacggcggcucccuccgcuccccccucggcgaggucgccauccgcgacaucguccaguucguccccuuccgccaguuccagaacgcccccaaggaggcccucgcccagugcguccucgccgagaucccccagcaggucgucggcuacuucaacaccuacaagcuccucccccccaagaaccccgccaccaagcagcagaagcaguga

SEQ ID NO: 41700 - RNA, 1728 nt, Artificial Sequence
  derived and/or modified sequence opt2 from CPNE4__Homo_sapiens__NP_001276041
auggccgucgagcccuccuccuccgaguccaucaagcgccgcgccggccgccgcaugaagaagauguccaacaucuacgaguccgccgccaacacccucggcaucuucaacucccccugccucaccaaggucgagcuccgcgucgccugcaagggcaucuccgaccgcgacgcccucuccaagcccgaccccugcgucauccucaagaugcagucccacggccagugguucgaggucgaccgcaccgaggucauccgcaccugcaucaaccccgucuacuccaagcucuucaccgucgacuucuacuucgaggagguccagcgccuccgcuucgagguccacgacaucuccuccaaccacaacggccucaaggaggccgacuuccucggcggcauggagugcacccucggccagaucgucucccagcgcaagcucuccaagucccuccucaagcacggcaacaccgccggcaaguccuccaucaccgucaucgccgaggagcucuccggcaacgacgacuacgucgagcucgccuucaacgcccgcaagcucgacgacaaggacuucuucuccaaguccgaccccuuccucgagaucuuccgcaugaacgacgacgccacccagcagcucguccaccgcaccgaggucgucaugaacaaccucucccccgccuggaaguccuucaaggucuccgucaacucccucugcuccggcgaccccgaccgccgccucaagugcaucgucugggacugggacuccaacggcaagcacgacuucaucggcgaguucaccuccaccuucaaggagaugcgcggcgccauggagggcaagcagguccagugggagugcaucaaccccaaguacaaggccaagaagaagaacuacaagaacuccggcaccgucauccucaaccucugcaagauccacaagaugcacuccuuccucgacuacaucaugggcggcugccagauccaguucaccgucgccaucgacuucaccgccuccaacggcgacccccgcaacuccugcucccuccacuacauccaccccuaccagcccaacgaguaccucaaggcccucgucgccgucggcgagaucugccaggacuacgacuccgacaagauguuccccgccuucggcuucggcgcccgcaucccccccgaguacaccgucucccacgacuucgccaucaacuucaacgaggacaaccccgagugcgccggcauccagggcgucgucgaggccuaccaguccugccuccccaagcuccagcucuacggccccaccaacaucgcccccaucauccagaaggucgccaaguccgccuccgaggagaccaacaccaaggaggccucccaguacuucauccuccucauccucaccgacggcgucaucaccgacauggccgacacccgcgaggccaucguccacgccucccaccuccccauguccgucaucaucgucggcgucggcaacgccgacuucuccgacaugcagaugcucgacggcgacgacggcauccuccgcucccccaagggcgagcccguccuccgcgacaucguccaguucguccccuuccgcaacuucaagcacgccucccccgccgcccucgccaaguccguccucgccgagguccccaaccaggucgucgacuacuacaacggcaagggcaucaagcccaagugcuccuccgagauguacgaguccucccgcacccucgcccccuga

SEQ ID NO: 41701 - RNA, 1902 nt, Artificial Sequence
  derived and/or modified sequence opt2 from CPNE7__Homo_sapiens__NP_055242
auguccgccggcuccgagcgcggcgccgccgccacccccggcggccuccccgcccccugcgccuccaaggucgagcuccgccucuccugccgccaccuccucgaccgcgacccccucaccaaguccgaccccuccgucgcccuccuccagcaggcccagggccaguggguccaggucggccgcaccgaggucguccgcuccucccuccaccccgucuucuccaaggucuucaccgucgacuacuacuucgaggagguccagcgccuccgcuucgaggucuacgacacccacggccccuccggcuucuccugccaggaggacgacuuccucggcggcauggagugcacccucggccagcccgcccagaaguggcuccuccaggucgucaugcgcgucuccgucgacguccucggccccgccggccacugcgccaagcacuuccucugcugcaccgaguccucccaccucgcccgcaccggccccuccuuccuccuccgcuacgacgaccucugccuccccugggccaccgccggcgccguccgcugguggaccugccgcggcggccacacccagggcuggcagaucgucgcccagaagaaggucacccgcccccuccuccucaaguucggccgcaacgccggcaaguccaccaucaccgucaucgccgaggacaucuccggcaacaacggcuacgucgagcucuccuuccgcgcccgcaagcucgacgacaaggaccucuucuccaaguccgaccccuuccucgagcucuaccgcgucaacgacgaccagggccuccagcucgucuaccgcaccgaggucgucaagaacaaccucaaccccgucugggaggccuucaaggucucccucuccucccucugcuccugcgaggagacccgcccccucaagugccucgucugggacuacgacucccgcggcaagcacgacuucaucggcgaguucuccaccaccuucgaggagaugcagaaggccuucgaggagggccaggcccagugggacugcgucaaccccaaguacaagcagaagcgccgcuccuacaagaacuccggcgucgucguccucgccgaccucaaguuccaccgcgucuacuccuuccucgacuacaucaugggcggcugccagauccacuucaccgucgccaucgacuucaccgccuccaacggcgacccccgcaacuccugcucccuccacuacaucaaccccuaccagcccaacgaguaccucaaggcccucgucuccgucggcgagaucugccaggacuacgacuccgacaagcgcuucuccgcccucggcuucggcgcccgcaucccccccaaguacgaggucucccacgacuucgccaucaacuucaaccccgaggacgacgagugcgagggcauccagggcgucgucgaggccuaccagaacugccucccccgcguccagcucuacggccccaccaacgucgcccccaucaucuccaaggucgcccgcgucgccgccgccgaggaguccaccggcaaggccucccaguacuacauccuccucauccucaccgacggcgucgucaccgacauggccgacacccgcgaggccaucguccgcgccucccgccuccccauguccaucaucaucgucggcgucggcaacgccgacuucaccgacaugcagguccucgacggcgacgacggcguccuccgcuccccccgcggcgagcccgcccuccgcgacaucguccaguucguccccuuccgcgagcucaagaacgccucccccgccgcccucgccaagugcguccucgccgagguccccaagcaggucgucgaguacuacucccaccgcggccuccccccccgcucccucggcguccccgccggcgaggccucccccggcugcacccccuga

SEQ ID NO: 41702 - RNA, 1695 nt, Artificial Sequence
  derived and/or modified sequence opt2 from CPNE8__Homo_sapiens__NP_705898
auggacucccgcuacaacuccaccgccggcaucggcgaccucaaccagcucuccgccgccauccccgccacccgcgucgaggucuccgucuccugccgcaaccuccucgaccgcgacaccuucuccaaguccgaccccaucugcguccucuacguccagggcgucggcaacaaggaguggcgcgaguucggccgcaccgaggucaucgacaacacccucaaccccgacuucguccgcaaguucauccucgacuacuucuucgaggagcgcgagaaccuccgcuucgaccucuacgacgucgacuccaagucccccaaccucuccaagcacgacuuccucggccaggucuucugcacccucggcgagaucgucggcucccagggcucccgccucgagaagcccaucgucggcauccccggcaagaagugcggcaccaucauccucaccgccgaggagcucaacugcugccgcgacgccguccucaugcaguucugcgccaacaagcucgacaagaaggacuucuucggcaaguccgaccccuuccucgucuucuaccgcuccaacgaggacggcuccuucaccaucugccacaagaccgaggucgucaagaacacccucaaccccgucuggcaggccuucaagaucuccguccgcgcccucugcaacggcgacuacgaccgcaccaucaaggucgaggucuacgacugggaccgcgacggcucccacgacuucaucggcgaguucaccaccuccuaccgcgagcucucccgcggccagucccaguucaacgucuacgaggucgucaaccccaagaagaagggcaagaagaagaaguacaccaacuccggcaccgucacccuccucuccuuccucgucgagaccgaggucuccuuccucgacuacaucaagggcggcacccagaucaacuucaccgucgccaucgacuucaccgccuccaacggcaaccccgcccagcccaccucccuccacuacaugaaccccuaccagcucaacgccuacggcauggcccucaaggccgucggcgagaucguccaggacuacgacuccgacaagauguuccccgcccucggcuucggcgccaagcucccccccgacggccgcaucucccacgaguucgcccucaacggcaacccccagaaccccuacugcgacggcaucgagggcgucauggaggccuacuaccgcucccucaaguccguccagcucuacggccccaccaacuucgcccccgucaucaaccacgucgcccgcuacgccuccuccgucaaggacggcucccaguacuucguccuccucaucgucaccgacggcgucaucuccgacauggcccagaccaaggaguccaucgucaacgccuccaagcuccccauguccaucaucaucgucggcgucggccccgccgaguucgacgccauggucgagcucgacggcgacgacguccgcgucuccucccgcggcaaguacgccgagcgcgacaucguccaguucguccccuuccgcgacuacaucgaccgcuccggcaaccacauccucuccauggcccgccucgccaaggacguccucgccgagauccccgagcaguuccucuccuacaugcgcgcccgcggcaucaagcccucccccgcccccccccccuacaccccccccacccacguccuccagacccagaucuga

SEQ ID NO: 41703 - RNA, 1125 nt, Artificial Sequence
  derived and/or modified sequence opt2 from CPO__Homo_sapiens__XP_011508929
augaagccccuccucgagacccucuaccuccucggcaugcucguccccggcggccucggcuacgaccgcucccucgcccagcaccgccaggagaucgucgacaaguccgucucccccuggucccucgagaccuacuccuacaacaucuaccaccccaugggcgagaucuacgaguggaugcgcgagaucuccgagaaguacaaggaggucgucacccagcacuuccucggcgucaccuacgagacccaccccauguacuaccucaagaucucccagcccuccggcaaccccaagaagaucaucuggauggacugcggcauccacgcccgcgaguggaucgcccccgccuucugccagugguucgucaaggagauccuccagaaccacaaggacaacuccuccauccgcaagcuccuccgcaaccucgacuucuacguccuccccguccucaacaucgacggcuacaucuacaccuggaccaccgaccgccucuggcgcaagucccgcuccccccacaacaacggcaccugcuucggcaccgaccucaaccgcaacuucaacgccuccuggugcuccaucggcgccucccgcaacugccaggaccagaccuucugcggcaccggccccgucuccgagcccgagaccaaggccgucgccuccuucaucgaguccaagaaggacgacauccucugcuuccucaccaugcacuccuacggccagcucauccucacccccuacggcuacaccaagaacaaguccuccaaccaccccgagaugauccaggucggccagaaggccgccaacgcccucaaggccaaguacggcaccaacuaccgcgucggcuccuccgccgacauccucuacgccuccuccggcuccucccgcgacugggcccgcgacaucggcauccccuucuccuacaccuucgagcuccgcgacuccggcaccuacggcuucguccuccccgaggcccagauccagcccaccugcgaggagaccauggaggccguccucuccguccucgacgacgucuacgccaagcacuggcacuccgacuccgccggccgcgucaccuccgccaccaugcuccucggccuccucgucuccugcaugucccuccucuga

SEQ ID NO: 41704 - RNA, 1365 nt, Artificial Sequence
  derived and/or modified sequence opt2 from CPOX__Homo_sapiens__NP_000088
auggcccuccagcucggccgccucuccuccggccccugcuggcucgucgcccgcggcggcugcggcggcccccgcgccuggucccagugcggcggcggcggccuccgcgccuggucccagcgcuccgccgccggccgcgucugccgcccccccggccccgccggcaccgagcagucccgcggccucggccacggcuccaccucccgcggcggccccugggucggcaccggccucgccgccgcccucgccggccucgucggccucgccaccgccgccuucggccacguccagcgcgccgagaugcuccccaagaccuccggcacccgcgccaccucccucggccgccccgaggaggaggaggacgagcucgcccaccgcugcuccuccuucauggccccccccgucaccgaccucggcgagcuccgccgccgccccggcgacaugaagaccaagauggagcuccucauccucgagacccaggcccaggucugccaggcccucgcccaggucgacggcggcgccaacuucuccgucgaccgcugggagcgcaaggagggcggcggcggcaucuccugcguccuccaggacggcugcgucuucgagaaggccggcgucuccaucuccgucguccacggcaaccucuccgaggaggccgccaagcagaugcgcucccgcggcaagguccucaagaccaaggacggcaagcuccccuucugcgccaugggcgucuccuccgucauccaccccaagaacccccacgcccccaccauccacuucaacuaccgcuacuucgaggucgaggaggccgacggcaacaagcaguggugguucggcggcggcugcgaccucacccccaccuaccucaaccaggaggacgccguccacuuccaccgcacccucaaggaggccugcgaccagcacggccccgaccucuaccccaaguucaagaaguggugcgacgacuacuucuucaucgcccaccgcggcgagcgccgcggcaucggcggcaucuucuucgacgaccucgacucccccuccaaggaggaggucuuccgcuucguccaguccugcgcccgcgccgucguccccuccuacaucccccucgucaagaagcacugcgacgacuccuucaccccccaggagaagcucuggcagcagcuccgccgcggccgcuacgucgaguucaaccuccucuacgaccgcggcaccaaguucggccucuucacccccggcucccgcaucgaguccauccucaugucccucccccucaccgcccgcugggaguacaugcacucccccuccgagaacuccaaggaggccgagauccucgagguccuccgccacccccgcgacuggguccgcuga

SEQ ID NO: 41705 - RNA, 519 nt, Artificial Sequence
  derived and/or modified sequence opt2 from CPPED1__Homo_sapiens__NP_001092925
auguccgccgccgaggccggcggcgucuuccaccgcgcccgcggccgcacccucgccgccuuccccgccgagaaggaguccgaguggaagggccccuucuacuucauccucggcgccgacccccaguucggccucaucaaggccugguccaccggcgacugcgacaacggcggcgacgagugggagcaggagauccgccucaccgagcaggccguccaggccaucaacaagcucaaccccaagcccaaguucuucguccucugcggcgaccucauccacgccaugcccggcgucaaggucgucuucuccggccacuaccaccgcaacgccggcggcaccuaccagaaccucgacauggucgucuccuccgccaucggcugccagcucggccgcgacccccacggccuccgcgucgucgucgucaccgccgagaagaucguccaccgcuacuacucccucgacgagcucuccgagaagggcaucgaggacgaccucauggaccucaucaagaagaaguga

SEQ ID NO: 41706 - RNA, 1419 nt, Artificial Sequence
  derived and/or modified sequence opt2 from CPQ__Homo_sapiens__NP_057218
augaaguuccucaucuucgccuucuucggcggcguccaccuccucucccucugcuccggcaaggccaucugcaagaacggcaucuccaagcgcaccuucgaggagaucaaggaggagaucgccuccugcggcgacgucgccaaggccaucaucaaccucgccgucuacggcaaggcccagaaccgcuccuacgagcgccucgcccuccucgucgacaccgucggcccccgccucuccggcuccaagaaccucgagaaggccauccagaucauguaccagaaccuccagcaggacggccucgagaagguccaccucgagcccguccgcaucccccacugggagcgcggcgaggaguccgccgucaugcucgagccccgcauccacaagaucgccauccucggccucggcuccuccaucggcaccccccccgagggcaucaccgccgagguccucgucgucaccuccuucgacgagcuccagcgccgcgccuccgaggcccgcggcaagaucgucgucuacaaccagcccuacaucaacuacucccgcaccguccaguaccgcacccagggcgccgucgaggccgccaaggucggcgcccucgccucccucauccgcuccgucgccuccuucuccaucuacuccccccacaccggcauccaggaguaccaggacggcguccccaagauccccaccgccugcaucaccgucgaggacgccgagaugaugucccgcauggccucccacggcaucaagaucgucauccagcucaagaugggcgccaagaccuaccccgacaccgacuccuucaacaccgucgccgagaucaccggcuccaaguaccccgagcaggucguccucgucuccggccaccucgacuccugggacgucggccagggcgccauggacgacggcggcggcgccuucaucuccugggaggcccucucccucaucaaggaccucggccuccgccccaagcgcacccuccgccucguccucuggaccgccgaggagcagggcggcgucggcgccuuccaguacuaccagcuccacaaggucaacaucuccaacuacucccucgucauggaguccgacgccggcaccuuccuccccaccggccuccaguucaccggcuccgagaaggcccgcgccaucauggaggaggucaugucccuccuccagccccucaacaucacccagguccucucccacggcgagggcaccgacaucaacuucuggauccaggccggcguccccggcgccucccuccucgacgaccucuacaaguacuucuucuuccaccacucccacggcgacaccaugaccgucauggaccccaagcagaugaacgucgccgccgccgucugggccgucgucuccuacgucgucgccgacauggaggagaugcucccccgcuccuga

SEQ ID NO: 41707 - RNA, 4521 nt, Artificial Sequence
  derived and/or modified sequence opt2 from CPS1__Homo_sapiens__NP_001116105
augccccagaucaucaagaugacccgcauccucaccgccuucaaggucguccgcacccucaagaccggcuucggcuucaccaacgucaccgcccaccagaaguggaaguucucccgccccggcauccgccuccucuccgucaaggcccagaccgcccacaucguccucgaggacggcaccaagaugaagggcuacuccuucggccaccccuccuccgucgccggcgaggucgucuucaacaccggccucggcggcuaccccgaggccaucaccgaccccgccuacaagggccagauccucaccauggccaaccccaucaucggcaacggcggcgcccccgacaccaccgcccucgacgagcucggccucuccaaguaccucgaguccaacggcaucaaggucuccggccuccucguccucgacuacuccaaggacuacaaccacuggcucgccaccaagucccucggccaguggcuccaggaggagaagguccccgccaucuacggcgucgacacccgcaugcucaccaagaucauccgcgacaagggcaccaugcucggcaagaucgaguucgagggccagcccgucgacuucgucgaccccaacaagcagaaccucaucgccgaggucuccaccaaggacgucaaggucuacggcaagggcaaccccaccaaggucgucgccgucgacugcggcaucaagaacaacgucauccgccuccucgucaagcgcggcgccgagguccaccucguccccuggaaccacgacuucaccaagauggaguacgacggcauccucaucgccggcggccccggcaaccccgcccucgccgagccccucauccagaacguccgcaagauccucgaguccgaccgcaaggagccccucuucggcaucuccaccggcaaccucaucaccggccucgccgccggcgccaagaccuacaagauguccauggccaaccgcggccagaaccagcccguccucaacaucaccaacaagcaggccuucaucaccgcccagaaccacggcuacgcccucgacaacacccuccccgccggcuggaagccccucuucgucaacgucaacgaccagaccaacgagggcaucaugcacgaguccaagcccuucuucgccguccaguuccaccccgaggucacccccggccccaucgacaccgaguaccucuucgacuccuucuucucccucaucaagaagggcaaggccaccaccaucaccuccguccuccccaagcccgcccucgucgccucccgcgucgaggucuccaagguccucauccucggcuccggcggccucuccaucggccaggccggcgaguucgacuacuccggcucccaggccgucaaggccaugaaggaggagaacgucaagaccguccucaugaaccccaacaucgccuccguccagaccaacgaggucggccucaagcaggccgacaccgucuacuuccuccccaucaccccccaguucgucaccgaggucaucaaggccgagcagcccgacggccucauccucggcaugggcggccagaccgcccucaacugcggcgucgagcucuucaagcgcggcguccucaaggaguacggcgucaagguccucggcaccuccgucgaguccaucauggccaccgaggaccgccagcucuucuccgacaagcucaacgagaucaacgagaagaucgcccccuccuucgccgucgaguccaucgaggacgcccucaaggccgccgacaccaucggcuaccccgucaugauccgcuccgccuacgcccucggcggccucggcuccggcaucugccccaaccgcgagacccucauggaccucuccaccaaggccuucgccaugaccaaccagauccucgucgagaaguccgucaccggcuggaaggagaucgaguacgaggucguccgcgacgccgacgacaacugcgucaccgucugcaacauggagaacgucgacgccaugggcguccacaccggcgacuccgucgucgucgcccccgcccagacccucuccaacgccgaguuccagaugcuccgccgcaccuccaucaacgucguccgccaccucggcaucgucggcgagugcaacauccaguucgcccuccaccccaccuccauggaguacugcaucaucgaggucaacgcccgccucucccgcuccuccgcccucgccuccaaggccaccggcuacccccucgccuucaucgccgccaagaucgcccucggcaucccccuccccgagaucaagaacgucgucuccggcaagaccuccgccugcuucgagcccucccucgacuacauggucaccaagaucccccgcugggaccucgaccgcuuccacggcaccuccucccgcaucggcuccuccaugaaguccgucggcgaggucauggccaucggccgcaccuucgaggaguccuuccagaaggcccuccgcaugugccaccccuccaucgagggcuucaccccccgccuccccaugaacaaggaguggcccuccaaccucgaccuccgcaaggagcucuccgagcccuccuccacccgcaucuacgccaucgccaaggccaucgacgacaacaugucccucgacgagaucgagaagcucaccuacaucgacaagugguuccucuacaagaugcgcgacauccucaacauggagaagacccucaagggccucaacuccgaguccaugaccgaggagacccucaagcgcgccaaggagaucggcuucuccgacaagcagaucuccaagugccucggccucaccgaggcccagacccgcgagcuccgccucaagaagaacauccaccccugggucaagcagaucgacacccucgccgccgaguaccccuccgucaccaacuaccucuacgucaccuacaacggccaggagcacgacgucaacuucgacgaccacggcaugaugguccucggcugcggccccuaccacaucggcuccuccgucgaguucgacuggugcgccgucuccuccauccgcacccuccgccagcucggcaagaagaccgucgucgucaacugcaaccccgagaccgucuccaccgacuucgacgagugcgacaagcucuacuucgaggagcucucccucgagcgcauccucgacaucuaccaccaggaggccugcggcggcugcaucaucuccgucggcggccagauccccaacaaccucgccgucccccucuacaagaacggcgucaagaucaugggcaccuccccccuccagaucgaccgcgccgaggaccgcuccaucuucuccgccguccucgacgagcucaaggucgcccaggcccccuggaaggccgucaacacccucaacgaggcccucgaguucgccaaguccgucgacuaccccugccuccuccgccccuccuacguccucuccggcuccgccaugaacgucgucuucuccgaggacgagaugaagaaguuccucgaggaggccacccgcgucucccaggagcaccccgucguccucaccaaguucgucgagggcgcccgcgaggucgagauggacgccgucggcaaggacggccgcgucaucucccacgccaucuccgagcacgucgaggacgccggcguccacuccggcgacgccacccucaugcuccccacccagaccaucucccagggcgccaucgagaaggucaaggacgccacccgcaagaucgccaaggccuucgccaucuccggccccuucaacguccaguuccucgucaagggcaacgacguccucgucaucgagugcaaccuccgcgccucccgcuccuuccccuucgucuccaagacccucggcgucgacuucaucgacgucgccaccaaggucaugaucggcgagaacgucgacgagaagcaccuccccacccucgaccaccccaucauccccgccgacuacgucgccaucaaggcccccauguucuccuggccccgccuccgcgacgccgaccccauccuccgcugcgagauggccuccaccggcgaggucgccugcuucggcgagggcauccacaccgccuuccucaaggccaugcucuccaccggcuucaagaucccccagaagggcauccucaucggcauccagcaguccuuccgcccccgcuuccucggcgucgccgagcagcuccacaacgagggcuucaagcucuucgccaccgaggccaccuccgacuggcucaacgccaacaacguccccgccacccccgucgccuggcccucccaggagggccagaaccccucccucuccuccauccgcaagcucauccgcgacggcuccaucgaccucgucaucaaccuccccaacaacaacaccaaguucguccacgacaacuacgucauccgccgcaccgccgucgacuccggcaucccccuccucaccaacuuccaggucaccaagcucuucgccgaggccguccagaagucccgcaaggucgacuccaagucccucuuccacuaccgccaguacuccgccggcaaggccgccuga

SEQ ID NO: 41708 - RNA, 4332 nt, Artificial Sequence
  derived and/or modified sequence opt2 from CPSF1__Homo_sapiens__NP_037423
auguacgccgucuacaagcaggcccacccccccaccggccucgaguucuccauguacugcaacuucuucaacaacuccgagcgcaaccucgucgucgccggcaccucccagcucuacgucuaccgccucaaccgcgacgccgaggcccucaccaagaacgaccgcuccaccgagggcaaggcccaccgcgagaagcucgagcucgccgccuccuucuccuucuucggcaacgucauguccauggccuccguccagcucgccggcgccaagcgcgacgcccuccuccucuccuucaaggacgccaagcucuccgucgucgaguacgaccccggcacccacgaccucaagacccucucccuccacuacuucgaggagcccgagcuccgcgacggcuucguccagaacguccacaccccccgcguccgcgucgaccccgacggccgcugcgccgccaugcucgucuacggcacccgccucgucguccuccccuuccgccgcgagucccucgccgaggagcacgagggccucgucggcgagggccagcgcuccuccuuccuccccuccuacaucaucgacguccgcgcccucgacgagaagcuccucaacaucaucgaccuccaguuccuccacggcuacuacgagcccacccuccucauccucuucgagcccaaccagaccuggcccggccgcgucgccguccgccaggacaccugcuccaucgucgccaucucccucaacaucacccagaagguccaccccgucaucuggucccucaccucccuccccuucgacugcacccaggcccucgccguccccaagcccaucggcggcgucgucgucuucgccgucaacucccuccucuaccucaaccaguccgucccccccuacggcgucgcccucaacucccucaccaccggcaccaccgccuucccccuccgcacccaggagggcguccgcaucacccucgacugcgcccaggccaccuucaucuccuacgacaagauggucaucucccucaagggcggcgagaucuacguccucacccucaucaccgacggcaugcgcuccguccgcgccuuccacuucgacaaggccgccgccuccguccucaccaccuccauggucaccauggagcccggcuaccucuuccucggcucccgccucggcaacucccuccuccucaaguacaccgagaagcuccaggagccccccgccuccgccguccgcgaggccgccgacaaggaggagccccccuccaagaagaagcgcgucgacgccaccgccggcugguccgccgccggcaaguccgucccccaggacgaggucgacgagaucgaggucuacggcuccgaggcccaguccggcacccagcucgccaccuacuccuucgaggucugcgacuccauccucaacaucggccccugcgccaacgccgccgucggcgagcccgccuuccucuccgaggaguuccagaacucccccgagcccgaccucgagaucgucgucugcuccggccacggcaagaacggcgcccucuccguccuccagaaguccauccgcccccaggucgucaccaccuucgagcuccccggcugcuacgacauguggaccgucaucgcccccguccgcaaggaggaggaggacaaccccaagggcgagggcaccgagcaggagcccuccaccacccccgaggccgacgacgacggccgccgccacggcuuccucauccucucccgcgaggacuccaccaugauccuccagaccggccaggagaucauggagcucgacaccuccggcuucgccacccagggccccaccgucuucgccggcaacaucggcgacaaccgcuacaucguccaggucuccccccucggcauccgccuccucgagggcgucaaccagcuccacuucauccccgucgaccucggcgcccccaucguccagugcgccgucgccgaccccuacgucgucaucauguccgccgagggccacgucaccauguuccuccucaaguccgacuccuacggcggccgccaccaccgccucgcccuccacaagcccccccuccaccaccaguccaaggucaucacccucugccucuaccgcgaccucuccggcauguucaccaccgagucccgccucggcggcgcccgcgacgagcucggcggccgcuccggccccgaggccgagggccucggcuccgagaccucccccaccgucgacgacgaggaggagaugcucuacggcgacuccggcucccucuucucccccuccaaggaggaggcccgccgcuccucccagccccccgccgaccgcgaccccgcccccuuccgcgccgagcccacccacuggugccuccucguccgcgagaacggcaccauggagaucuaccagcuccccgacuggcgccucgucuuccucgucaagaacuuccccgucggccagcgcguccucgucgacuccuccuucggccagcccaccacccagggcgaggcccgccgcgaggaggccacccgccagggcgagcucccccucgucaaggagguccuccucgucgcccucggcucccgccagucccgccccuaccuccucguccacgucgaccaggagcuccucaucuacgaggccuucccccacgacucccagcucggccagggcaaccucaagguccgcuucaagaaggucccccacaacaucaacuuccgcgagaagaagcccaagcccuccaagaagaaggccgagggcggcggcgccgaggagggcgccggcgcccgcggccgcgucgcccgcuuccgcuacuucgaggacaucuacggcuacuccggcgucuucaucugcggccccuccccccacuggcuccucgucaccggccgcggcgcccuccgccuccaccccauggccaucgacggccccgucgacuccuucgcccccuuccacaacgucaacugcccccgcggcuuccucuacuucaaccgccagggcgagcuccgcaucuccguccuccccgccuaccucuccuacgacgcccccuggcccguccgcaagaucccccuccgcugcaccgcccacuacgucgccuaccacgucgaguccaaggucuacgccgucgccaccuccaccaacacccccugcgcccgcaucccccgcaugaccggcgaggagaaggaguucgagaccaucgagcgcgacgagcgcuacauccacccccagcaggaggccuucuccauccagcucaucucccccgucuccugggaggccauccccaacgcccgcaucgagcuccaggagugggagcacgucaccugcaugaagaccgucucccuccgcuccgaggagaccgucuccggccucaagggcuacgucgccgccggcaccugccucaugcagggcgaggaggucaccugccgcggccgcauccucaucauggacgucaucgaggucguccccgagcccggccagccccucaccaagaacaaguucaagguccucuacgagaaggagcagaagggccccgucaccgcccucugccacugcaacggccaccucgucuccgccaucggccagaagaucuuccucuggucccuccgcgccuccgagcucaccggcauggccuucaucgacacccagcucuacauccaccagaugaucuccgucaagaacuucauccucgccgccgacgucaugaaguccaucucccuccuccgcuaccaggaggaguccaagacccucucccucgucucccgcgacgccaagccccucgaggucuacuccgucgacuucauggucgacaacgcccagcucggcuuccucgucuccgaccgcgaccgcaaccucauggucuacauguaccuccccgaggccaaggaguccuucggcggcaugcgccuccuccgccgcgccgacuuccacgucggcgcccacgucaacaccuucuggcgcacccccugccgcggcgccaccgagggccucuccaagaaguccgucgucugggagaacaagcacaucaccugguucgccacccucgacggcggcaucggccuccuccuccccaugcaggagaagaccuaccgccgccuccucaugcuccagaacgcccucaccaccaugcucccccaccacgccggccucaacccccgcgccuuccgcaugcuccacgucgaccgccgcacccuccagaacgccguccgcaacguccucgacggcgagcuccucaaccgcuaccucuaccucuccaccauggagcgcuccgagcucgccaagaagaucggcaccacccccgacaucauccucgacgaccuccucgagaccgaccgcgucaccgcccacuucuga

SEQ ID NO: 41709 - RNA, 2349 nt, Artificial Sequence
  derived and/or modified sequence opt2 from CPSF2__Homo_sapiens__NP_059133
augaccuccaucaucaagcucaccacccucuccggcguccaggaggaguccgcccucugcuaccuccuccaggucgacgaguuccgcuuccuccucgacugcggcugggacgagcacuucuccauggacaucaucgacucccuccgcaagcacguccaccagaucgacgccguccuccucucccaccccgacccccuccaccucggcgcccuccccuacgccgucggcaagcucggccucaacugcgccaucuacgccaccauccccgucuacaagaugggccagauguucauguacgaccucuaccagucccgccacaacaccgaggacuucacccucuucacccucgacgacgucgacgccgccuucgacaagauccagcagcucaaguucucccagaucgucaaccucaagggcaagggccacggccucuccaucaccccccuccccgccggccacaugaucggcggcaccaucuggaagaucgucaaggacggcgaggaggagaucgucuacgccgucgacuucaaccacaagcgcgagauccaccucaacggcugcucccucgagaugcucucccgccccucccuccucaucaccgacuccuucaacgccaccuacguccagccccgccgcaagcagcgcgacgagcagcuccucaccaacguccucgagacccuccgcggcgacggcaacguccucaucgccgucgacaccgccggccgcguccucgagcucgcccagcuccucgaccagaucuggcgcaccaaggacgccggccucggcgucuacucccucgcccuccucaacaacgucuccuacaacgucgucgaguucuccaagucccaggucgaguggauguccgacaagcucaugcgcugcuucgaggacaagcgcaacaaccccuuccaguuccgccaccucucccucugccacggccucuccgaccucgcccgcguccccucccccaaggucguccucgccucccagcccgaccucgagugcggcuucucccgcgaccucuucauccaguggugccaggaccccaagaacuccaucauccucaccuaccgcaccacccccggcacccucgcccgcuuccucaucgacaaccccuccgagaagaucaccgagaucgagcuccgcaagcgcgucaagcucgagggcaaggagcucgaggaguaccucgagaaggagaagcucaagaaggaggccgccaagaagcucgagcaguccaaggaggccgacaucgacuccuccgacgaguccgacaucgaggaggacaucgaccagcccuccgcccacaagaccaagcacgaccucaugaugaagggcgagggcucccgcaagggcuccuucuucaagcaggccaagaaguccuaccccauguuccccgcccccgaggagcgcaucaagugggacgaguacggcgagaucaucaagcccgaggacuuccucguccccgagcuccaggccaccgaggaggagaaguccaagcucgaguccggccucaccaacggcgacgagcccauggaccaggaccucuccgacguccccaccaagugcaucuccaccaccgaguccaucgagaucaaggcccgcgucaccuacaucgacuacgagggccgcuccgacggcgacuccaucaagaagaucaucaaccagaugaagccccgccagcucaucaucguccacggcccccccgaggccucccaggaccucgccgagugcugccgcgccuucggcggcaaggacaucaaggucuacaugcccaagcuccacgagaccgucgacgccaccuccgagacccacaucuaccagguccgccucaaggacucccucgucuccucccuccaguucugcaaggccaaggacgccgagcucgccuggaucgacggcguccucgacaugcgcgucuccaaggucgacaccggcgucauccucgaggagggcgagcucaaggacgacggcgaggacuccgagaugcaggucgaggcccccuccgacuccuccgucaucgcccagcagaaggccaugaagucccucuucggcgacgacgagaaggagaccggcgaggaguccgagaucauccccacccucgagccccuccccccccacgagguccccggccaccaguccgucuucaugaacgagccccgccucuccgacuucaagcagguccuccuccgcgagggcauccaggccgaguucgucggcggcguccucgucugcaacaaccaggucgccguccgccgcaccgagaccggccgcaucggccucgagggcugccucugccaggacuucuaccgcauccgcgaccuccucuacgagcaguacgccaucgucuga

SEQ ID NO: 41710 - RNA, 2055 nt, Artificial Sequence
  derived and/or modified sequence opt2 from CPSF3__Homo_sapiens__NP_057291
auguccgccauccccgccgaggaguccgaccagcuccucauccgcccccucggcgccggccaggaggucggccgcuccugcaucauccucgaguucaagggccgcaagaucaugcucgacugcggcauccaccccggccucgagggcauggacgcccuccccuacaucgaccucaucgaccccgccgagaucgaccuccuccucaucucccacuuccaccucgaccacugcggcgcccuccccugguuccuccagaagaccuccuucaagggccgcaccuucaugacccacgccaccaaggccaucuaccgcuggcuccucuccgacuacgucaaggucuccaacaucuccgccgacgacaugcucuacaccgagaccgaccucgaggaguccauggacaagaucgagaccaucaacuuccacgaggucaaggaggucgccggcaucaaguucuggugcuaccacgccggccacguccucggcgccgccauguucaugaucgagaucgccggcgucaagcuccucuacaccggcgacuucucccgccaggaggaccgccaccucauggccgccgagauccccaacaucaagcccgacauccucaucaucgaguccaccuacggcacccacauccacgagaagcgcgaggagcgcgaggcccgcuucugcaacaccguccacgacaucgucaaccgcggcggccgcggccucauccccgucuucgcccucggccgcgcccaggagcuccuccucauccucgacgaguacuggcagaaccaccccgagcuccacgacauccccaucuacuacgccuccucccucgccaagaagugcauggccgucuaccagaccuacgucaacgccaugaacgacaagauccgcaagcagaucaacaucaacaaccccuucgucuucaagcacaucuccaaccucaaguccauggaccacuucgacgacaucggccccuccgucgucauggccucccccggcaugaugcaguccggccucucccgcgagcucuucgaguccuggugcaccgacaagcgcaacggcgucaucaucgccggcuacugcgucgagggcacccucgccaagcacaucauguccgagcccgaggagaucaccaccauguccggccagaagcucccccucaagauguccgucgacuacaucuccuucuccgcccacaccgacuaccagcagaccuccgaguucauccgcgcccucaagcccccccacgucauccucguccacggcgagcagaacgagauggcccgccucaaggccgcccucauccgcgaguacgaggacaacgacgagguccacaucgagguccacaacccccgcaacaccgaggccgucacccucaacuuccgcggcgagaagcucgccaaggucaugggcuuccucgccgacaagaagcccgagcagggccagcgcgucuccggcauccucgucaagcgcaacuucaacuaccacauccucucccccugcgaccucuccaacuacaccgaccucgccauguccaccgucaagcagacccaggccauccccuacaccggccccuucaaccuccucugcuaccagcuccagaagcucaccggcgacgucgaggagcucgagauccaggagaagcccgcccucaaggucuucaagaacaucaccgucauccaggagcccggcauggucguccucgaguggcucgccaaccccuccaacgacauguacgccgacaccgucaccaccgucauccucgagguccaguccaaccccaagauccgcaagggcgccguccagaaggucuccaagaagcucgagaugcacgucuacuccaagcgccucgagaucaugcuccaggacaucuucggcgaggacugcgucuccgucaaggacgacuccauccucuccgucaccgucgacggcaagaccgccaaccucaaccucgagacccgcaccgucgagugcgaggagggcuccgaggacgacgagucccuccgcgagauggucgagcucgccgcccagcgccucuacgaggcccucacccccguccacuga

SEQ ID NO: 41711 - RNA, 1983 nt, Artificial Sequence
  derived and/or modified sequence opt2 from CPSF3L__Homo_sapiens__XP_011539949
augcccgagauccgcgucaccccccucggcgccugccccguccucuccuggaaccucguccucccccccggccgcggcucccgcgcccccuccuccaccgacacccgcaccggcuuccacguccucccccacggcccccucggcugcggccccgucauccucaugugcggcgccggcuucggccacuucgaguggcucgccggcggcggcgccggccaggacgucggccgcuccugcauccucgucuccaucgccggcaagaacgucaugcucgacugcggcaugcacaugggcuucaacgacgaccgccgcuuccccgacuucuccuacaucacccagaacggccgccucaccgacuuccucgacugcgucaucaucucccacuuccaccucgaccacugcggcgcccuccccuacuucuccgagauggucggcuacgacggccccaucuacaugacccaccccacccaggccaucugccccauccuccucgaggacuaccgcaagaucgccgucgacaagaagggcgaggccaacuucuucaccucccagaugaucaaggacugcaugaagaaggucgucgccguccaccuccaccagaccguccaggucgacgacgagcucgagaucaaggccuacuacgccggccacguccucggcgccgccauguuccagaucaaggucggcuccgaguccgucgucuacaccggcgacuacaacaugacccccgaccgccaccucggcgccgccuggaucgacaagugccgccccaaccuccucaucaccgaguccaccuacgccaccaccauccgcgacuccaagcgcugccgcgagcgcgacuuccucaagaagguccacgagaccgucgagcgcggcggcaagguccucauccccgucuucgcccucggccgcgcccaggagcucugcauccuccucgagaccuucugggagcgcaugaaccucaagguccccaucuacuucuccaccggccucaccgagaaggccaaccacuacuacaagcucuucauccccuggaccaaccagaagauccgcaagaccuucguccagcgcaacauguucgaguucaagcacaucaaggccuucgaccgcgccuucgccgacaaccccggccccauggucgucuucgccacccccggcaugcuccacgccggccagucccuccagaucuuccgcaagugggccggcaacgagaagaacauggucaucaugcccggcuacugcguccagggcaccgucggccacaagauccucuccggccagcgcaagcucgagauggagggccgccagguccucgaggucaagaugcaggucgaguacauguccuucuccgcccacgccgacgccaagggcaucaugcagcucgucggccaggccgagcccgaguccguccuccucguccacggcgaggccaagaagauggaguuccucaagcagaagaucgagcaggagcuccgcgucaacugcuacaugcccgccaacggcgagaccgucacccuccccaccucccccuccauccccgucggcaucucccucggccuccucaagcgcgagauggcccagggccuccuccccgaggccaagaagccccgccuccuccacggcacccucaucaugaaggacuccaacuuccgccucgucuccuccgagcaggcccucaaggagcucggccucgccgagcaccagcuccgcuucaccugccgcguccaccuccacgacacccgcaaggagcaggagaccgcccuccgcgucuacucccaccucaaguccguccucaaggaccacugcguccagcaccuccccgacggcuccgucaccgucgaguccguccuccuccaggccgccgcccccuccgaggaccccggcaccaagguccuccucgucuccuggaccuaccaggacgaggagcucggcuccuuccucaccucccuccucaagaagggccucccccaggcccccuccuga

SEQ ID NO: 41712 - RNA, 735 nt, Artificial Sequence
  derived and/or modified sequence opt2 from CPSF4__Homo_sapiens__NP_001075028
augcaggagaucaucgccuccgucgaccacaucaaguucgaccucgagaucgccgucgagcagcagcucggcgcccagccccuccccuuccccggcauggacaaguccggcgccgccgucugcgaguucuuccucaaggccgccugcggcaagggcggcaugugccccuuccgccacaucuccggcgagaagaccgucgucugcaagcacuggcuccgcggccucugcaagaagggcgaccagugcgaguuccuccacgaguacgacaugaccaagaugcccgagugcuacuucuacuccaaguucggcgagugcuccaacaaggagugccccuuccuccacaucgaccccgaguccaagaucaaggacugccccugguacgaccgcggcuucugcaagcacggcccccucugccgccaccgccacacccgccgcgucaucugcgucaacuaccucgucggcuucugccccgagggccccuccugcaaguucaugcacccccgcuucgagcuccccaugggcaccaccgagcagcccccccucccccagcagacccagccccccgccaagcagcgcaccccccaggucaucggcgucaugcagucccagaacuccuccgccggcaaccgcggcccccgcccccucgagcaggucaccugcuacaagugcggcgagaagggccacuacgccaaccgcugcaccaagggccaccucgccuuccucuccggccaguga

SEQ ID NO: 41713 - RNA, 1767 nt, Artificial Sequence
  derived and/or modified sequence opt2 from CPSF6__Homo_sapiens__NP_001287876
auggccgacggcgucgaccacaucgacaucuacgccgacgucggcgaggaguucaaccaggaggccgaguacggcggccacgaccagaucgaccucuacgacgacgucaucucccccuccgccaacaacggcgacgcccccgaggaccgcgacuacauggacacccucccccccaccgucggcgacgacgucggcaagggcgccgcccccaacgucgucuacaccuacaccggcaagcgcaucgcccucuacaucggcaaccucaccugguggaccaccgacgaggaccucaccgaggccguccacucccucggcgucaacgacauccucgagaucaaguucuucgagaaccgcgccaacggccaguccaagggcuucgcccucgucggcgucggcuccgaggccuccuccaagaagcucauggaccuccuccccaagcgcgagcuccacggccagaaccccgucgucacccccugcaacaagcaguuccucucccaguucgagaugcagucccgcaagaccacccaguccggccagauguccggcgagggcaaggccggcccccccggcggcuccucccgcgccgccuucccccagggcggccgcggccgcggccgcuuccccggcgccguccccggcggcgaccgcuuccccggccccgccggccccggcggcccccccccccccuuccccggcaaccucaucaagcaccucgucaagggcacccgcccccucuuccucgagacccgcauccccuggcacaugggccacuccaucgaggagauccccaucuucggccucaaggccggccagacccccccccgccccccccucggcccccccggcccccccggcccccccggcccccccccccccggccagguccucccccccccccucgccggcccccccaaccgcggcgaccgcccccccccccccguccucuuccccggccagcccuucggccagcccccccucggcccccucccccccggcccccccccccccguccccggcuacggccccccccccggccccccccccccccagcagggccccccccccccccccggccccuuccccccccgcccccccggcccccucggccccccccucacccucgccccccccccccaccuccccggccccccccccggcgcccccccccccgccccccacgucaaccccgccuucuuccccccccccaccaacuccggcaugcccaccuccgacucccgcggccccccccccaccgaccccuacggccgccccccccccuacgaccgcggcgacuacggcccccccggccgcgagauggacaccgcccgcaccccccucuccgaggccgaguucgaggagaucaugaaccgcaaccgcgccaucuccuccuccgccaucucccgcgccgucuccgacgccuccgccggcgacuacggcuccgccaucgagacccucgucaccgccaucucccucaucaagcaguccaaggucuccgccgacgaccgcugcaagguccucaucuccucccuccaggacugccuccacggcaucgaguccaaguccuacggcuccggcucccgccgcgagcgcucccgcgagcgcgaccacucccgcucccgcgagaagucccgccgccacaagucccgcucccgcgaccgccacgacgacuacuaccgcgagcgcucccgcgagcgcgagcgccaccgcgaccgcgaccgcgaccgcgaccgcgagcgcgaccgcgagcgcgaguaccgccaccgcuga

SEQ ID NO: 41714 - RNA, 1416 nt, Artificial Sequence
  derived and/or modified sequence opt2 from CPSF7__Homo_sapiens__NP_001129512
auguccgagggcgucgaccucaucgacaucuacgccgacgaggaguucaaccaggaccccgaguucaacaacaccgaccagaucgaccucuacgacgacguccucaccgccaccucccagcccuccgacgaccgcuccuccuccaccgagccccccccccccguccgccaggagcccucccccaagcccaacaacaagacccccgccauccucuacaccuacuccggccuccgcaaccgccgcgccgccgucuacgucggcuccuucuccugguggaccaccgaccagcagcucauccaggucauccgcuccaucggcgucuacgacgucgucgagcucaaguucgccgagaaccgcgccaacggccaguccaagggcuacgccgaggucgucgucgccuccgagaacuccguccacaagcuccucgagcuccuccccggcaagguccucaacggcgagaaggucgacguccgccccgccacccgccagaaccucucccaguucgaggcccaggcccgcaagcgcgagugcguccgcgucccccgcggcggcauccccccccgcgcccacucccgcgacuccuccgacuccgccgacggccgcgccacccccuccgagaaccucguccccuccuccgcccgcgucgacaagccccccuccguccuccccuacuucaaccgcccccccuccgcccucccccucaugggccucccccccccccccaucccccccccccccccccucuccuccuccuucggcguccccccccccccccccggcauccacuaccagcaccucaugcccccccccccccgccuccccccccaccucgccguccccccccccggcgccaucccccccgcccuccaccucaaccccgccuucuuccccccccccaacgccaccgucggccccccccccgacaccuacaugaaggccuccgcccccuacaaccaccacggcucccgcgacuccggccccccccccuccaccgucuccgaggccgaguucgaggacaucaugaagcgcaaccgcgccaucuccuccuccgccaucuccaaggccgucuccggcgccuccgccggcgacuacuccgacgccaucgagacccuccucaccgccaucgccgucaucaagcagucccgcgucgccaacgacgagcgcugccgcguccucaucuccucccucaaggacugccuccacggcaucgaggccaaguccuacuccgucggcgccuccggcuccuccucccgcaagcgccaccgcucccgcgagcgcucccccucccgcucccgcgaguccucccgccgccaccgcgaccuccuccacaacgaggaccgccacgacgacuacuuccaggagcgcaaccgcgagcacgagcgccaccgcgaccgcgagcgcgaccgccaccacuga

SEQ ID NO: 41715 - RNA, 2418 nt, Artificial Sequence
  derived and/or modified sequence opt2 from CPT1A__Homo_sapiens__XP_005273819
augcagcaccucuccuccgaggcccucuccaccgagcucuccccccagcucggcaccgccggccucgaccuccccaccgagcgcuacucccucaagauggccgaggcccaccaggccgucgccuuccaguucaccgucacccccgacggcaucgaccuccgccucucccacgaggcccuccgccagaucuaccucuccggccuccacuccuggaagaagaaguucauccgcuucaagaacggcaucaucaccggcgucuaccccgccucccccuccuccuggcucaucgucgucgucggcgucaugaccaccauguacgccaagaucgaccccucccucggcaucaucgccaagaucaaccgcacccucgagaccgccaacugcauguccucccagaccaagaacgucgucuccggcguccucuucggcaccggccucugggucgcccucaucgucaccaugcgcuacucccucaagguccuccucuccuaccacggcuggauguucaccgagcacggcaagaugucccgcgccaccaagaucuggaugggcauggucaagaucuucuccggccgcaagcccaugcucuacuccuuccagaccucccucccccgccuccccguccccgccgucaaggacaccgucaaccgcuaccuccaguccguccgcccccucaugaaggaggaggacuucaagcgcaugaccgcccucgcccaggacuucgccgucggccucggcccccgccuccagugguaccucaagcucaaguccuggugggccaccaacuacgucuccgacuggugggaggaguacaucuaccuccgcggccgcggcccccucauggucaacuccaacuacuacgccauggaccuccucuacauccuccccacccacauccaggccgcccgcgccggcaacgccauccacgccauccuccucuaccgccgcaagcucgaccgcgaggagaucaagcccauccgccuccucggcuccaccaucccccucugcuccgcccagugggagcgcauguucaacaccucccgcauccccggcgaggagaccgacaccauccagcacaugcgcgacuccaagcacaucgucgucuaccaccgcggccgcuacuucaaggucuggcucuaccacgacggccgccuccucaagccccgcgagauggagcagcagaugcagcgcauccucgacaacaccuccgagccccagcccggcgaggcccgccucgccgcccucaccgccggcgaccgcguccccugggcccgcugccgccaggccuacuucggccgcggcaagaacaagcagucccucgacgccgucgagaaggccgccuucuucgucacccucgacgagaccgaggagggcuaccgcuccgaggaccccgacaccuccauggacuccuacgccaagucccuccuccacggccgcugcuacgaccgcugguucgacaaguccuucaccuucgucgucuucaagaacggcaagaugggccucaacgccgagcacuccugggccgacgcccccaucgucgcccaccucugggaguacgucauguccaucgacucccuccagcucggcuacgccgaggacggccacugcaagggcgacaucaaccccaacauccccuaccccacccgccuccagugggacauccccggcgagugccaggaggucaucgagaccucccucaacaccgccaaccuccucgccaacgacgucgacuuccacuccuuccccuucgucgccuucggcaagggcaucaucaagaagugccgcaccucccccgacgccuucguccagcucgcccuccagcucgcccacuacaaggacaugggcaaguucugccucaccuacgaggccuccaugacccgccucuuccgcgagggccgcaccgagaccguccgcuccugcaccaccgaguccugcgacuucguccgcgccauggucgaccccgcccagaccgucgagcagcgccucaagcucuucaagcucgccuccgagaagcaccagcacauguaccgccucgccaugaccggcuccggcaucgaccgccaccucuucugccucuacgucgucuccaaguaccucgccgucgagucccccuuccucaaggagguccucuccgagcccuggcgccucuccaccucccagaccccccagcagcaggucgagcucuucgaccucgagaacaaccccgaguacgucuccuccggcggcggcuucggccccgucgccgacgacggcuacggcgucuccuacauccucgucggcgagaaccucaucaacuuccacaucuccuccaaguucuccugccccgagaccgacucccaccgcuucggccgccaccucaaggaggccaugaccgacaucaucacccucuucggccucuccuccaacuccaagaaguga

SEQ ID NO: 41716 - RNA, 2217 nt, Artificial Sequence
  derived and/or modified sequence opt2 from CPT1B__Homo_sapiens__NP_001138606
auggccgaggcccaccaggccgucgccuuccaguucaccgucacccccgacggcgucgacuuccgccucucccgcgaggcccucaagcacgucuaccucuccggcaucaacuccuggaagaagcgccucauccgcaucaagaacggcauccuccgcggcgucuaccccggcucccccaccuccuggcucgucgucaucauggccaccgucggcuccuccuucugcaacgucgacaucucccucggccucgucuccugcauccagcgcugccucccccagggcugcggccccuaccagaccccccagacccgcgcccuccucuccauggccaucuucuccaccggcgucugggucaccggcaucuucuucuuccgccagacccucaagcuccuccucugcuaccacggcuggauguucgagaugcacggcaagaccuccaaccucacccgcaucugggccuaccucgaguccguccgcccccuccucgacgacgaggaguacuaccgcauggagcuccucgccaaggaguuccaggacaagaccgccccccgccuccagaaguaccucguccucaaguccuggugggccuccaacuacgucuccgacuggugggaggaguacaucuaccuccgcggccgcuccccccucauggucaacuccaacuacuacgucauggaccucguccucaucaagaacaccgacguccaggccgcccgccucggcaacaucauccacgccaugaucauguaccgccgcaagcucgaccgcgaggagaucaagcccgucauggcccucggcaucguccccaugugcuccuaccagauggagcgcauguucaacaccacccgcauccccggcaaggacaccgacguccuccagcaccucuccgacucccgccacgucgccgucuaccacaagggccgcuucuucaagcucuggcucuacgagggcgcccgccuccucaagccccaggaccucgagaugcaguuccagcgcauccucgacgaccccucccccccccagcccggcgaggagaagcucgccgcccucaccgccggcggccgcgucgagugggcccaggcccgccaggccuucuucuccuccggcaagaacaaggccgcccucgaggccaucgagcgcgccgccuucuucgucgcccucgacgaggaguccuacuccuacgaccccgaggacgaggccucccucucccucuacggcaaggcccuccuccacggcaacugcuacaaccgcugguucgacaaguccuucacccucaucuccuucaagaacggccagcucggccucaacgccgagcacgccugggccgacgcccccaucaucggccaccucugggaguucguccucggcaccgacuccuuccaccucggcuacaccgagaccggccacugccucggcaagcccaaccccgcccucgccccccccacccgccuccagugggacauccccaagcagugccaggccgucaucgaguccuccuaccaggucgccaaggcccucgccgacgacgucgagcucuacugcuuccaguuccuccccuucggcaagggccucaucaagaagugccgcaccucccccgacgccuucguccagaucgcccuccagcucgcccacuuccgcgaccgcggcaaguucugccucaccuacgaggccuccaugacccgcauguuccgcgagggccgcaccgagaccguccgcuccugcaccuccgaguccaccgccuucguccaggccaugauggagggcucccacaccaaggccgaccuccgcgaccucuuccagaaggccgccaagaagcaccagaacauguaccgccucgccaugaccggcgccggcaucgaccgccaccucuucugccucuaccucgucuccaaguaccucggcgucuccucccccuuccucgccgagguccucuccgagcccuggcgccucuccaccucccagaucccccagucccagauccgcauguucgaccccgagcagcaccccaaccaccucggcgccggcggcggcuucggccccgucgccgacgacggcuacggcgucuccuacaugaucgccggcgagaacaccaucuucuuccacaucuccuccaaguucuccuccuccgagaccaacgcccagcgcuucggcaaccacauccgcaaggcccuccucgacaucgccgaccucuuccagguccccaaggccuacuccuga

SEQ ID NO: 41717 - RNA, 2379 nt, Artificial Sequence
  derived and/or modified sequence opt2 from CPT1C__Homo_sapiens__NP_001129524
auggccgaggcccaccaggccgucggcuuccgccccucccucaccuccgacggcgccgaggucgagcucuccgcccccguccuccaggagaucuaccucuccggccuccgcuccuggaagcgccaccucucccgcuucuggaacgacuuccucaccggcgucuuccccgccuccccccucuccuggcucuuccucuucuccgccauccagcucgccugguuccuccagcucgaccccucccucggccucauggagaagaucaaggagcuccuccccgacuggggcggccagcaccacggccuccgcggcguccucgccgccgcccucuucgccuccugccucuggggcgcccucaucuucacccuccacgucgcccuccgccuccuccucuccuaccacggcuggcuccucgagccccacggcgccauguccucccccaccaagaccuggcucgcccucguccgcaucuucuccggccgccaccccaugcucuucuccuaccagcgcucccucccccgccagcccguccccuccguccaggacaccguccgcaaguaccucgaguccguccgccccauccucuccgacgaggacuucgacuggaccgccguccucgcccaggaguuccuccgccuccaggccucccuccuccagugguaccuccgccucaaguccuggugggccuccaacuacgucuccgacuggugggaggaguucgucuaccuccgcucccgcaacccccucauggucaacuccaacuacuacaugauggccgcccgcgccggcaacgccguccacgcccuccuccucuaccgccaccgccucaaccgccaggagaucccccccacccuccucaugggcaugcgcccccucugcuccgcccaguacgagaagaucuucaacaccacccgcauccccggcguccagaaggacuacauccgccaccuccacgacucccagcacgucgccgucuuccaccgcggccgcuucuuccgcaugggcacccacucccgcaacucccuccucuccccccgcgcccucgagcagcaguuccagcgcauccucgacgaccccucccccgccugcccccacgaggagcaccucgccgcccucaccgccgccccccgcggcaccugggcccagguccgcaccucccucaagacccaggccgccgaggcccucgaggccgucgagggcgccgccuucuucgucucccucgacgccgagcccgccggccucacccgcgaggaccccgccgccucccucgacgccuacgcccacgcccuccucgccggccgcggccacgaccgcugguucgacaaguccuucacccucaucgucuucuccaacggcaagcucggccucuccgucgagcacuccugggccgacugccccaucuccggccacaugugggaguucacccucgccaccgagugcuuccagcucggcuacuccaccgacggccacugcaagggccaccccgaccccacccucccccagccccagcgccuccagugggaccuccccgaccagauccacuccuccaucucccucgcccuccgcggcgccaagauccucuccgagaacgucgacugccacgucguccccuucucccucuucggcaaguccuucauccgccgcugccaccucuccuccgacuccuucauccagaucgcccuccagcucgcccacuuccgcgaccgcggccaguucugccucaccuacgaguccgccaugacccgccucuuccucgagggccgcaccgagaccguccgcuccugcacccgcgaggccugcaacuucguccgcgccauggaggacaaggagaagaccgacccccagugccucgcccucuuccgcgucgccgucgacaagcaccaggcccuccucaaggccgccauguccggccagggcgucgaccgccaccucuucgcccucuacaucgucucccgcuuccuccaccuccagucccccuuccucacccagguccacuccgagcaguggcagcucuccaccucccagauccccguccagcagaugcaccucuucgacguccacaacuaccccgacuacgucuccuccggcggcggcuucggccccgccgacgaccacggcuacggcgucuccuacaucuucaugggcgacggcaugaucaccuuccacaucuccuccaagaaguccuccaccaagaccgacucccaccgccucggccagcacaucgaggacgcccuccucgacgucgccucccucuuccaggccggccagcacuucaagcgccgcuuccgcggcuccggcaaggagaacucccgccaccgcugcggcuuccucucccgccagaccggcgccuccaaggccuccaugaccuccaccgacuucuga

SEQ ID NO: 41718 - RNA, 1431 nt, Artificial Sequence
  derived and/or modified sequence opt2 from CPVL__Homo_sapiens__XP_011513739
auggucggcgccauguggaaggucaucgucucccucguccuccucaugcccggccccugcgacggccucuuccgcucccucuaccgcuccgucuccaugccccccaagggcgacuccggccagccccucuuccucacccccuacaucgaggccggcaagauccagaagggccgcgagcucucccucgucggccccuuccccggccucaacaugaaguccuacgccggcuuccucaccgucaacaagaccuacaacuccaaccucuucuucugguucuuccccgcccagauccagcccgaggacgcccccgucguccucuggcuccagggcggccccggcggcuccuccauguucggccucuucgucgagcacggccccuacgucgucaccuccaacaugacccuccgcgaccgcgacuuccccuggaccaccacccucuccaugcucuacaucgacaaccccgucggcaccggcuucuccuucaccgacgacacccacggcuacgccgucaacgaggacgacgucgcccgcgaccucuacuccgcccucauccaguucuuccagaucuuccccgaguacaagaacaacgacuucuacgucaccggcgaguccuacgccggcaaguacguccccgccaucgcccaccucauccacucccucaaccccguccgcgaggucaagaucaaccucaacggcaucgccaucggcgacggcuacuccgaccccgaguccaucaucggcggcuacgccgaguuccucuaccagaucggccuccucgacgagaagcagaagaaguacuuccagaagcagugccacgagugcaucgagcacauccgcaagcagaacugguucgaggccuucgagauccucgacaagcuccucgacggcgaccucaccuccgaccccuccuacuuccagaacgucaccggcugcuccaacuacuacaacuuccuccgcugcaccgagcccgaggaccagcucuacuacgucaaguuccucucccuccccgagguccgccaggccauccacgucggcaaccagaccuucaacgacggcaccaucgucgagaaguaccuccgcgaggacaccguccaguccgucaagcccuggcucaccgagaucaugaacaacuacaagguccucaucuacaacggccagcucgacaucaucgucgccgccgcccucaccgagcgcucccucaugggcauggacuggaagggcucccaggaguacaagaaggccgagaagaaggucuggaagaucuucaaguccgacuccgaggucgccggcuacauccgccaggccggcgacuuccaccaggucaucauccgcggcggcggccacauccuccccuacgaccagccccuccgcgccuucgacaugaucaaccgcuucaucuacggcaagggcugggaccccuacgucggcuga

SEQ ID NO: 41719 - RNA, 906 nt, Artificial Sequence
  derived and/or modified sequence opt2 from CPXCR1__Homo_sapiens__NP_001171700
auguccucccccaccaaggagggcuccgacaccgccggcaacgcccacaagaacuccgagaacgagccccccaacgacugcuccaccgacaucgagucccccuccgccgaccccaacaugaucuaccaggucgagaccaaccccaucaaccgcgagcccggcaccgccaccucccaggaggacgucgucccccaggccgccgagaacuccgagcucgagaccgagauccagaaggaccagcgcgaggaggaccucaaggaggagcuccuccuccuccagacccccaucccccgcaagcucgucucccacaagccccucaacgaccgcucccgcucccacuccggcaaggucgagaugaaggccaacaacuuccccaucaaccacaagacccgcuuccgccucuccaccuccuggcgcguccccuucaucaacucccacgagauccgcuccaugauccuccaccuccucugcgaccgcuacuucucccaggccgccggcugccagaacaccaugugggucaagcgcaaguacaucgccugccucuaccaccccaacuccuucacccaccacgagcgcgccaucaccuuccgccgccccucccgcguccacuacuaccgcccccucaccgagcgcaugaccuccggcaaguucugcaaguccaccgacaccaagggcaagugccgcuuccgcgccaucguccgcuccguccucuucgucucccagauccagaucgaguccaucuucaacaucaagggcuucgucgacauccucaccuacauccacaccaugaacgucaugaucaccaacaccaacaacggcuggaaguacuucugccccaucugcggccgccucuucaacaccuacuccgagcuccgccagcacuccugcuccuccuccggcaacuga

SEQ ID NO: 41720 - RNA, 1959 nt, Artificial Sequence
  derived and/or modified sequence opt2 from CPZ__Homo_sapiens__NP_001014447
augccccccccccccccccuccuccuccucaccguccucgucgucgccgccgcccgccccggcugcgaguucgagcgcaaccccgccggcgagugccaccgcccccccgccgccgacuccgccaccugcgucgaccuccagcuccgcaccugcuccgacgccgccuacaaccacaccaccuuccccaaccuccuccagcaccgcuccugggaggucgucgaggccuccuccgaguacauccuccucuccguccuccaccagcuccucgagggccagugcaaccccgaccuccgccuccucggcugcgccguccucgccccccgcugcgagggcggcuggguccgccgccccugccgccacaucugcgagggccuccgcgaggucugccagcccgccuucgacgccaucgacauggccuggcccuacuuccucgacugccaccgcuacuucacccgcgaggacgagggcugcuacgacccccucgagaagcuccgcggcggccucgaggccgacgaggcccuccccuccggccucccccccaccuucauccgcuucucccaccacuccuacgcccagaugguccgcguccuccgccgcaccgccucccgcugcgcccacgucgcccgcaccuacuccaucggccgcuccuucgacggccgcgagcuccucgucaucgaguucuccucccgccccggccagcacgagcucauggagcccgaggucaagcucaucggcaacauccacggcaacgaggucgccggccgcgagaugcucaucuaccucgcccaguaccucugcuccgaguaccuccucggcaacccccgcauccagcgccuccucaacaccacccgcauccaccuccuccccuccaugaaccccgacggcuacgaggucgccgccgccgagggcgccggcuacaacggcuggaccuccggccgccagaacgcccagaaccucgaccucaaccgcaacuuccccgaccucaccuccgaguacuaccgccucgccgagacccgcggcgcccgcuccgaccacauccccaucccccagcacuacugguggggcaaggucgcccccgagaccaaggccaucaugaaguggaugcagaccauccccuucguccucuccgccucccuccacggcggcgaccucgucgucuccuaccccuucgacuucuccaagcacccccaggaggagaagauguucucccccacccccgacgagaagauguucaagcuccucucccgcgccuacgccgacguccaccccaugaugauggaccgcuccgagaaccgcugcggcggcaacuuccucaagcgcggcuccaucaucaacggcgccgacugguacuccuucaccggcggcauguccgacuucaacuaccuccacaccaacugcuucgagaucaccgucgagcucggcugcgucaaguucccccccgaggaggcccucuacacccucuggcagcacaacaaggagucccuccucaacuucgucgagaccguccaccgcggcaucaagggcgucgucaccgacaaguucggcaagcccgucaagaacgcccgcaucuccgucaagggcauccgccacgacaucaccaccgcccccgacggcgacuacuggcgccuccucccccccggcauccacaucgucaucgcccaggcccccggcuacgccaaggucaucaagaaggucaucauccccgcccgcaugaagcgcgccggccgcgucgacuucauccuccagccccucggcaugggccccaagaacuucauccacggccuccgccgcaccggcccccacgacccccucggcggcgccuccucccucggcgaggccaccgagcccgacccccuccgcgcccgccgccagcccuccgccgacggcuccaagcccugguggugguccuacuucaccucccucuccacccaccgcccccgcuggcuccucaaguacuga

SEQ ID NO: 41721 - RNA, 6120 nt, Artificial Sequence
  derived and/or modified sequence opt2 from CR1__Homo_sapiens__NP_000564
augggcgccuccuccccccgcucccccgagcccgucggcccccccgcccccggccuccccuucugcugcggcggcucccuccucgccgucgucguccuccucgcccuccccgucgccuggggccagugcaacgcccccgaguggcuccccuucgcccgccccaccaaccucaccgacgaguucgaguuccccaucggcaccuaccucaacuacgagugccgccccggcuacuccggccgccccuucuccaucaucugccucaagaacuccgucuggaccggcgccaaggaccgcugccgccgcaaguccugccgcaacccccccgaccccgucaacggcaugguccacgucaucaagggcauccaguucggcucccagaucaaguacuccugcaccaagggcuaccgccucaucggcuccuccuccgccaccugcaucaucuccggcgacaccgucaucugggacaacgagacccccaucugcgaccgcauccccugcggccucccccccaccaucaccaacggcgacuucaucuccaccaaccgcgagaacuuccacuacggcuccgucgucaccuaccgcugcaaccccggcuccggcggccgcaaggucuucgagcucgucggcgagcccuccaucuacugcaccuccaacgacgaccaggucggcaucugguccggccccgccccccagugcaucauccccaacaagugcaccccccccaacgucgagaacggcauccucgucuccgacaaccgcucccucuucucccucaacgaggucgucgaguuccgcugccagcccggcuucgucaugaagggcccccgccgcgucaagugccaggcccucaacaagugggagcccgagcuccccuccugcucccgcgucugccagcccccccccgacguccuccacgccgagcgcacccagcgcgacaaggacaacuucucccccggccaggaggucuucuacuccugcgagcccggcuacgaccuccgcggcgccgccuccaugcgcugcaccccccagggcgacuggucccccgccgcccccaccugcgaggucaaguccugcgacgacuucaugggccagcuccucaacggccgcguccucuuccccgucaaccuccagcucggcgccaaggucgacuucgucugcgacgagggcuuccagcucaagggcuccuccgccuccuacugcguccucgccggcauggagucccucuggaacuccuccguccccgucugcgagcagaucuucugccccuccccccccgucauccccaacggccgccacaccggcaagccccucgaggucuuccccuucggcaagaccgucaacuacaccugcgacccccaccccgaccgcggcaccuccuucgaccucaucggcgaguccaccauccgcugcaccuccgacccccagggcaacggcgucugguccucccccgccccccgcugcggcauccucggccacugccaggcccccgaccacuuccucuucgccaagcucaagacccagaccaacgccuccgacuuccccaucggcaccucccucaaguacgagugccgccccgaguacuacggccgccccuucuccaucaccugccucgacaaccucgucugguccucccccaaggacgucugcaagcgcaaguccugcaagaccccccccgaccccgucaacggcaugguccacgucaucaccgacauccaggucggcucccgcaucaacuacuccugcaccaccggccaccgccucaucggccacuccuccgccgagugcauccucuccggcaacgccgcccacugguccaccaagccccccaucugccagcgcauccccugcggccucccccccaccaucgccaacggcgacuucaucuccaccaaccgcgagaacuuccacuacggcuccgucgucaccuaccgcugcaaccccggcuccggcggccgcaaggucuucgagcucgucggcgagcccuccaucuacugcaccuccaacgacgaccaggucggcaucugguccggccccgccccccagugcaucauccccaacaagugcaccccccccaacgucgagaacggcauccucgucuccgacaaccgcucccucuucucccucaacgaggucgucgaguuccgcugccagcccggcuucgucaugaagggcccccgccgcgucaagugccaggcccucaacaagugggagcccgagcuccccuccugcucccgcgucugccagcccccccccgacguccuccacgccgagcgcacccagcgcgacaaggacaacuucucccccggccaggaggucuucuacuccugcgagcccggcuacgaccuccgcggcgccgccuccaugcgcugcaccccccagggcgacuggucccccgccgcccccaccugcgaggucaaguccugcgacgacuucaugggccagcuccucaacggccgcguccucuuccccgucaaccuccagcucggcgccaaggucgacuucgucugcgacgagggcuuccagcucaagggcuccuccgccuccuacugcguccucgccggcauggagucccucuggaacuccuccguccccgucugcgagcagaucuucugccccuccccccccgucauccccaacggccgccacaccggcaagccccucgaggucuuccccuucggcaaggccgucaacuacaccugcgacccccaccccgaccgcggcaccuccuucgaccucaucggcgaguccaccauccgcugcaccuccgacccccagggcaacggcgucugguccucccccgccccccgcugcggcauccucggccacugccaggcccccgaccacuuccucuucgccaagcucaagacccagaccaacgccuccgacuuccccaucggcaccucccucaaguacgagugccgccccgaguacuacggccgccccuucuccaucaccugccucgacaaccucgucugguccucccccaaggacgucugcaagcgcaaguccugcaagaccccccccgaccccgucaacggcaugguccacgucaucaccgacauccaggucggcucccgcaucaacuacuccugcaccaccggccaccgccucaucggccacuccuccgccgagugcauccucuccggcaacaccgcccacugguccaccaagccccccaucugccagcgcauccccugcggccucccccccaccaucgccaacggcgacuucaucuccaccaaccgcgagaacuuccacuacggcuccgucgucaccuaccgcugcaaccucggcucccgcggccgcaaggucuucgagcucgucggcgagcccuccaucuacugcaccuccaacgacgaccaggucggcaucugguccggccccgccccccagugcaucauccccaacaagugcaccccccccaacgucgagaacggcauccucgucuccgacaaccgcucccucuucucccucaacgaggucgucgaguuccgcugccagcccggcuucgucaugaagggcccccgccgcgucaagugccaggcccucaacaagugggagcccgagcuccccuccugcucccgcgucugccagcccccccccgagauccuccacggcgagcacacccccucccaccaggacaacuucucccccggccaggaggucuucuacuccugcgagcccggcuacgaccuccgcggcgccgccucccuccacugcaccccccagggcgacuggucccccgaggccccccgcugcgccgucaaguccugcgacgacuuccucggccagcucccccacggccgcguccucuucccccucaaccuccagcucggcgccaaggucuccuucgucugcgacgagggcuuccgccucaagggcuccuccgucucccacugcguccucgucggcaugcgcucccucuggaacaacuccguccccgucugcgagcacaucuucugccccaacccccccgccauccucaacggccgccacaccggcacccccuccggcgacauccccuacggcaaggagaucuccuacaccugcgacccccaccccgaccgcggcaugaccuucaaccucaucggcgaguccaccauccgcugcaccuccgacccccacggcaacggcgucugguccucccccgccccccgcugcgagcucuccguccgcgccggccacugcaagacccccgagcaguuccccuucgccucccccaccauccccaucaacgacuucgaguuccccgucggcaccucccucaacuacgagugccgccccggcuacuucggcaagauguucuccaucuccugccucgagaaccucgucugguccuccgucgaggacaacugccgccgcaaguccugcggccccccccccgagcccuucaacggcaugguccacaucaacaccgacacccaguucggcuccaccgucaacuacuccugcaacgagggcuuccgccucaucggcucccccuccaccaccugccucgucuccggcaacaacgucaccugggacaagaaggcccccaucugcgagaucaucuccugcgagcccccccccaccaucuccaacggcgacuucuacuccaacaaccgcaccuccuuccacaacggcaccgucgucaccuaccagugccacaccggccccgacggcgagcagcucuucgagcucgucggcgagcgcuccaucuacugcaccuccaaggacgaccaggucggcgucugguccuccccccccccccgcugcaucuccaccaacaagugcaccgcccccgaggucgagaacgccauccgcguccccggcaaccgcuccuucuucacccucaccgagaucauccgcuuccgcugccagcccggcuucgucauggucggcucccacaccguccagugccagaccaacggccgcuggggccccaagcucccccacugcucccgcgucugccagcccccccccgagauccuccacggcgagcacacccucucccaccaggacaacuucucccccggccaggaggucuucuacuccugcgagcccuccuacgaccuccgcggcgccgccucccuccacugcaccccccagggcgacuggucccccgaggccccccgcugcaccgucaaguccugcgacgacuuccucggccagcucccccacggccgcguccuccucccccucaaccuccagcucggcgccaaggucuccuucgucugcgacgagggcuuccgccucaagggccgcuccgccucccacugcguccucgccggcaugaaggcccucuggaacuccuccguccccgucugcgagcagaucuucugccccaacccccccgccauccucaacggccgccacaccggcacccccuucggcgacauccccuacggcaaggagaucuccuacgccugcgacacccaccccgaccgcggcaugaccuucaaccucaucggcgaguccuccauccgcugcaccuccgacccccagggcaacggcgucugguccucccccgccccccgcugcgagcucuccguccccgccgccugcccccacccccccaagauccagaacggccacuacaucggcggccacgucucccucuaccuccccggcaugaccaucuccuacaucugcgaccccggcuaccuccucgucggcaagggcuucaucuucugcaccgaccagggcaucuggucccagcucgaccacuacugcaaggaggucaacugcuccuucccccucuucaugaacggcaucuccaaggagcucgagaugaagaaggucuaccacuacggcgacuacgucacccucaagugcgaggacggcuacacccucgagggcucccccuggucccagugccaggccgacgaccgcugggaccccccccucgccaagugcaccucccgcacccacgacgcccucaucgucggcacccucuccggcaccaucuucuucauccuccucaucaucuuccucuccuggaucauccucaagcaccgcaagggcaacaacgcccacgagaaccccaaggaggucgccauccaccuccacucccagggcggcuccuccguccacccccgcacccuccagaccaacgaggagaacucccgcguccuccccuga

SEQ ID NO: 41722 - RNA, 3279 nt, Artificial Sequence
  derived and/or modified sequence opt2 from CR2__Homo_sapiens__NP_001006659
augggcgccgccggccuccucggcgucuuccucgcccucgucgcccccggcguccucggcaucuccugcggcucccccccccccauccucaacggccgcaucuccuacuacuccacccccaucgccgucggcaccgucauccgcuacuccugcuccggcaccuuccgccucaucggcgagaagucccuccucugcaucaccaaggacaaggucgacggcaccugggacaagcccgcccccaagugcgaguacuucaacaaguacuccuccugccccgagcccaucguccccggcggcuacaagauccgcggcuccacccccuaccgccacggcgacuccgucaccuucgccugcaagaccaacuucuccaugaacggcaacaaguccgucuggugccaggccaacaacauguggggccccacccgccuccccaccugcgucuccgucuucccccucgagugccccgcccuccccaugauccacaacggccaccacaccuccgagaacgucggcuccaucgcccccggccucuccgucaccuacuccugcgaguccggcuaccuccucgucggcgagaagaucaucaacugccucuccuccggcaagugguccgccgucccccccaccugcgaggaggcccgcugcaagucccucggccgcuuccccaacggcaaggucaaggagccccccauccuccgcgucggcgucaccgccaacuucuucugcgacgagggcuaccgccuccagggcccccccuccucccgcugcgucaucgccggccagggcgucgccuggaccaagaugcccgucugcgaggagaucuucugccccucccccccccccauccucaacggccgccacaucggcaacucccucgccaacgucuccuacggcuccaucgucaccuacaccugcgaccccgaccccgaggagggcgucaacuucauccucaucggcgaguccacccuccgcugcaccgucgacucccagaagaccggcaccugguccggccccgccccccgcugcgagcucuccaccuccgccguccagugcccccacccccagauccuccgcggccgcauggucuccggccagaaggaccgcuacaccuacaacgacaccgucaucuucgccugcauguucggcuucacccucaagggcuccaagcagauccgcugcaacgcccagggcaccugggagcccuccgcccccgucugcgagaaggagugccaggccccccccaacauccucaacggccagaaggaggaccgccacaugguccgcuucgaccccggcaccuccaucaaguacuccugcaaccccggcuacguccucgucggcgaggaguccauccagugcaccuccgagggcgucuggaccccccccgucccccagugcaaggucgccgccugcgaggccaccggccgccagcuccucaccaagccccagcaccaguucguccgccccgacgucaacuccuccugcggcgagggcuacaagcucuccggcuccgucuaccaggagugccagggcaccauccccugguucauggagauccgccucugcaaggagaucaccugcccccccccccccgucaucuacaacggcgcccacaccggcuccucccucgaggacuuccccuacggcaccaccgucaccuacaccugcaaccccggccccgagcgcggcgucgaguucucccucaucggcgaguccaccauccgcugcaccuccaacgaccaggagcgcggcaccugguccggccccgccccccucugcaagcucucccuccucgccguccagugcucccacguccacaucgccaacggcuacaagaucuccggcaaggaggcccccuacuucuacaacgacaccgucaccuucaagugcuacuccggcuucacccucaagggcuccucccagauccgcugcaaggccgacaacaccugggaccccgagauccccgucugcgagaagggcugccaguccccccccggccuccaccacggccgccacaccggcggcaacaccgucuucuucgucuccggcaugaccgucgacuacaccugcgaccccggcuaccuccucgucggcaacaaguccauccacugcaugcccuccggcaacuggucccccuccgccccccgcugcgaggagaccugccagcacguccgccagucccuccaggagcuccccgccggcucccgcgucgagcucgucaacaccuccugccaggacggcuaccagcucaccggccacgccuaccagaugugccaggacgccgagaacggcaucugguucaagaagaucccccucugcaaggucauccacugccaccccccccccgucaucgucaacggcaagcacaccggcaugauggccgagaacuuccucuacggcaacgaggucuccuacgagugcgaccagggcuucuaccuccucggcgagaagaagcuccagugccgcuccgacuccaagggccacggcuccugguccggccccuccccccagugccuccgcuccccccccgucacccgcugccccaaccccgaggucaagcacggcuacaagcucaacaagacccacuccgccuacucccacaacgacaucgucuacgucgacugcaaccccggcuucaucaugaacggcucccgcgucauccgcugccacaccgacaacaccuggguccccggcguccccaccugcaucaagaaggccuucaucggcugcccccccccccccaagacccccaacggcaaccacaccggcggcaacaucgcccgcuucucccccggcauguccauccucuacuccugcgaccagggcuaccuccucgucggcgaggcccuccuccucugcacccacgagggcaccuggucccagcccgccccccacugcaaggaggucaacugcuccucccccgccgacauggacggcauccagaagggccucgagccccgcaagauguaccaguacggcgccgucgucacccucgagugcgaggacggcuacaugcucgagggcuccccccagucccagugccaguccgaccaccaguggaaccccccccucgccgucugccgcucccgcucccucgcccccguccucugcggcaucgccgccggccucauccuccucaccuuccucaucgucaucacccucuacgucaucuccaagcaccgcgcccgcaacuacuacaccgacaccucccagaaggaggccuuccaccucgaggcccgcgaggucuacuccgucgaccccuacaaccccgccuccuga

SEQ ID NO: 41723 - RNA, 414 nt, Artificial Sequence
  derived and/or modified sequence opt2 from CRABP1__Homo_sapiens__NP_004369
augcccaacuucgccggcaccuggaagaugcgcuccuccgagaacuucgacgagcuccucaaggcccucggcgucaacgccaugcuccgcaaggucgccgucgccgccgccuccaagccccacgucgagauccgccaggacggcgaccaguucuacaucaagaccuccaccaccguccgcaccaccgagaucaacuucaaggucggcgagggcuucgaggaggagaccgucgacggccgcaagugccgcucccucgccaccugggagaacgagaacaagauccacugcacccagacccuccucgagggcgacggccccaagaccuacuggacccgcgagcucgccaacgacgagcucauccucaccuucggcgccgacgacgucgucugcacccgcaucuacguccgcgaguga

SEQ ID NO: 41724 - RNA, 417 nt, Artificial Sequence
  derived and/or modified sequence opt2 from CRABP2__Homo_sapiens__NP_001186652
augcccaacuucuccggcaacuggaagaucauccgcuccgagaacuucgaggagcuccucaagguccucggcgucaacgucaugcuccgcaagaucgccgucgccgccgccuccaagcccgccgucgagaucaagcaggagggcgacaccuucuacaucaagaccuccaccaccguccgcaccaccgagaucaacuucaaggucggcgaggaguucgaggagcagaccgucgacggccgccccugcaagucccucgucaagugggaguccgagaacaagauggucugcgagcagaagcuccucaagggcgagggccccaagaccuccuggacccgcgagcucaccaacgacggcgagcucauccucaccaugaccgccgacgacgucgucugcacccgcgucuacguccgcgaguga

SEQ ID NO: 41725 - RNA, 2196 nt, Artificial Sequence
  derived and/or modified sequence opt2 from CRACR2A__Homo_sapiens__NP_001138430
auggccgcccccgacggccgcgucgucucccgcccccagcgccucggccagggcuccggccagggccccaagggcuccggcgccugccuccacccccucgacucccucgagcagaaggagacccaggagcagaccuccggccagcucgucaugcuccgcaaggcccaggaguucuuccagaccugcgacgccgagggcaagggcuucaucgcccgcaaggacaugcagcgccuccacaaggagcucccccucucccucgaggagcucgaggacgucuucgacgcccucgacgccgacggcaacggcuaccucaccccccaggaguucaccaccggcuucucccacuucuucuucucccagaacaaccccucccaggaggacgccggcgagcaggucgcccagcgccacgaggagaaggucuaccucucccgcggcgacgaggaccucggcgacaugggcgaggacgaggaggcccaguuccgcaugcucauggaccgccucggcgcccagaagguccucgaggacgaguccgacgucaagcagcucuggcuccagcucaagaaggaggagccccaccuccucuccaacuucgaggacuuccucacccgcaucaucucccagcuccaggaggcccacgaggagaagaacgagcucgagugcgcccucaagcgcaagaucgccgccuacgacgaggagauccagcaccucuacgaggagauggagcagcagaucaaguccgagaaggagcaguuccuccucaaggacaccgagcgcuuccaggcccgcucccaggagcucgagcagaagcuccucugcaaggagcaggagcucgagcagcucacccagaagcagaagcgccucgagggccagugcaccgcccuccaccacgacaagcacgagaccaaggccgagaacaccaagcucaagcucaccaaccaggagcucgcccgcgagcucgagcgcaccuccugggagcuccaggacgcccagcagcagcucgagucccuccagcaggaggccugcaagcuccaccaggagaaggagauggaggucuaccgcgucaccgagucccuccagcgcgagaaggccggccuccucaagcagcucgacuuccuccgcgagcgcaacaagcaccuccgcgacgagcgcgacaucugcuuccagaagaacaaggccgccaaggccaacaccgccgccucccgcgccuccuggaagaagcgcuccggcuccgucaucggcaaguacgucgacucccgcggcauccuccgcucccaguccgaggaggaggaggaggucuucggcaucccccgccgcuccucccucggccucuccggcuacccccucaccgaggaggagcccggcaccggcgagcccggccccggcggccccuacccccgcccccuccgccgcaucaucuccgucgaggaggacccccucccccagcuccucgacggcggcuucgagcagccccucuccaagugcuccgaggaggaggaggucuccgaccagggcguccagggccagauccccgaggcccccccccucaagcucacccccaccuccccccgcggccagcccgucggcaaggaggcccucugcaaggaggaguccucccccuccgcccccgaccgccucuucaagaucgucuucgucggcaacuccgccgucggcaagaccuccuuccuccgccgcuucugcgaggaccgcuucucccccggcauggccgccaccgucggcaucgacuaccgcgucaagacccucaacgucgacaacucccaggucgcccuccagcucugggacaccgccggccaggagcgcuaccgcugcaucacccagcaguucuuccgcaaggccgacggcgucaucgucauguacgaccucaccgacaagcaguccuuccucuccguccgccgcuggcucuccuccgucgaggaggccgucggcgaccgcguccccguccuccuccucggcaacaagcucgacaacgagaaggagcgcgaggucccccgcggccucggcgagcagcucgccaccgagaacaaccucaucuucuacgagugcuccgccuacuccggccacaacaccaaggagucccuccuccaccucgcccgcuuccucaaggagcaggaggacaccguccgcgaggacaccauccaggucggccaccccgccaagaagaaguccugcugcggcuga

SEQ ID NO: 41726 - RNA, 600 nt, Artificial Sequence
  derived and/or modified sequence opt2 from CRADD__Homo_sapiens__NP_003796
auggaggcccgcgacaagcagguccuccgcucccuccgccucgagcucggcgccgagguccucgucgagggccucguccuccaguaccucuaccaggagggcauccucaccgagaaccacauccaggagaucaacgcccagaccaccggccuccgcaagaccaugcuccuccucgacauccuccccucccgcggccccaaggccuucgacaccuuccucgacucccuccaggaguuccccuggguccgcgagaagcucaagaaggcccgcgaggaggccaugaccgaccuccccgccggcgaccgccucaccggcauccccucccacauccucaacuccucccccuccgaccgccagaucaaccagcucgcccagcgccucggccccgagugggagcccaugguccucucccucggccucucccagaccgacaucuaccgcugcaaggccaaccacccccacaacguccagucccaggucgucgaggccuucauccgcuggcgccagcgcuucggcaagcaggccaccuuccagucccuccacaacggccuccgcgccgucgaggucgaccccucccuccuccuccacaugcucgaguga

SEQ ID NO: 41727 - RNA, 3810 nt, Artificial Sequence
  derived and/or modified sequence opt2 from CRAMP1L__Homo_sapiens__NP_065876
augaccgucaagcucggcgacggcggcuccggcgaggacggccucaagaagcucggcaagcgcgccgccgacgaggagucccucgagggcgagggcgccggcggcgccgacgccgccgaggaguccuccggcaccaagcgcgacgagaagaccccccgcgccggcgccgacggcccccccgccccccccggcgccccccaggcccccucccccccccagggcuccccccaggaccagcaccacuuccuccgcuccuccguccgcccccaguccaagcgcccccgcaaggacccccccuccgccgucggcuccggcaacgccggcggcuccggcccccgcggcaagggcgccgagggcggcggcuccuccuccggcaacgucuccggcgucgcccccgccgcccccgccggcggcucccgcuccuccucccgcaaccucggcuccuccggcggcgagaaggaggagggcaagaagguccgccgccagugggaguccugguccaccgaggacaagaacaccuucuucgagggccucuacgagcacggcaaggacuucgaggccauccagaacaacaucgcccucaaguacaagaagaagggcaagcccgccuccauggucaagaacaaggagcagguccgccacuucuacuaccgcaccuggcacaagaucaccaaguacaucgacuucgaccacgucuucucccgcggccucaagaaguccucccaggagcucuacggccucaucugcuacggcgagcuccgcaagaagaucggcggcugcauggacgacaagaacgccaccaagcucaacgagcucauccaggucggcgccaccaccguccgcuacaagggccgcaaccuccgcaucaaggcccccaugugccgcgcccucaagaagcucugcgaccccgacggccucuccgacgaggaggaccagaagcccguccgccucccccucaagguccccaucgagcuccagccccgcaacaaccacgccugggcccgcguccagucccucgcccagaacccccgccuccgcaugaucgucgagcuccaccgcaaggucuccucccucaucgaguuccucaagcagaagugggcccuccacgagguccgcguccgcaagacccucgaggagcgccagcuccaggacuccugcuccgcccccaugcaggagaaggucacccuccaccucuuccccggcgagaacugcacccucaccccccuccccggcgucgcccgcgucguccacuccaaggccuucugcaccguccacuggcaggagggcggccgcugcaagcaguccgccaaggacgcccacguccucccccccgcccagauccucggcauccaguccggccagggcaccgcccgcggccaggucaagugcccccgcuccggcgccgagggcaagggcgucggccgccccccccccgccgccgacgcccuccaguccuccggcgaguccucccccgaguccgcccccggcgagggcgccgcccucucccucuccucccccgacgcccccgaccgcccccccccccgccaccaggacaccggccccugccucgagaagacccccgccgagggccgcgacucccccacccgcgagcccggcgcccuccccugcgccugcggccagcuccccgaccucgaggacgagcucucccuccucgacccccucccccgcuaccucaaguccugccaggaccucaucguccccgagcagugccgcugcgccgacacccgccccggcuccgagcagcccccccucggcggcgccgccucccccgagguccucgcccccgucuccaaggaggccgccgaccucgcccccaccggccccuccccccgccccggccccggccuccuccucgacgucugcaccaaggaccucgccgacgcccccgccgaggagcuccaggagaagggcucccccgccggccccccccccucccagggccagcccgccgcccgcccccccaaggagguccccgccucccgccucgcccagcagcuccgcgaggagggcuggaaccuccagaccuccgagucccucacccucgccgaggucuaccucaugaugggcaagcccuccaagcuccagcucgaguacgacuggcucggccccggccgccaggacccccgccccggcucccuccccaccgcccuccacaagcagcgccuccucuccugccuccucaagcucaucuccaccgaggucaaccccaagcucgcccucgaggccaacaccaucuccaccgccuccguccgccccgcccaggaggagcaguccaugaccccccccggcaaggucgucaccgucuccucccgcuccccccgcugcccccgcaaccaggccucccuccgcuccuccaagaccuucccccccuccuccgcccccugcuccuccggccuccgcaaccccccccgcccccuccucguccccggccccuccuccaccggcuccaacgacuccgacggcggccucuucgccguccccaccacccucccccccaacucccgccacggcaagcucuucucccccuccaaggaggccgagcucaccuuccgccagcaccucaacuccaucuccaugcaguccgacuucuuccuccccaagccccgcaagcuccgcaaccgccaccuccgcaagccccucgucguccagcgcacccuccucccccgccccuccgagaaccagucccacaacgucugcuccuucuccauccucuccaacuccuccgucaccggccgcggcuccuuccgccccauccaguccucccucaccaaggccgcccucucccgccccaucguccccaagguccuccccccccaggccaccucccaccucgccuccgccaucgaccucgccgccaccuccgccggcauccucuccggcaacccccuccccgcccucgacaccgagggccucuccggcaucuccccccucuccuccgacgaggucaccggcgccaucuccggccaggacuccaccggcacccaccaggacggcgacacccuccccaccgucggcggcuccgaccccuucgucuccauccccucccgccccgagcaggagcccgucgccgacuccuuccagggcuccuccguccucucccucuccgagcuccccaaggccccccuccagaacggccucuccaucccccucuccuccuccgaguccuccuccacccgccucuccccccccgacgucuccgcccuccucgacaucucccuccccggcccccccgaggacgcccucucccagggcgagcccgccacccacaucuccgacuccaucaucgagaucgccaucuccuccggccaguacggcgagggcgucccccucucccccgccaagcucaacggcuccgacuccuccaagucccuccccucccccuccuccuccccccagccccacuggaucgccucccccacccacgacccccagugguaccccuccgacuccaccgacuccucccucuccucccucuucgccuccuucaucucccccgagaagucccgcaagaugcuccccacccccaucggcaccaacuccggcaccucccuccucggccccucccuccucgacggcaacucccgcgacuccuucgucucccgcucccucgccgacgucgccgaggucgucgacucccagcucgucugcaugaugaacgagaacuccaucgacuacaucucccgcuucaacgaccucgcccaggagcucuccaucgccgagcccggccgccgcgaggcccucuucgacggcggcggcggcggccccgccgucuccgaccucucccaguga

SEQ ID NO: 41728 - RNA, 1881 nt, Artificial Sequence
  derived and/or modified sequence opt2 from CRAT__Homo_sapiens__NP_000746
augcucgccuucgccgcccgcaccgucgucaagccccucggcuuccucaagcccuucucccucaugaaggccuccucccgcuucaaggcccaccaggacgcccucccccgccuccccguccccccccuccagcagucccucgaccacuaccucaaggcccuccagcccaucgucuccgaggaggagugggcccacaccaagcagcucgucgacgaguuccaggccuccggcggcgucggcgagcgccuccagaagggccucgagcgccgcgcccgcaagaccgagaacuggcucuccgagugguggcucaagaccgccuaccuccaguaccgccagcccgucgucaucuacuccucccccggcgucaugcuccccaagcaggacuucgucgaccuccagggccagcuccgcuucgccgccaagcucaucgagggcguccucgacuucaaggucaugaucgacaacgagacccuccccgucgaguaccucggcggcaagccccucugcaugaaccaguacuaccagauccucuccuccugccgcguccccggccccaagcaggacaccgucuccaacuucuccaagaccaagaagccccccacccacaucaccgucguccacaacuaccaguucuucgagcucgacgucuaccacuccgacggcaccccccucaccgccgaccagaucuucguccagcucgagaagaucuggaacuccucccuccagaccaacaaggagcccgucggcauccucaccuccaaccaccgcaacuccugggccaaggccuacaacacccucaucaaggacaaggucaaccgcgacuccguccgcuccauccagaaguccaucuucaccgucugccucgacgccaccaugccccgcgucuccgaggacgucuaccgcucccacgucgccggccagaugcuccacggcggcggcucccgccucaacuccggcaaccgcugguucgacaagacccuccaguucaucgucgccgaggacggcuccugcggccucgucuacgagcacgccgccgccgagggcccccccaucgucacccuccucgacuacgucaucgaguacaccaagaagcccgagcucguccgcucccccauggucccccuccccaugcccaagaagcuccgcuucaacaucacccccgagaucaaguccgacaucgagaaggccaagcagaaccucuccaucaugauccaggaccucgacaucaccgucauggucuuccaccacuucggcaaggacuuccccaaguccgagaagcucucccccgacgccuucauccagauggcccuccagcucgccuacuaccgcaucuacggccaggccugcgccaccuacgaguccgccucccuccgcauguuccaccucggccgcaccgacaccauccgcuccgccuccauggacucccucaccuucgucaaggccauggacgacuccuccgucaccgagcaccagaaggucgagcuccuccgcaaggccguccaggcccaccgcggcuacaccgaccgcgccauccgcggcgaggccuucgaccgccaccuccucggccucaagcuccaggccaucgaggaccucgucuccaugcccgacaucuucauggacaccuccuacgccaucgccaugcacuuccaccucuccaccucccagguccccgccaagaccgacugcgucauguucuucggccccgucguccccgacggcuacggcgucugcuacaaccccauggaggcccacaucaacuucucccucuccgccuacaacuccugcgccgagaccaacgccgcccgccucgcccacuaccucgagaaggcccuccucgacaugcgcgcccuccuccagucccacccccgcgccaagcucuga

SEQ ID NO: 41729 - RNA, 3885 nt, Artificial Sequence
  derived and/or modified sequence opt2 from CRB1__Homo_sapiens__NP_001180569
auggcccucaagaacaucaacuaccuccucaucuucuaccucuccuucucccuccucaucuacaucaagaacuccuucugcaacaagaacaacacccgcugccucuccaacuccugccagaacaacuccaccugcaaggacuucuccaaggacaacgacugcuccugcuccgacaccgccaacaaccucgacaaggacugcgacaacaugaaggaccccugcuucuccaaccccugccagggcuccgccaccugcgucaacacccccggcgagcgcuccuuccucugcaagugcccccccggcuacuccggcaccaucugcgagaccaccaucggcuccugcggcaagaacuccugccagcacggcggcaucugccaccaggaccccaucuaccccgucugcaucugccccgccggcuacgccggccgcuucugcgagaucgaccacgacgagugcgccuccucccccugccagaacggcgccgucugccaggacggcaucgacggcuacuccugcuucugcguccccggcuaccagggccgccacugcgaccucgaggucgacgagugcgccuccgaccccugcaagaacgaggccaccugccucaacgagaucggccgcuacaccugcaucugcccccacaacuacuccggcuacaccggcgcccagugcgagaucgaccucaacgagugcaacuccaaccccugccaguccaacggcgagugcgucgagcucuccuccgagaagcaguacggccgcaucaccggccuccccuccuccuucuccuaccacgaggccuccggcuacgucugcaucugccagcccggcuucaccggcauccacugcgaggaggacgucaacgagugcuccuccaaccccugccagaacggcggcaccugcgagaaccuccccggcaacuacaccugccacugccccuucgacaaccucucccgcaccuucuacggcggccgcgacugcuccgacauccuccucggcugcacccaccagcagugccucaacaacggcaccugcaucccccacuuccaggacggccagcacggcuucuccugccucugccccuccggcuacaccggcucccucugcgagaucgccaccacccucuccuucgagggcgacggcuuccucugggucaaguccggcuccgucaccaccaagggcuccgucugcaacaucgcccuccgcuuccagaccguccagcccauggcccuccuccucuuccgcuccaaccgcgacgucuucgucaagcucgagcuccucuccggcuacauccaccucuccauccaggucaacaaccaguccaagguccuccucuucaucucccacaacaccuccgacggcgaguggcacuucgucgaggucaucuucgccgaggccgucacccucacccucaucgacgacuccugcaaggagaagugcaucgccaaggcccccaccccccucgaguccgaccaguccaucugcgccuuccagaacuccuuccucggcggccuccccgucggcaugaccuccaacggcgucgcccuccucaacuucuacaacaugcccuccacccccuccuucgucggcugccuccaggacaucaagaucgacuggaaccacaucacccucgagaacaucuccuccggcuccucccucaacgucaaggccggcugcguccgcaaggacuggugcgagucccagcccugccagucccgcggccgcugcaucaaccucuggcucuccuaccagugcgacugccaccgccccuacgagggccccaacugccuccgcgaguacgucgccggccgcuucggccaggacgacuccaccggcuacgucaucuucacccucgacgaguccuacggcgacaccaucucccucuccauguucguccgcacccuccagcccuccggccuccuccucgcccucgagaacuccaccuaccaguacauccgcgucuggcucgagcgcggccgccucgccaugcucacccccaacucccccaagcucgucgucaaguucguccucaacgacggcaacguccaccucaucucccucaagaucaagcccuacaagaucgagcucuaccaguccucccagaaccucggcuucaucuccgccuccaccuggaagaucgagaagggcgacgucaucuacaucggcggccuccccgacaagcaggagaccgagcucaacggcggcuucuucaagggcugcauccaggacguccgccucaacaaccagaaccucgaguucuuccccaaccccaccaacaacgccucccucaaccccguccucgucaacgucacccagggcugcgccggcgacaacuccugcaaguccaaccccugccacaacggcggcgucugccacucccgcugggacgacuucuccugcuccugccccgcccucaccuccggcaaggccugcgaggagguccaguggugcggcuucucccccugcccccacggcgcccagugccagcccguccuccagggcuucgagugcaucgccaacgccgucuucaacggccaguccggccagauccucuuccgcuccaacggcaacaucacccgcgagcucaccaacaucaccuucggcuuccgcacccgcgacgccaacgucaucauccuccacgccgagaaggagcccgaguuccucaacaucuccauccaggacucccgccucuucuuccagcuccaguccggcaacuccuucuacaugcucucccucaccucccuccaguccgucaacgacggcaccuggcacgaggucacccucuccaugaccgacccccucucccagaccucccgcuggcagauggaggucgacaacgagacccccuucgucaccuccaccaucgccaccggcucccucaacuuccucaaggacaacaccgacaucuacgucggcgaccgcgccaucgacaacaucaagggccuccagggcugccucuccaccaucgagaucggcggcaucuaccucuccuacuucgagaacguccacggcuucaucaacaagccccaggaggagcaguuccucaagaucuccaccaacuccgucgucaccggcugccuccagcucaacgucugcaacuccaaccccugccuccacggcggcaacugcgaggacaucuacuccuccuaccacugcuccugcccccucggcugguccggcaagcacugcgagcucaacaucgacgagugcuucuccaaccccugcauccacggcaacugcuccgaccgcgucgccgccuaccacugcaccugcgagcccggcuacaccggcgucaacugcgaggucgacaucgacaacugccagucccaccagugcgccaacggcgccaccugcaucucccacaccaacggcuacuccugccucugcuucggcaacuucaccggcaaguucugccgccagucccgccuccccuccaccgucugcggcaacgagaagaccaaccucaccugcuacaacggcggcaacugcaccgaguuccagaccgagcucaagugcaugugccgccccggcuucaccggcgaguggugcgagaaggacaucgacgagugcgccuccgaccccugcgucaacggcggccucugccaggaccuccucaacaaguuccagugccucugcgacgucgccuucgccggcgagcgcugcgaggucgaccucgccgacgaccucaucuccgacaucuucaccaccaucggcuccgucaccgucgcccuccuccucauccuccuccucgccaucgucgccuccgucgucaccuccaacaagcgcgccacccagggcaccuacucccccucccgccaggagaaggagggcucccgcgucgagauguggaaccucaugcccccccccgccauggagcgccucaucuga

SEQ ID NO: 41730 - RNA, 3858 nt, Artificial Sequence
  derived and/or modified sequence opt2 from CRB2__Homo_sapiens__NP_775960
auggcccucgcccgccccggcacccccgacccccaggcccucgccuccguccuccuccuccuccucugggcccccgcccucucccuccucgccggcaccguccccuccgagccccccuccgccugcgccuccgaccccugcgcccccggcaccgagugccaggccaccgaguccggcggcuacaccugcggccccauggagccccgcggcugcgccacccagcccugccaccacggcgcccucugcgucccccagggccccgaccccaccggcuuccgcugcuacugcguccccggcuuccagggcccccgcugcgagcucgacaucgacgagugcgccucccgccccugccaccacggcgccaccugccgcaaccucgccgaccgcuacgagugccacugcccccucggcuacgccggcgucaccugcgagauggaggucgacgagugcgccuccgcccccugccuccacggcggcuccugccucgacggcgucggcuccuuccgcugcgucugcgcccccggcuacggcggcacccgcugccagcucgaccucgacgagugccagucccagcccugcgcccacggcggcaccugccacgaccucgucaacggcuuccgcugcgacugcgccggcaccggcuacgagggcacccacugcgagcgcgagguccucgagugcgccuccgcccccugcgagcacaacgccuccugccucgagggccucggcuccuuccgcugccucugcuggcccggcuacuccggcgagcucugcgaggucgacgaggacgagugcgccuccucccccugccagcacggcggccgcugccuccagcgcuccgaccccgcccucuacggcggcguccaggccgccuuccccggcgccuucuccuuccgccacgccgccggcuuccucugccacugcccccccggcuucgagggcgccgacugcggcgucgaggucgacgagugcgccucccgccccugccucaacggcggccacugccaggaccuccccaacggcuuccagugccacugccccgacggcuacgccggccccaccugcgaggaggacgucgacgagugccucuccgaccccugccuccacggcggcaccugcuccgacaccgucgccggcuacaucugccgcugccccgagaccuggggcggccgcgacugcuccguccagcucaccggcugccagggccacaccugcccccucgccgccaccugcauccccaucuucgaguccggcguccacuccuacgucugccacugcccccccggcacccacggccccuucugcggccagaacaccaccuucuccgucauggccggcucccccauccaggccuccguccccgccggcggcccccucggccucgcccuccgcuuccgcaccacccuccccgccggcacccucgccacccgcaacgacaccaaggagucccucgagcucgcccucgucgccgccacccuccaggccacccucugguccuacuccaccaccguccucguccuccgccuccccgaccucgcccucaacgacggccacuggcaccaggucgaggucguccuccaccucgccacccucgagcuccgccucuggcacgagggcugccccgcccgccucugcgucgccuccggccccgucgcccucgccuccaccgccuccgccaccccccuccccgccggcaucuccuccgcccagcucggcgacgccaccuucgccggcugccuccaggacguccgcgucgacggccaccuccuccuccccgaggaccucggcgagaacguccuccucggcugcgagcgccgcgagcagugccgcccccuccccugcguccacggcggcuccugcgucgaccucuggacccacuuccgcugcgacugcgcccgcccccaccgcggccccaccugcgccgacgagauccccgccgccaccuucggccucggcggcgcccccuccuccgccuccuuccuccuccaggagcuccccggccccaaccucaccgucuccuuccuccuccgcacccgcgaguccgccggccuccuccuccaguucgccaacgacuccgccgccggccucaccgucuuccucuccgagggccgcauccgcgccgagguccccggcucccccgccgucguccuccccggccgcugggacgacggccuccgccaccucgucaugcucuccuucggccccgaccagcuccaggaccucggccagcacguccacgucggcggccgccuccucgccgccgacucccagcccuggggcggccccuuccgcggcugccuccaggaccuccgccucgacggcugccaccuccccuucuucccccucccccucgacaacuccucccagcccuccgagcucggcggccgccaguccuggaaccucaccgccggcugcgucuccgaggacaugugcucccccgaccccugcuucaacggcggcaccugccucgucaccuggaacgacuuccacugcaccugccccgccaacuucaccggccccaccugcgcccagcagcucuggugccccggccagcccugccucccccccgccaccugcgaggagguccccgacggcuucgucugcgucgccgaggccaccuuccgcgagggcccccccgccgccuucuccggccacaacgccuccuccggccgccuccucggcggccucucccucgccuuccgcacccgcgacuccgaggccuggcuccuccgcgccgccgccggcgcccucgagggcgucuggcucgccguccgcaacggcucccucgccggcggcguccgcggcggccacggccuccccggcgccguccuccccauccccggcccccgcgucgccgacggcgccuggcaccgcguccgccucgccauggagcgccccgccgccaccaccucccgcuggcuccucuggcucgacggcgccgccacccccgucgcccuccgcggccucgccuccgaccucggcuuccuccagggccccggcgccguccgcauccuccucgccgagaacuucaccggcugccucggccgcgucgcccucggcggccucccccucccccucgcccgcccccgccccggcgccgcccccggcgcccgcgagcacuucgccuccuggcccggcacccccgcccccauccucggcugccgcggcgcccccgucugcgcccccucccccugccuccacgacggcgccugccgcgaccucuucgacgccuucgccugcgccugcggccccggcugggagggcccccgcugcgaggcccacgucgaccccugccacuccgcccccugcgcccgcggccgcugccacacccaccccgacggccgcuucgagugccgcugcccccccggcuucggcggcccccgcugccgccuccccguccccuccaaggagugcucccucaacgucaccugccucgacggcucccccugcgagggcggcucccccgccgccaacugcuccugccucgagggccucgccggccagcgcugccagguccccacccuccccugcgaggccaaccccugccucaacggcggcaccugccgcgccgccggcggcgucuccgagugcaucugcaacgcccgcuucuccggccaguucugcgaggucgccaagggccucccccucccccuccccuucccccuccucgaggucgccguccccgccgccugcgccugccuccuccuccuccuccucggccuccucuccggcauccucgccgcccgcaagcgccgccaguccgagggcaccuacucccccucccagcaggaggucgccggcgcccgccucgagauggacuccguccucaaggucccccccgaggagcgccucaucuga

SEQ ID NO: 41731 - RNA, 372 nt, Artificial Sequence
  derived and/or modified sequence opt2 from CRB3__Homo_sapiens__NP_777377
auggccaaccccggccucggccuccuccucgcccucggccuccccuuccuccucgcccgcuggggccgcgccuggggccagauccagaccaccuccgccaacgagaacuccaccguccuccccuccuccaccuccuccuccuccgacggcaaccuccgccccgaggccaucaccgccaucaucgucgucuucucccuccucgccgcccuccuccucgccgucggccucgcccuccucguccgcaagcuccgcgagaagcgccagaccgagggcaccuaccgccccuccuccgaggagcaguucucccacgccgccgaggcccgcgccccccaggacuccaaggagaccguccagggcugccuccccaucuga

SEQ ID NO: 41732 - RNA, 1326 nt, Artificial Sequence
  derived and/or modified sequence opt2 from CRBN__Homo_sapiens__NP_001166953
auggccggcgagggcgaccagcaggacgccgcccacaacaugggcaaccaccucccccuccuccccgaguccgaggaggaggacgagauggaggucgaggaccaggacuccaaggaggccaagaagcccaacaucaucaacuucgacaccucccuccccaccucccacaccuaccucggcgccgacauggaggaguuccacggccgcacccuccacgacgacgacuccugccaggucauccccguccucccccaggucaugaugauccucauccccggccagacccucccccuccagcucuuccacccccaggaggucuccaugguccgcaaccucauccagaaggaccgcaccuucgccguccucgccuacuccaacguccaggagcgcgaggcccaguucggcaccaccgccgagaucuacgccuaccgcgaggagcaggacuucggcaucgagaucgucaaggucaaggccaucggccgccagcgcuucaagguccucgagcuccgcacccaguccgacggcauccagcaggccaagguccagauccuccccgagugcguccuccccuccaccauguccgccguccagcucgagucccucaacaagugccagaucuuccccuccaagcccgucucccgcgaggaccagugcuccuacaagugguggcagaaguaccagaagcgcaaguuccacugcgccaaccucaccuccuggccccgcuggcucuacucccucuacgacgccgagacccucauggaccgcaucaagaagcagcuccgcgagugggacgagaaccucaaggacgacucccuccccuccaaccccaucgacuucuccuaccgcgucgccgccugccuccccaucgacgacguccuccgcauccagcuccucaagaucggcuccgccauccagcgccuccgcugcgagcucgacaucaugaacaagugcaccucccucugcugcaagcagugccaggagaccgagaucaccaccaagaacgagaucuucucccucucccucugcggccccauggccgccuacgucaacccccacggcuacguccacgagacccucaccgucuacaaggccugcaaccucaaccucaucggccgccccuccaccgagcacuccugguuccccggcuacgccuggaccgucgcccagugcaagaucugcgccucccacaucggcuggaaguucaccgccaccaagaaggacauguccccccagaaguucuggggccucacccgcuccgcccuccuccccaccauccccgacaccgaggacgagaucucccccgacaaggucauccucugccucuga

SEQ ID NO: 41733 - RNA, 348 nt, Artificial Sequence
  derived and/or modified sequence opt2 from CRCP__Homo_sapiens__NP_001035737
auggaggucaaggacgccaacuccgcccuccucuccaacuacgagacccucaaguacaucuccaagacccccugccgccaccagucccccgagaucguccgcgaguuccucaccgcccucaagucccacaagcucaccaaggccgagaagcuccagcuccucaaccaccgccccgucaccgccgucgagauccagcucauggucgaggaguccgaggagcgccucaccgaggagcagaucgaggcccuccuccacaccgucaccuccauccuccccgccgagcccgaggccgagcagaagaagaacaccaacuccaacgucgccauggacgaggaggaccccgccuga

SEQ ID NO: 41734 - RNA, 300 nt, Artificial Sequence
  derived and/or modified sequence opt2 from CRCT1__Homo_sapiens__NP_061933
auguccucccagcaguccgccgucuccgccaagggcuucuccaagggcuccucccagggccccgcccccugccccgcccccgcccccacccccgcccccgccuccuccuccuccugcugcggcuccggccgcggcugcugcggcgacuccggcugcugcggcuccuccuccaccuccugcugcugcuucccccgccgccgccgccgccagcgcuccuccggcugcugcugcugcggcggcggcucccagcgcucccagcgcuccaacaaccgcuccuccggcugcugcuccggcugcuga

SEQ ID NO: 41735 - RNA, 1026 nt, Artificial Sequence
  derived and/or modified sequence opt2 from CREB1__Homo_sapiens__XP_011508947
augaccauggaguccggcgccgagaaccagcaguccggcgacgccgccgucaccgaggccgagaaccagcagaugaccguccaggcccagccccagaucgccacccucgcccaggucuccaugcccgccgcccacgccaccuccuccgcccccaccgucacccucguccagcuccccaacggccagaccguccagguccacggcgucauccaggccgcccagcccuccgucauccaguccccccagguccagaccguccaguccuccugcaaggaccucaagcgccucuucuccggcacccagaucuccaccaucgccgaguccgaggacucccaggaguccgucgacuccgucaccgacucccagaagcgccgcgagauccucucccgccgccccuccuaccgcaagauccucaacgaccucuccuccgacgcccccggcgucccccgcaucgaggaggagaaguccgaggaggagaccuccgcccccgccaucaccaccgucaccguccccacccccaucuaccagaccuccuccggccaguacaucgccaucacccagggcggcgccauccagcucgccaacaacggcaccgacggcguccagggccuccagacccucaccaugaccaacgccgccgccacccagcccggcaccaccauccuccaguacgcccagaccaccgacggccagcagauccucguccccuccaaccaggucgucguccaggccgccuccggcgacguccagaccuaccagauccgcaccgcccccaccuccaccaucgcccccggcgucgucauggccuccucccccgcccuccccacccagcccgccgaggaggccgcccgcaagcgcgagguccgccucaugaagaaccgcgaggccgcccgcgagugccgccgcaagaagaaggaguacgucaagugccucgagaaccgcgucgccguccucgagaaccagaacaagacccucaucgaggagcucaaggcccucaaggaccucuacugccacaaguccgacuga

SEQ ID NO: 41736 - RNA, 1116 nt, Artificial Sequence
  derived and/or modified sequence opt2 from CREB3__Homo_sapiens__NP_006359
auggagcucgagcucgacgccggcgaccaggaccuccucgccuuccuccucgaggaguccggcgaccucggcaccgcccccgacgaggccguccgcgccccccucgacugggcccucccccucuccgagguccccuccgacugggaggucgacgaccuccucugcucccuccucuccccccccgccucccucaacauccucuccuccuccaaccccugccucguccaccacgaccacaccuacucccucccccgcgagaccgucuccauggaccucgaguccgaguccugccgcaaggagggcacccagaugaccccccagcacauggaggagcucgccgagcaggagaucgcccgccucguccucaccgacgaggagaagucccuccucgagaaggagggccucauccuccccgagacccucccccucaccaagaccgaggagcagauccucaagcgcguccgccgcaagauccgcaacaagcgcuccgcccaggagucccgccgcaagaagaaggucuacgucggcggccucgagucccgcguccucaaguacaccgcccagaacauggagcuccagaacaagguccagcuccucgaggagcagaaccucucccuccucgaccagcuccgcaagcuccaggccauggucaucgagaucuccaacaagaccuccuccuccuccaccugcauccucguccuccucgucuccuucugccuccuccucguccccgccauguacuccuccgacacccgcggcucccuccccgccgagcacggcguccucucccgccagcuccgcgcccuccccuccgaggaccccuaccagcucgagcuccccgcccuccaguccgagguccccaaggacuccacccaccaguggcucgacggcuccgacugcguccuccaggcccccggcaacaccuccugccuccuccacuacaugccccaggcccccuccgccgagcccccccucgaguggcccuuccccgaccucuucuccgagccccucugccgcggccccauccucccccuccaggccaaccucacccgcaagggcggcuggcuccccaccggcucccccuccgucauccuccaggaccgcuacuccggcuga

SEQ ID NO: 41737 - RNA, 1560 nt, Artificial Sequence
  derived and/or modified sequence opt2 from CREB3L1__Homo_sapiens__NP_443086
auggacgccguccucgagcccuuccccgccgaccgccucuuccccggcuccuccuuccucgaccucggcgaccucaacgaguccgacuuccucaacaacgcccacuuccccgagcaccucgaccacuucaccgagaacauggaggacuucuccaacgaccucuucuccuccuucuucgacgaccccguccucgacgagaaguccccccuccucgacauggagcucgacucccccacccccggcauccaggccgagcacuccuacucccucuccggcgacuccgccccccaguccccccucguccccaucaagauggaggacaccacccaggacgccgagcacggcgccugggcccucggccacaagcucugcuccaucauggucaagcaggagcagucccccgagcuccccgucgacccccucgccgcccccuccgccauggccgccgccgccgccauggccaccaccccccuccucggccucuccccccucucccgccuccccaucccccaccaggcccccggcgagaugacccagcuccccgucaucaaggccgagccccucgaggucaaccaguuccucaaggucacccccgaggaccucguccagaugccccccaccccccccuccucccacggcuccgacuccgacggcucccaguccccccgcucccucccccccuccucccccguccgccccauggcccgcuccuccaccgccaucuccaccuccccccuccucaccgccccccacaagcuccagggcaccuccggcccccuccuccucaccgaggaggagaagcgcacccucaucgccgagggcuaccccauccccaccaagcucccccucaccaaggccgaggagaaggcccucaagcgcguccgccgcaagaucaagaacaagaucuccgcccaggagucccgccgcaagaagaaggaguacgucgagugccucgagaagaaggucgagaccuucaccuccgagaacaacgagcucuggaagaaggucgagacccucgagaacgccaaccgcacccuccuccagcagcuccagaagcuccagacccucgucaccaacaagaucucccgccccuacaagauggccgccacccagaccggcaccugccucauggucgccgcccucugcuucguccucguccucggcucccucguccccugccuccccgaguucuccuccggcucccagaccgucaaggaggacccccucgccgccgacggcgucuacaccgccucccagaugcccucccgcucccuccucuucuacgacgacggcgccggccucugggaggacggccgcuccacccuccuccccauggagccccccgacggcugggagaucaaccccggcggccccgccgagcagcgcccccgcgaccaccuccagcacgaccaccucgacuccacccacgagaccaccaaguaccucuccgaggccuggcccaaggacggcggcaacggcaccucccccgacuucucccacuccaaggagugguuccacgaccgcgaccucggccccaacaccaccaucaagcucuccuga

SEQ ID NO: 41738 - RNA, 747 nt, Artificial Sequence
  derived and/or modified sequence opt2 from CREB3L2__Homo_sapiens__NP_001240704
auggagguccucgaguccggcgagcagggcguccuccagugggaccgcaagcucuccgagcucuccgagcccggcgacggcgaggcccucauguaccacacccacuucuccgagcuccucgacgaguucucccagaacguccucggccagcuccucaacgaccccuuccucuccgagaaguccgucuccauggaggucgagcccucccccaccucccccgccccccucauccaggccgagcacuccuacucccucugcgaggagccccgcgcccagucccccuucacccacaucaccaccuccgacuccuucaacgacgacgaggucgaguccgagaagugguaccucuccaccgacuuccccuccaccuccaucaagaccgagcccgucaccgacgagcccccccccggccucguccccuccgucacccucaccaucaccgccaucuccaccccccucgagaaggaggagcccccccucgagaugaacaccggcgucgacuccuccugccagaccaucauccccaagaucaagcucgagccccacgaggucgaccaguuccucaacuucucccccaaggagggccucuccgcccuccccgucucccucugggucauggacauggucuccggcuccaccgagcgcgaguacggcgagcgcgccggcaugucccucuaccaccgcugcugcuccuggcucuacgagaucgcccucuuccucaagaacaagaacuucgccuccaaguga

SEQ ID NO: 41739 - RNA, 1383 nt, Artificial Sequence
  derived and/or modified sequence opt2 from CREB3L3__Homo_sapiens__NP_001258924
augaacaccgaccucgccgccggcaagauggccuccgccgccugcuccauggaccccaucgacuccuucgagcuccucgaccuccucuucgaccgccaggacggcauccuccgccacgucgagcucggcgagggcuggggccacgucaaggaccagguccuccccaaccccgacuccgacgacuuccucuccuccauccucggcuccggcgacucccuccccuccuccccccucuggucccccgagggcuccgacuccggcaucuccgaggaccuccccuccgacccccaggacacccccccccgcuccggccccgccaccucccccgccggcugccaccccgcccagcccggcaagggccccugccucuccuaccaccccggcaacuccugcuccaccaccacccccggccccgucauccagguccccgaggccuccgucaccaucgaccucgagauguggucccccggcggccgcaucugcgccgagaagcccgccgaccccgucgaccucuccccccgcugcaaccucaccgucaaggaccuccuccucuccggcuccuccggcgaccuccagcagcaccaccucggcgccuccuaccuccuccgccccggcgccggccacugccaggagcucguccucaccgaggacgagaagaagcuccucgccaaggagggcaucacccuccccacccagcucccccucaccaaguacgaggagcgcguccucaagaagauccgccgcaagauccgcaacaagcaguccgcccaggagucccgcaagaagaagaaggaguacaucgacggccucgagacccgcauguccgccugcaccgcccagaaccaggagcuccagcgcaagguccuccaccucgagaagcagaaccucucccuccucgagcagcucaagaagcuccaggccaucgucguccaguccaccuccaaguccgcccagaccggcaccugcgucgccguccuccuccucuccuucgcccucaucauccuccccuccaucucccccuucggccccaacaagaccgagucccccggcgacuucgcccccguccgcgucuucucccgcacccuccacaacgacgccgccucccgcgucgccgccgacgccguccccggcuccgaggcccccggcccccgccccgaggccgacaccacccgcgaggagucccccggcucccccggcgccgacuggggcuuccaggacaccgccaaccucaccaacuccaccgaggagcucgacaacgccacccucguccuccgcaacgccaccgagggccucggccaggucgcccuccucgacugggucgcccccggccccuccaccggcuccggccgcgccggccucgaggccgccggcgacgagcucuga

SEQ ID NO: 41740 - RNA, 1188 nt, Artificial Sequence
  derived and/or modified sequence opt2 from CREB3L4__Homo_sapiens__NP_001242908
auggaccucggcauccccgaccuccucgacgccuggcucgagccccccgaggacaucuucuccaccggcuccguccucgagcucggccuccacugccccccccccgagguccccgucacccgccuccaggagcagggccuccagggcuggaaguccggcggcgaccgcggcugcggccuccaggaguccgagcccgaggacuuccucaagcucuucaucgaccccaacgaggucuacugcuccgaggccucccccggcuccgacuccggcaucuccgaggaccccugccaccccgacuccccccccgccccccgcgccaccuccucccccaugcucuacgaggucgucuacgaggccggcgcccucgagcgcaugcagggcgagaccggccccaacgucggccucaucuccauccagcucgaccaguggucccccgccuucaugguccccgacuccugcauggucuccgagcuccccuucgacgcccacgcccacauccucccccgcgccggcaccgucgcccccguccccugcaccacccuccuccccugccagacccucuuccucaccgacgaggagaagcgccuccucggccaggagggcgucucccuccccucccaccucccccucaccaaggccgaggagcgcguccucaagaagguccgccgcaagauccgcaacaagcaguccgcccaggacucccgccgccgcaagaaggaguacaucgacggccucgagucccgcgucgccgccugcuccgcccagaaccaggagcuccagaagaagguccaggagcucgagcgccacaacaucucccucgucgcccagcuccgccagcuccagacccucaucgcccagaccuccaacaaggccgcccagaccuccaccugcguccucauccuccucuucucccucgcccucaucauccuccccuccuucucccccuuccagucccgccccgaggccggcuccgaggacuaccagccccacggcgucaccucccgcaacauccucacccacaaggacgucaccgagaaccucgagacccaggucgucgagucccgccuccgcgagccccccggcgccaaggacgccaacggcuccacccgcacccuccucgagaagaugggcggcaagccccgccccuccggccgcauccgcuccguccuccacgccgacgagauguga

SEQ ID NO: 41741 - RNA, 1110 nt, Artificial Sequence
  derived and/or modified sequence opt2 from CREB5__Homo_sapiens__NP_001011666
auguucugcaccuccggcggcaacuccgccuccgucauguccaugcgccccguccccggcucccucuccucccuccuccaccuccacaaccgccagcgccagcccaugcccgccuccaugcccggcacccuccccaaccccaccaugcccggcuccuccgccguccucaugcccauggagcgccagauguccgucaacuccuccaucaugggcaugcagggccccaaccucuccaaccccugcgccuccccccagguccagcccaugcacuccgaggccaagaugcgccucaaggccgcccucacccaccaccccgccgccauguccaacggcaacaugaacaccaugggccacaugauggagaugaugggcucccgccaggaccagaccccccaccaccacaugcacucccacccccaccagcaccagacccuccccccccaccaccccuacccccaccagcaccagcaccccgcccaccacccccacccccagccccaccaccagcagaaccacccccaccaccacucccacucccaccuccacgcccaccccgcccaccaccagaccuccccccaccccccccuccacaccggcaaccaggcccaggucucccccgccacccagcagaugcagcccacccagaccauccagcccccccagcccaccggcggccgccgccgccgcgucgucgacgaggaccccgacgagcgccgccgcaaguuccucgagcgcaaccgcgccgccgccacccgcugccgccagaagcgcaaggucugggucaugucccucgagaagaaggccgaggagcucacccagaccaacaugcagcuccagaacgaggucuccaugcucaagaacgaggucgcccagcucaagcagcuccuccucacccacaaggacugccccaucaccgccaugcagaaggagucccagggcuaccucucccccgaguccuccccccccgccucccccguccccgccugcucccagcagcaggucauccagcacaacaccaucaccaccuccuccuccgucuccgaggucgucggcuccuccacccucucccagcucaccacccaccgcaccgaccucaaccccauccucuga

SEQ ID NO: 41742 - RNA, 7215 nt, Artificial Sequence
  derived and/or modified sequence opt2 from CREBBP__Homo_sapiens__NP_001073315
auggccgagaaccuccucgacggcccccccaaccccaagcgcgccaagcucuccucccccggcuucuccgccaacgacuccaccgacuucggcucccucuucgaccucgagaacgaccuccccgacgagcucauccccaacggcggcgagcucggccuccucaacuccggcaaccucguccccgacgccgccuccaagcacaagcagcucuccgagcuccuccgcggcggcuccggcuccuccaucaaccccggcaucggcaacgucuccgccuccucccccguccagcagggccucggcggccaggcccagggccagcccaacuccgccaacauggccucccucuccgccaugggcaaguccccccucucccagggcgacuccuccgcccccucccuccccaagcaggccgccuccaccuccggccccacccccgccgccucccaggcccucaacccccaggcccagaagcaggucggccucgccaccuccucccccgccaccucccagaccggccccggcaucugcaugaacgccaacuucaaccagacccaccccggccuccucaacuccaacuccggccacucccucaucaaccaggccucccagggccaggcccaggucaugaacggcucccucggcgccgccggccgcggccgcggcgccggcaugcccuaccccacccccgccaugcagggcgccuccuccuccguccucgccgagacccucacccaggucuccccccagaugaccggccacgccggccucaacaccgcccaggccggcggcauggccaagaugggcaucaccggcaacaccucccccuucggccagcccuucucccaggccggcggccagcccaugggcgccaccggcgucaacccccagcucgccuccaagcaguccauggucaacucccuccccaccuuccccaccgacaucaagaacaccuccgucaccaacguccccaacaugucccagaugcagaccuccgucggcaucguccccacccaggccaucgccaccggccccaccgccgaccccgagaagcgcaagcucauccagcagcagcucguccuccuccuccacgcccacaagugccagcgccgcgagcaggccaacggcgagguccgcgccugcucccucccccacugccgcaccaugaagaacguccucaaccacaugacccacugccaggccggcaaggccugccaggccauccucggcucccccgccuccggcauccagaacaccaucggcuccgucggcaccggccagcagaacgccaccucccucuccaaccccaaccccaucgaccccuccuccaugcagcgcgccuacgccgcccucggccuccccuacaugaaccagccccagacccagcuccagccccagguccccggccagcagcccgcccagccccagacccaccagcagaugcgcacccucaacccccucggcaacaaccccaugaacauccccgccggcggcaucaccaccgaccagcagccccccaaccucaucuccgaguccgcccuccccaccucccucggcgccaccaacccccucaugaacgacggcuccaacuccggcaacaucggcacccucuccaccauccccaccgccgccccccccuccuccaccggcguccgcaagggcuggcacgagcacgucacccaggaccuccgcucccaccucguccacaagcucguccaggccaucuuccccacccccgaccccgccgcccucaaggaccgccgcauggagaaccucgucgccuacgccaagaaggucgagggcgacauguacgaguccgccaacucccgcgacgaguacuaccaccuccucgccgagaagaucuacaagauccagaaggagcucgaggagaagcgccgcucccgccuccacaagcagggcauccucggcaaccagcccgcccuccccgcccccggcgcccagccccccgucaucccccaggcccagcccguccgcccccccaacggcccccucucccuccccgucaaccgcaugcaggucucccagggcaugaacuccuucaaccccaugucccucggcaacguccagcucccccaggcccccaugggcccccgcgccgccucccccaugaaccacuccguccagaugaacuccaugggcuccguccccggcauggccaucucccccucccgcaugccccagccccccaacaugaugggcgcccacaccaacaacaugauggcccaggcccccgcccagucccaguuccucccccagaaccaguuccccuccuccuccggcgccauguccgucggcaugggccagccccccgcccagaccggcgucucccagggccagguccccggcgccgcccuccccaacccccucaacaugcucggcccccaggccucccagcuccccugcccccccgucacccaguccccccuccaccccacccccccccccgccuccaccgccgccggcaugcccucccuccagcacaccaccccccccggcaugacccccccccagcccgccgcccccacccagcccuccacccccgucuccuccuccggccagacccccacccccacccccggcuccguccccuccgccacccagacccaguccacccccaccguccaggccgccgcccaggcccaggucaccccccagccccagacccccguccagccccccuccgucgccaccccccaguccucccagcagcagcccacccccguccacgcccagccccccggcaccccccucucccaggccgccgccuccaucgacaaccgcguccccacccccuccuccgucgccuccgccgagaccaacucccagcagcccggccccgacguccccguccucgagaugaagaccgagacccaggccgaggacaccgagcccgaccccggcgaguccaagggcgagccccgcuccgagaugauggaggaggaccuccagggcgccucccaggucaaggaggagaccgacaucgccgagcagaaguccgagcccauggaggucgacgagaagaagcccgaggucaaggucgaggucaaggaggaggaggaguccuccuccaacggcaccgccucccaguccaccucccccucccagccccgcaagaagaucuucaagcccgaggagcuccgccaggcccucaugcccacccucgaggcccucuaccgccaggaccccgagucccuccccuuccgccagcccgucgacccccagcuccucggcauccccgacuacuucgacaucgucaagaaccccauggaccucuccaccaucaagcgcaagcucgacaccggccaguaccaggagcccuggcaguacgucgacgacgucuggcucauguucaacaacgccuggcucuacaaccgcaagaccucccgcgucuacaaguucugcuccaagcucgccgaggucuucgagcaggagaucgaccccgucaugcagucccucggcuacugcugcggccgcaaguacgaguucuccccccagacccucugcugcuacggcaagcagcucugcaccaucccccgcgacgccgccuacuacuccuaccagaaccgcuaccacuucugcgagaagugcuucaccgagauccagggcgagaacgucacccucggcgacgaccccucccagccccagaccaccaucuccaaggaccaguucgagaagaagaagaacgacacccucgaccccgagcccuucgucgacugcaaggagugcggccgcaagaugcaccagaucugcguccuccacuacgacaucaucuggcccuccggcuucgucugcgacaacugccucaagaagaccggccgcccccgcaaggagaacaaguucuccgccaagcgccuccagaccacccgccucggcaaccaccucgaggaccgcgucaacaaguuccuccgccgccagaaccaccccgaggccggcgaggucuucguccgcgucgucgccuccuccgacaagaccgucgaggucaagcccggcaugaagucccgcuucgucgacuccggcgagauguccgaguccuuccccuaccgcaccaaggcccucuucgccuucgaggagaucgacggcgucgacgucugcuucuucggcaugcacguccaggaguacggcuccgacugccccccccccaacacccgccgcgucuacaucuccuaccucgacuccauccacuucuuccgcccccgcugccuccgcaccgccgucuaccacgagauccucaucggcuaccucgaguacgucaagaagcucggcuacgucaccggccacaucugggccugcccccccuccgagggcgacgacuacaucuuccacugccacccccccgaccagaagauccccaagcccaagcgccuccaggagugguacaagaagaugcucgacaaggccuucgccgagcgcaucauccacgacuacaaggacaucuucaagcaggccaccgaggaccgccucaccuccgccaaggagcuccccuacuucgagggcgacuucuggcccaacguccucgaggaguccaucaaggagcucgagcaggaggaggaggagcgcaagaaggaggaguccaccgccgccuccgagaccaccgagggcucccagggcgacuccaagaacgccaagaagaagaacaacaagaagaccaacaagaacaaguccuccaucucccgcgccaacaagaagaagcccuccaugcccaacgucuccaacgaccucucccagaagcucuacgccaccauggagaagcacaaggaggucuucuucgucauccaccuccacgccggccccgucaucaacacccucccccccaucgucgaccccgacccccuccucuccugcgaccucauggacggccgcgacgccuuccucacccucgcccgcgacaagcacugggaguucuccucccuccgccgcuccaagugguccacccucugcaugcucgucgagcuccacacccagggccaggaccgcuucgucuacaccugcaacgagugcaagcaccacgucgagacccgcuggcacugcaccgucugcgaggacuacgaccucugcaucaacugcuacaacaccaagucccacgcccacaagauggucaaguggggccucggccucgacgacgagggcuccucccagggcgagccccaguccaaguccccccaggagucccgccgccucuccauccagcgcugcauccagucccucguccacgccugccagugccgcaacgccaacugcucccuccccuccugccagaagaugaagcgcgucguccagcacaccaagggcugcaagcgcaagaccaacggcggcugccccgucugcaagcagcucaucgcccucugcugcuaccacgccaagcacugccaggagaacaagugccccguccccuucugccucaacaucaagcacaagcuccgccagcagcagauccagcaccgccuccagcaggcccagcucaugcgccgccgcauggccaccaugaacacccgcaacgucccccagcagucccuccccucccccaccuccgccccccccggcacccccacccagcagcccuccaccccccagaccccccagccccccgcccagccccagcccucccccgucuccaugucccccgccggcuuccccuccgucgcccgcacccagccccccaccaccgucuccaccggcaagcccaccucccagguccccgccccccccccccccgcccagcccccccccgccgccgucgaggccgcccgccagaucgagcgcgaggcccagcagcagcagcaccucuaccgcgucaacaucaacaacuccaugccccccggccgcaccggcaugggcacccccggcucccagauggcccccgucucccucaacgucccccgccccaaccaggucuccggccccgucaugcccuccaugccccccggccaguggcagcaggccccccucccccagcagcagcccaugcccggccucccccgccccgucaucuccaugcaggcccaggccgccgucgccggcccccgcaugcccuccguccagcccccccgcuccaucucccccuccgcccuccaggaccuccuccgcacccucaagucccccuccuccccccagcagcagcagcagguccucaacauccucaaguccaacccccagcucauggccgccuucaucaagcagcgcaccgccaaguacgucgccaaccagcccggcaugcagccccagcccggccuccagucccagcccggcaugcagccccagcccggcaugcaccagcagcccucccuccagaaccucaacgccaugcaggccggcgucccccgccccggcguccccccccagcagcaggccaugggcggccucaacccccagggccaggcccucaacaucaugaaccccggccacaaccccaacauggccuccaugaacccccaguaccgcgagaugcuccgccgccagcuccuccagcagcagcagcagcagcagcagcagcagcagcagcagcagcagcagcagcagggcuccgccggcauggccggcggcauggccggccacggccaguuccagcagccccagggccccggcggcuacccccccgccaugcagcagcagcagcgcaugcagcagcaccucccccuccagggcuccuccaugggccagauggccgcccagaugggccagcucggccagaugggccagcccggccucggcgccgacuccacccccaacauccagcaggcccuccagcagcgcauccuccagcagcagcagaugaagcagcagaucggcucccccggccagcccaaccccauguccccccagcagcacaugcucuccggccagccccaggccucccaccuccccggccagcagaucgccaccucccucuccaaccagguccgcucccccgcccccguccaguccccccgcccccagucccagcccccccacuccucccccuccccccgcauccagccccagcccuccccccaccacgucuccccccagaccggcuccccccaccccggccucgccgucaccauggccuccuccaucgaccagggccaccucggcaaccccgagcaguccgccaugcucccccagcucaacacccccucccgcuccgcccucuccuccgagcucucccucgucggcgacaccaccggcgacacccucgagaaguucgucgagggccucuga

SEQ ID NO: 41743 - RNA, 1254 nt, Artificial Sequence
  derived and/or modified sequence opt2 from CREBRF__Homo_sapiens__NP_001161865
augccccagcccuccgucuccggcauggacccccccuucggcgacgccuuccgcucccacaccuucuccgagcagacccucauguccaccgaccuccucgccaacuccuccgaccccgacuucauguacgagcucgaccgcgagaugaacuaccagcagaacccccgcgacaacuuccucucccucgaggacugcaaggacaucgagaaccucgaguccuucaccgacguccucgacaacgagggcgcccucaccuccaacugggagcagugggacaccuacugcgaggaccucaccaaguacaccaagcucaccuccugcgacaucuggggcaccaaggaggucgacuaccucggccucgacgacuucuccucccccuaccaggacgaggaggucaucuccaagacccccacccucgcccagcucaacuccgaggacucccaguccgucuccgacucccucuacuaccccgacucccucuucuccgucaagcagaacccccuccccuccuccuuccccggcaagaagaucaccucccgcgccgccgcccccgucugcuccuccaagacccuccaggccgaggucccccucuccgacugcguccagaaggccuccaagcccaccuccuccacccagaucauggucaagaccaacauguaccacaacgagaaggucaacuuccacgucgagugcaaggacuacgucaagaaggccaaggucaagaucaaccccguccagcagucccgcccccuccucucccagauccacaccgacgccgccaaggagaacaccugcuacugcggcgccgucgccaagcgccaggagaagaagggcauggagccccuccagggccacgccacccccgcccuccccuucaaggagacccaggagcuccuccucuccccccucccccaggagggccccggcucccucgccgccggcgaguccuccucccucuccgccuccaccuccgucuccgacuccucccagaagaaggaggagcacaacuacucccucuucgucuccgacaaccucggcgagcagcccaccaagugcucccccgaggaggacgaggaggacgaggaggacgucgacgacgaggaccacgacgagggcuucggcuccgagcacgagcucuccgagaacgaggaggaggaggaggaggaggaggacuacgaggacgacaaggacgacgacaucuccgacaccuucuccgagcccggcaucaucaugcucgccucccuccccgacuga

SEQ ID NO: 41744 - RNA, 1065 nt, Artificial Sequence
  derived and/or modified sequence opt2 from CREBZF__Homo_sapiens__NP_001034707
augcgccacucccucaccaagcuccucgccgccuccggcuccaacucccccacccgcuccgagucccccgagcccgccgccaccugcucccuccccuccgaccucacccgcgccgccgccggcgaggaggagaccgccgccgccggcucccccggccgcaagcagcaguucggcgacgagggcgagcucgaggccggccgcggcucccgcggcggcgucgccguccgcgcccccucccccgaggagauggaggaggaggccaucgccucccuccccggcgaggagaccgaggacauggacuuccucuccggccucgagcucgccgaccuccucgacccccgccagcccgacuggcaccucgaccccggccucuccucccccggcccccucuccuccuccggcggcggcuccgacuccggcggccucuggcgcggcgacgacgacgacgaggccgccgccgccgagaugcagcgcuucuccgaccuccuccagcgccuccucaacggcaucggcggcugcuccuccuccuccgacuccggcuccgccgagaagcgccgccgcaagucccccggcggcggcggcggcggcggcuccggcaacgacaacaaccaggccgccaccaaguccccccgcaaggccgccgccgccgccgcccgccucaaccgccucaagaagaaggaguacgucaugggccucgagucccgcguccgcggccucgccgccgagaaccaggagcuccgcgccgagaaccgcgagcucggcaagcgcguccaggcccuccaggaggagucccgcuaccuccgcgccguccucgccaacgagaccggccucgcccgccuccucucccgccucuccggcgucggccuccgccucaccaccucccucuuccgcgacucccccgccggcgaccacgacuacgcccuccccgucggcaagcagaagcaggaccuccucgaggaggacgacuccgccggcggcgucugccuccacgucgacaaggacaaggucuccgucgaguucugcuccgccugcgcccgcaaggccuccuccucccucaagauguga

SEQ ID NO: 41745 - RNA, 663 nt, Artificial Sequence
  derived and/or modified sequence opt2 from CREG1__Homo_sapiens__NP_003842
auggccggccucucccgcggcuccgcccgcgcccuccucgccgcccuccucgccuccacccuccucgcccuccucgucucccccgcccgcggccgcggcggccgcgaccacggcgacugggacgaggccucccgccuccccccccuccccccccgcgaggacgccgcccgcgucgcccgcuucgucacccacgucuccgacuggggcgcccucgccaccaucuccacccucgaggccguccgcggccgccccuucgccgacguccucucccucuccgacggcccccccggcgccggcuccggcguccccuacuucuaccucuccccccuccagcucuccgucuccaaccuccaggagaaccccuacgccacccucaccaugacccucgcccagaccaacuucugcaagaagcacggcuucgacccccaguccccccucugcguccacaucaugcucuccggcaccgucaccaaggucaacgagaccgagauggacaucgccaagcacucccucuucauccgccaccccgagaugaagaccuggcccuccucccacaacugguucuucgccaagcucaacaucaccaacaucuggguccucgacuacuucggcggccccaagaucgucacccccgaggaguacuacaacgucaccguccaguga

SEQ ID NO: 41746 - RNA, 1269 nt, Artificial Sequence
  derived and/or modified sequence opt2 from CRELD1__Homo_sapiens__NP_001026887
auggcccccuggccccccaagggccucguccccgccguccucuggggccucucccucuuccucaaccuccccggccccaucuggcuccagcccuccccccccccccaguccuccccccccccccagccccaccccugccacaccugccgcggccucgucgacuccuucaacaagggccucgagcgcaccauccgcgacaacuucggcggcggcaacaccgccugggaggaggagaaccucuccaaguacaaggacuccgagacccgccucgucgagguccucgagggcgucugcuccaaguccgacuucgagugccaccgccuccucgagcucuccgaggagcucgucgaguccuggugguuccacaagcagcaggaggcccccgaccucuuccaguggcucugcuccgacucccucaagcucugcugccccgccggcaccuucggccccuccugccuccccugccccggcggcaccgagcgccccugcggcggcuacggccagugcgagggcgagggcacccgcggcggcuccggccacugcgacugccaggccggcuacggcggcgaggccugcggccagugcggccucggcuacuucgaggccgagcgcaacgccucccaccucgucugcuccgccugcuucggccccugcgcccgcugcuccggccccgaggaguccaacugccuccagugcaagaagggcugggcccuccaccaccucaagugcgucgacaucgacgagugcggcaccgagggcgccaacugcggcgccgaccaguucugcgucaacaccgagggcuccuacgagugccgcgacugcgccaaggccugccucggcugcaugggcgccggccccggccgcugcaagaagugcucccccggcuaccagcaggucggcuccaagugccucgacgucgacgagugcgagaccgaggucugccccggcgagaacaagcagugcgagaacaccgagggcggcuaccgcugcaucugcgccgagggcuacaagcagauggagggcaucugcgucaaggagcagauccccggcgccuuccccauccucaccgaccucacccccgagaccacccgccgcuggaagcucggcucccacccccacuccaccuacgucaagaugaagaugcagcgcgacgaggccaccuuccccggccucuacggcaagcaggucgccaagcucggcucccagucccgccaguccgaccgcggcacccgccucauccacucccagcaggccuccucccagcgcuga

SEQ ID NO: 41747 - RNA, 1209 nt, Artificial Sequence
  derived and/or modified sequence opt2 from CRELD2__Homo_sapiens__NP_001128573
augcgccucccccgccgcgccgcccucggccuccucccccuccuccuccuccucccccccgcccccgaggccgccaagaagcccacccccugccaccgcugccgcggccucgucgacaaguucaaccagggcauggucgacaccgccaagaagaacuucggcggcggcaacaccgccugggaggagaagacccucuccaaguacgaguccuccgagauccgccuccucgagauccucgagggccucugcgaguccuccgacuucgagugcaaccagaugcucgaggcccaggaggagcaccucgaggccugguggcuccagcucaaguccgaguaccccgaccucuucgagugguucugcgucaagacccucaaggucugcugcucccccggcaccuacggccccgacugccucgccugccagggcggcucccagcgccccugcuccggcaacggccacugcuccggcgacggcucccgccagggcgacggcuccugccgcugccacaugggcuaccagggcccccucugcaccgacugcauggacggcuacuucuccucccuccgcaacgagacccacuccaucugcaccguccgcaccggccucuccgacuccuacccccccugcugccucucccucggcugcuggcgcggcgucggccacgccuggauccgcggccgcaacacccacacccagcccggcuacuccucccgcgucuggaucgccgccuucucccccgccugcgacgaguccugcaagaccugcuccggccucaccaaccgcgacugcggcgagugcgaggucggcuggguccucgacgagggcgccugcgucgacgucgacgagugcgccgccgagcccccccccugcuccgccgcccaguucugcaagaacgccaacggcuccuacaccugcgaggagugcgacuccuccugcgucggcugcaccggcgagggccccggcaacugcaaggagugcaucuccggcuacgcccgcgagcacggccagugcgccgacgucgacgagugcucccucgccgagaagaccugcguccgcaagaacgagaacugcuacaacacccccggcuccuacgucugcgucugccccgacggcuucgaggagaccgaggacgccugcgucccccccgccgaggccgaggccaccgagggcgagucccccacccagcuccccucccgcgaggaccucuga

SEQ ID NO: 41748 - RNA, 540 nt, Artificial Sequence
  derived and/or modified sequence opt2 from CREM__Homo_sapiens__NP_001254491
auggccguccccaccuccaucuaccagaccuccaccggccaguacaucgccaucgcccagggcggcaccauccagaucuccaaccccggcuccgacggcguccagggccuccaggcccucaccaugaccaacuccggcgcccccccccccggcgccaccaucguccaguacgccgcccaguccgccgacggcacccagcaguucuucguccccggcucccaggucgucguccaggccgccaccggcgacaugcccaccuaccagauccgcgcccccaccgccgcccucccccagggcgucgucauggccgccucccccggcucccuccacuccccccagcagcucgccgaggaggccacccgcaagcgcgagcuccgccucaugaagaaccgcgaggccgccaaggagugccgccgccgcaagaaggaguacgucaagugccucgagucccgcgucgccguccucgagguccagaacaagaagcucaucgaggagcucgagacccucaaggacaucugcucccccaagaccgacuacuga

SEQ ID NO: 41749 - RNA, 969 nt, Artificial Sequence
  derived and/or modified sequence opt2 from CRHBP__Homo_sapiens__NP_001873
augucccccaacuucaagcuccagugccacuucauccucaucuuccucaccgcccuccgcggcgagucccgcuaccucgagcuccgcgaggccgccgacuacgaccccuuccuccucuucuccgccaaccucaagcgcgagcucgccggcgagcagcccuaccgccgcgcccuccgcugccucgacaugcucucccuccagggccaguucaccuucaccgccgaccgcccccagcuccacugcgccgccuucuucaucuccgagcccgaggaguucaucaccauccacuacgaccaggucuccaucgacugccagggcggcgacuuccucaaggucuucgacggcuggauccucaagggcgagaaguuccccuccucccaggaccacccccuccccuccgccgagcgcuacaucgacuucugcgaguccggccucucccgccgcuccauccgcuccucccagaacgucgccaugaucuucuuccgcguccacgagcccggcaacggcuucacccucaccaucaagaccgaccccaaccucuuccccugcaacgucaucucccagacccccaacggcaaguucacccucgucgucccccaccagcaccgcaacugcuccuucuccaucaucuaccccgucgucaucaagaucuccgaccucacccucggccacgucaacggccuccagcucaagaaguccuccgccggcugcgagggcaucggcgacuucgucgagcuccucggcggcaccggccucgaccccuccaagaugaccccccucgccgaccucugcuaccccuuccacggccccgcccagaugaaggucggcugcgacaacaccgucguccgcauggucuccuccggcaagcacgucaaccgcgucaccuucgaguaccgccagcucgagcccuacgagcucgagaaccccaacggcaacuccaucggcgaguucugccucuccggccucuga

SEQ ID NO: 41750 - RNA, 591 nt, Artificial Sequence
  derived and/or modified sequence opt2 from CRH__Homo_sapiens__NP_000747
augcgccucccccuccucgucuccgccggcguccuccucgucgcccuccuccccugcccccccugccgcgcccuccucucccgcggccccguccccggcgcccgccaggccccccagcacccccagccccucgacuucuuccagccccccccccaguccgagcagccccagcagccccaggcccgccccguccuccuccgcaugggcgaggaguacuuccuccgccucggcaaccucaacaagucccccgccgccccccucucccccgccuccucccuccucgccggcggcuccggcucccgccccucccccgagcaggccaccgccaacuucuuccgcguccuccuccagcagcuccuccucccccgccgcucccucgacucccccgccgcccucgccgagcgcggcgcccgcaacgcccucggcggccaccaggaggcccccgagcgcgagcgccgcuccgaggagccccccaucucccucgaccucaccuuccaccuccuccgcgagguccucgagauggcccgcgccgagcagcucgcccagcaggcccacuccaaccgcaagcucauggagaucaucggcaaguga

SEQ ID NO: 41751 - RNA, 1335 nt, Artificial Sequence
  derived and/or modified sequence opt2 from CRHR1__Homo_sapiens__NP_001138618
augggcggccacccccagcuccgccucgucaaggcccuccuccuccucggccucaaccccgucuccgccucccuccaggaccagcacugcgagucccucucccucgccuccaacaucuccggccuccagugcaacgccuccgucgaccucaucggcaccugcuggccccgcucccccgccggccagcucgucguccgccccugccccgccuucuucuacggcguccgcuacaacaccaccaacaacggcuaccgcgagugccucgccaacggcuccugggccgcccgcgucaacuacuccgagugccaggagauccucaacgaggagaagaaguccaagguccacuaccacgucgccgucaucaucaacuaccucggccacugcaucucccucgucgcccuccucgucgccuucguccucuuccuccgccuccgccccggcugcacccacuggggcgaccaggccgacggcgcccucgaggucggcgcccccugguccggcgcccccuuccagguccgccgcuccauccgcugccuccgcaacaucauccacuggaaccucaucuccgccuucauccuccgcaacgccaccugguucgucguccagcucaccaugucccccgagguccaccaguccaacgucggcuggugccgccucgucaccgccgccuacaacuacuuccacgucaccaacuucuucuggauguucggcgagggcugcuaccuccacaccgccaucguccucaccuacuccaccgaccgccuccgcaaguggauguucaucugcaucggcuggggcguccccuuccccaucaucgucgccugggccaucggcaagcucuacuacgacaacgagaagugcugguucggcaagcgccccggcgucuacaccgacuacaucuaccagggccccaugauccucguccuccucaucaacuucaucuuccucuucaacaucguccgcauccucaugaccaagcuccgcgccuccaccaccuccgagaccauccaguaccgcaaggccgucaaggccacccucguccuccucccccuccucggcaucaccuacaugcucuucuucgucaaccccggcgaggacgaggucucccgcgucgucuucaucuacuucaacuccuuccucgaguccuuccagggcuucuucgucuccgucuucuacugcuuccucaacuccgagguccgcuccgccauccgcaagcgcuggcaccgcuggcaggacaagcacuccauccgcgcccgcgucgcccgcgccauguccauccccaccucccccacccgcgucuccuuccacuccaucaagcaguccaccgccgucuga

SEQ ID NO: 41752 - RNA, 1317 nt, Artificial Sequence
  derived and/or modified sequence opt2 from CRHR2__Homo_sapiens__NP_001189404
augcgcggccccuccggcccccccggccuccucuacgucccccaccuccuccucugccuccucugccuccucccccccccccuccaguacgccgccggccagucccagaugcccaaggaccagccccucugggcccuccucgagcaguacugccacaccaucaugacccucaccaaccucuccggccccuacuccuacugcaacaccacccucgaccagaucggcaccugcuggccccgcuccgccgccggcgcccucgucgagcgccccugccccgaguacuucaacggcgucaaguacaacaccacccgcaacgccuaccgcgagugccucgagaacggcaccugggccuccaagaucaacuacucccagugcgagcccauccucgacgacaagcagcgcaaguacgaccuccacuaccgcaucgcccucgucgucaacuaccucggccacugcgucuccgucgccgcccucgucgccgccuuccuccucuuccucgcccuccgcuccauccgcugccuccgcaacgucauccacuggaaccucaucaccaccuucauccuccgcaacgucaugugguuccuccuccagcucgucgaccacgagguccacgaguccaacgaggucuggugccgcugcaucaccaccaucuucaacuacuucgucgucaccaacuucuucuggauguucgucgagggcugcuaccuccacaccgccaucgucaugaccuacuccaccgagcgccuccgcaagugccucuuccucuucaucggcuggugcauccccuuccccaucaucgucgccugggccaucggcaagcucuacuacgagaacgagcagugcugguucggcaaggagcccggcgaccucgucgacuacaucuaccagggccccaucauccucguccuccucaucaacuucgucuuccucuucaacaucguccgcauccucaugaccaagcuccgcgccuccaccaccuccgagaccauccaguaccgcaaggccgucaaggccacccucguccuccucccccuccucggcaucaccuacaugcucuucuucgucaaccccggcgaggacgaccucucccagaucauguucaucuacuucaacuccuuccuccaguccuuccagggcuucuucgucuccgucuucuacugcuucuucaacggcgagguccgcuccgccguccgcaagcgcuggcaccgcuggcaggaccaccacucccuccgcguccccauggcccgcgccauguccauccccaccucccccacccgcaucuccuuccacuccaucaagcagaccgccgccgucuga

SEQ ID NO: 41753 - RNA, 3111 nt, Artificial Sequence
  derived and/or modified sequence opt2 from CRIM1__Homo_sapiens__NP_057525
auguaccucgucgccggcgaccgcggccucgccggcugcggccaccuccucgucucccuccucggccuccuccuccuccucgcccgcuccggcacccgcgcccucgucugccuccccugcgacgaguccaagugcgaggagccccgcaacugccccggcuccaucguccagggcgucugcggcugcugcuacaccugcgccucccagcgcaacgaguccugcggcggcaccuucggcaucuacggcaccugcgaccgcggccuccgcugcgucauccgccccccccucaacggcgacucccucaccgaguacgaggccggcgucugcgaggacgagaacuggaccgacgaccagcuccucggcuucaagcccugcaacgagaaccucaucgccggcugcaacaucaucaacggcaagugcgagugcaacaccauccgcaccugcuccaaccccuucgaguuccccucccaggacaugugccucuccgcccucaagcgcaucgaggaggagaagcccgacugcuccaaggcccgcugcgagguccaguucuccccccgcugccccgaggacuccguccucaucgagggcuacgccccccccggcgagugcugcccccuccccucccgcugcgucugcaaccccgccggcugccuccgcaaggucugccagcccggcaaccucaacauccucgucuccaaggccuccggcaagcccggcgagugcugcgaccucuacgagugcaagcccgucuucggcgucgacugccgcaccgucgagugcccccccguccagcagaccgccugcccccccgacuccuacgagacccagguccgccucaccgccgacggcugcugcacccuccccacccgcugcgagugccucuccggccucugcggcuuccccgucugcgaggucggcuccaccccccgcaucgucucccgcggcgacggcacccccggcaagugcugcgacgucuucgagugcgucaacgacaccaagcccgccugcgucuucaacaacgucgaguacuacgacggcgacauguuccgcauggacaacugccgcuucugccgcugccagggcggcgucgccaucugcuucaccgcccagugcggcgagaucaacugcgagcgcuacuacguccccgagggcgagugcugccccgucugcgaggaccccgucuaccccuucaacaaccccgccggcugcuacgccaacggccucauccucgcccacggcgaccgcuggcgcgaggacgacugcaccuucugccagugcgucaacggcgagcgccacugcgucgccaccgucugcggccagaccugcaccaaccccgucaagguccccggcgagugcugccccgucugcgaggagcccaccaucaucaccgucgacccccccgccugcggcgagcucuccaacugcacccucaccggcaaggacugcaucaacggcuucaagcgcgaccacaacggcugccgcaccugccagugcaucaacaccgaggagcucugcuccgagcgcaagcagggcugcacccucaacugccccuucggcuuccucaccgacgcccagaacugcgagaucugcgagugccgcccccgccccaagaagugccgccccaucaucugcgacaaguacugcccccucggccuccucaagaacaagcacggcugcgacaucugccgcugcaagaagugccccgagcucuccugcuccaagaucugcccccucggcuuccagcaggacucccacggcugccucaucugcaagugccgcgaggccuccgccuccgccggcccccccauccucuccggcaccugccucaccgucgacggccaccaccacaagaacgaggaguccuggcacgacggcugccgcgagugcuacugccucaacggccgcgagaugugcgcccucaucaccugccccguccccgccugcggcaaccccaccauccaccccggccagugcugccccuccugcgccgacgacuucgucguccagaagcccgagcucuccacccccuccaucugccacgcccccggcggcgaguacuucgucgagggcgagaccuggaacaucgacuccugcacccagugcaccugccacuccggccgcguccucugcgagaccgaggucugccccccccuccucugccagaaccccucccgcacccaggacuccugcugcccccagugcaccgaccagcccuuccgccccucccucucccgcaacaacuccguccccaacuacugcaagaacgacgagggcgacaucuuccucgccgccgaguccuggaagcccgacgucugcaccuccugcaucugcaucgacuccgucaucuccugcuucuccgaguccugccccuccgucuccugcgagcgccccguccuccgcaagggccagugcugccccuacugcaucgaggacaccauccccaagaaggucgucugccacuucuccggcaaggccuacgccgacgaggagcgcugggaccucgacuccugcacccacugcuacugccuccagggccagacccucugcuccaccgucuccugccccccccuccccugcgucgagcccaucaacgucgagggcuccugcugccccaugugccccgagauguacguccccgagcccaccaacauccccaucgagaagaccaaccaccgcggcgaggucgaccucgaggucccccucuggcccacccccuccgagaacgacaucguccaccucccccgcgacaugggccaccuccaggucgacuaccgcgacaaccgccuccaccccuccgaggacuccucccucgacuccaucgccuccgucgucguccccaucaucaucugccucuccaucaucaucgccuuccucuucaucaaccagaagaagcaguggaucccccuccucugcugguaccgcacccccaccaagcccuccucccucaacaaccagcucgucuccgucgacugcaagaagggcacccgcguccaggucgacuccucccagcgcaugcuccgcaucgccgagcccgacgcccgcuucuccggcuucuacuccaugcagaagcagaaccaccuccaggccgacaacuucuaccagaccgucuga

SEQ ID NO: 41754 - RNA, 849 nt, Artificial Sequence
  derived and/or modified sequence opt2 from CRIP2__Homo_sapiens__NP_001257766
augcccccccaccaccuccuccccuggcucgcccagguccccuccgccgagggcgagcucguccgccucgucucccgcgccggcggccgcggcgccugcuucuggcccgccgucaccauggagauggccgucgccgccggcugcgucugcaagggcggcggcugcugccaccgcgagcccucccaggaccaccacgagucccaggagcaccgcggcccccucgucggcucccagaccugccucguccaccaggccgagggcaccgccgagaaggucuccucccucggcaaggacuggcacaaguucugccucaagugcgagcgcugcuccaagacccucacccccggcggccacgccgagcacgacggcaagcccuucugccacaagcccugcuacgccacccucuucggccccaagggcgucaacaucggcggcgccggcuccuacaucuacgagaagccccucgccgagggcccccaggucaccggccccaucgagguccccgccgcccgcgccgaggagcgcaaggccuccggcccccccaagggccccucccgcgccuccuccgucaccaccuucaccggcgagcccaacaccugcccccgcugcuccaagaaggucuacuucgccgagaaggucaccucccucggcaaggacuggcaccgccccugccuccgcugcgagcgcugcggcaagacccucacccccggcggccacgccgagcacgacggccagcccuacugccacaagcccugcuacggcauccucuucggccccaagggcgucaacaccggcgccgucggcuccuacaucuacgaccgcgaccccgagggcaagguccagcccuga

SEQ ID NO: 41755 - RNA, 615 nt, Artificial Sequence
  derived and/or modified sequence opt2 from CRIP3__Homo_sapiens__NP_996805
auguccuggaccugcccccgcugccagcagcccgucuucuucgccgagaaggucuccucccucggcaagaacuggcaccgcuucugccucaagugcgagcgcugccacuccauccucucccccggcggccacgccgagcacaacggccgccccuacugccacaagcccugcuacggcgcccucuucggcccccgcggcgucaacaucggcggcgucggcuccuaccucuacaacccccccacccccucccccggcugcaccaccccccucucccccuccuccuucucccccccccgcccccgcaccggccucccccagggcaagaagucccccccccacaugaagaccuucaccggcgagaccucccucugccccggcugcggcgagcccgucuacuucgccgagaaggucaugucccucggccgcaacuggcaccgccccugccuccgcugccagcgcugccacaagacccucaccgccggcucccacgccgagcacgacggcguccccuacugccacguccccugcuacggcuaccucuucggccccaagggcgucaacaucggcgacgucggcugcuacaucuacgaccccgucaagaucaaguucaaguga

SEQ ID NO: 41756 - RNA, 1341 nt, Artificial Sequence
  derived and/or modified sequence opt2 from CRIPAK__Homo_sapiens__NP_787114
augcacgagcccucccucugcgccaacgucgagugcccccccgcccacaccugccccugcggcguccccgccugcuccugcgcccacgucgagugcccccccgcccacaccugccgcugcggcguccccgccugcucccacaugcccaugugguccgcccgccuccucacccgcgcccacgucgagugcccccccgcccacacccgcguccacgucgagugcccccccgcccacguccccaugugguccgcccaccuccucaccugcgccgacgucgagugccaccuccucacccacguccccaugugguccgcccgccuccucaccugccccugcggcguccccgccugcucccacguccccaugcgcuccgcccgccuccucacccgcgcccacgccgagugcccccccgcccacaccugccccugcggcguccccgccugcucccacguccccaugcgcuccgcccgccuccucacccgcgccgacgucgagugcccccccgcccacaccugccccugcggcguccccgccugcucccacguccccaccugguccgcccgccucaucacccgcgcccacgucgagugcucccccgcccacaccugccgcugcggcguccccgccugcucccacguccccaugugguccguccgccuccucacccgcgccgacgccgagugcccccccgcccacaccugccgcugcggcguccccgccugcucccacguccccaugugguccgcccgccuccucaccugccgcugcggcguccccgccugcucccacguccccaugugguccgcccgccuccucaccugccgcugcggcguccccgccugcucccacguccccaugugguccgcccgccuccucacccgcgcccacgucgagugcccccccgcccacaccugccgccgcggcguccccgccugcucccgcgcccacauggagugcccccccgcccacaccugccacugcggcguccccgccugcucccacaccugccgcugcggcguccccgccugcucccacguccccaugugguccgcccgccuccucacccgcgcccacgucgagugcccccccgcccacacccgcgcccacgucgagugcccccccgcccacaccugccccugcggcguccccgccugcucccacaccugccccugcggcguccccgccugcucccacaaggcccucgccuggugguucugccgcuuccccguccuccccgccgaguccgacgccgucaccguccacuccacccacggcggcuuccucauccgcuucuacgucaaggaccccuucuacaucucccuccaccucgagaucaccuga

SEQ ID NO: 41757 - RNA, 306 nt, Artificial Sequence
  derived and/or modified sequence opt2 from CRIPT__Homo_sapiens__NP_054890
auggucugcgagaagugcgagaagaagcucggcaccgucaucacccccgacaccuggaaggacggcgcccgcaacaccaccgaguccggcggccgcaagcucaacgagaacaaggcccucaccuccaagaaggcccgcuucgaccccuacggcaagaacaaguucuccaccugccgcaucugcaaguccuccguccaccagcccggcucccacuacugccagggcugcgccuacaagaagggcaucugcgccaugugcggcaagaagguccucgacaccaagaacuacaagcagaccuccgucuga

SEQ ID NO: 41758 - RNA, 750 nt, Artificial Sequence
  derived and/or modified sequence opt2 from CRISP1__Homo_sapiens__NP_001122
auggagaucaagcaccuccucuuccucgucgccgccgccugccuccuccccaugcucuccaugaagaagaaguccgcccgcgaccaguucaacaagcucgucaccgaccuccccaacguccaggaggagaucgucaacauccacaacgcccuccgccgccgcgucgucccccccgccuccaacaugcucaagauguccugguccgaggaggccgcccagaacgcccgcaucuucuccaaguacugcgacaugaccgaguccaacccccucgagcgccgccuccccaacaccuucugcggcgagaacaugcacaugaccuccuaccccgucuccugguccuccgucaucggcgucugguacuccgaguccaccuccuucaagcacggcgaguggaccaccaccgacgacgacaucaccaccgaccacuacacccagaucgucugggccaccuccuaccucaucggcugcgccaucgccuccugccgccagcagggcuccccccgcuaccucuacgucugccacuacugccacgagggcaacgaccccgagaccaagaacgagcccuacaagaccggcguccccugcgaggccugccccuccaacugcgaggacaagcucugcaccaaccccugcaucuacuacgacgaguacuucgacugcgacauccagguccacuaccucggcugcaaccacuccaccaccauccucuucugcaaggccaccugccucugcgacaccgagaucaaguga

SEQ ID NO: 41759 - RNA, 732 nt, Artificial Sequence
  derived and/or modified sequence opt2 from CRISP2__Homo_sapiens__NP_001135879
auggcccuccuccccguccucuuccucgucaccguccuccuccccucccuccccgccgagggcaaggaccccgccuucaccgcccuccucaccacccagcuccagguccagcgcgagaucgucaacaagcacaacgagcuccgcaaggccgucuccccccccgccuccaacaugcucaagauggaguggucccgcgaggucaccaccaacgcccagcgcugggccaacaagugcacccuccagcacuccgaccccgaggaccgcaagaccuccacccgcugcggcgagaaccucuacauguccuccgaccccaccuccugguccuccgccauccaguccugguacgacgagauccucgacuucgucuacggcgucggccccaagucccccaacgccgucgucggccacuacacccagcucgucugguacuccaccuaccaggucggcugcggcaucgccuacugccccaaccaggacucccucaaguacuacuacgucugccaguacugccccgccggcaacaacaugaaccgcaagaacacccccuaccagcagggcacccccugcgccggcugccccgacgacugcgacaagggccucugcaccaacuccugccaguaccaggaccuccucuccaacugcgacucccucaagaacaccgccggcugcgagcacgagcuccucaaggagaagugcaaggccaccugccucugcgagaacaagaucuacuga

SEQ ID NO: 41760 - RNA, 807 nt, Artificial Sequence
  derived and/or modified sequence opt2 from CRISP3__Homo_sapiens__NP_001177915
augaagcagauccuccaccccgcccucgagaccaccgaccccugcuccaccggcuucgucuuccccgccaugacccucuuccccguccuccucuuccucgucgccggccuccuccccuccuuccccgccaacgaggacaaggaccccgccuucaccgcccuccucaccacccagacccagguccagcgcgagaucgucaacaagcacaacgagcuccgccgcgccgucuccccccccgcccgcaacaugcucaagauggaguggaacaaggaggccgccgccaacgcccagaagugggccaaccagugcaacuaccgccacuccaaccccaaggaccgcaugaccucccucaagugcggcgagaaccucuacauguccuccgccuccuccuccuggucccaggccauccaguccugguucgacgaguacaacgacuucgacuucggcgucggccccaagacccccaacgccgucgucggccacuacacccaggucgucugguacuccuccuaccucgucggcugcggcaacgccuacugccccaaccagaagguccucaaguacuacuacgucugccaguacugccccgccggcaacugggccaaccgccucuacguccccuacgagcagggcgcccccugcgccuccugccccgacaacugcgacgacggccucugcaccaacggcugcaaguacgaggaccucuacuccaacugcaagucccucaagcucacccucaccugcaagcaccagcucguccgcgacuccugcaaggccuccugcaacugcuccaacuccaucuacuga

SEQ ID NO: 41761 - RNA, 939 nt, Artificial Sequence
  derived and/or modified sequence opt2 from CRISPLD1__Homo_sapiens__NP_001273707
augaacaucuggggccagaucuggcccaaggccgucuaccucgucugcaacuacucccccaagggcaacugguggggccacgcccccuacaagcacggccgccccugcuccgccugcccccccuccuucggcggcggcugccgcgagaaccucugcuacaaggagggcuccgaccgcuacuaccccccccgcgaggaggagaccaacgagaucgagcgccagcagucccagguccacgacacccacguccgcacccgcuccgacgacuccucccgcaacgaggucaucuccgcccagcagaugucccagaucgucuccugcgagguccgccuccgcgaccagugcaagggcaccaccugcaaccgcuacgagugccccgccggcugccucgacuccaaggccaaggucaucggcuccguccacuacgagaugcaguccuccaucugccgcgccgccauccacuacggcaucaucgacaacgacggcggcugggucgacaucacccgccagggccgcaagcacuacuucaucaaguccaaccgcaacggcauccagaccaucggcaaguaccaguccgccaacuccuucaccgucuccaaggucaccguccaggccgucaccugcgagaccaccgucgagcagcucugccccuuccacaagcccgccucccacugcccccgcgucuacugcccccgcaacugcaugcaggccaacccccacuacgcccgcgucaucggcacccgcgucuacuccgaccucuccuccaucugccgcgccgccguccacgccggcgucguccgcaaccacggcggcuacgucgacgucaugcccgucgacaagcgcaagaccuacaucgccuccuuccagaacggcaucuucuccgagucccuccagaacccccccggcggcaaggccuuccgcgucuucgccgucgucuga

SEQ ID NO: 41762 - RNA, 1494 nt, Artificial Sequence
  derived and/or modified sequence opt2 from CRISPLD2__Homo_sapiens__NP_113664
auguccugcguccucggcggcgucaucccccucggccuccucuuccucgucugcggcucccagggcuaccuccuccccaacgucacccuccucgaggagcuccucuccaaguaccagcacaacgagucccacucccgcguccgccgcgccaucccccgcgaggacaaggaggagauccucaugcuccacaacaagcuccgcggccagguccagccccaggccuccaacauggaguacaugaccugggacgacgagcucgagaaguccgccgccgccugggccucccagugcaucugggagcacggccccaccucccuccucgucuccaucggccagaaccucggcgcccacuggggccgcuaccgcucccccggcuuccacguccaguccugguacgacgaggucaaggacuacaccuaccccuaccccuccgagugcaaccccuggugccccgagcgcugcuccggccccaugugcacccacuacacccagaucgucugggccaccaccaacaagaucggcugcgccgucaacaccugccgcaagaugaccgucuggggcgaggucugggagaacgccgucuacuucgucugcaacuacucccccaagggcaacuggaucggcgaggcccccuacaagaacggccgccccugcuccgagugcccccccuccuacggcggcuccugccgcaacaaccucugcuaccgcgaggagaccuacacccccaagcccgagaccgacgagaugaacgaggucgagaccgcccccauccccgaggagaaccacgucuggcuccagccccgcgucaugcgccccaccaagcccaagaagaccuccgccgucaacuacaugacccaggucguccgcugcgacaccaagaugaaggaccgcugcaagggcuccaccugcaaccgcuaccagugccccgccggcugccucaaccacaaggccaagaucuucggcacccucuucuacgaguccuccuccuccaucugccgcgccgccauccacuacggcauccucgacgacaagggcggccucgucgacaucacccgcaacggcaagguccccuucuucgucaaguccgagcgccacggcguccagucccucuccaaguacaagcccuccuccuccuucauggucuccaaggucaagguccaggaccucgacugcuacaccaccgucgcccagcucugccccuucgagaagcccgccacccacugcccccgcauccacugccccgcccacugcaaggacgagcccuccuacugggcccccgucuucggcaccaacaucuacgccgacaccuccuccaucugcaagaccgccguccacgccggcgucaucuccaacgaguccggcggcgacgucgacgucaugcccgucgacaagaagaagaccuacgucggcucccuccgcaacggcguccaguccgagucccucggcaccccccgcgacggcaaggccuuccgcaucuucgccguccgccaguga

SEQ ID NO: 41763 - RNA, 615 nt, Artificial Sequence
  derived and/or modified sequence opt2 from CRK__Homo_sapiens__NP_005197
auggccggcaacuucgacuccgaggagcgcuccuccugguacuggggccgccucucccgccaggaggccgucgcccuccuccagggccagcgccacggcgucuuccucguccgcgacuccuccaccucccccggcgacuacguccucuccgucuccgagaacucccgcgucucccacuacaucaucaacuccuccggcccccgcccccccgucccccccucccccgcccagcccccccccggcgucucccccucccgccuccgcaucggcgaccaggaguucgacucccuccccgcccuccucgaguucuacaagauccacuaccucgacaccaccacccucaucgagcccgucucccgcucccgccagggcuccggcgucauccuccgccaggaggaggccgaguacguccgcgcccucuucgacuucaacggcaacgacgaggaggaccuccccuucaagaagggcgacauccuccgcauccgcgacaagcccgaggagcagugguggaacgccgaggacuccgagggcaagcgcggcaugauccccguccccuacgucgagaaguaccgccccgccuccgccuccgucuccgcccucaucggcggccgcuga

SEQ ID NO: 41764 - RNA, 912 nt, Artificial Sequence
  derived and/or modified sequence opt2 from CRKL__Homo_sapiens__NP_005198
auguccuccgcccgcuucgacuccuccgaccgcuccgccugguacaugggccccgucucccgccaggaggcccagacccgccuccagggccagcgccacggcauguuccucguccgcgacuccuccaccugccccggcgacuacguccucuccgucuccgagaacucccgcgucucccacuacaucaucaacucccuccccaaccgccgcuucaagaucggcgaccaggaguucgaccaccuccccgcccuccucgaguucuacaagauccacuaccucgacaccaccacccucaucgagcccgccccccgcuaccccuccccccccaugggcuccgucuccgcccccaaccuccccaccgccgaggacaaccucgaguacguccgcacccucuacgacuuccccggcaacgacgccgaggaccuccccuucaagaagggcgagauccucgucaucaucgagaagcccgaggagcaguggugguccgcccgcaacaaggacggccgcgucggcaugauccccguccccuacgucgagaagcucguccgcuccuccccccacggcaagcacggcaaccgcaacuccaacuccuacggcauccccgagcccgcccacgccuacgcccagccccagaccaccaccccccuccccgccgucuccggcucccccggcgccgccaucaccccccuccccuccacccagaacggccccgucuucgccaaggccauccagaagcgcguccccugcgccuacgacaagaccgcccucgcccucgaggucggcgacaucgucaaggucacccgcaugaacaucaacggccagugggagggcgaggucaacggccgcaagggccucuuccccuucacccacgucaagaucuucgacccccagaaccccgacgagaacgaguga

SEQ ID NO: 41765 - RNA, 1269 nt, Artificial Sequence
  derived and/or modified sequence opt2 from CRLF1__Homo_sapiens__NP_004741
augcccgccggccgccgcggccccgccgcccaguccgcccgccgcccccccccccuccucccccuccuccuccuccucugcguccucggcgccccccgcgccggcuccggcgcccacaccgccgucaucuccccccaggaccccacccuccucaucggcuccucccuccucgccaccugcuccguccacggcgacccccccggcgccaccgccgagggccucuacuggacccucaacggccgccgccucccccccgagcucucccgcguccucaacgccuccacccucgcccucgcccucgccaaccucaacggcucccgccagcgcuccggcgacaaccucgucugccacgcccgcgacggcuccauccucgccggcuccugccucuacgucggccucccccccgagaagcccgucaacaucuccugcugguccaagaacaugaaggaccucaccugccgcuggacccccggcgcccacggcgagaccuuccuccacaccaacuacucccucaaguacaagcuccgcugguacggccaggacaacaccugcgaggaguaccacaccgucggcccccacuccugccacauccccaaggaccucgcccucuucacccccuacgagaucugggucgaggccaccaaccgccucggcuccgcccgcuccgacguccucacccucgacauccucgacgucgucaccaccgaccccccccccgacguccacgucucccgcgucggcggccucgaggaccagcucuccguccgcugggucuccccccccgcccucaaggacuuccucuuccaggccaaguaccagauccgcuaccgcgucgaggacuccgucgacuggaaggucgucgacgacgucuccaaccagaccuccugccgccucgccggccucaagcccggcaccgucuacuucguccagguccgcugcaaccccuucggcaucuacggcuccaagaaggccggcaucugguccgaguggucccaccccaccgccgccuccaccccccgcuccgagcgccccggccccggcggcggcgccugcgagccccgcggcggcgagcccuccuccggccccguccgccgcgagcucaagcaguuccucggcuggcucaagaagcacgccuacugcuccaaccucuccuuccgccucuacgaccaguggcgcgccuggaugcagaagucccacaagacccgcaaccaggacgagggcauccuccccuccggccgccgcggcaccgcccgcggccccgcccgcuga

SEQ ID NO: 41766 - RNA, 1116 nt, Artificial Sequence
  derived and/or modified sequence opt2 from CRLF2__Homo_sapiens__NP_071431
augggccgccucguccuccucuggggcgccgccgucuuccuccucggcggcuggauggcccucggccagggcggcgccgccgagggcguccagauccagaucaucuacuucaaccucgagaccguccaggucaccuggaacgccuccaaguacucccgcaccaaccucaccuuccacuaccgcuucaacggcgacgaggccuacgaccagugcaccaacuaccuccuccaggagggccacaccuccggcugccuccucgacgccgagcagcgcgacgacauccucuacuucuccauccgcaacggcacccaccccgucuucaccgccucccgcuggauggucuacuaccucaagcccuccucccccaagcacguccgcuucuccuggcaccaggacgccgucaccgucaccugcuccgaccucuccuacggcgaccuccucuacgagguccaguaccgcucccccuucgacaccgaguggcaguccaagcaggagaacaccugcaacgucaccaucgagggccucgacgccgagaagugcuacuccuucuggguccgcgucaaggccauggaggacgucuacggccccgacaccuaccccuccgacugguccgaggucaccugcuggcagcgcggcgagauccgcgacgccugcgccgagacccccaccccccccaagcccaagcucuccaaguucauccucaucuccucccucgccauccuccucauggucucccuccuccuccucucccucuggaagcucuggcgcgucaagaaguuccucauccccuccguccccgaccccaaguccaucuuccccggccucuucgagauccaccagggcaacuuccaggaguggaucaccgacacccagaacgucgcccaccuccacaagauggccggcgccgagcaggaguccggccccgaggagccccucgucguccagcucgccaagaccgaggccgaguccccccgcaugcucgacccccagaccgaggagaaggaggccuccggcggcucccuccagcucccccaccagccccuccagggcggcgacgucgucaccaucggcggcuucaccuucgucaugaacgaccgcuccuacgucgcccucuga

SEQ ID NO: 41767 - RNA, 1329 nt, Artificial Sequence
  derived and/or modified sequence opt2 from CRLF3__Homo_sapiens__NP_057070
augcgcggcgccauggagcucgagcccgagcuccuccuccaggaggcccgcgagaacgucgaggccgcccaguccuaccgccgcgagcucggccaccgccucgagggccuccgcgaggcccgccgccagaucaaggaguccgccucccagacccgcgacguccucaagcagcacuucaacgaccucaagggcacccucggcaagcuccucgacgagcgccucgucacccuccuccaggaggucgacaccaucgagcaggagaccaucaagccccucgacgacugccagaagcucaucgagcacggcgucaacaccgccgaggaccucguccgcgagggcgagaucgccaugcucggcggcgucggcgaggagaacgagaagcucugguccuucaccaagaaggccucccacauccagcucgacucccuccccgaggucccccuccucgucgacguccccugccucuccgcccagcucgacgacuccauccucaacaucgucaaggaccacaucuucaagcacggcaccgucgccucccgcccccccguccagaucgaggagcucaucgagaagcccggcggcaucaucguccgcuggugcaaggucgacgacgacuucaccgcccaggacuaccgccuccaguuccgcaagugcaccuccaaccacuucgaggacgucuacgucggcuccgagaccgaguucaucguccuccacaucgaccccaacgucgacuaccaguuccgcgucugcgcccgcggcgacggccgccaggaguggucccccugguccgucccccagaucggccacuccacccucgucccccacgaguggaccgccggcuucgagggcuacucccucuccucccgccgcaacaucgcccuccgcaacgacuccgaguccuccggcguccucuacucccgcgcccccaccuacuucugcggccagacccucaccuuccgcgucgagaccgucggccagcccgaccgccgcgacuccaucggcgucugcgccgagaagcaggacggcuacgacucccuccagcgcgaccaggccgucugcaucuccaccaacggcgccgucuucgucaacggcaaggagaugaccaaccagcuccccgccgucaccuccggcuccaccgucaccuucgacaucgaggccgucacccucggcaccaccuccaacaacgagggcggccacuucaagcuccgcgucaccaucuccuccaacaaccgcgaggucgucuucgacuggcuccucgaccaguccugcggcucccucuacuucggcugcuccuucuucuaccccggcuggaagguccucgucuucuga

SEQ ID NO: 41768 - RNA, 609 nt, Artificial Sequence
  derived and/or modified sequence opt2 from CRLS1__Homo_sapiens__NP_001120930
augccccaguacgagaaccccuggaccauccccaacaugcucuccaugacccgcaucggccucgcccccguccucggcuaccucaucaucgaggaggacuucaacaucgcccucggcgucuucgcccucgccggccucaccgaccuccucgacggcuucaucgcccgcaacugggccaaccagcgcuccgcccucggcuccgcccucgacccccucgccgacaagauccucaucuccauccucuacgucucccucaccuacgccgaccucauccccgucccccucaccuacaugaucaucucccgcgacgucaugcucaucgccgccgucuucuacguccgcuaccgcacccuccccaccccccgcacccucgccaaguacuucaaccccugcuacgccaccgcccgccucaagcccaccuucaucuccaaggucaacaccgccguccagcucauccucgucgccgccucccucgccgcccccgucuucaacuacgccgacuccaucuaccuccagauccucuggugcuucaccgccuucaccaccgccgccuccgccuacuccuacuaccacuacggccgcaagaccguccaggucaucaaggacuga

SEQ ID NO: 41769 - RNA, 2061 nt, Artificial Sequence
  derived and/or modified sequence opt2 from CRMP1__Homo_sapiens__NP_001014809
auggccgaccgccgccgcgccuggaacaccgaggacgaccuccccgucuaccucgcccgccccggcuccgccgcccagaccccccgccagaaguacggcggcauguucgccgccgucgagggcgccuacgagaacaagaccaucgacuucgacgccuacuccgucggccgccgcggcuccgcccgcaccccccgcuccgccggccgccccgacgccgucggccuccccggccccggcggcuccgaggacaccgccuccgacgucuccgagcccuccggcuccgccgucuccucccccggcgagcgcgacgagcgcccccccacccuccgcauccgccgccccgccccccgcgaccucccccucggccgcgacaacggccaguccgaccgccuccucaucaagggcggccgcaucaucaacgacgaccagucccucuacgccgacgucuaccucgaggacggccucaucaagcagaucggcgagaaccucaucguccccggcggcgucaagaccaucgaggccaacggccgcauggucauccccggcggcaucgacgucaacaccuaccuccagaagcccucccagggcaugaccgccgccgacgacuucuuccagggcacccgcgccgcccucgucggcggcaccaccaugaucaucgaccacgucguccccgagcccggcuccucccuccucaccuccuucgagaaguggcacgaggccgccgacaccaaguccugcugcgacuacucccuccacgucgacaucaccuccugguacgacggcguccgcgaggagcucgagguccucguccaggacaagggcgucaacuccuuccaggucuacauggccuacaaggacgucuaccagauguccgacucccagcucuacgaggccuucaccuuccucaagggccucggcgccgucauccucguccacgccgagaacggcgaccucaucgcccaggagcagaagcgcauccucgagaugggcaucaccggccccgagggccacgcccucucccgccccgaggagcucgaggccgaggccgucuuccgcgccaucaccaucgccggccgcaucaacugccccgucuacaucaccaaggucauguccaaguccgccgccgacaucaucgcccucgcccgcaagaagggcccccucgucuucggcgagcccaucgccgccucccucggcaccgacggcacccacuacugguccaagaacugggccaaggccgccgccuucgucaccucccccccccucucccccgaccccaccacccccgacuaccucaccucccuccucgccugcggcgaccuccaggucaccggcuccggccacugccccuacuccaccgcccagaaggccgucggcaaggacaacuucacccucauccccgagggcgucaacggcaucgaggagcgcaugaccgucgucugggacaaggccgucgccaccggcaagauggacgagaaccaguucgucgccgucaccuccaccaacgccgccaagaucuucaaccucuacccccgcaagggccgcaucgccgucggcuccgacgccgacgucgucaucugggaccccgacaagcucaagaccaucaccgccaagucccacaaguccgccgucgaguacaacaucuucgagggcauggagugccacggcuccccccucgucgucaucucccagggcaagaucgucuucgaggacggcaacaucaacgucaacaagggcaugggccgcuucaucccccgcaaggccuuccccgagcaccucuaccagcgcgucaagauccgcaacaaggucuucggccuccagggcgucucccgcggcauguacgacggccccgucuacgagguccccgccacccccaaguacgccacccccgcccccuccgccaaguccucccccuccaagcaccagcccccccccauccgcaaccuccaccaguccaacuucucccucuccggcgcccagaucgacgacaacaacccccgccgcaccggccaccgcaucgucgccccccccggcggccgcuccaacaucaccucccucggcuga

SEQ ID NO: 41770 - RNA, 2511 nt, Artificial Sequence
  derived and/or modified sequence opt2 from CRNKL1__Homo_sapiens__NP_001265554
augaccgccaccgucgagaaccucaccuuccagaaggacacccucggcaacgccgucgacaagaaccgccgccacggcuccaccgagccccucguccucgccugguccucccaguuccgccgccucaccuggggcugcgcccucgacgcccuccaccgcucccccugcgucgccgccucccagcacggcgucacccaccucauccgcuccucccgcaccccccacuccacccgcugccgcaaggaggacgcccagcccggccaccacggcaacggcgccgccuccgucaccgcccaggcccgcggccagcgcuccguccuccaggucccccuccccgucccccgcuccugccucuucuccgaguccuucgucgucuccgucuccucccagucccgcuuccucgccuccguccccggcaccggcguccagcgcuccaccgccgccgacauggccgccuccaccgccgccggcaagcagcgcauccccaaggucgccaaggucaagaacaaggcccccgccgagguccagaucaccgccgagcagcuccuccgcgaggccaaggagcgcgagcucgagcuccuccccccccccccccagcagaagaucaccgacgaggaggagcucaacgacuacaagcuccgcaagcgcaagaccuucgaggacaacauccgcaagaaccgcaccgucaucuccaacuggaucaaguacgcccagugggaggagucccucaaggagauccagcgcgcccgcuccaucuacgagcgcgcccucgacgucgacuaccgcaacaucacccucuggcucaaguacgccgagauggagaugaagaaccgccaggucaaccacgcccgcaacaucugggaccgcgccaucaccacccucccccgcgucaaccaguucugguacaaguacaccuacauggaggagaugcucggcaacgucgccggcgcccgccaggucuucgagcgcuggauggaguggcagcccgaggagcaggccuggcacuccuacaucaacuucgagcuccgcuacaaggaggucgaccgcgcccgcaccaucuacgagcgcuucguccucguccaccccgacgucaagaacuggaucaaguacgcccgcuucgaggagaagcacgccuacuucgcccacgcccgcaaggucuacgagcgcgccgucgaguucuucggcgacgagcacauggacgagcaccucuacgucgccuucgccaaguucgaggagaaccagaaggaguucgagcgcguccgcgucaucuacaaguacgcccucgaccgcaucuccaagcaggacgcccaggagcucuucaagaacuacaccaucuucgagaagaaguucggcgaccgccgcggcaucgaggacaucaucgucuccaagcgccgcuuccaguacgaggaggaggucaaggccaacccccacaacuacgacgccugguucgacuaccuccgccucgucgaguccgacgccgaggccgaggccguccgcgaggucuacgagcgcgccaucgccaacgucccccccauccaggagaagcgccacuggaagcgcuacaucuaccucuggaucaacuacgcccucuacgaggagcucgaggccaaggaccccgagcgcacccgccaggucuaccaggccucccucgagcucaucccccacaagaaguucaccuucgccaagauguggauccucuacgcccaguucgagauccgccagaagaaccucucccucgcccgccgcgcccucggcaccuccaucggcaagugccccaagaacaagcucuucaaggucuacaucgagcucgagcuccagcuccgcgaguucgaccgcugccgcaagcucuacgagaaguuccucgaguucggccccgagaacugcaccuccuggaucaaguucgccgagcucgagaccauccucggcgacaucgaccgcgcccgcgccaucuacgagcucgccaucucccagccccgccucgacaugcccgagguccucuggaaguccuacaucgacuucgagaucgagcaggaggagaccgagcgcacccgcaaccucuaccgccgccuccuccagcgcacccagcacgucaaggucuggaucuccuucgcccaguucgagcucuccuccggcaaggagggcucccucaccaagugccgccagaucuacgaggaggccaacaagaccaugcgcaacugcgaggagaaggaggagcgccucaugcuccucgaguccuggcgcuccuucgaggaggaguucggcaccgccuccgacaaggagcgcgucgacaagcucaugcccgagaaggucaagaagcgccgcaagguccagaccgacgacggcuccgacgccggcugggaggaguacuucgacuacaucuuccccgaggacgccgccaaccagcccaaccucaagcuccucgccauggccaagcucuggaagaagcagcagcaggagaaggaggacgccgagcaccaccccgacgaggacgucgacgaguccgaguccuga

SEQ ID NO: 41771 - RNA, 1488 nt, Artificial Sequence
  derived and/or modified sequence opt2 from CRNN__Homo_sapiens__NP_057274
augccccagcuccuccagaacaucaacggcaucaucgaggccuuccgccgcuacgcccgcaccgagggcaacugcaccgcccucacccgcggcgagcucaagcgccuccucgagcaggaguucgccgacgucaucgucaagccccacgaccccgccaccgucgacgagguccuccgccuccucgacgaggaccacaccggcaccgucgaguucaaggaguuccucguccucgucuucaaggucgcccaggccugcuucaagacccucuccgaguccgccgagggcgccugcggcucccaggaguccggcucccuccacuccggcgccucccaggagcucggcgagggccagcgcuccggcaccgaggucggccgcgccggcaagggccagcacuacgagggcuccucccaccgccagucccagcagggcucccgcggccagaaccgccccggcguccagacccagggccaggccaccggcuccgccugggucuccuccuacgaccgccaggccgagucccagucccaggagcgcaucuccccccagauccagcucuccggccagaccgagcagacccagaaggccggcgagggcaagcgcaaccagaccaccgagaugcgccccgagcgccagccccagacccgcgagcaggaccgcgcccaccagaccggcgagaccgucaccggcuccggcacccagacccaggccggcgccacccagaccgucgagcaggacuccucccaccagaccggccgcaccuccaagcagacccaggaggccaccaacgaccagaaccgcggcaccgagacccacggccagggccgcucccagaccucccaggccgucaccggcggccacgcccagauccaggccggcacccacacccagacccccacccagaccgucgagcaggacuccucccaccagaccggcuccaccuccacccagacccaggaguccaccaacggccagaaccgcggcaccgagauccacggccagggccgcucccagaccucccaggccgucaccggcggccacacccagauccaggccggcucccacaccgagaccgucgagcaggaccgcucccagaccgucucccacggcggcgcccgcgagcagggccagacccagacccagcccggcuccggccagcgcuggaugcaggucuccaaccccgaggccggcgagaccguccccggcggccaggcccagaccggcgccuccaccgaguccggccgccaggagugguccuccacccacccccgccgcugcgucaccgagggccagggcgaccgccagcccaccgucgucggcgaggagugggucgacgaccacucccgcgagaccgucauccuccgccucgaccagggcaaccuccacaccuccgucuccuccgcccagggccaggacgccgcccaguccgaggagaagcgcggcaucaccgcccgcgagcucuacuccuaccuccgcuccaccaagcccuga

SEQ ID NO: 41772 - RNA, 5316 nt, Artificial Sequence
  derived and/or modified sequence opt2 from CROCC__Homo_sapiens__XP_011540774
augaccuccugggacccccagaaccccgccggccucuggggccgcacccucggcauggagccccgcacccucgaguccuccguccucugccaggagaagggccucggcgcccgcgaccucgcccaggacgcccagaucaccucccuccccgcccucauccgcgagaucgucacccgcaaccucucccagcccgagucccccguccuccuccccgccaccgagauggccucccuccucucccuccaggaggagaaccagcuccuccagcaggagcucucccgcgucgaggaccuccucgcccagucccgcgccgagcgcgacgagcucgccaucaaguacaacgccgucuccgagcgccucgagcaggcccuccgccucgagcccggcgagcucgagacccaggagccccgcggccucguccgccaguccgucgagcuccgccgccagcuccaggaggagcaggccuccuaccgccgcaagcuccaggccuaccaggagggccagcagcgccaggcccagcucguccagcgccuccagggcaagauccuccaguacaagaagcgcugcuccgagcucgagcagcagcuccucgagcgcuccggcgagcucgagcagcagcgccuccgcgacaccgagcacucccaggaccucgaguccgcccucauccgccucgaggaggagcagcagcgcuccgccucccucgcccaggucaacgccaugcuccgcgagcagcucgaccaggccggcuccgccaaccaggcccucuccgaggacauccgcaaggucaccaacgacuggacccgcugccgcaaggagcucgagcaccgcgaggccgccuggcgccgcgaggaggaguccuucaacgccuacuucuccaacgagcacucccgccuccuccuccucuggcgccaggucgucggcuuccgccgccucgucuccgaggucaagauguucaccgagcgcgaccuccuccagcucggcggcgagcucgcccgcaccucccgcgccguccaggaggccggccucggccucuccaccggccuccgccucgccgagucccgcgccgaggccgcccucgagaagcaggcccuccuccaggcccagcucgaggagcagcuccgcgacaagguccuccgcgagaaggaccucgcccagcagcagaugcaguccgaccucgacaaggccgaccucuccgcccgcgucaccgagcucggccucgccgucaagcgccucgagaagcagaaccucgagaaggaccaggucaacaaggaccucaccgagaagcucgaggcccucgagucccuccgccuccaggagcaggccgcccucgagaccgaggacggcgagggccuccagcagacccuccgcgaccucgcccaggccguccucuccgacuccgaguccggcguccagcucuccggcuccgagcgcaccgccgacgccuccaacggcucccuccgcggccucuccggccagcgcacccccucccccccccgccgcuccucccccggccgcggccgcuccccccgccgcggccccucccccgccugcuccgacuccuccacccucgcccucauccacuccgcccuccacaagcgccagcuccagguccaggacaugcgcggccgcuacgaggccucccaggaccuccucggcacccuccgcaagcagcucuccgacuccgaguccgagcgccgcgcccucgaggagcagcuccagcgccuccgcgacaagaccgacggcgccaugcaggcccacgaggacgcccagcgcgagguccagcgccuccgcuccgccaacgagcuccucucccgcgagaaguccaaccucgcccacucccuccaggucgcccagcagcaggccgaggagcuccgccaggagcgcgagaagcuccaggccgcccaggaggagcuccgccgccagcgcgaccgccucgaggaggagcaggaggacgccguccaggacggcgcccgcguccgccgcgagcucgagcgcucccaccgccagcucgagcagcucgagggcaagcgcuccguccucgccaaggagcucgucgagguccgcgaggcccucucccgcgccacccuccagcgcgacaugcuccaggccgagaaggccgaggucgccgaggcccucaccaaggccgaggccggccgcgucgagcucgagcucuccaugaccaagcuccgcgccgaggaggccucccuccaggacucccucuccaagcucuccgcccucaacgagucccucgcccaggacaagcucgaccucaaccgccucgucgcccagcucgaggaggagaaguccgcccuccagggccgccagcgccaggccgagcaggaggccaccgucgcccgcgaggagcaggagcgccucgaggagcuccgccucgagcaggaggucgcccgccagggccucgagggcucccuccgcgucgccgagcaggcccaggaggcccucgagcagcagcuccccacccuccgccacgagcgcucccagcuccaggagcagcucgcccagcucucccgccagcucuccggccgcgagcaggagcucgagcaggcccgccgcgaggcccagcgccaggucgaggcccucgagcgcgccgcccgcgagaaggaggcccucgccaaggagcacgccggccucgccguccagcucgucgccgccgagcgcgagggccgcacccucuccgaggaggccacccgccuccgccucgagaaggaggcccucgagggcucccucuucgagguccagcgccagcucgcccagcucgaggcccgccgcgagcagcucgaggccgagggccaggcccuccuccucgccaaggagacccucaccggcgagcucgccggccuccgccagcagaucaucgccacccaggagaaggccucccucgacaaggagcucauggcccagaagcucguccaggccgagcgcgaggcccaggccucccuccgcgagcagcgcgccgcccacgaggaggaccuccagcgccuccagcgcgagaaggaggccgccuggcgcgagcucgaggccgagcgcgcccagcuccagucccagcuccagcgcgagcaggaggagcuccucgcccgccucgaggccgagaaggaggagcucuccgaggagaucgccgcccuccagcaggagcgcgacgagggccuccuccucgccgaguccgagaagcagcaggcccucucccucaaggaguccgagaagaccgcccucuccgagaagcucaugggcacccgccacucccucgccaccaucucccucgagauggagcgccagaagcgcgacgcccagucccgccaggagcaggaccgcuccaccgucaacgcccucaccuccgagcuccgcgaccuccgcgcccagcgcgaggaggccgccgccgcccacgcccaggagguccgccgccuccaggagcaggcccgcgaccucggcaagcagcgcgacuccugccuccgcgaggccgaggagcuccgcacccagcuccgccuccucgaggacgcccgcgacggccuccgccgcgagcuccucgaggcccagcgcaagcuccgcgagucccaggagggccgcgagguccagcgccaggaggccggcgagcuccgccgcucccucggcgagggcgccaaggagcgcgaggcccuccgccgcuccaacgaggagcuccgcuccgccgucaagaaggccgaguccgagcgcaucucccucaagcucgccaacgaggacaaggagcagaagcucgcccuccucgaggaggcccgcaccgccgucggcaaggaggccggcgagcuccgcaccggccuccaggaggucgagcgcucccgccucgaggcccgccgcgagcuccaggagcuccgccgccagaugaagaugcucgacuccgagaacacccgccucggccgcgagcucgccgagcuccagggccgccucgcccucggcgagcgcgccgagaaggagucccgccgcgagacccucggccuccgccagcgccuccucaagggcgaggccucccucgaggucaugcgccaggagcuccaggucgcccagcgcaagcuccaggagcaggagggcgaguuccgcacccgcgagcgccgccuccucggcucccucgaggaggcccgcggcaccgagaagcagcagcucgaccacgcccgcggccucgagcucaagcucgaggccgcccgcgccgaggccgccgagcucggccuccgccucuccgccgccgagggccgcgcccagggccucgaggccgagcucgcccgcgucgagguccagcgccgcgccgccgaggcccagcucggcggccuccgcuccgcccuccgccgcggccucggccucggccgcgcccccucccccgccccccgccccguccccggcucccccgcccgcgacgcccccgccgagggcuccggcgagggccucaacucccccuccacccucgagugcucccccggcucccagccccccucccccggccccgccaccucccccgccucccccgaccucgaccccgaggccguccgcggcgcccuccgcgaguuccuccaggagcuccgcuccgcccagcgcgagcgcgacgagcuccgcacccagaccuccgcccucaaccgccagcucgccgagauggaggccgagcgcgacuccgccaccucccgcgcccgccagcuccagaaggccgucgccgaguccgaggaggcccgccgcuccgucgacggccgccucuccggcguccaggccgagcucgcccuccaggaggaguccguccgccgcuccgagcgcgagcgccgcgccacccucgaccaggucgccacccucgagcgcucccuccaggccaccgaguccgagcuccgcgccucccaggagaagaucuccaagaugaaggccaacgagaccaagcucgagggcgacaagcgccgccucaaggagguccucgacgccuccgagucccgcaccgucaagcucgagcuccagcgccgcucccucgagggcgagcuccagcgcucccgccucggccucuccgaccgcgaggcccaggcccaggcccuccaggaccgcgucgacucccuccagcgccaggucgccgacuccgaggucaaggccggcacccuccagcucaccgucgagcgccucaacggcgcccucgccaaggucgaggaguccgagggcgcccuccgcgacaagguccgcggccucaccgaggcccucgcccaguccuccgccucccucaacuccacccgcgacaagaaccuccaccuccagaaggcccucaccgccugcgagcacgaccgccagguccuccagguccgcuga

SEQ ID NO: 41773 - RNA, 1923 nt, Artificial Sequence
  derived and/or modified sequence opt2 from CROT__Homo_sapiens__NP_001137407
auggagaaccagcucgccaaguccaccgaggagcgcaccuuccaguaccaggacucccuccccucccuccccguccccucccucgaggagucccucaagaaguaccucgaguccgucacccgcaccugcuaccagauccgcggccucgaccccgacgccaagcgcggcuuccucgaccucacccgcgagggcauccaggucaagcccuucgccaaccaggaggaguacaagaagaccgaggagaucguccagaaguuccaguccggcaucggcgagaagcuccaccagaagcuccucgagcgcgccaagggcaagcgcaacuggcucgaggagugguggcucaacgucgccuaccucgacguccgcauccccucccagcucaacgucaacuucgccggccccgccgcccacuucgagcacuacuggccccccaaggagggcacccagcucgagcgcggcuccaucacccucuggcacaaccucaacuacuggcagcuccuccgcaaggagaagguccccguccacaaggucggcaacaccccccucgacaugaaccaguuccgcaugcucuucuccaccugcaagguccccggcaucacccgcgacuccaucaugaacuacuuccgcaccgaguccgagggccgcucccccaaccacaucgucguccucugccgcggccgcgccuucgucuucgacgucauccacgagggcugccucgucaccccccccgagcuccuccgccagcucaccuacauccacaagaagugccacuccgagcccgacggccccggcaucgccgcccucaccuccgaggagcgcacccgcugggccaaggcccgcgaguaccucaucggccucgaccccgagaaccucgcccuccucgagaagauccaguccucccuccucgucuacuccauggaggacuccuccccccacgucacccccgaggacuacuccgagaucaucgccgccauccucaucggcgaccccaccguccgcuggggcgacaaguccuacaaccucaucuccuucuccaacggcgucuucggcugcaacugcgaccacgcccccuucgacgccaugaucauggucaacaucuccuacuacgucgacgagaagaucuuccagaacgagggccgcuggaagggcuccgagaagguccgcgacaucccccuccccgaggagcucaucuucaucgucgacgagaagguccucaacgacaucaaccaggccaaggcccaguaccuccgcgaggccuccgaccuccagaucgccgccuacgccuucaccuccuucggcaagaagcucaccaagaacaagaugcuccaccccgacaccuucauccagcucgcccuccagcucgccuacuaccgccuccacggccaccccggcugcugcuacgagaccgccaugacccgccacuucuaccacggccgcaccgagaccaugcgcuccugcaccgucgaggccguccgcuggugccaguccaugcaggaccccuccgucaaccuccgcgagcgccagcagaagaugcuccaggccuucgccaagcacaacaagaugaugaaggacugcuccgccggcaagggcuucgaccgccaccuccucggccuccuccucaucgccaaggaggagggccuccccguccccgagcucuucaccgacccccucuucuccaaguccggcggcggcggcaacuucguccucuccaccucccucgucggcuaccuccgcguccagggcgucgucguccccaugguccacaacggcuacggcuucuucuaccacauccgcgacgaccgcuucgucgucgccugcuccgccuggaaguccugccccgagaccgacgccgagaagcucguccagcucaccuucugcgccuuccacgacaugauccagcucaugaacuccacccaccucuga

SEQ ID NO: 41774 - RNA, 675 nt, Artificial Sequence
  derived and/or modified sequence opt2 from CRP__Homo_sapiens__XP_011507509
auggagaagcuccucugcuuccucguccucaccucccucucccacgccuucggccagaccgacaugucccgcaaggccuucgucuuccccaaggaguccgacaccuccuacgucucccucaaggccccccucaccaagccccucaaggccuucaccgucugccuccacuucuacaccgagcucuccuccacccgcggcuacuccaucuucuccuacgccaccaagcgccaggacaacgagauccucaucuucugguccaaggacaucggcuacuccuucaccgucggcggcuccgagauccucuucgagguccccgaggucaccgucgcccccguccacaucugcaccuccugggaguccgccuccggcaucgucgaguucugggucgacggcaagccccgcguccgcaagucccucaagaagggcuacaccgucggcgccgaggccuccaucauccucggccaggagcaggacuccuucggcggcaacuucgagggcucccagucccucgucggcgacaucggcaacgucaacaugugggacuucguccucucccccgacgagaucaacaccaucuaccucggcggccccuucucccccaacguccucaacuggcgcgcccucaaguacgagguccagggcgaggucuucaccaagccccagcucuggcccuga

SEQ ID NO: 41775 - RNA, 1938 nt, Artificial Sequence
  derived and/or modified sequence opt2 from CRTAC1__Homo_sapiens__NP_001193457
auggcccccuccgccgaccccggcaugucccgcaugcuccccuuccuccuccuccucugguuccuccccaucaccgagggcucccagcgcgccgagcccauguucaccgccgucaccaacuccguccucccccccgacuacgacuccaaccccacccagcucaacuacggcgucgccgucaccgacgucgaccacgacggcgacuucgagaucgucgucgccggcuacaacggccccaaccucguccucaaguacgaccgcgcccagaagcgccucgucaacaucgccgucgacgagcgcuccucccccuacuacgcccuccgcgaccgccagggcaacgccaucggcgucaccgccugcgacaucgacggcgacggccgcgaggagaucuacuuccucaacaccaacaacgccuucuccggcgucgccaccuacaccgacaagcucuucaaguuccgcaacaaccgcugggaggacauccucuccgacgaggucaacgucgcccgcggcgucgccucccucuucgccggccgcuccgucgccugcgucgaccgcaagggcuccggccgcuacuccaucuacaucgccaacuacgccuacggcaacgucggccccgacgcccucaucgagauggaccccgaggccuccgaccucucccgcggcauccucgcccuccgcgacgucgccgccgaggccggcgucuccaaguacaccggcggccgcggcgucuccgucggccccauccucuccuccuccgccuccgacaucuucugcgacaacgagaacggccccaacuuccucuuccacaaccgcggcgacggcaccuucgucgacgccgccgccuccgccggcgucgacgacccccaccagcacggccgcggcgucgcccucgccgacuucaaccgcgacggcaaggucgacaucgucuacggcaacuggaacggcccccaccgccucuaccuccagauguccacccacggcaagguccgcuuccgcgacaucgccucccccaaguucuccaugcccucccccguccgcaccgucaucaccgccgacuucgacaacgaccaggagcucgagaucuucuucaacaacaucgccuaccgcuccuccuccgccaaccgccucuuccgcgucauccgccgcgagcacggcgacccccucaucgaggagcucaaccccggcgacgcccucgagcccgagggccgcggcaccggcggcgucgucaccgacuucgacggcgacggcaugcucgaccucauccucucccacggcgaguccauggcccagccccucuccgucuuccgcggcaaccagggcuucaacaacaacuggcuccgcgucgucccccgcacccgcuucggcgccuucgcccgcggcgccaaggucguccucuacaccaagaaguccggcgcccaccuccgcaucaucgacggcggcuccggcuaccucugcgagauggagcccgucgcccacuucggccucggcaaggacgaggccuccuccgucgaggucaccuggcccgacggcaagauggucucccgcaacgucgccuccggcgagaugaacuccguccucgagauccucuacccccgcgacgaggacacccuccaggaccccgccccccucgagugcggccagggcuucucccagcaggagaacggccacugcauggacaccaacgagugcauccaguuccccuucgucugcccccgcgacaagcccgucugcgucaacaccuacggcuccuaccgcugccgcaccaacaagaagugcucccgcggcuacgagcccaacgaggacggcaccgccugcgucgcccaggucgccuuccucggcggcuacuccuccgccgccucccgcaucuccgagccccucucccgcgccuccuaccucucccucggccucggccucugccuccagcucuacgcccucuga

SEQ ID NO: 41776 - RNA, 585 nt, Artificial Sequence
  derived and/or modified sequence opt2 from CRTAM__Homo_sapiens__NP_001291711
augugggucaagcuccucuccaucgucgccgaguucugcuucucccccuuccucgucaccgacgaggagaccgccuccgacgcccucgagcgcaacucccucuccucccaggacccccagcagcccaccuccaccgucuccgucaccgaggacuccuccaccuccgagaucgacaaggaggagaaggagcagaccacccaggaccccgaccucaccaccgaggccaacccccaguaccucggccucgcccgcaagaaguccggcauccuccuccucacccucgucuccuuccucaucuucauccucuucaucaucguccagcucuucaucaugaagcuccgcaaggcccacgucaucuggaagaaggagaacgaggucuccgagcacacccucgaguccuaccgcucccgcuccaacaacgaggagaccuccuccgaggagaagaacggccaguccucccaccccaugcgcugcaugaacuacaucaccaagcucuacuccgaggccaagaccaagcgcaaggagaacguccagcacuccaagcucgaggagaagcacauccagguccccgaguccaucgucuga

SEQ ID NO: 41777 - RNA, 1206 nt, Artificial Sequence
  derived and/or modified sequence opt2 from CRTAP__Homo_sapiens__NP_006362
auggagcccggccgccgcggcgccgccgcccuccucgcccuccucugcgucgccugcgcccuccgcgccggccgcgcccaguacgagcgcuacuccuuccgcuccuucccccgcgacgagcucaugccccucgaguccgccuaccgccacgcccucgacaaguacuccggcgagcacugggccgaguccgucggcuaccucgagaucucccuccgccuccaccgccuccuccgcgacuccgaggccuucugccaccgcaacugcuccgccgccccccagcccgagcccgccgccggccucgccuccuaccccgagcuccgccucuucggcggccuccuccgccgcgcccacugccucaagcgcugcaagcagggccuccccgccuuccgccagucccagcccucccgcgagguccucgccgacuuccagcgccgcgagcccuacaaguuccuccaguucgccuacuucaaggccaacaaccuccccaaggccaucgccgccgcccacaccuuccuccucaagcaccccgacgacgagaugaugaagcgcaacauggccuacuacaagucccuccccggcgccgaggacuacaucaaggaccucgagaccaaguccuacgagucccucuucauccgcgccguccgcgccuacaacggcgagaacuggcgcaccuccaucaccgacauggagcucgcccuccccgacuucuucaaggccuucuacgagugccucgccgccugcgagggcucccgcgagaucaaggacuucaaggacuucuaccucuccaucgccgaccacuacgucgagguccucgagugcaagauccagugcgaggagaaccucacccccgucaucggcggcuaccccgucgagaaguucgucgccaccauguaccacuaccuccaguucgccuacuacaagcucaacgaccucaagaacgccgcccccugcgccgucuccuaccuccucuucgaccagaacgacaaggucaugcagcagaaccucgucuacuaccaguaccaccgcgacaccuggggccucuccgacgagcacuuccagccccgccccgaggccguccaguucuucaacgucaccacccuccagaaggagcucuacgacuucgccaaggagaacaucauggacgacgacgagggcgaggucgucgaguacgucgacgaccuccucgagcucgaggagaccuccuga

SEQ ID NO: 41778 - RNA, 1953 nt, Artificial Sequence
  derived and/or modified sequence opt2 from CRTC1__Homo_sapiens__NP_001091952
auggccaccuccaacaacccccgcaaguucuccgagaagaucgcccuccacaaccagaagcaggccgaggagaccgccgccuucgaggaggucaugaaggaccucucccucacccgcgccgcccgccuccagcuccagaagucccaguaccuccagcucggccccucccgcggccaguacuacggcggcucccuccccaacgucaaccagaucggcuccggcaccauggaccuccccuuccagcccuccggcuuccucggcgaggcccucgccgccgcccccgucucccucacccccuuccaguccuccggccucgacaccucccgcaccacccgccaccacggccucgucgaccgcgucuaccgcgagcgcggccgccucggcuccccccaccgccgcccccucuccgucgacaagcacggccgccaggccgacuccugccccuacggcaccauguaccucuccccccccgccgacaccuccuggcgccgcaccaacuccgacuccgcccuccaccaguccaccaugacccccacccagcccgaguccuucuccuccggcucccaggacguccaccagaagcgcguccuccuccucaccguccccggcauggaggagaccaccuccgaggccgacaagaaccucuccaagcaggccugggacaccaagaagaccggcucccgccccaaguccugcgagguccccggcaucaacaucuuccccuccgccgaccaggagaacaccaccgcccucauccccgccacccacaacaccggcggcucccuccccgaccucaccaacauccacuuccccuccccccuccccaccccccucgaccccgaggagcccaccuuccccgcccucuccuccuccuccuccaccggcaaccucgccgccaaccucacccaccucggcaucggcggcgccggccagggcauguccacccccggcuccuccccccagcaccgccccgccggcgucuccccccucucccucuccaccgaggcccgccgccagcaggccucccccacccucuccccccucucccccaucacccaggccgucgccauggacgcccucucccucgagcagcagcuccccuacgccuucuucacccaggccggcucccagcagccccccccccagccccagcccccccccccccccccccccgccucccagcagccccccccccccccccccccccaggcccccguccgccucccccccggcggcccccuccuccccuccgccucccucacccgcggcccccagccccccccccucgccgucaccguccccuccucccucccccaguccccccccgagaaccccggccagcccuccaugggcaucgacaucgccuccgcccccgcccuccagcaguaccgcaccuccgccggcucccccgccaaccagucccccaccucccccgucuccaaccagggcuucucccccggcuccuccccccagcacaccuccacccucggcuccgucuucggcgacgccuacuacgagcagcagauggccgcccgccaggccaacgcccucucccaccagcucgagcaguucaacaugauggagaacgccaucuccuccuccucccucuacucccccggcuccacccucaacuacucccaggccgccaugaugggccucaccggcucccacggcucccuccccgacucccagcagcucggcuacgccucccacuccggcauccccaacaucauccucaccgucaccggcgaguccccccccucccucuccaaggagcucaccuccucccucgccggcgucggcgacgucuccuucgacuccgacucccaguucccccucgacgagcucaagaucgacccccucacccucgacggccuccacaugcucaacgaccccgacaugguccucgccgaccccgccaccgaggacaccuuccgcauggaccgccucuga

SEQ ID NO: 41779 - RNA, 2082 nt, Artificial Sequence
  derived and/or modified sequence opt2 from CRTC2__Homo_sapiens__NP_859066
auggccaccuccggcgccaacggccccggcuccgccaccgccuccgccuccaacccccgcaaguucuccgagaagaucgcccuccagaagcagcgccaggccgaggagaccgccgccuucgaggaggucaugauggacaucggcuccacccgccuccaggcccagaagcuccgccucgccuacacccgcuccucccacuacggcggcucccuccccaacgucaaccagaucggcuccggccucgccgaguuccaguccccccuccacuccccccucgacuccucccgcuccacccgccaccacggccucgucgagcgcguccagcgcgacccccgccgcauggucuccccccuccgccgcuacacccgccacaucgacuccucccccuacucccccgccuaccucucccccccccccgaguccuccuggcgccgcaccauggccuggggcaacuuccccgccgagaagggccagcucuuccgccuccccuccgcccucaaccgcaccuccuccgacuccgcccuccacaccuccgucaugaaccccuccccccaggacaccuaccccggccccaccccccccuccauccuccccucccgccgcggcggcauccucgacggcgagauggaccccaagguccccgccaucgaggagaaccuccucgacgacaagcaccuccucaagcccugggacgccaagaagcucuccuccuccuccucccgcccccgcuccugcgagguccccggcaucaacaucuuccccucccccgaccagcccgccaacguccccguccucccccccgccaugaacaccggcggcucccuccccgaccucaccaaccuccacuucccccccccccuccccaccccccucgaccccgaggagaccgccuaccccucccucuccggcggcaacuccaccuccaaccucacccacaccaugacccaccucggcaucucccgcggcaugggccucggccccggcuacgacgcccccggccuccacuccccccucucccaccccucccuccaguccucccucuccaaccccaaccuccaggccucccucuccuccccccagccccagcuccagggcucccacucccaccccucccuccccgccuccucccucgcccgccacguccuccccaccaccucccucggccaccccucccucuccgcccccgcccucuccuccuccuccuccuccuccuccaccuccucccccguccucggcgcccccuccuaccccgccuccacccccggcgccuccccccaccaccgccgcgucccccucuccccccucucccuccucgccggccccgccgacgcccgccgcucccagcagcagcuccccaagcaguucucccccaccaugucccccacccucuccuccaucacccagggcgucccccucgacaccuccaagcucuccaccgaccagcgccucccccccuaccccuacuccucccccucccucguccuccccacccagccccacacccccaagucccuccagcagcccggccuccccucccaguccugcuccguccaguccuccggcggccagccccccggccgccagucccacuacggcacccccuacccccccggccccuccggccacggccagcaguccuaccaccgccccauguccgacuucaaccucggcaaccucgagcaguucuccauggagucccccuccgccucccucguccucgacccccccggcuucuccgagggccccggcuuccucggcggcgagggccccaugggcggcccccaggacccccacaccuucaaccaccagaaccucacccacugcucccgccacggcuccggccccaacaucauccucaccggcgacuccucccccggcuucuccaaggagaucgccgccgcccucgccggcguccccggcuucgaggucuccgccgccggccucgagcucggccucggccucgaggacgagcuccgcauggagccccucggccucgagggccucaacaugcucuccgaccccugcgcccuccuccccgaccccgccgucgaggaguccuuccgcuccgaccgccuccaguga

SEQ ID NO: 41780 - RNA, 1857 nt, Artificial Sequence
  derived and/or modified sequence opt2 from CRTC3__Homo_sapiens__NP_001036039
auggccgccucccccggcuccggcuccgccaacccccgcaaguucuccgagaagaucgcccuccacacccagcgccaggccgaggagacccgcgccuucgagcagcucaugaccgaccucacccucucccgcguccaguuccagaagcuccagcagcuccgccucacccaguaccacggcggcucccuccccaacgucucccagcuccgcuccuccgccuccgaguuccagcccuccuuccaccaggccgacaacguccgcggcacccgccaccacggccucgucgagcgccccucccgcaaccgcuuccacccccuccaccgccgcuccggcgacaagcccggccgccaguucgacggcuccgccuucggcgccaacuacuccucccagccccucgacgaguccuggccccgccagcagccccccuggaaggacgagaagcaccccggcuuccgccucaccuccgcccucaaccgcaccaacuccgacuccgcccuccacaccuccgcccucuccaccaagccccaggaccccuacggcggcggcggccaguccgccuggcccgcccccuacaugggcuucugcgacggcgagaacaacggccacggcgaggucgccuccuuccccggcccccucaaggaggagaaccuccucaacguccccaagccccuccccaagcagcucugggagaccaaggagauccagucccucuccggccgcccccgcuccugcgacgucggcggcggcaacgccuucccccacaacggccagaaccucggccucucccccuuccucggcacccucaacaccggcggcucccuccccgaccucaccaaccuccacuacuccaccccccuccccgccucccucgacaccaccgaccaccacuucggcuccauguccgucggcaacuccgucaacaacauccccgccgccaugacccaccucggcauccgcuccuccuccggccuccaguccucccgcuccaaccccuccauccaggccacccucaacaagaccguccucuccuccucccucaacaaccacccccagaccuccguccccaacgccuccgcccuccaccccucccuccgccucuucucccucuccaaccccucccucuccaccaccaaccucuccggccccucccgccgccgccagccccccgucuccccccucacccucucccccggccccgaggcccaccagggcuucucccgccagcucuccuccaccuccccccucgcccccuaccccaccucccagauggucuccuccgaccgcucccagcucuccuuccuccccaccgaggcccaggcccaggucuccccccccccccccuaccccgccccccaggagcucacccagccccuccuccagcagccccgcgcccccgaggcccccgcccagcagccccaggccgccuccucccucccccaguccgacuuccagcuccuccccgcccagggcuccucccucaccaacuucuuccccgacgucggcuucgaccagcaguccaugcgccccggccccgccuucccccagcaggucccccucguccagcagggcucccgcgagcuccaggacuccuuccaccuccgccccucccccuacuccaacugcggcucccuccccaacaccauccuccccgacuccuccaccucccucuucaaggaccucaacuccgcccucgccggccuccccgaggucucccucaacgucgacacccccuucccccucgaggaggagcuccagaucgagccccucucccucgacggccucaacaugcucuccgacuccuccaugggccuccucgaccccuccgucgaggagaccuuccgcgccgaccgccucuga

SEQ ID NO: 41781 - RNA, 900 nt, Artificial Sequence
  derived and/or modified sequence opt2 from CRX__Homo_sapiens__NP_000545
augauggccuacaugaaccccggcccccacuacuccgucaacgcccucgcccucuccggccccuccgucgaccucaugcaccaggccguccccuaccccuccgccccccgcaagcagcgccgcgagcgcaccaccuucacccgcucccagcucgaggagcucgaggcccucuucgccaagacccaguaccccgacgucuacgcccgcgaggaggucgcccucaagaucaaccuccccgagucccgcguccaggucugguucaagaaccgccgcgccaagugccgccagcagcgccagcagcagaagcagcagcagcagccccccggcggccaggccaaggcccgccccgccaagcgcaaggccggcaccuccccccgccccuccaccgacgucugccccgacccccucggcaucuccgacuccuacucccccccccuccccggccccuccggcucccccaccaccgccgucgccaccgucuccaucuggucccccgccuccgaguccccccuccccgaggcccagcgcgccggccucgucgccuccggccccucccucaccuccgcccccuacgccaugaccuacgcccccgccuccgccuucugcuccucccccuccgccuacggcucccccuccuccuacuucuccggccucgaccccuaccucucccccauggucccccagcucggcggccccgcccucuccccccucuccggccccuccgucggccccucccucgcccagucccccaccucccucuccggccaguccuacggcgccuacucccccgucgacucccucgaguucaaggaccccaccggcaccuggaaguucaccuacaaccccauggacccccucgacuacaaggaccaguccgccuggaaguuccagauccucuga

SEQ ID NO: 41782 - RNA, 1761 nt, Artificial Sequence
  derived and/or modified sequence opt2 from CRY1__Homo_sapiens__NP_004066
augggcgucaacgccguccacugguuccgcaagggccuccgccuccacgacaaccccgcccucaaggagugcauccagggcgccgacaccauccgcugcgucuacauccucgaccccugguucgccggcuccuccaacgucggcaucaaccgcuggcgcuuccuccuccagugccucgaggaccucgacgccaaccuccgcaagcucaacucccgccucuucgucauccgcggccagcccgccgacgucuucccccgccucuucaaggaguggaacaucaccaagcucuccaucgaguacgacuccgagcccuucggcaaggagcgcgacgccgccaucaagaagcucgccaccgaggccggcgucgaggucaucguccgcaucucccacacccucuacgaccucgacaagaucaucgagcucaacggcggccagcccccccucaccuacaagcgcuuccagacccucaucuccaagauggagccccucgagauccccgucgagaccaucaccuccgaggucaucgagaagugcaccaccccccucuccgacgaccacgacgagaaguacggcguccccucccucgaggagcucggcuucgacaccgacggccucuccuccgccgucuggcccggcggcgagaccgaggcccucacccgccucgagcgccaccucgagcgcaaggccugggucgccaacuucgagcgcccccgcaugaacgccaacucccuccucgccucccccaccggccucucccccuaccuccgcuucggcugccucuccugccgccucuucuacuucaagcucaccgaccucuacaagaaggucaagaagaacuccucccccccccucucccucuacggccagcuccucuggcgcgaguucuucuacaccgccgccaccaacaacccccgcuucgacaagauggagggcaaccccaucugcguccagauccccugggacaagaaccccgaggcccucgccaagugggccgagggccgcaccggcuuccccuggaucgacgccaucaugacccagcuccgccaggagggcuggauccaccaccucgcccgccacgccgucgccugcuuccucacccgcggcgaccucuggaucuccugggaggagggcaugaaggucuucgaggagcuccuccucgacgccgacugguccaucaacgccggcuccuggauguggcucuccugcuccuccuucuuccagcaguucuuccacugcuacugccccgucggcuucggccgccgcaccgaccccaacggcgacuacauccgccgcuaccuccccguccuccgcggcuuccccgccaaguacaucuacgaccccuggaacgcccccgagggcauccagaaggucgccaagugccucaucggcgucaacuaccccaagcccauggucaaccacgccgaggccucccgccucaacaucgagcgcaugaagcagaucuaccagcagcucucccgcuaccgcggccucggccuccucgccuccguccccuccaaccccaacggcaacggcggcuucaugggcuacuccgccgagaacauccccggcugcuccuccuccggcuccugcucccagggcuccggcauccuccacuacgcccacggcgacucccagcagacccaccuccucaagcagggccgcuccuccaugggcaccggccucuccggcggcaagcgccccucccaggaggaggacacccaguccaucggccccaagguccagcgccaguccaccaacuga

SEQ ID NO: 41783 - RNA, 1599 nt, Artificial Sequence
  derived and/or modified sequence opt2 from CRY2__Homo_sapiens__NP_001120929
augcccgccccccccggccgcacccacaccugguuccuccuccagucccucgaggaccucgacaccucccuccgcaagcucaacucccgccucuucgucguccgcggccagcccgccgacgucuucccccgccucuucaaggaguggggcgucacccgccucaccuucgaguacgacuccgagcccuucggcaaggagcgcgacgccgccaucaugaagauggccaaggaggccggcgucgaggucgucaccgagaacucccacacccucuacgaccucgaccgcaucaucgagcucaacggccagaagcccccccucaccuacaagcgcuuccaggccaucaucucccgcauggagcuccccaagaagcccgucggccucgucaccucccagcagauggaguccugccgcgccgagauccaggagaaccacgacgagaccuacggcguccccucccucgaggagcucggcuuccccaccgagggccucggccccgccgucuggcagggcggcgagaccgaggcccucgcccgccucgacaagcaccucgagcgcaaggccugggucgccaacuacgagcgcccccgcaugaacgccaacucccuccucgccucccccaccggccucucccccuaccuccgcuucggcugccucuccugccgccucuucuacuaccgccucugggaccucuacaagaaggucaagcgcaacuccacccccccccucucccucuucggccagcuccucuggcgcgaguucuucuacaccgccgccaccaacaacccccgcuucgaccgcauggagggcaaccccaucugcauccagauccccugggaccgcaaccccgaggcccucgccaagugggccgagggcaagaccggcuuccccuggaucgacgccaucaugacccagcuccgccaggagggcuggauccaccaccucgcccgccacgccgucgccugcuuccucacccgcggcgaccucugggucuccugggaguccggcguccgcgucuucgacgagcuccuccucgacgccgacuucuccgucaacgccggcuccuggauguggcucuccugcuccgccuucuuccagcaguucuuccacugcuacugccccgucggcuucggccgccgcaccgaccccuccggcgacuacauccgccgcuaccuccccaagcucaaggccuuccccucccgcuacaucuacgagcccuggaacgcccccgaguccauccagaaggccgccaagugcaucaucggcgucgacuacccccgccccaucgucaaccacgccgagaccucccgccucaacaucgagcgcaugaagcagaucuaccagcagcucucccgcuaccgcggccucugccuccucgccuccguccccuccugcgucgaggaccucucccaccccgucgccgagcccuccuccucccaggccggcuccauguccuccgccggcccccgcccccuccccuccggccccgccucccccaagcgcaagcucgaggccgccgaggagccccccggcgaggagcucuccaagcgcgcccgcgucgccgagcuccccacccccgagcuccccuccaaggacgccuga

SEQ ID NO: 41784 - RNA, 528 nt, Artificial Sequence
  derived and/or modified sequence opt2 from CRYAB__Homo_sapiens__NP_001276737
auggacaucgccauccaccaccccuggauccgccgccccuucuuccccuuccacucccccucccgccucuucgaccaguucuucggcgagcaccuccucgaguccgaccucuuccccaccuccaccucccucucccccuucuaccuccgcccccccuccuuccuccgcgcccccuccugguucgacaccggccucuccgagaugcgccucgagaaggaccgcuucuccgucaaccucgacgucaagcacuucucccccgaggagcucaaggucaagguccucggcgacgucaucgagguccacggcaagcacgaggagcgccaggacgagcacggcuucaucucccgcgaguuccaccgcaaguaccgcauccccgccgacgucgacccccucaccaucaccuccucccucuccuccgacggcguccucaccgucaacggcccccgcaagcaggucuccggccccgagcgcaccauccccaucacccgcgaggagaagcccgccgucaccgccgcccccaagaaguga

SEQ ID NO: 41785 - RNA, 648 nt, Artificial Sequence
  derived and/or modified sequence opt2 from CRYBA1__Homo_sapiens__NP_005199
auggagacccaggccgagcagcaggagcucgagacccuccccaccaccaagauggcccagaccaaccccacccccggcucccucggccccuggaagaucaccaucuacgaccaggagaacuuccagggcaagcgcauggaguucaccuccuccugccccaacgucuccgagcgcuccuucgacaacguccgcucccucaaggucgaguccggcgccuggaucggcuacgagcacaccuccuucugcggccagcaguucauccucgagcgcggcgaguacccccgcugggacgccugguccggcuccaacgccuaccacaucgagcgccucauguccuuccgccccaucugcuccgccaaccacaaggaguccaagaugaccaucuucgagaaggagaacuucaucggccgccagugggagaucuccgacgacuaccccucccuccaggccaugggcugguucaacaacgaggucggcuccaugaagauccaguccggcgccugggucugcuaccaguaccccggcuaccgcggcuaccaguacauccucgagugcgaccaccacggcggcgacuacaagcacuggcgcgaguggggcucccacgcccagaccucccagauccaguccauccgccgcauccagcaguga

SEQ ID NO: 41786 - RNA, 594 nt, Artificial Sequence
  derived and/or modified sequence opt2 from CRYBA2__Homo_sapiens__NP_476434
auguccuccgcccccgcccccggccccgcccccgccucccucacccucugggacgaggaggacuuccagggccgccgcugccgccuccucuccgacugcgccaacgucugcgagcgcggcggccucccccgcguccgcuccgucaaggucgagaacggcgucugggucgccuucgaguaccccgacuuccagggccagcaguucauccucgagaagggcgacuacccccgcugguccgccugguccggcuccuccucccacaacuccaaccagcuccucuccuuccgccccguccucugcgccaaccacaacgacucccgcgucacccucuucgagggcgacaacuuccagggcugcaaguucgaccucgucgacgacuaccccucccuccccuccaugggcugggccuccaaggacgucggcucccucaaggucuccuccggcgccugggucgccuaccaguaccccggcuaccgcggcuaccaguacguccucgagcgcgaccgccacuccggcgaguucugcaccuacggcgagcucggcacccaggcccacaccggccagcuccaguccauccgccgcguccagcacuga

SEQ ID NO: 41787 - RNA, 591 nt, Artificial Sequence
  derived and/or modified sequence opt2 from CRYBA4__Homo_sapiens__NP_001877
augacccuccagugcaccaaguccgccggccccuggaagauggucgucugggacgaggacggcuuccagggccgccgccacgaguucaccgccgagugccccuccguccucgagcucggcuucgagaccguccgcucccucaagguccucuccggcgccugggucggcuucgagcacgccggcuuccagggccagcaguacauccucgagcgcggcgaguaccccuccugggacgccuggggcggcaacaccgccuaccccgccgagcgccucaccuccuuccgccccgccgccugcgccaaccaccgcgacucccgccucaccaucuucgagcaggagaacuuccucggcaagaagggcgagcucuccgacgacuaccccucccuccaggccaugggcugggagggcaacgaggucggcuccuuccacguccacuccggcgccugggucugcucccaguuccccggcuaccgcggcuuccaguacguccucgagugcgaccaccacuccggcgacuacaagcacuuccgcgaguggggcucccacgcccccaccuuccagguccaguccauccgccgcauccagcaguga

SEQ ID NO: 41788 - RNA, 759 nt, Artificial Sequence
  derived and/or modified sequence opt2 from CRYBB1__Homo_sapiens__NP_001878
augucccaggccgccaaggccuccgccuccgccaccgucgccgucaaccccggccccgacaccaagggcaagggcgccccccccgccggcaccucccccucccccggcaccacccucgcccccaccaccguccccaucaccuccgccaaggccgccgagcucccccccggcaacuaccgccucgucgucuucgagcucgagaacuuccagggccgccgcgccgaguucuccggcgagugcuccaaccucgccgaccgcggcuucgaccgcguccgcuccaucaucgucuccgccggccccugggucgccuucgagcaguccaacuuccgcggcgagauguucauccucgagaagggcgaguacccccgcuggaacaccugguccuccuccuaccgcuccgaccgccucauguccuuccgccccaucaagauggacgcccaggagcacaagaucucccucuucgagggcgccaacuucaagggcaacaccaucgagauccagggcgacgacgcccccucccucugggucuacggcuucuccgaccgcgucggcuccgucaaggucuccuccggcaccugggucggcuaccaguaccccggcuaccgcggcuaccaguaccuccucgagcccggcgacuuccgccacuggaacgaguggggcgccuuccagccccagaugcagucccuccgccgccuccgcgacaagcaguggcaccucgagggcuccuuccccguccucgccaccgagccccccaaguga

SEQ ID NO: 41789 - RNA, 618 nt, Artificial Sequence
  derived and/or modified sequence opt2 from CRYBB2__Homo_sapiens__NP_000487
auggccuccgaccaccagacccaggccggcaagccccagucccucaaccccaagaucaucaucuucgagcaggagaacuuccagggccacucccacgagcucaacggccccugccccaaccucaaggagaccggcgucgagaaggccggcuccguccucguccaggccggccccugggucggcuacgagcaggccaacugcaagggcgagcaguucgucuucgagaagggcgaguacccccgcugggacuccuggaccuccucccgccgcaccgacucccucuccucccuccgccccaucaaggucgacucccaggagcacaagaucauccucuacgagaaccccaacuucaccggcaagaagauggagaucaucgacgacgacguccccuccuuccacgcccacggcuaccaggagaaggucuccuccguccgcguccaguccggcaccugggucggcuaccaguaccccggcuaccgcggccuccaguaccuccucgagaagggcgacuacaaggacuccuccgacuucggcgccccccacccccagguccaguccguccgccgcauccgcgacaugcaguggcaccagcgcggcgccuuccaccccuccaacuga

SEQ ID NO: 41790 - RNA, 636 nt, Artificial Sequence
  derived and/or modified sequence opt2 from CRYBB3__Homo_sapiens__NP_004067
auggccgagcagcacggcgcccccgagcaggccgccgccggcaagucccacggcgaccucggcggcuccuacaaggucauccucuacgagcucgagaacuuccagggcaagcgcugcgagcucuccgccgagugccccucccucaccgacucccuccucgagaaggucggcuccauccaggucgaguccggccccuggcucgccuucgagucccgcgccuuccgcggcgagcaguucguccucgagaagggcgacuacccccgcugggacgccugguccaacucccgcgacuccgacucccuccucucccuccgcccccucaacaucgacuccccccaccacaagcuccaccucuucgagaaccccgccuucuccggccgcaagauggagaucgucgacgacgacguccccucccucugggcccacggcuuccaggaccgcgucgccuccguccgcgccaucaacggcaccugggucggcuacgaguuccccggcuaccgcggccgccaguacgucuucgagcgcggcgaguaccgccacuggaacgagugggacgccucccagccccagcuccaguccguccgccgcauccgcgaccagaaguggcacaagcgcggccgcuuccccuccuccuga

SEQ ID NO: 41791 - RNA, 528 nt, Artificial Sequence
  derived and/or modified sequence opt2 from CRYGB__Homo_sapiens__NP_005201
augggcaagaucaccuucuacgaggaccgcgccuuccagggccgcuccuacgagugcaccaccgacugccccaaccuccagcccuacuucucccgcugcaacuccauccgcgucgaguccggcugcuggaugaucuacgagcgccccaacuaccagggccaccaguacuuccuccgccgcggcgaguaccccgacuaccagcaguggaugggccucuccgacuccauccgcuccugcugccucauccccccccacuccggcgccuaccgcaugaagaucuacgaccgcgacgagcuccgcggccagauguccgagcucaccgacgacugcaucuccguccaggaccgcuuccaccucaccgagauccacucccucaacguccucgagggcuccuggauccucuacgagaugcccaacuaccgcggccgccaguaccuccuccgccccggcgaguaccgccgcuuccucgacuggggcgcccccaacgccaaggucggcucccuccgccgcgucauggaccucuacuga

SEQ ID NO: 41792 - RNA, 525 nt, Artificial Sequence
  derived and/or modified sequence opt2 from CRYGC__Homo_sapiens__NP_066269
augggcaagaucaccuucuacgaggaccgcgccuuccagggccgcuccuacgagaccaccaccgacugccccaaccuccagcccuacuucucccgcugcaacuccauccgcgucgaguccggcugcuggaugcucuacgagcgccccaacuaccagggccagcaguaccuccuccgccgcggcgaguaccccgacuaccagcaguggaugggccucuccgacuccauccgcuccugcugccucaucccccagaccgucucccaccgccuccgccucuacgagcgcgaggaccacaagggccucaugauggagcucuccgaggacugccccuccauccaggaccgcuuccaccucuccgagauccgcucccuccacguccucgagggcugcuggguccucuacgagcuccccaacuaccgcggccgccaguaccuccuccgcccccaggaguaccgccgcugccaggacuggggcgccauggacgccaaggccggcucccuccgccgcgucgucgaccucuacuga

SEQ ID NO: 41793 - RNA, 525 nt, Artificial Sequence
  derived and/or modified sequence opt2 from CRYGD__Homo_sapiens__NP_008822
augggcaagaucacccucuacgaggaccgcggcuuccagggccgccacuacgagugcuccuccgaccaccccaaccuccagcccuaccucucccgcugcaacuccgcccgcgucgacuccggcugcuggaugcucuacgagcagcccaacuacuccggccuccaguacuuccuccgccgcggcgacuacgccgaccaccagcaguggaugggccucuccgacuccguccgcuccugccgccucaucccccacuccggcucccaccgcauccgccucuacgagcgcgaggacuaccgcggccagaugaucgaguucaccgaggacugcuccugccuccaggaccgcuuccgcuucaacgagauccacucccucaacguccucgagggcuccuggguccucuacgagcucuccaacuaccgcggccgccaguaccuccucaugcccggcgacuaccgccgcuaccaggacuggggcgccaccaacgcccgcgucggcucccuccgccgcgucaucgacuucuccuga

SEQ ID NO: 41794 - RNA, 537 nt, Artificial Sequence
  derived and/or modified sequence opt2 from CRYGS__Homo_sapiens__NP_060011
auguccaagaccggcaccaagaucaccuucuacgaggacaagaacuuccagggccgccgcuacgacugcgacugcgacugcgccgacuuccacaccuaccucucccgcugcaacuccaucaaggucgagggcggcaccugggccgucuacgagcgccccaacuucgccggcuacauguacauccucccccagggcgaguaccccgaguaccagcgcuggaugggccucaacgaccgccucuccuccugccgcgccguccaccuccccuccggcggccaguacaagauccagaucuucgagaagggcgacuucuccggccagauguacgagaccaccgaggacugccccuccaucauggagcaguuccacaugcgcgagauccacuccugcaagguccucgagggcgucuggaucuucuacgagcuccccaacuaccgcggccgccaguaccuccucgacaagaaggaguaccgcaagcccaucgacuggggcgccgccucccccgccguccaguccuuccgccgcaucgucgaguga

SEQ ID NO: 41795 - RNA, 960 nt, Artificial Sequence
  derived and/or modified sequence opt2 from CRYL1__Homo_sapiens__NP_057058
auggccuccuccgccgccggcugcgucgucaucgucggcuccggcgucaucggccgcuccugggccaugcucuucgccuccggcggcuuccaggucaagcucuacgacaucgagcagcagcagauccgcaacgcccucgagaacauccgcaaggagaugaagcuccucgagcaggccggcucccucaagggcucccucuccgucgaggagcagcucucccucaucuccggcugccccaacauccaggaggccgucgagggcgccaugcacauccaggagugcguccccgaggaccucgagcucaagaagaagaucuucgcccagcucgacuccaucaucgacgaccgcgucauccucuccuccuccaccuccugccucaugcccuccaagcucuucgccggccucguccacgucaagcagugcaucgucgcccaccccgucaacccccccuacuacaucccccucgucgagcucgucccccaccccgagaccgcccccaccaccgucgaccgcacccacgcccucaugaagaagaucggccagugccccaugcgcguccagaaggaggucgccggcuucguccucaaccgccuccaguacgccaucaucuccgaggccuggcgccucgucgaggagggcaucgucucccccuccgaccucgaccucgucauguccgagggccucggcaugcgcuacgccuucaucggcccccucgagaccaugcaccucaacgccgagggcaugcucuccuacugcgaccgcuacuccgagggcaucaagcacguccuccagaccuucggccccauccccgaguucucccgcgccaccgccgagaaggucaaccaggacaugugcaugaagguccccgacgaccccgagcaccucgccgcccgccgccaguggcgcgacgagugccucaugcgccucgccaagcucaagucccagguccagccccaguga

SEQ ID NO: 41796 - RNA, 945 nt, Artificial Sequence
  derived and/or modified sequence opt2 from CRYM__Homo_sapiens__NP_001879
augucccgcguccccgccuuccucuccgccgccgaggucgaggagcaccuccgcuccuccucccuccucauccccccccucgagaccgcccucgccaacuucuccuccggccccgagggcggcgucaugcagcccguccgcaccgucguccccgucaccaagcaccgcggcuaccucggcgucaugcccgccuacuccgccgccgaggacgcccucaccaccaagcucgucaccuucuacgaggaccgcggcaucaccuccgucguccccucccaccaggccaccguccuccucuucgagcccuccaacggcacccuccucgccgucauggacggcaacgucaucaccgccaagcgcaccgccgccgucuccgccaucgccaccaaguuccucaagccccccuccuccgagguccucugcauccucggcgccggcguccaggccuacucccacuacgagaucuucaccgagcaguucuccuucaaggagguccgcaucuggaaccgcaccaaggagaacgccgagaaguucgccgacaccguccagggcgagguccgcgucugcuccuccguccaggaggccgucgccggcgccgacgucaucaucaccgucacccucgccaccgagcccauccucuucggcgagugggucaagcccggcgcccacaucaacgccgucggcgccucccgccccgacuggcgcgagcucgacgacgagcucaugaaggaggccguccucuacgucgacucccaggaggccgcccucaaggaguccggcgacguccuccucuccggcgccgagaucuucgccgagcucggcgaggucaucaagggcgucaagcccgcccacugcgagaagaccaccgucuucaagucccucggcauggccgucgaggacaccgucgccgccaagcucaucuacgacuccugguccuccggcaaguga

SEQ ID NO: 41797 - RNA, 1050 nt, Artificial Sequence
  derived and/or modified sequence opt2 from CRYZL1__Homo_sapiens__NP_665857
augaagggccucuacuuccagcaguccuccaccgacgaggagaucaccuucgucuuccaggagaaggaggaccuccccgucaccgaggacaacuucgucaagcuccaggucaaggccugcgcccucucccagaucaacaccaagcuccucgccgagaugaagaugaagaaggaccucuuccccgucggccgcgagaucgccggcaucguccucgacgucggcuccaaggucuccuucuuccagcccgacgacgaggucgucggcauccucccccucgacuccgaggaccccggccucugcgaggucguccgcguccacgagcacuaccucguccacaagcccgagaaggucaccuggaccgaggccgccggcuccauccgcgacggcguccgcgccuacaccgcccuccacuaccucucccaccucucccccggcaaguccguccucaucauggacggcgccuccgccuucggcaccaucgccauccagcucgcccaccaccgcggcgccaaggucaucuccaccgccugcucccucgaggacaagcagugccucgagcgcuuccgcccccccaucgcccgcgucaucgacgucuccaacggcaagguccacgucgccgaguccugccucgaggagaccggcggccucggcgucgacaucguccucgacgccggcguccgccucuacuccaaggacgacgagcccgccgucaagcuccagcuccucccccacaagcacgacaucaucacccuccucggcgucggcggccacugggucaccaccgaggagaaccuccagcucgacccccccgacucccacugccucuuccucaagggcgccacccucgccuuccucaacgacgaggucuggaaccucuccaacguccagcagggcaaguaccucugcauccucaaggacgucauggagaagcucuccaccggcgucuuccgcccccagcucgacgagcccaucccccucuacgaggccaaggucuccauggaggccguccagaagaaccagggccgcaagaagcaggucguccaguucuga

SEQ ID NO: 41798 - RNA, 1482 nt, Artificial Sequence
  derived and/or modified sequence opt2 from CSAD__Homo_sapiens__NP_001231634
auggccgacuccgaggcccuccccucccucgccggcgaccccgucgccgucgaggcccuccuccgcgccgucuucggcgucgucgucgacgaggccauccagaagggcaccuccgucucccagaaggucugcgaguggaaggagcccgaggagcucaagcagcuccucgaccucgagcuccgcucccagggcgagucccagaagcagauccucgagcgcugccgcgccgucauccgcuacuccgucaagaccggccacccccgcuucuucaaccagcucuucuccggccucgacccccacgcccucgccggccgcaucaucaccgagucccucaacaccucccaguacaccuacgagaucgcccccgucuucguccucauggaggaggagguccuccgcaagcuccgcgcccucgucggcugguccuccggcgacggcaucuucugccccggcggcuccaucuccaacauguacgccgucaaccucgcccgcuaccagcgcuaccccgacugcaagcagcgcggccuccgcacccuccccccccucgcccucuucaccuccaaggagugccacuacuccauccagaagggcgccgccuuccucggccucggcaccgacuccguccgcgucgucaaggccgacgagcgcggcaagaugguccccgaggaccucgagcgccagaucggcauggccgaggccgagggcgccguccccuuccucgucuccgccaccuccggcaccaccguccucggcgccuucgacccccucgaggccaucgccgacgucugccagcgccacggccucuggcuccacgucgacgccgccuggggcggcuccguccuccucucccagacccaccgccaccuccucgacggcauccagcgcgccgacuccgucgccuggaacccccacaagcuccucgccgccggccuccagugcuccgcccuccuccuccaggacaccuccaaccuccucaagcgcugccacggcucccaggccuccuaccucuuccagcaggacaaguucuacgacgucgcccucgacaccggcgacaaggucguccagugcggccgccgcgucgacugccucaagcucuggcucauguggaaggcccagggcgaccagggccucgagcgccgcaucgaccaggccuucguccucgcccgcuaccucgucgaggagaugaagaagcgcgagggcuucgagcucgucauggagcccgaguucgucaacgucugcuucugguucgucccccccucccuccgcggcaagcaggagucccccgacuaccacgagcgccucuccaaggucgcccccguccucaaggagcgcauggucaaggagggcuccaugaugaucggcuaccagccccacggcacccgcggcaacuucuuccgcgucgucgucgccaacuccgcccucaccugcgccgacauggacuuccuccucaacgagcucgagcgccucggccaggaccucuga

SEQ ID NO: 41799 - RNA, 333 nt, Artificial Sequence
  derived and/or modified sequence opt2 from CSAG3__Homo_sapiens__NP_001123300
auguggaugggccucauccagcucgucgagggcgucaagcgcaaggaccagggcuuccucgagaaggaguucuaccacaagaccaacaucaagaugcgcugcgaguuccucgccugcuggcccgccuucaccguccucggcgaggccuggcgcgaccaggucgacuggucccgccuccuccgcgacgccggccucgucaagaugucccgcaagccccgcgccuccuccccccucuccaacaaccacccccccacccccaagcgcuucccccgccagcccggccgcgagaagggccccaucaaggagguccccggcaccaagggcucccccuga

SEQ ID NO: 41800 - RNA, 2748 nt, Artificial Sequence
  derived and/or modified sequence opt2 from CSE1L__Homo_sapiens__NP_001243064
auggagcucuccgacgccaaccuccagacccucaccgaguaccucaagaagacccucgaccccgaccccgccauccgccgccccgccgagaaguuccucgaguccgucgagggcaaccagaacuacccccuccuccuccucacccuccucgagaagucccaggacaacgucaucaaggucugcgccuccgucaccuucaagaacuacaucaagcgcaacuggcgcaucgucgaggacgagcccaacaagaucugcgaggccgaccgcgucgccaucaaggccaacaucguccaccucaugcucuccucccccgagcagauccagaagcagcucuccgacgccaucuccaucaucggccgcgaggacuucccccagaaguggcccgaccuccucaccgagauggucaaccgcuuccaguccggcgacuuccacgucaucaacggcguccuccgcaccgcccacucccucuucaagcgcuaccgccacgaguucaaguccaacgagcucuggaccgagaucaagcucguccucgacgccuucgcccucccccucaccaaccucuucaaggccaccaucgagcucugcuccacccacgccaacgacgccuccgcccuccgcauccucuucuccucccucauccucaucuccaagcucuucuacucccucaacuuccaggaccuccccgaguucuucgaggacaacauggagaccuggaugaacaacuuccacacccuccucacccucgacaacaagcuccuccagaccgaccucgucuccaacgccauccaguuccucgccuccgucugcgagcgcccccacuacaagaaccucuucgaggaccagaacacccucaccuccaucugcgagaaggucaucguccccaacauggaguuccgcgccgccgacgaggaggccuucgaggacaacuccgaggaguacauccgccgcgaccucgagggcuccgacaucgacacccgccgccgcgccgccugcgaccucguccgcggccucugcaaguucuucgagggccccgucaccggcaucuucuccggcuacgucaacuccaugcuccaggaguacgccaagaaccccuccgucaacuggaagcacaaggacgccgccaucuaccucgucaccucccucgccuccaaggcccagacccagaagcacggcaucacccaggccaacgagcucgucaaccucaccgaguucuucgucaaccacauccuccccgaccucaaguccgccaacgucaacgaguuccccguccucaaggccgacggcaucaaguacaucaugaucuuccgcaaccagguccccaaggagcaccuccucgucuccaucccccuccucaucaaccaccuccaggccgaguccaucgucguccacaccuacgccgcccacgcccucgagcgccucuucaccaugcgcggccccaacaacgccacccucuucaccgccgccgagaucgcccccuucgucgagauccuccucaccaaccucuucaaggcccucacccuccccggcuccuccgagaacgaguacaucaugaaggccaucaugcgcuccuucucccuccuccaggaggccaucauccccuacauccccacccucaucacccagcucacccagaagcuccucgccgucuccaagaaccccuccaagccccacuucaaccacuacauguucgaggccaucugccucuccauccgcaucaccugcaaggccaaccccgccgccgucgucaacuucgaggaggcccucuuccucgucuucaccgagauccuccagaacgacguccaggaguucauccccuacgucuuccaggucaugucccuccuccucgagacccacaagaacgacauccccuccuccuacauggcccucuucccccaccuccuccagcccguccucugggagcgcaccggcaacauccccgcccucguccgccuccuccaggccuuccucgagcgcggcuccaacaccaucgccuccgccgccgccgacaagauccccggccuccucggcgucuuccagaagcucaucgccuccaaggccaacgaccaccagggcuucuaccuccucaacuccaucaucgagcacaugccccccgaguccgucgaccaguaccgcaagcagaucuucauccuccucuuccagcgccuccagaacuccaagaccaccaaguucaucaaguccuuccucgucuucaucaaccucuacugcaucaaguacggcgcccucgcccuccaggagaucuucgacggcauccagcccaagauguucggcaugguccucgagaagaucaucauccccgagauccagaaggucuccggcaacgucgagaagaagaucugcgccgucggcaucaccaagcuccucaccgagugcccccccaugauggacaccgaguacaccaagcucuggaccccccuccuccagucccucaucggccucuucgagcuccccgaggacgacaccauccccgacgaggagcacuucaucgacaucgaggacacccccggcuaccagaccgccuucucccagcucgccuucgccggcaagaaggagcacgaccccgucggccagauggucaacaaccccaagauccaccucgcccagucccuccacaagcucuccaccgccugccccggccgcguccccuccauggucuccaccucccucaacgccgaggcccuccaguaccuccagggcuaccuccaggccgccuccgucacccuccucuga

SEQ ID NO: 41801 - RNA, 2919 nt, Artificial Sequence
  derived and/or modified sequence opt2 from CSF1R__Homo_sapiens__NP_005202
augggccccggcguccuccuccuccuccucgucgccaccgccuggcacggccagggcauccccgucaucgagcccuccguccccgagcucgucgucaagcccggcgccaccgucacccuccgcugcgucggcaacggcuccgucgagugggacggcccccccuccccccacuggacccucuacuccgacggcuccuccuccauccucuccaccaacaacgccaccuuccagaacaccggcaccuaccgcugcaccgagcccggcgacccccucggcggcuccgccgccauccaccucuacgucaaggaccccgcccgccccuggaacguccucgcccaggaggucgucgucuucgaggaccaggacgcccuccuccccugccuccucaccgaccccguccucgaggccggcgucucccucguccgcguccgcggccgcccccucaugcgccacaccaacuacuccuucucccccuggcacggcuucaccauccaccgcgccaaguucauccagucccaggacuaccagugcuccgcccucaugggcggccgcaaggucauguccaucuccauccgccucaagguccagaaggucauccccggcccccccgcccucacccucguccccgccgagcucguccgcauccgcggcgaggccgcccagaucgucugcuccgccuccuccgucgacgucaacuucgacgucuuccuccagcacaacaacaccaagcucgccaucccccagcaguccgacuuccacaacaaccgcuaccagaagguccucacccucaaccucgaccaggucgacuuccagcacgccggcaacuacuccugcgucgccuccaacguccagggcaagcacuccaccuccauguucuuccgcgucgucgaguccgccuaccucaaccucuccuccgagcagaaccucauccaggaggucaccgucggcgagggccucaaccucaaggucauggucgaggccuaccccggccuccagggcuucaacuggaccuaccucggccccuucuccgaccaccagcccgagcccaagcucgccaacgccaccaccaaggacaccuaccgccacaccuucacccucucccucccccgccucaagcccuccgaggccggccgcuacuccuuccucgcccgcaaccccggcggcuggcgcgcccucaccuucgagcucacccuccgcuacccccccgaggucuccgucaucuggaccuucaucaacggcuccggcacccuccucugcgccgccuccggcuacccccagcccaacgucaccuggcuccagugcuccggccacaccgaccgcugcgacgaggcccagguccuccaggucugggacgaccccuaccccgagguccucucccaggagcccuuccacaaggucaccguccagucccuccucaccgucgagacccucgagcacaaccagaccuacgagugccgcgcccacaacuccgucggcuccggcuccugggccuucauccccaucuccgccggcgcccacacccacccccccgacgaguuccucuucacccccgucgucgucgccugcauguccaucauggcccuccuccuccuccuccuccuccuccuccucuacaaguacaagcagaagcccaaguaccagguccgcuggaagaucaucgaguccuacgagggcaacuccuacaccuucaucgaccccacccagcuccccuacaacgagaagugggaguucccccgcaacaaccuccaguucggcaagacccucggcgccggcgccuucggcaaggucgucgaggccaccgccuucggccucggcaaggaggacgccguccucaaggucgccgucaagaugcucaaguccaccgcccacgccgacgagaaggaggcccucauguccgagcucaagaucaugucccaccucggccagcacgagaacaucgucaaccuccucggcgccugcacccacggcggccccguccucgucaucaccgaguacugcugcuacggcgaccuccucaacuuccuccgccgcaaggccgaggccaugcucggccccucccucucccccggccaggaccccgagggcggcgucgacuacaagaacauccaccucgagaagaaguacguccgccgcgacuccggcuucuccucccagggcgucgacaccuacgucgagaugcgccccgucuccaccuccuccaacgacuccuucuccgagcaggaccucgacaaggaggacggccgcccccucgagcuccgcgaccuccuccacuucuccucccaggucgcccagggcauggccuuccucgccuccaagaacugcauccaccgcgacgucgccgcccgcaacguccuccucaccaacggccacgucgccaagaucggcgacuucggccucgcccgcgacaucaugaacgacuccaacuacaucgucaagggcaacgcccgccuccccgucaaguggauggcccccgaguccaucuucgacugcgucuacaccguccaguccgacgucugguccuacggcauccuccucugggagaucuucucccucggccucaaccccuaccccggcauccucgucaacuccaaguucuacaagcucgucaaggacggcuaccagauggcccagcccgccuucgcccccaagaacaucuacuccaucaugcaggccugcugggcccucgagcccacccaccgccccaccuuccagcagaucugcuccuuccuccaggagcaggcccaggaggaccgccgcgagcgcgacuacaccaaccuccccuccuccucccgcuccggcggcuccggcuccuccuccuccgagcucgaggaggaguccuccuccgagcaccucaccugcugcgagcagggcgacaucgcccagccccuccuccagcccaacaacuaccaguucugcuga

SEQ ID NO: 41802 - RNA, 435 nt, Artificial Sequence
  derived and/or modified sequence opt2 from CSF2__Homo_sapiens__NP_000749
auguggcuccagucccuccuccuccucggcaccgucgccugcuccaucuccgcccccgcccgcucccccucccccuccacccagcccugggagcacgucaacgccauccaggaggcccgccgccuccucaaccucucccgcgacaccgccgccgagaugaacgagaccgucgaggucaucuccgagauguucgaccuccaggagcccaccugccuccagacccgccucgagcucuacaagcagggccuccgcggcucccucaccaagcucaagggcccccucaccaugauggccucccacuacaagcagcacugcccccccacccccgagaccuccugcgccacccagaucaucaccuucgaguccuucaaggagaaccucaaggacuuccuccucgucauccccuucgacugcugggagcccguccaggaguga

SEQ ID NO: 41803 - RNA, 1305 nt, Artificial Sequence
  derived and/or modified sequence opt2 from CSF2RA__Homo_sapiens__NP_001155002
augcuccuccucgucaccucccuccuccucugcgagcucccccaccccgccuuccuccucauccccgagaaguccgaccuccgcaccgucgcccccgccuccucccucaacguccgcuucgacucccgcaccaugaaccucuccugggacugccaggagaacaccaccuucuccaagugcuuccucaccgacaagaagaaccgcgucgucgagccccgccucuccaacaacgagugcuccugcaccuuccgcgagaucugccuccacgagggcgucaccuucgagguccacgucaacaccucccagcgcggcuuccagcagaagcuccucuaccccaacuccggccgcgagggcaccgccgcccagaacuucuccugcuucaucuacaacgccgaccucaugaacugcaccugggcccgcggccccaccgccccccgcgacguccaguacuuccucuacauccgcaacuccaagcgccgccgcgagauccgcugccccuacuacauccaggacuccggcacccacgucggcugccaccucgacaaccucuccggccucaccucccgcaacuacuuccucgucaacggcaccucccgcgagaucggcauccaguucuucgacucccuccucgacaccaagaagaucgagcgcuucaacccccccuccaacgucaccguccgcugcaacaccacccacugccucguccgcuggaagcagccccgcaccuaccagaagcucuccuaccucgacuuccaguaccagcucgacguccaccgcaagaacacccagcccggcaccgagaaccuccucaucaacgucuccggcgaccucgagaaccgcuacaacuuccccuccuccgagccccgcgccaagcacuccgucaagauccgcgccgccgacguccgcauccucaacugguccuccugguccgaggccaucgaguucggcucccacuccgucacccaggccggcguccaguggcacaaccucggcucccuccagccccccuccccccgccucaagcgcuucuccugccuccgccuccccggcuccgacgacggcaaccucggcuccgucuacaucuacguccuccucaucgucggcacccucgucugcggcaucguccucggcuuccucuucaagcgcuuccuccgcauccagcgccucuucccccccgucccccagaucaaggacaagcucaacgacaaccacgaggucgaggacgagaucaucugggaggaguucacccccgaggagggcaagggcuaccgcgaggagguccucaccgucaaggagaucaccuga

SEQ ID NO: 41804 - RNA, 2694 nt, Artificial Sequence
  derived and/or modified sequence opt2 from CSF2RB__Homo_sapiens__NP_000386
augguccucgcccagggccuccucuccauggcccuccucgcccucugcugggagcgcucccucgccggcgccgaggagaccaucccccuccagacccuccgcugcuacaacgacuacaccucccacaucaccugccgcugggccgacacccaggacgcccagcgccucgucaacgucacccucauccgccgcgucaacgaggaccuccucgagcccgucuccugcgaccucuccgacgacaugcccugguccgccugcccccacccccgcugcgucccccgccgcugcgucauccccugccaguccuucgucgucaccgacgucgacuacuucuccuuccagcccgaccgcccccucggcacccgccucaccgucacccucacccagcacguccagccccccgagccccgcgaccuccagaucuccaccgaccaggaccacuuccuccucaccugguccgucgcccucggcuccccccagucccacuggcucucccccggcgaccucgaguucgaggucgucuacaagcgccuccaggacuccugggaggacgccgccauccuccucuccaacaccucccaggccacccucggccccgagcaccucaugcccuccuccaccuacgucgcccgcguccgcacccgccucgcccccggcucccgccucuccggccgccccuccaaguggucccccgaggucugcugggacucccagcccggcgacgaggcccagccccagaaccucgagugcuucuucgacggcgccgccguccucuccugcuccugggagguccgcaaggaggucgccuccuccgucuccuucggccucuucuacaagcccucccccgacgccggcgaggaggagugcucccccguccuccgcgagggccucggcucccuccacacccgccaccacugccagauccccguccccgaccccgccacccacggccaguacaucgucuccguccagccccgccgcgccgagaagcacaucaaguccuccgucaacauccagauggccccccccucccucaacgucaccaaggacggcgacuccuacucccuccgcugggagaccaugaagaugcgcuacgagcacaucgaccacaccuucgagauccaguaccgcaaggacaccgccaccuggaaggacuccaagaccgagacccuccagaacgcccacuccauggcccuccccgcccucgagcccuccacccgcuacugggcccgcguccgcguccgcaccucccgcaccggcuacaacggcaucugguccgagugguccgaggcccgcuccugggacaccgaguccguccuccccauguggguccucgcccucaucgucaucuuccucaccaucgccguccuccucgcccuccgcuucugcggcaucuacggcuaccgccuccgccgcaagugggaggagaagauccccaaccccuccaagucccaccucuuccagaacggcuccgccgagcucuggccccccggcuccauguccgccuucaccuccggcucccccccccaccagggccccuggggcucccgcuuccccgagcucgagggcgucuuccccgucggcuucggcgacuccgaggucuccccccucaccaucgaggaccccaagcacgucugcgacccccccuccggccccgacaccacccccgccgccuccgaccuccccaccgagcagccccccuccccccagcccggcccccccgccgccucccacacccccgagaagcaggccuccuccuucgacuucaacggccccuaccucggccccccccacucccgcucccuccccgacauccucggccagcccgagcccccccaggagggcggcucccagaagucccccccccccggcucccucgaguaccucugccuccccgccggcggccagguccagcucgucccccucgcccaggccaugggccccggccaggccgucgaggucgagcgccgccccucccagggcgccgccggcucccccucccucgaguccggcggcggccccgccccccccgcccucggcccccgcgucggcggccaggaccagaaggacucccccgucgccauccccauguccuccggcgacaccgaggaccccggcgucgccuccggcuacgucuccuccgccgaccucgucuucacccccaacuccggcgccuccuccgucucccucguccccucccucggccuccccuccgaccagacccccucccucugccccggccucgccuccggcccccccggcgcccccggccccgucaaguccggcuucgagggcuacgucgagcucccccccaucgagggccgcuccccccgcuccccccgcaacaaccccgucccccccgaggccaagucccccguccucaaccccggcgagcgccccgccgacgucucccccaccuccccccagcccgagggccuccucguccuccagcaggucggcgacuacugcuuccuccccggccucggccccggcccccucucccuccgcuccaagcccuccucccccggccccggccccgagaucaagaaccucgaccaggccuuccaggucaagaagccccccggccaggccgucccccagguccccgucauccagcucuucaaggcccucaagcagcaggacuaccucucccucccccccugggaggucaacaagcccggcgaggucugcuga

SEQ ID NO: 41805 - RNA, 624 nt, Artificial Sequence
  derived and/or modified sequence opt2 from CSF3__Homo_sapiens__NP_000750
auggccggccccgccacccagucccccaugaagcucauggcccuccagcuccuccucuggcacuccgcccucuggaccguccaggaggccaccccccucggccccgccuccucccucccccaguccuuccuccucaagugccucgagcagguccgcaagauccagggcgacggcgccgcccuccaggagaagcucgucuccgagugcgccaccuacaagcucugccaccccgaggagcucguccuccucggccacucccucggcauccccugggccccccucuccuccugccccucccaggcccuccagcucgccggcugccucucccagcuccacuccggccucuuccucuaccagggccuccuccaggcccucgagggcaucucccccgagcucggccccacccucgacacccuccagcucgacgucgccgacuucgccaccaccaucuggcagcagauggaggagcucggcauggcccccgcccuccagcccacccagggcgccaugcccgccuucgccuccgccuuccagcgccgcgccggcggcguccucgucgccucccaccuccaguccuuccucgaggucuccuaccgcguccuccgccaccucgcccagcccuga

SEQ ID NO: 41806 - RNA, 1599 nt, Artificial Sequence
  derived and/or modified sequence opt2 from CSGALNACT1__Homo_sapiens__NP_001123990
augaugaugguccgccgcggccuccucgccuggaucucccgcgucgucguccuccucguccuccucugcugcgccaucuccguccucuacaugcucgccugcacccccaagggcgacgaggagcagcucgcccucccccgcgccaacucccccaccggcaaggagggcuaccaggccguccuccaggagugggaggagcagcaccgcaacuacgucuccucccucaagcgccagaucgcccagcucaaggaggagcuccaggagcgcuccgagcagcuccgcaacggccaguaccaggccuccgacgccgccggccucggccucgaccgcuccccccccgagaagacccaggccgaccuccucgccuuccuccacucccaggucgacaaggccgaggucaacgccggcgucaagcucgccaccgaguacgccgccguccccuucgacuccuucacccuccagaaggucuaccagcucgagaccggccucacccgccaccccgaggagaagcccguccgcaaggacaagcgcgacgagcucgucgaggccaucgaguccgcccucgagacccucaacucccccgccgagaacucccccaaccaccgccccuacaccgccuccgacuucaucgagggcaucuaccgcaccgagcgcgacaagggcacccucuacgagcucaccuucaagggcgaccacaagcacgaguucaagcgccucauccucuuccgccccuucggccccaucaugaaggucaagaacgagaagcucaacauggccaacacccucaucaacgucaucgucccccucgccaagcgcgucgacaaguuccgccaguucaugcagaacuuccgcgagaugugcaucgagcaggacggccgcguccaccucaccgucgucuacuucggcaaggaggagaucaacgaggucaagggcauccucgagaacaccuccaaggccgccaacuuccgcaacuucaccuucauccagcucaacggcgaguucucccgcggcaagggccucgacgucggcgcccgcuucuggaagggcuccaacguccuccucuucuucugcgacgucgacaucuacuucaccuccgaguuccucaacaccugccgccucaacacccagcccggcaagaaggucuucuaccccguccucuucucccaguacaaccccggcaucaucuacggccaccacgacgccguccccccccucgagcagcagcucgucaucaagaaggagaccggcuucuggcgcgacuucggcuucggcaugaccugccaguaccgcuccgacuucaucaacaucggcggcuucgaccucgacaucaagggcuggggcggcgaggacguccaccucuaccgcaaguaccuccacuccaaccucaucgucguccgcacccccguccgcggccucuuccaccucuggcacgagaagcgcugcauggacgagcucacccccgagcaguacaagaugugcaugcaguccaaggccaugaacgaggccucccacggccagcucggcaugcucgucuuccgccacgagaucgaggcccaccuccgcaagcagaagcagaagaccuccuccaagaagaccuga

SEQ ID NO: 41807 - RNA, 1629 nt, Artificial Sequence
  derived and/or modified sequence opt2 from CSGALNACT2__Homo_sapiens__NP_061060
augccccgccgcggccucauccuccacacccgcacccacuggcuccuccucggccucgcccuccucugcucccucguccucuucauguaccuccucgagugcgccccccagaccgacggcaacgccucccuccccggcgucgucggcgagaacuacggcaaggaguacuaccaggcccuccuccaggagcaggaggagcacuaccagacccgcgccaccucccucaagcgccagaucgcccagcucaagcaggagcuccaggagauguccgagaagaugcgcucccuccaggagcgccgcaacgucggcgccaacggcaucggcuaccaguccaacaaggagcaggcccccuccgaccuccucgaguuccuccacucccagaucgacaaggccgaggucuccaucggcgccaagcuccccuccgaguacggcgucauccccuucgaguccuucacccucaugaaggucuuccagcucgagaugggccucacccgccaccccgaggagaagcccguccgcaaggacaagcgcgacgagcucgucgaggucaucgaggccggccucgaggucaucaacaaccccgacgaggacgacgagcaggaggacgaggagggcccccucggcgagaagcucaucuucaacgagaacgacuucgucgagggcuacuaccgcaccgagcgcgacaagggcacccaguacgagcucuucuucaagaaggccgaccucaccgaguaccgccacgucacccucuuccgccccuucggcccccucaugaaggucaaguccgagaugaucgacaucacccgcuccaucaucaacaucaucgucccccucgccgagcgcaccgaggccuucguccaguucaugcagaacuuccgcgacgucugcauccaccaggacaagaagauccaccucaccgucgucuacuucggcaaggagggccucuccaaggucaaguccauccucgaguccgucaccuccgaguccaacuuccacaacuacacccucgucucccucaacgaggaguucaaccgcggccgcggccucaacgucggcgcccgcgccugggacaagggcgagguccucauguucuucugcgacgucgacaucuacuucuccgccgaguuccucaacuccugccgccucaacgccgagcccggcaagaaggucuucuaccccgucgucuucucccucuacaaccccgccaucgucuacgccaaccaggagguccccccccccgucgagcagcagcucguccacaagaaggacuccggcuucuggcgcgacuucggcuucggcaugaccugccaguaccgcuccgacuuccucaccaucggcggcuucgacauggaggucaagggcuggggcggcgaggacguccaccucuaccgcaaguaccuccacggcgaccucaucgucauccgcacccccguccccggccucuuccaccucuggcacgagaagcgcugcgccgacgagcucacccccgagcaguaccgcaugugcauccaguccaaggccaugaacgaggccucccacucccaccucggcaugcucgucuuccgcgaggagaucgagacccaccuccacaagcaggccuaccgcaccaacuccgaggccgucggcuga

SEQ ID NO: 41808 - RNA, 654 nt, Artificial Sequence
  derived and/or modified sequence opt2 from CSH1__Homo_sapiens__NP_001308
auggcccccggcucccgcaccucccuccuccucgccuucgcccuccucugccuccccuggcuccaggaggccggcgccguccagaccgucccccucucccgccucuucgaccacgccaugcuccaggcccaccgcgcccaccagcucgccaucgacaccuaccaggaguucgaggagaccuacauccccaaggaccagaaguacuccuuccuccacgacucccagaccuccuucugcuucuccgacuccauccccacccccuccaacauggaggagacccagcagaaguccaaccucgagcuccuccgcaucucccuccuccucaucgaguccuggcucgagcccguccgcuuccuccgcuccauguucgccaacaaccucgucuacgacaccuccgacuccgacgacuaccaccuccucaaggaccucgaggagggcauccagacccucaugggccgccucgaggacggcucccgccgcaccggccagauccucaagcagaccuacuccaaguucgacaccaacucccacaaccacgacgcccuccucaagaacuacggccuccucuacugcuuccgcaaggacauggacaaggucgagaccuuccuccgcaugguccagugccgcuccgucgagggcuccugcggcuucuga

SEQ ID NO: 41809 - RNA, 654 nt, Artificial Sequence
  derived and/or modified sequence opt2 from CSH2__Homo_sapiens__NP_066271
auggccgccggcucccgcaccucccuccuccucgccuucgcccuccucugccuccccuggcuccaggaggccggcgccguccagaccgucccccucucccgccucuucgaccacgccaugcuccaggcccaccgcgcccaccagcucgccaucgacaccuaccaggaguucgaggagaccuacauccccaaggaccagaaguacuccuuccuccacgacucccagaccuccuucugcuucuccgacuccauccccacccccuccaacauggaggagacccagcagaaguccaaccucgagcuccuccgcaucucccuccuccucaucgaguccuggcucgagcccguccgcuuccuccgcuccauguucgccaacaaccucgucuacgacaccuccgacuccgacgacuaccaccuccucaaggaccucgaggagggcauccagacccucaugggccgccucgaggacggcucccgccgcaccggccagauccucaagcagaccuacuccaaguucgacaccaacucccacaaccacgacgcccuccucaagaacuacggccuccucuacugcuuccgcaaggacauggacaaggucgagaccuuccuccgcaugguccagugccgcuccgucgagggcuccugcggcuucuga

SEQ ID NO: 41810 - RNA, 387 nt, Artificial Sequence
  derived and/or modified sequence opt2 from CSHL1__Homo_sapiens__NP_001309
auggaggagacccagcagaaguccaaccucgagcuccuccacaucucccuccuccucaucgagucccgccucgagcccguccgcuuccuccgcuccaccuucaccaacaaccucgucuacgacaccuccgacuccgacgacuaccaccuccucaaggaccucgaggagggcauccagaugcucaugggccgccucgaggacggcucccaccucaccggccagacccucaagcagaccuacuccaaguucgacaccaacucccacaaccacgacgcccuccucaagaacuacggccuccuccacugcuuccgcaaggacauggacaaggucgagaccuuccuccgcaugguccagugccgcuccgucgagggcuccugcggcuucuga

SEQ ID NO: 41811 - RNA, 1401 nt, Artificial Sequence
  derived and/or modified sequence opt2 from CS__Homo_sapiens__NP_004068
auggcccuccucaccgccgccgcccgccuccucggcaccaagaacgccuccugccucguccucgccgcccgccacgccuccgccuccuccaccaaccucaaggacauccucgccgaccucauccccaaggagcaggcccgcaucaagaccuuccgccagcagcacggcaagaccgucgucggccagaucaccgucgacaugauguacggcggcaugcgcggcaugaagggccucgucuacgagaccuccguccucgaccccgacgagggcauccgcuuccgcggcuucuccauccccgagugccagaagcuccuccccaaggccaagggcggcgaggagccccuccccgagggccucuucuggcuccucgucaccggccacauccccaccgaggagcaggucuccuggcucuccaaggagugggccaagcgcgccgcccuccccucccacgucgucaccaugcucgacaacuuccccaccaaccuccaccccaugucccagcucuccgccgccgucaccgcccucaacuccgaguccaacuucgcccgcgccuacgcccagggcaucucccgcaccaaguacugggagcucaucuacgaggacuccauggaccucaucgccaagcuccccugcgucgccgccaagaucuaccgcaaccucuaccgcgagggcuccggcaucggcgccaucgacuccaaccucgacuggucccacaacuucaccaacaugcucggcuacaccgaccaccaguucaccgagcucacccgccucuaccucaccauccacuccgaccacgagggcggcaacgucuccgcccacaccucccaccucgucggcuccgcccucuccgaccccuaccucuccuucgccgccgccaugaacggccucgccggcccccuccacggccucgccaaccaggagguccucgucuggcucacccagcuccagaaggaggucggcaaggacgucuccgacgagaagcuccgcgacuacaucuggaacacccucaacuccggccgcgucguccccggcuacggccacgccguccuccgcaagaccgacccccgcuacaccugccagcgcgaguucgcccucaagcaccuccccaacgaccccauguucaagcucgucgcccagcucuacaagaucguccccaacguccuccucgagcagggcaaggccaagaaccccuggcccaacgucgacgcccacuccggcguccuccuccaguacuacggcaugaccgagaugaacuacuacaccguccucuucggcgucucccgcgcccucggcguccucgcccagcucaucuggucccgcgcccucggcuucccccucgagcgccccaaguccauguccaccgagggccucaugaaguucgucgacuccaaguccggcuga

SEQ ID NO: 41812 - RNA, 1353 nt, Artificial Sequence
  derived and/or modified sequence opt2 from CSK__Homo_sapiens__XP_005254222
auguccgccauccaggccgccuggcccuccggcaccgagugcaucgccaaguacaacuuccacggcaccgccgagcaggaccuccccuucugcaagggcgacguccucaccaucgucgccgucaccaaggaccccaacugguacaaggccaagaacaaggucggccgcgagggcaucauccccgccaacuacguccagaagcgcgagggcgucaaggccggcaccaagcucucccucaugcccugguuccacggcaagaucacccgcgagcaggccgagcgccuccucuacccccccgagaccggccucuuccucguccgcgaguccaccaacuaccccggcgacuacacccucugcgucuccugcgacggcaaggucgagcacuaccgcaucauguaccacgccuccaagcucuccaucgacgaggaggucuacuucgagaaccucaugcagcucgucgagcacuacaccuccgacgccgacggccucugcacccgccucaucaagcccaaggucauggagggcaccgucgccgcccaggacgaguucuaccgcuccggcugggcccucaacaugaaggagcucaagcuccuccagaccaucggcaagggcgaguucggcgacgucaugcucggcgacuaccgcggcaacaaggucgccgucaagugcaucaagaacgacgccaccgcccaggccuuccucgccgaggccuccgucaugacccagcuccgccacuccaaccucguccagcuccucggcgucaucgucgaggagaagggcggccucuacaucgucaccgaguacauggccaagggcucccucgucgacuaccuccgcucccgcggccgcuccguccucggcggcgacugccuccucaaguucucccucgacgucugcgaggccauggaguaccucgagggcaacaacuucguccaccgcgaccucgccgcccgcaacguccucgucuccgaggacaacgucgccaaggucuccgacuucggccucaccaaggaggccuccuccacccaggacaccggcaagcuccccgucaaguggaccgcccccgaggcccuccgcgagaagaaguucuccaccaaguccgacgucugguccuucggcauccuccucugggagaucuacuccuucggccgcguccccuacccccgcaucccccucaaggacgucgucccccgcgucgagaagggcuacaagauggacgcccccgacggcugcccccccgccgucuacgaggucaugaagaacugcuggcaccucgacgccgccaugcgccccuccuuccuccagcuccgcgagcagcucgagcacaucaagacccacgagcuccaccucuga

SEQ ID NO: 41813 - RNA, 10695 nt, Artificial Sequence
  derived and/or modified sequence opt2 from CSMD1__Homo_sapiens__NP_150094
augaccgccuggcgccgcuuccagucccuccuccuccuccucggccuccucguccucugcgcccgccuccucaccgccgccaagggccagaacugcggcggccucguccagggccccaacggcaccaucgagucccccggcuucccccacggcuaccccaacuacgccaacugcaccuggaucaucaucaccggcgagcgcaaccgcauccagcucuccuuccacaccuucgcccucgaggaggacuucgacauccucuccgucuacgacggccagccccagcagggcaaccucaagguccgccucuccggcuuccagcuccccuccuccaucgucuccaccggcuccauccucacccucugguucaccaccgacuucgccgucuccgcccagggcuucaaggcccucuacgagguccuccccucccacaccugcggcaaccccggcgagauccucaagggcguccuccacggcacccgcuucaacaucggcgacaagauccgcuacuccugccuccccggcuacauccucgagggccacgccauccucaccugcaucgucucccccggcaacggcgccuccugggacuuccccgcccccuucugccgcgccgagggcgccugcggcggcacccuccgcggcaccuccuccuccaucuccuccccccacuuccccuccgaguacgagaacaacgccgacugcaccuggaccauccucgccgagcccggcgacaccaucgcccucgucuucaccgacuuccagcucgaggagggcuacgacuuccucgagaucuccggcaccgaggcccccuccaucuggcucaccggcaugaaccuccccucccccgucaucuccuccaagaacuggcuccgccuccacuucaccuccgacuccaaccaccgccgcaagggcuucaacgcccaguuccaggucaagaaggccaucgagcucaagucccgcggcgucaagaugcuccccuccaaggacggcucccacaagaacuccguccucucccagggcggcgucgcccucgucuccgacaugugccccgaccccggcauccccgagaacggccgccgcgccggcuccgacuuccgcgucggcgccaacguccaguucuccugcgaggacaacuacguccuccagggcuccaaguccaucaccugccagcgcgucaccgagacccucgccgccugguccgaccaccgccccaucugccgcgcccgcaccugcggcuccaaccuccgcggccccuccggcgucaucaccucccccaacuaccccguccaguacgaggacaacgcccacugcgucugggucaucaccaccaccgaccccgacaaggucaucaagcucgccuucgaggaguucgagcucgagcgcggcuacgacacccucaccgucggcgacgccggcaaggucggcgacacccgcuccguccucuacguccucaccggcuccuccguccccgaccucaucgucuccauguccaaccagauguggcuccaccuccaguccgacgacuccaucggcucccccggcuucaaggccgucuaccaggagaucgagaagggcggcugcggcgaccccggcauccccgccuacggcaagcgcaccggcuccuccuuccuccacggcgacacccucaccuucgagugccccgccgccuucgagcucgucggcgagcgcgucaucaccugccagcagaacaaccagugguccggcaacaagcccuccugcgucuucuccugcuucuucaacuucaccgccuccuccggcaucauccucucccccaacuaccccgaggaguacggcaacaacaugaacugcgucuggcucaucaucuccgagcccggcucccgcauccaccucaucuucaacgacuucgacgucgagccccaguucgacuuccucgccgucaaggacgacggcaucuccgacaucaccguccucggcaccuucuccggcaacgagguccccucccagcucgccuccuccggccacaucguccgccucgaguuccaguccgaccacuccaccaccggccgcggcuucaacaucaccuacaccaccuucggccagaacgagugccacgaccccggcauccccaucaacggccgccgcuucggcgaccgcuuccuccucggcuccuccgucuccuuccacugcgacgacggcuucgucaagacccagggcuccgaguccaucaccugcauccuccaggacggcaacgucgucugguccuccaccgucccccgcugcgaggcccccugcggcggccaccucaccgccuccuccggcgucauccucccccccggcuggcccggcuacuacaaggacucccuccacugcgaguggaucaucgaggccaagcccggccacuccaucaagaucaccuucgaccgcuuccagaccgaggucaacuacgacacccucgagguccgcgacggccccgccuccuccuccccccucaucggcgaguaccacggcacccaggccccccaguuccucaucuccaccggcaacuucauguaccuccucuucaccaccgacaacucccgcuccuccaucggcuuccucauccacuacgaguccgucacccucgaguccgacuccugccucgaccccggcauccccgucaacggccaccgccacggcggcgacuucggcauccgcuccaccgucaccuucuccugcgaccccggcuacacccucuccgacgacgagccccucgucugcgagcgcaaccaccaguggaaccacgcccuccccuccugcgacgcccucugcggcggcuacauccagggcaaguccggcaccguccucucccccggcuuccccgacuucuaccccaacucccucaacugcaccuggaccaucgaggucucccacggcaagggcguccagaugaucuuccacaccuuccaccucgaguccucccacgacuaccuccucaucaccgaggacggcuccuucuccgagcccgucgcccgccucaccggcuccguccucccccacaccaucaaggccggccucuucggcaacuucaccgcccagcuccgcuucaucuccgacuucuccaucuccuacgagggcuucaacaucaccuucuccgaguacgaccucgagcccugcgacgaccccggcguccccgccuucucccgccgcaucggcuuccacuucggcgucggcgacucccucaccuucuccugcuuccucggcuaccgccucgagggcgccaccaagcucaccugccucggcggcggccgccgcgucugguccgccccccucccccgcugcgucgccgagugcggcgccuccgucaagggcaacgagggcacccuccucucccccaacuuccccuccaacuacgacaacaaccacgagugcaucuacaagaucgagaccgaggccggcaagggcauccaccuccgcacccgcuccuuccagcucuucgagggcgacacccucaaggucuacgacggcaaggacuccuccucccgcccccucggcaccuucaccaagaacgagcuccucggccucauccucaacuccaccuccaaccaccucuggcucgaguucaacaccaacggcuccgacaccgaccagggcuuccagcucaccuacaccuccuucgaccucgucaagugcgaggaccccggcauccccaacuacggcuaccgcauccgcgacgagggccacuucaccgacaccgucguccucuacuccugcaaccccggcuacgccaugcacggcuccaacacccucaccugccucuccggcgaccgccgcgucugggacaagccccuccccuccugcaucgccgagugcggcggccagauccacgccgccaccuccggccgcauccucucccccggcuaccccgcccccuacgacaacaaccuccacugcaccuggaucaucgaggccgaccccggcaagaccaucucccuccacuucaucgucuucgacaccgagauggcccacgacauccucaaggucugggacggccccgucgacuccgacauccuccucaaggagugguccggcuccgcccuccccgaggacauccacuccaccuucaacucccucacccuccaguucgacuccgacuucuucaucuccaaguccggcuucuccauccaguucuccaccuccaucgccgccaccugcaacgaccccggcaugccccagaacggcacccgcuacggcgacucccgcgaggccggcgacaccgucaccuuccagugcgaccccggcuaccagcuccagggccaggccaagaucaccugcguccagcucaacaaccgcuucuucuggcagcccgacccccccaccugcaucgccgccugcggcggcaaccucaccggccccgccggcgucauccucucccccaacuacccccagcccuacccccccggcaaggagugcgacuggcgcgucaaggucaaccccgacuucgucaucgcccucaucuucaaguccuucaacauggagcccuccuacgacuuccuccacaucuacgagggcgaggacuccaacuccccccucaucggcuccuaccagggcucccaggcccccgagcgcaucgaguccuccggcaacucccucuuccucgccuuccgcuccgacgccuccgucggccucuccggcuucgccaucgaguucaaggagaagccccgcgaggccugcuucgaccccggcaacaucaugaacggcacccgcgucggcaccgacuucaagcucggcuccaccaucaccuaccagugcgacuccggcuacaagauccucgaccccuccuccaucaccugcgucaucggcgccgacggcaagcccuccugggaccagguccuccccuccugcaacgcccccugcggcggccaguacaccggcuccgagggcgucguccucucccccaacuacccccacaacuacaccgccggccagaucugccucuacuccaucaccguccccaaggaguucgucgucuucggccaguucgccuacuuccagaccgcccucaacgaccucgccgagcucuucgacggcacccacgcccaggcccgccuccucuccucccucuccggcucccacuccggcgagacccucccccucgccaccuccaaccagauccuccuccgcuucuccgccaaguccggcgccuccgcccgcggcuuccacuucgucuaccaggccgucccccgcaccuccgacacccagugcuccuccguccccgagccccgcuacggccgccgcaucggcuccgaguucuccgccggcuccaucguccgcuucgagugcaaccccggcuaccuccuccagggcuccaccgcccuccacugccaguccguccccaacgcccucgcccaguggaacgacaccauccccuccugcgucguccccugcuccggcaacuucacccagcgccgcggcaccauccucucccccggcuaccccgagcccuacggcaacaaccucaacugcaucuggaagaucaucgucaccgagggcuccggcauccagauccaggucaucuccuucgccaccgagcagaacugggacucccucgagauccacgacggcggcgacgucaccgccccccgccucggcuccuucuccggcaccaccguccccgcccuccucaacuccaccuccaaccagcucuaccuccacuuccaguccgacaucuccgucgccgccgccggcuuccaccucgaguacaagaccgucggccucgccgccugccaggagcccgcccuccccuccaacuccaucaagaucggcgaccgcuacauggucaacgacguccucuccuuccagugcgagcccggcuacacccuccagggccgcucccacaucuccugcaugcccggcaccguccgccgcuggaacuaccccuccccccucugcaucgccaccugcggcggcacccucuccacccucggcggcgucauccucucccccggcuuccccggcuccuaccccaacaaccucgacugcaccuggcgcaucucccuccccaucggcuacggcgcccacauccaguuccucaacuucuccaccgaggccaaccacgacuuccucgagauccagaacggccccuaccacaccucccccaugaucggccaguucuccggcaccgaccuccccgccgcccuccucuccaccacccacgagacccucauccacuucuacuccgaccacucccagaaccgccagggcuucaagcucgccuaccaggccuacgagcuccagaacugccccgaccccccccccuuccagaacggcuacaugaucaacuccgacuacuccgucggccaguccgucuccuucgagugcuaccccggcuacauccucaucggccaccccguccucaccugccagcacggcaucaaccgcaacuggaacuaccccuucccccgcugcgacgcccccugcggcuacaacgucaccucccagaacggcaccaucuacucccccggcuuccccgacgaguaccccauccucaaggacugcaucuggcucaucaccgucccccccggccacggcgucuacaucaacuucacccuccuccagaccgaggccgucaacgacuacaucgccgucugggacggccccgaccagaacuccccccagcucggcgucuucuccggcaacaccgcccucgagaccgccuacuccuccaccaaccagguccuccucaaguuccacuccgacuucuccaacggcggcuucuucguccucaacuuccacgccuuccagcucaagaagugccagcccccccccgccgucccccaggccgagaugcucaccgaggacgacgacuucgagaucggcgacuucgucaaguaccagugccaccccggcuacacccucgucggcaccgacauccucaccugcaagcucuccucccagcuccaguucgagggcucccuccccaccugcgaggcccagugccccgccaacgagguccgcaccggcuccuccggcgucauccucucccccggcuaccccggcaacuacuucaacucccagaccugcuccugguccaucaaggucgagcccaacuacaacaucaccaucuucgucgacaccuuccaguccgagaagcaguucgacgcccucgaggucuucgacggcuccuccggccaguccccccuccucgucguccucuccggcaaccacaccgagcaguccaacuucaccucccgcuccaaccagcucuaccuccgcugguccaccgaccacgccaccuccaagaagggcuucaagauccgcuacgccgcccccuacugcucccucacccacccccucaagaacggcggcauccucaaccgcaccgccggcgccgucggcuccaagguccacuacuucugcaagcccggcuaccgcauggucggccacuccaacgccaccugccgccgcaacccccucggcauguaccagugggacucccucaccccccucugccaggccgucuccugcggcauccccgagucccccggcaacggcuccuucaccggcaacgaguucacccucgacuccaaggucgucuacgagugccacgagggcuucaagcucgaguccucccagcaggccaccgccgucugccaggaggacggccucugguccaacaagggcaagccccccaccugcaagcccgucgccugccccuccaucgaggcccagcucuccgagcacgucaucuggcgccucgucuccggcucccucaacgaguacggcgcccagguccuccucuccugcucccccggcuacuaccucgagggcuggcgccuccuccgcugccaggccaacggcaccuggaacaucggcgacgagcgccccuccugccgcgucaucuccugcggcucccucuccuucccccccaacggcaacaagaucggcacccucaccgucuacggcgccaccgccaucuucaccugcaacaccggcuacacccucgucggcucccacguccgcgagugccucgccaacggccucugguccggcuccgagacccgcugccucgccggccacugcggcucccccgaccccaucgucaacggccacaucuccggcgacggcuucuccuaccgcgacaccgucgucuaccagugcaaccccggcuuccgccucgucggcaccuccguccgcaucugccuccaggaccacaagugguccggccagacccccgucugcguccccaucaccugcggccaccccggcaaccccgcccacggcuucaccaacggcuccgaguucaaccucaacgacgucgucaacuucaccugcaacaccggcuaccuccuccagggcgucucccgcgcccagugccgcuccaacggccagugguccuccccccuccccaccugccgcgucgucaacugcuccgaccccggcuucgucgagaacgccauccgccacggccagcagaacuuccccgaguccuucgaguacggcauguccauccucuaccacugcaagaagggcuucuaccuccucggcuccuccgcccucaccugcauggccaacggccucugggaccgcucccuccccaagugccucgccaucuccugcggccaccccggcguccccgccaacgccguccucaccggcgagcucuucaccuacggcgccgucguccacuacuccugccgcggcuccgagucccucaucggcaacgacacccgcgucugccaggaggacucccacugguccggcgcccucccccacugcaccggcaacaaccccggcuucugcggcgaccccggcacccccgcccacggcucccgccucggcgacgacuucaagaccaagucccuccuccgcuucuccugcgagaugggccaccagcuccgcggcucccccgagcgcaccugccuccucaacggcuccugguccggccuccagcccgucugcgaggccgucuccugcggcaaccccggcacccccaccaacggcaugaucgucuccuccgacggcauccucuucuccuccuccgucaucuacgccugcugggagggcuacaagaccuccggccucaugacccgccacugcaccgccaacggcaccuggaccggcaccgcccccgacugcaccaucaucuccugcggcgaccccggcacccucgccaacggcauccaguucggcaccgacuucaccuucaacaagaccgucuccuaccagugcaaccccggcuacgucauggaggccgucaccuccgccaccauccgcugcaccaaggacggccgcuggaaccccuccaagcccgucugcaaggccguccucugcccccagcccccccccguccagaacggcaccgucgagggcuccgacuuccgcuggggcuccuccaucuccuacuccugcauggacggcuaccagcucucccacuccgccauccucuccugcgagggccgcggcgucuggaagggcgagaucccccagugccuccccgucuucugcggcgaccccggcauccccgccgagggccgccucuccggcaaguccuucaccuacaaguccgaggucuucuuccagugcaagucccccuucauccucgucggcuccucccgccgcgucugccaggccgacggcaccugguccggcauccagcccaccugcaucgaccccgcccacaacaccugccccgaccccggcaccccccacuucggcauccagaacuccucccgcggcuacgaggucggcuccaccgucuucuuccgcugccgcaagggcuaccacauccagggcuccaccacccgcaccugccucgccaaccucaccugguccggcauccagaccgagugcaucccccacgccugccgccagcccgagacccccgcccacgccgacguccgcgccaucgaccuccccaccuucggcuacacccucgucuacaccugccaccccggcuucuuccucgccggcggcuccgagcaccgcaccugcaaggccgacaugaaguggaccggcaagucccccgucugcaaguccaagggcguccgcgaggucaacgagaccgucaccaagacccccguccccuccgacgucuucuucgucaacucccucuggaagggcuacuacgaguaccucggcaagcgccagcccgccacccucaccgucgacugguucaacgccaccuccuccaaggucaacgccaccuucuccgaggccucccccgucgagcucaagcucaccggcaucuacaagaaggaggaggcccaccuccuccucaaggccuuccagaucaagggccaggccgacaucuucgucuccaaguucgagaacgacaacuggggccucgacggcuacgucuccuccggccucgagcgcggcggcuucaccuuccagggcgacauccacggcaaggacuucggcaaguucaagcucgagcgccaggacccccucaaccccgaccaggacuccuccucccacuaccacggcaccuccuccggcuccgucgccgccgccauccucguccccuucuucgcccucauccucuccggcuucgccuucuaccucuacaagcaccgcacccgccccaagguccaguacaacggcuacgccggccacgagaacuccaacggccaggccuccuucgagaaccccauguacgacaccaaccucaagcccaccgaggccaaggccguccgcuucgacaccacccucaacaccgucugcaccgucgucuga

SEQ ID NO: 41814 - RNA, 10824 nt, Artificial Sequence
  derived and/or modified sequence opt2 from CSMD2__Homo_sapiens__XP_011538874
augccccgcucccgcggccgcgagcucggccgcugcggcugccccgccggccgcgcccgcggcgagaccggcaucuccgcccucguccccggcgccggcucccgcuggggccgcccccccccccccaccccccccccccuccuccuccuccucggcugcggccuccucuccgucuccgccgccgccggccagaacugcaccuuccagcuccacggccccaacggcaccgucgagucccccggcuuccccuacggcuaccccaacuacgccaacugcaccuggaccaucaccgccgaggagcagcaccgcauccagcucgucuuccaguccuucgcccucgaggaggacuucgacguccucuccgucuucgacggccccccccagcccgagaaccuccgcacccgccucaccggcuuccagcuccccgccaccaucgucuccgccgccaccacccucucccuccgccucaucuccgacuacgccgucuccgcccagggcuuccacgccaccuacgagguccuccccucccacaccugcggcaaccccggccgccuccccaacggcauccagcagggcuccaccuucaaccucggcgacaagguccgcuacuccugcaaccucggcuucuuccucgagggccacgccguccucaccugccacgccggcuccgagaacuccgccaccugggacuucccccuccccuccugccgcgccgacgacgccugcggcggcacccuccgcggccaguccggcaucaucuccuccccccacuuccccuccgaguaccacaacaacgccgacugcaccuggaccauccucgccgagcucggcgacaccaucgcccucgucuucaucgacuuccagcucgaggacggcuacgacuuccucgaggucaccggcaccgagggcuccucccucugguucaccggcgccucccuccccgcccccgucaucuccuccaagaacuggcuccgccuccacuucaccuccgacggcaaccaccgccagcgcggcuucuccgcccaguaccaggucaagaagcagaucgagcucaagucccgcggcgucaagcucaugcccuccaaggacaacucccagaagaccuccguccucacccaggucggcgucucccagggccacaacaugugccccgaccccggcauccccgagcgcggcaagcgccucggcuccgacuuccgccucggcuccuccguccaguucaccugcaacgagggcuacgaccuccagggcuccaagcgcaucaccugcaugaaggucuccgacauguucgccgccugguccgaccaccgccccgucugccgcgcccgcaugugcgacgcccaccuccgcggccccuccggcaucaucaccucccccaacuuccccauccaguacgacaacaacgcccacugcgucuggaucaucaccgcccucaaccccuccaaggucaucaagcucgccuucgaggaguucgaccucgagcgcggcuacgacacccucaccgucggcgacggcggccaggacggcgaccagaagaccguccucuacauccucaccggcaccuccguccccgaccucaucgucuccaccaaccaccagauguggcuccucuuccagaccgacggcuccggcuccucccucggcuucaaggccuccuacgaggagaucgagcagggcuccugcggcgaccccggcauccccgccuacggccgccgcgagggcucccgcuuccaccacggcgacacccucaaguucgagugccagcccgccuucgagcucgucggccagaaggccaucaccugccagaagaacaaccagugguccgccaagaagcccggcugcgucuucuccugcuucuucaacuucaccucccccuccggcgucguccucucccccaacuaccccgaggacuacggcaaccaccuccacugcgucuggcucauccucgcccgccccgagucccgcauccaccucgccuucaacgacaucgacgucgagccccaguucgacuuccucgucaucaaggacggcgccaccgccgaggcccccguccucggcaccuucuccggcaaccagcuccccuccuccaucaccuccuccggccacgucgcccgccucgaguuccagaccgaccacuccaccggcaagcgcggcuucaacaucaccuucaccaccuuccgccacaacgagugccccgaccccggcguccccgucaacggcaagcgcuucggcgacucccuccagcucggcuccuccaucuccuuccucugcgacgagggcuuccucggcacccagggcuccgagaccaucaccugcguccucaaggagggcuccgucgucuggaacuccgccguccuccgcugcgaggcccccugcggcggccaccucaccucccccuccggcaccauccucucccccggcuggcccggcuucuacaaggacgcccucuccugcgccugggucaucgaggcccagcccggcuaccccaucaagaucaccuucgaccgcuucaagaccgaggucaacuacgacacccucgagguccgcgacggccgcaccuacuccgccccccucaucggcgucuaccacggcacccaggucccccaguuccucaucuccaccuccaacuaccucuaccuccucuucuccaccgacaagucccacuccgacaucggcuuccagcuccgcuacgagaccaucacccuccaguccgaccacugccucgaccccggcauccccgucaacggccagcgccacggcaacgacuucuacgucggcgcccucgucaccuucuccugcgacuccggcuacacccucuccgacggcgagccccucgagugcgagcccaacuuccaguggucccgcgcccuccccuccugcgaggcccucugcggcggcuucauccagggcuccuccggcaccauccucucccccggcuuccccgacuucuaccccaacaaccucaacugcaccuggaucaucgagaccucccacggcaagggcgucuucuucaccuuccacaccuuccaccucgaguccggccacgacuaccuccucaucaccgagaacggcuccuucacccagccccuccgccagcucaccggcucccgccuccccgcccccaucuccgccggccucuacggcaacuucaccgcccagguccgcuucaucuccgacuucuccauguccuacgagggcuucaacaucaccuucuccgaguacgaccucgagcccugcgaggagcccgagguccccgccuacuccauccgcaagggccuccaguucggcgucggcgacacccucaccuucuccugcuuccccggcuaccgccucgagggcaccgcccgcaucaccugccucggcggccgccgccgccucugguccuccccccucccccgcugcgucgccgagugcggcaacuccgucaccggcacccagggcacccuccucucccccaacuuccccgucaacuacaacaacaaccacgagugcaucuacuccauccagacccagcccggcaagggcauccagcucaaggcccgcgccuucgagcucuccgagggcgacguccucaaggucuacgacggcaacaacaacuccgcccgccuccucggcgucuucucccacuccgagaugaugggcgucacccucaacuccaccuccuccucccucuggcucgacuucaucaccgacgccgagaacaccuccaagggcuucgagcuccacuucuccuccuucgagcucaucaagugcgaggaccccggcacccccaaguucggcuacaagguccacgacgagggccacuucgccggcuccuccgucuccuucuccugcgaccccggcuacucccuccgcggcuccgaggagcuccucugccucuccggcgagcgccgcaccugggaccgcccccuccccaccugcgucgccgagugcggcggcaccguccgcggcgaggucuccggccagguccucucccccggcuaccccgcccccuacgagcacaaccucaacugcaucuggaccaucgaggccgaggccggcugcaccaucggccuccacuuccucgucuucgacaccgaggagguccacgacguccuccgcaucugggacggccccgucgaguccggcguccuccucaaggagcucuccggccccgcccuccccaaggaccuccacuccaccuucaacuccgucguccuccaguucuccaccgacuucuucaccuccaagcagggcuucgccauccaguucuccgucuccaccgccaccuccugcaacgaccccggcaucccccagaacggcucccgcuccggcgacuccugggaggccggcgacuccaccgucuuccagugcgaccccggcuacgcccuccagggcuccgccgagaucuccugcgucaagaucgagaaccgcuucuucuggcagcccuccccccccaccugcaucgcccccugcggcggcgaccucaccggccccuccggcgucauccucucccccaacuaccccgagcccuacccccccggcaaggagugcgacuggaaggucaccgucucccccgacuacgucaucgcccucgucuucaacaucuucaaccucgagcccggcuacgacuuccuccacaucuacgacggccgcgacucccucuccccccucaucggcuccuucuacggcucccagcuccccggccgcaucgaguccuccuccaacucccucuuccucgccuuccgcuccgacgccuccgucuccaacgccggcuucgucaucgacuacaccgagaacccccgcgaguccugcuucgaccccggcuccaucaagaacggcacccgcgucggcuccgaccucaagcucggcuccuccgucaccuacuacugccacggcggcuacgaggucgagggcaccuccacccucuccugcauccucggccccgacggcaagcccgucuggaacaacccccgccccgucugcaccgcccccugcggcggccaguacgucggcuccgacggcgucguccucucccccaacuacccccagaacuacaccuccggccagaucugccucuacuucgucaccguccccaaggacuacgucgucuucggccaguucgccuucuuccacaccgcccucaacgacgucgucgagguccacgacggccacucccagcacucccgccuccucuccucccucuccggcucccacaccggcgagucccucccccucgccaccuccaaccagguccucaucaaguucuccgccaagggccucgcccccgcccgcggcuuccacuucgucuaccaggccgucccccgcaccuccgccacccagugcuccuccguccccgagccccgcuacggcaagcgccucggcuccgacuucuccgucggcgccaucguccgcuucgagugcaacuccggcuacgcccuccagggcucccccgagaucgagugccuccccguccccggcgcccucgcccaguggaacgucuccgcccccaccugcgucguccccugcggcggcaaccucaccgagcgccgcggcaccauccucucccccggcuuccccgagcccuaccucaacucccucaacugcgucuggaagaucgucguccccgagggcgccggcauccagauccaggucgucuccuucgucaccgagcagaacugggacucccucgaggucuucgacggcgccgacaacaccgucaccaugcucggcuccuucuccggcaccaccguccccgcccuccucaacuccaccuccaaccagcucuaccuccacuucuacuccgacaucuccgucuccgccgccggcuuccaccucgaguacaagaccgucggccucuccuccugccccgagcccgccguccccuccaacggcgucaagaccggcgagcgcuaccucgucaacgacgucgucuccuuccagugcgagcccggcuacgcccuccagggccacgcccacaucuccugcaugcccggcaccguccgccgcuggaacuacccccccccccucugcaucgcccagugcggcggcaccgucgaggagauggagggcgucauccucucccccggcuuccccggcaacuaccccuccaacauggacugcuccuggaagaucgcccuccccgucggcuucggcgcccacauccaguuccucaacuucuccaccgagcccaaccacgacuacaucgagauccgcaacggccccuacgagaccucccgcaugaugggccgcuucuccggcuccgagcuccccuccucccuccucuccaccucccacgagaccaccgucuacuuccacuccgaccacucccagaaccgccccggcuucaagcucgaguaccaggccuacgagcuccaggagugccccgaccccgagcccuucgccaacggcaucguccgcggcgccggcuacaacgucggccaguccgucaccuucgagugccuccccggcuaccagcucaccggccaccccguccucaccugccagcacggcaccaaccgcaacugggaccacccccuccccaagugcgagguccccugcggcggcaacaucaccuccuccaacggcaccgucuacucccccggcuuccccucccccuacuccuccucccaggacugcgucuggcucaucaccguccccaucggccacggcguccgccucaaccucucccuccuccagaccgagcccuccggcgacuucaucaccaucugggacggcccccagcagaccgccccccgccucggcgucuucacccgcuccauggccaagaagaccguccaguccuccuccaaccagguccuccucaaguuccaccgcgacgccgccaccggcggcaucuucgccaucgccuucuccgccuacccccucaccaagugccccccccccaccauccuccccaacgccgaggucgucaccgagaacgaggaguucaacaucggcgacaucguccgcuaccgcugccuccccggcuucacccucgucggcaacgagauccucaccugcaagcucggcaccuaccuccaguucgagggccccccccccaucugcgagguccacugccccaccaacgagcuccucaccgacuccaccggcgucauccucucccaguccuaccccggcuccuacccccaguuccagaccugcuccuggcucguccgcgucgagcccgacuacaacaucucccucaccgucgaguacuuccucuccgagaagcaguacgacgaguucgagaucuucgacggccccuccggccaguccccccuccucaaggcccucuccggcaacuacuccgccccccucaucgucaccuccuccuccaacuccgucuaccuccgcugguccuccgaccacgccuacaaccgcaagggcuucaagauccgcuacuccgcccccuacugcucccucccccgcgccccccuccacggcuucauccucggccagaccuccacccagcccggcggcuccauccacuucggcugcaacgccggcuaccgccucgucggccacuccauggccaucugcacccgccacccccagggcuaccaccucugguccgaggccaucccccucugccaggcccucuccugcggccuccccgaggcccccaagaacggcauggucuucggcaaggaguacaccgucggcaccaaggccauguacuccugcuccgagggcuaccaccuccaggccggcgccgaggccaccgccgagugccucgacaccggccucugguccaaccgcaacguccccccccagugcguccccgucaccugccccgacgucuccuccaucuccgucgagcacggccgcuggcgccucaucuucgagacccaguaccaguuccaggcccagcucaugcucaucugcgaccccggcuacuacuacaccggccagcgcgucauccgcugccaggccaacggcaaguggucccucggcgacuccacccccaccugccgcaucaucuccugcggcgagcuccccaucccccccaacggccaccgcaucggcacccucuccgucuacggcgccaccgccaucuucuccugcaacuccggcuacacccucgucggcucccgcguccgcgagugcauggccaacggccucugguccggcuccgagguccgcugccucgccggccacugcggcacccccgagcccaucgucaacggccacaucaacggcgagaacuacuccuaccgcggcuccgucgucuaccagugcaacgccggcuuccgccucaucggcauguccguccgcaucugccagcaggaccaccacugguccggcaagacccccuucugcguccccaucaccugcggccaccccggcaaccccgucaacggccucacccagggcaaccaguucaaccucaacgacgucgucaaguucgucugcaaccccggcuacauggccgagggcgccgcccgcucccagugccucgccuccggccagugguccgacaugcuccccaccugccgcaucaucaacugcaccgaccccggccaccaggagaacuccguccgccagguccacgccuccggcccccaccgcuucuccuucggcaccaccgucuccuaccgcugcaaccacggcuucuaccuccucggcacccccguccucuccugccagggcgacggcaccugggaccgcccccgcccccagugccuccucgucuccugcggccaccccggcucccccccccacucccagauguccggcgacuccuacaccgucggcgccgucguccgcuacuccugcaucggcaagcgcacccucgucggcaacuccacccgcaugugcggccucgacggccacuggaccggcucccucccccacugcuccggcaccuccgucggcgucugcggcgaccccggcauccccgcccacggcauccgccucggcgacuccuucgaccccggcaccgucaugcgcuucuccugcgaggccggccacguccuccgcggcuccuccgagcgcaccugccaggccaacggcuccugguccggcucccagcccgagugcggcgucaucuccugcggcaaccccggcacccccuccaacgcccgcgucgucuucuccgacggccucgucuucuccuccuccaucgucuacgagugccgcgagggcuacuacgccaccggccuccucucccgccacugcuccgucaacggcaccuggaccggcuccgaccccgagugccucgucaucaacugcggcgaccccggcauccccgccaacggccuccgccucggcaacgacuuccgcuacaacaagaccgucaccuaccagugcguccccggcuacaugauggagucccaccgcgucuccguccucuccugcaccaaggaccgcaccuggaacggcaccaagcccgucugcaaggcccucaugugcaagccccccccccucauccccaacggcaaggucgucggcuccgacuucauguggggcuccuccgucaccuacgccugccucgagggcuaccagcucucccuccccgccgucuucaccugcgagggcaacggcuccuggaccggcgagcucccccagugcuuccccgucuucugcggcgaccccggcguccccucccgcggccgccgcgaggaccgcggcuucuccuaccgcuccuccgucuccuucuccugccaccccccccucguccucgucggcuccccccgccgcuucugccaguccgacggcaccugguccggcacccagcccuccugcaucgaccccacccucaccaccugcgccgaccccggcgucccccaguucggcauccagaacaacucccagggcuaccaggucggcuccaccguccucuuccgcugccagaagggcuaccuccuccagggcuccaccacccgcaccugccuccccaaccucaccugguccggcaccccccccgacugcgucccccaccacugccgccagcccgagacccccacccacgccaacgucggcgcccucgaccuccccuccaugggcuacacccucaucuacuccugccaggagggcuucucccucaagggcggcuccgagcaccgcaccugcaaggccgacggcuccuggaccggcaagccccccaucugccucgccgagguccgccccuccggccgccccaucaacaccgcccgcgagcccccccucacccaggcccucauccccggcgacgucuucgccaagaacucccucuggaagggcgccuacgaguaccagggcaagaagcagcccgccaugcuccgcgucaccggcuuccaggucgccaacuccaaggucaacgccaccaugaucgaccacuccggcgucgagcuccaccucgccggcaccuacaagaaggaggacuuccaccuccuccuccaggucuaccagaucaccggccccgucgagaucuucaugaacaaguucaaggacgaccacugggcccucgacggccacgucuccuccgaguccuccggcgccaccuucaucuaccagggcuccgucaagggccagggcuucggccaguucggcuuccagcgccucgaccuccgccuccucgaguccgaccccgaguccaucggccgccacuucgccuccaacuccuccuccgucgccgccgccauccucguccccuucaucgcccucaucaucgccggcuucguccucuaccucuacaagcaccgccgccgccccaagguccccuucaacggcuacgccggccacgagaacaccaacguccgcgccaccuucgagaaccccauguacgaccgcaacauccagcccaccgacaucauggccuccgaggccgaguucaccgucuccaccgucugcaccgccgucuga

SEQ ID NO: 41815 - RNA, 10617 nt, Artificial Sequence
  derived and/or modified sequence opt2 from CSMD3__Homo_sapiens__NP_443132
augaagggcauccgcaagggcgagucccgcgccaaggaguccaagcccugggagcccggcaagcgccgcugcgccaagugcggccgccucgacuucauccucaugaagaagaugggcaucaaguccggcuucaccuucuggaaccucgucuuccuccucaccgucuccugcgucaagggcuucaucuacaccugcggcggcacccucaagggccucaacggcaccaucgagucccccggcuuccccuacggcuaccccaacggcgccaacugcaccugggucaucaucgccgaggagcgcaaccgcauccagaucgucuuccaguccuucgcccucgaggaggaguacgacuaccucucccucuacgacggccacccccaccccaccaacuuccgcacccgccucaccggcuuccaccuccccccccccgucaccuccaccaaguccgucuucucccuccgccucaccuccgacuucgccgucuccgcccacggcuucaaggucuacuacgaggagcuccaguccuccuccugcggcaaccccggcgucccccccaagggcguccucuacggcacccgcuucgacgucggcgacaagauccgcuacuccugcgucaccggcuacauccucgacggccacccccagcucaccugcaucgccaacuccgucaacaccgccuccugggacuuccccguccccaucugccgcgccgaggacgccugcggcggcaccaugcgcggcuccuccggcaucaucuccucccccuccuuccccaacgaguaccacaacaacgccgacugcaccuggaccaucgucgccgagcccggcgacaccaucucccucaucuucaccgacuuccagauggaggagaaguacgacuaccucgagaucgagggcuccgagccccccaccaucuggcucuccggcaugaacauccccccccccaucaucuccaacaagaacuggcuccgccuccacuucgucaccgacuccaaccaccgcuaccgcggcuucuccgcccccuaccaggucaagaaggccaucgacuucaagucccgcggcuucaagcucuuccccggcaaggacaacuccaacaaguucuccauccucaacgagggcggcaucaagaccgccuccaaccucugccccgaccccggcgagcccgagaacggcaagcgcaucggcuccgacuucucccucggcuccaccguccaguucuccugcgacgaggacuacguccuccagggcgccaaguccaucaccugccagcgcaucgccgaggucuucgccgccugguccgaccaccgccccgucugcaaggucaagaccugcggcuccaaccuccagggccccuccggcaccuucaccucccccaacuuccccuuccaguacgacuccaacgcccagugcgucugggucaucaccgccgucaacaccaacaaggucauccagaucaacuucgaggaguucgaccucgagaucggcuacgacacccucaccaucggcgacggcggcgaggucggcgacccccgcaccguccuccagguccucaccggcuccuucguccccgaccucaucgucuccauguccucccagauguggcuccaccuccagaccgacgaguccgucggcuccgucggcuucaaggucaacuacaaggagaucgagaaggaguccugcggcgaccccggcaccccccucuacggcauccgcgagggcgacggcuucuccaaccgcgacguccuccgcuucgagugccaguucggcuucgagcucaucggcgagaaguccaucgucugccaggagaacaaccagugguccgccaacauccccaucugcaucuuccccugccucuccaacuucaccgcccccaugggcaccguccucucccccgacuaccccgagggcuacggcaacaaccucaacugcaucuggaccaucaucuccgaccccggcucccgcauccaccucuccuucaacgacuucgaccucgagucccaguucgacuuccucgccgucaaggacggcgacucccccgagucccccauccucggcaccuucaccggcgccgagguccccucccaccucaccuccaacucccacauccuccgccucgaguuccaggccgaccacuccauguccggccgcggcuucaacaucaccuacaacaccuucggccacaacgagugccccgaccccggcauccccaucaacgcccgccgcuucggcgacaacuuccagcucggcuccuccaucuccgucaucugcgaggagggcuucaucaagacccagggcaccgagaccaucaccugcauccucauggacggcaaggucaugugguccggccucauccccaagugcggcgcccccugcggcggccacuucuccgcccccuccggcgucauccucucccccggcuggcccggcuacuacaaggacucccucaacugcgagugggucaucgaggccgagcccggccacuccaucaagaucaccuucgagcgcuuccagaccgagcucaacuacgacguccucgagguccacgacggccccaaccuccucuccccccuccucggcuccuacaacggcacccaggucccccaguuccucuucuccuccuccaacuucaucuaccuccucuucaccaccgacaacucccgcuccaacaacggcuucaagauccacuacgaguccgucaccgucaacaccuacuccugccucgaccccggcauccccguccacggccgccgcuacggccacgacuucuccaucggcuccaccgucuccuucuccugcgacuccggcuaccgccucucccacgaggagccccuccucugcgagaagaaccacugguggucccacccccuccccaccugcgacgcccucugcggcggcgacguccgcggccccuccggcaccauccucucccccggcuaccccgaguucuaccccaacucccucaacugcaccuggaccgucgacgucacccacggcaagggcguccaguucaacuuccacaccuuccaccucgaggaccaccacgacuaccuccucaucaccgagaacggcuccuucacccagccccucgcccgccucaccggcuccgaccucccccccaccaucaacgccggccucuacggcaacuuccgcgcccagcuccgcuucaucuccgacuucuccaucuccuacgagggcuucaacaucaccuucuccgaguacaaccucgagcccugcgaggaccccggcaucccccaguacggcucccgcaucggcuucaacuucggcaucggcgacacccucaccuucuccugcuccuccggcuaccgccucgagggcaccuccgagaucaucugccucggcggcggccgccgcgucugguccgccccccucccccgcugcgucgccgagugcggcgccuccgccaccaacaacgagggcauccuccucucccccaacuacccccucaacuacgagaacaaccacgagugcaucuacuccauccagguccaggccggcaagggcaucaacaucuccgcccgcaccuuccaccucgcccagggcgacguccucaagaucuacgacggcaaggacaagaccacccaccuccucggcgccuucaccggcgccuccaugcgcggccucacccucuccuccaccuccaaccagcucuggcucgaguucaacuccgacaccgagggcaccgacgagggcuuccagcucgucuacaccuccuucgagcucucccacugcgaggaccccggcaucccccaguucggcuacaagaucuccgaccagggccacuucgccggcuccaccaucaucuacggcugcaaccccggcuacacccuccacggcuccucccuccucaagugcaugaccggcgagcgccgcgccugggacuacccccuccccuccugcaucgccgagugcggcggccgcuucaagggcgaguccuccggccgcauccucucccccggcuaccccuuccccuacgacaacaaccuccgcugcauguggaugaucgaggucgaccccggcaacaucgucucccuccaguuccucgccuucgacaccgaggccucccacgacauccuccgcgucugggacggcccccccgagaacgacaugcuccucaaggagaucuccggcucccucauccccgagggcauccacuccacccucaacaucgucaccauccaguucgacaccgacuucuacaucuccaaguccggcuucgccauccaguucuccuccuccgucgccaccgccugccgcgaccccggcguccccaugaacggcacccgcaacggcgacggccgcgagcccggcgacaccgucgucuuccagugcgaccccggcuacgagcuccagggcgaggagcgcaucaccugcauccaggucgagaaccgcuacuucuggcagcccuccccccccgucugcaucgcccccugcggcggcaaccucaccggcuccuccggcuucauccucucccccaacuucccccaccccuacccccacucccgcgacugcgacuggaccaucaccgucaacgccgacuacgucaucucccucgccuucaucuccuucuccaucgagcccaacuacgacuuccucuacaucuacgacggccccgacuccaacuccccccucaucggcuccuuccaggacuccaagcuccccgagcgcaucgaguccuccuccaacaccaugcaccucgccuuccgcuccgacggcuccgucuccuacaccggcuuccaccucgaguacaaggccaagcuccgcgaguccugcuucgaccccggcaacaucaugaacggcacccgccucggcauggacuacaagcucggcuccaccgucaccuacuacugcgacgccggcuacguccuccagggcuacuccacccucaccugcaucaugggcgacgacggccgccccggcuggaaccgcgcccuccccuccugccacgcccccugcggcucccgcuccaccggcuccgagggcaccguccucucccccaacuaccccaagaacuacuccgucggccacaacugcgucuacuccaucgccguccccaaggaguucgucgucuucggccaguucgucuucuuccagaccucccuccacgacgucgucgaggucuacgacggccccacccagcaguccucccuccucuccucccucuccggcucccacuccggcgagucccucccccucuccuccggcaaccagaucaccauccgcuucaccuccgucggccccaucaccgccaagggcuuccacuucgucuaccaggccgucccccgcaccuccuccacccagugcuccuccguccccgagccccgcuucggccgccgcaucggcaacgaguucgccgucggcuccuccguccucuucgacugcaaccccggcuacauccuccacggcuccaucgccauccgcugcgagaccguccccaacucccucgcccaguggaacgacucccuccccaccugcaucguccccugcggcggcauccucaccaagcgcaagggcaccauccucucccccggcuaccccgagcccuacgacaacaaccucaacugcgucuggaagaucaccguccccgagggcgccggcauccagguccaggucgucuccuucgccaccgagcacaacugggacucccucgacuucuacgacggcggcgacaacaacgccccccgccucggcuccuacuccggcaccaccaucccccaccuccucaacuccaccuccaacaaccucuaccucaacuuccaguccgacaucuccgucuccgccgccggcuuccaccucgaguacaccgccaucggccucgacuccugccccgagccccagacccccuccuccggcaucaagaucggcgaccgcuacauggucggcgacgucgucuccuuccagugcgaccagggcuacucccuccagggccacucccacaucaccugcaugcccggccccguccgccgcuggaacuaccccauccccaucugccucgcccagugcggcggcgccauguccgacuucuccggcgucauccucucccccggcuuccccggcaacuaccccuccucccucgacugcaccuggaccaucaaccuccccaucggcuucggcguccaccuccaguucgucaacuucuccaccgagaccauccacgacuaccucgagguccgcuccggcuccuccgagaccuccaccgucaucggccgccucuccggcccccagauccccuccucccucuucuccaccacccacgagaccucccucuacuuccacuccgacuacucccagaacaagcagggcuuccacaucgucuaccaggccuaccagcuccaguccugccccgacccccgccccuuccgcaacggcuucgucaucggcaacgacuucaccgucggccagaccaucuccuucgagugcuuccccggcuacacccucaucggcaacuccgcccucaccugccuccacggcgucucccgcaacuggaaccacccccucccccgcugcgaggcccucugcggcggcaacaucaccgccaugaacggcaccaucuacucccccggcuaccccgacgaguaccccaacuuccaggacugcuucuggcucguccgcgucccccccggcaacggcaucuacaucaacuucaccguccuccagaccgagcccaucuacgacuucaucaccgucugggacggccccgaccagaacuccccccagaucggccaguucuccggcaacaccgcccucgaguccgucuacuccaccuccaaccagauccucaucaaguuccacuccgacuucaccaccuccggcuucuucguccucuccuaccacgccuaccagcuccgcgucugccagccccccccccccguccccaacgccgagauccucaccgaggacgacgaguucgagaucggcgacaucauccgcuaccagugccuccccggcuucacccucgucggcaacgccauccucaccugccgccucggcgagcgccuccagauggacggcgccccccccgucugccagguccucugccccgccaacgagcuccgccucgacuccaccggcgucauccucucccccggcuaccccgacuccuaccccaaccuccagaugugcgccugguccaucuccgucgagaagggcuacaacaucaccauguucgucgaguucuuccagaccgagaaggaguucgacguccuccaggucuacgacggccccaacauccagucccccguccucaucucccucuccggcgacuacuccuccgccuucaacaucaccuccaacggccacgaggucuuccuccagugguccgccgaccacggcaacaacaagaagggcuuccgcauccgcuacaucgccuucuacugcuccacccccgagucccccccccacggcuacaucaucucccagaccggcggccagcucaacuccgucguccgcugggccugcgaccgcggcuuccgccucgucggcaaguccuccgccgucugccgcaaguccuccuacggcuaccacgccugggacgcccccguccccgccugccaggccaucuccugcggcauccccaaggcccccaccaacggcggcauccucaccaccgacuaccucgucggcacccgcgucaccuacuucugcaacgacggcuaccgccucuccuccaaggagcucaccaccgccgucugccaguccgacggcaccugguccaaccacaacaagaccccccgcugcgucgucaucuccugcggcgagcuccccaccccccccaacggcaacaagaucggcacccagaccuccuacggcuccaccgccaucuucaccugcgaccucggcuucaugcucgucggcuccgccguccgcgagugccucuccuccggccucugguccgaguccgagacccgcugccucgccggccacugcggcauccccgagcucaucgucaacggccaggucaucggcgagaacuacggcuaccgcgacaccgucgucuaccagugcaaccccggcuuccgccucaucggcuccuccguccgcaucugccagcaggaccacaacugguccggccagcuccccuccugcguccccgucuccugcggccaccccggcucccccaucuacggccgcaccuccggcaacggcuucaacuucaacgacgucgucaccuucuccugcaacaucggcuaccucaugcagggccccaccaaggcccagugccaggccaaccgccaguggucccaccccccccccaugugcaaggucgucaacugcuccgaccccggcauccccgccaacuccaagcgcgaguccaagaucgagcacggcaacuucaccuacggcaccgucgucuucuacgacugcaaccccggcuacuuccucuucggcuccuccguccucaucugccagcccaacggccagugggacaagccccuccccgagugcaucaugaucgacugcggccaccccggcgucccccccaacgccguccucuccggcgagaaguacaccuucggcuccaccguccacuacuccugcaccggcaagcgcucccuccucggccaguccucccgcaccugccagcucaacggccacugguccggcucccagccccacugcuccggcgacgccaccggcaccugcggcgaccccggcacccccggccacggcucccgccaggaguccaacuuccgcaccaaguccaccguccgcuacgccugcgacaccggcuacauccuccacggcuccgaggagcgcaccugccucgccaacggcuccuggaccggccgccagcccgagugcaaggccguccagugcggcaaccccggcaccaccgccaacggcaaggucuuccgcaucgacggcaccaccuucuccuccuccgucaucuacuccugcauggagggcuacauccucuccggccccuccguccgccagugcaccgccaacggcaccugguccggcacccuccccaacugcaccaucaucuccugcggcgaccccggcauccccgccaacggccuccgcuacggcgacgacuacgucgucggccagaacgucuccuacaugugccagcccggcuacaccauggagcucaacggcucccgcauccgcaccugcaccaucaacggcaccugguccggcgucaugcccaccugccgcgccgucaccugccccacccccccccagaucuccaacggccgccucgagggcaccaacuucgacuggggcuucuccaucuccuacaucugcucccccggcuacgagcucuccuuccccgccguccucaccugcgucggcaacggcaccugguccggcgaggucccccagugccuccccaaguucugcggcgaccccggcauccccgcccagggcaagcgcgagggcaaguccuucaucuaccaguccgaggucuccuucuccugcaacuuccccuucauccucgucggcuccuccacccgcaucugccaggccgacggcaccugguccggcuccuccccccacugcaucgagcccacccagaccuccugcgagaaccccggcgucccccgccacggcucccagaacaacaccuucggcuuccaggucggcuccgucguccaguuccacugcaagaagggccaccuccuccagggcuccaccacccgcaccugccuccccgaccucaccugguccggcauccagcccgagugcaucccccacuccugcaagcagcccgagacccccgcccacgccaacgucgucggcauggaccuccccucccacggcuacacccucaucuacaccugccagcccggcuucuuccucgccggcggcaccgagcaccgcgucugccgcuccgacaacaccuggaccggcaagguccccaucugcgaggccggcuccaagauccucgucaaggacccccgccccgcccucggcacccccucccccaagcucuccguccccgacgacgucuucgcccagaacuacaucuggaagggcuccuacaacuucaagggccgcaagcagcccaugacccucaccgucaccuccuucaacgccuccaccggccgcgucaacgccacccucuccaacuccaacauggagcuccuccucuccggcgucuacaagucccaggaggcccgccucaugcuccgcaucuaccucaucaagguccccgcccacgccuccgucaagaagaugaaggaggagaacugggccauggacggcuucgucuccgccgagcccgacggcgccaccuacgucuuccagggcuucauccagggcaaggacuacggccaguucggccuccagcgccucggccucaacauguccgagggcuccaacuccuccaaccagccccacggcaccaacuccuccuccgucgccaucgccauccucguccccuucuucgcccucaucuucgccggcuucggcuucuaccucuacaagcagcgcaccgcccccaagacccaguacaccggcugcuccguccacgagaacaacaacggccaggccgccuucgagaaccccauguacgacaccaacgccaaguccgucgagggcaaggccguccgcuucgaccccaaccucaacaccgucugcaccauggucuga

SEQ ID NO: 41816 - RNA, 531 nt, Artificial Sequence
  derived and/or modified sequence opt2 from CSN1S1__Homo_sapiens__NP_001020275
augcgccuccucauccucaccugccucgucgccgucgcccucgcccgccccaagcucccccuccgcuaccccgagcgccuccagaaccccuccgaguccuccgagcccaucccccucgagucccgcgaggaguacaugaacggcaugaaccgccgcaacauccuccgcgagaagcagaccgacgagaucaaggacacccgcaacgaguccacccagaacugcgucgucgccgagcccgagaagauggaguccuccaucuccuccuccuccgaggagcaguucugccgccucaacgaguacaaccagcuccagcuccaggccgcccacgcccaggagcagauccgccgcaugaacgagaacucccacguccagguccccuuccagcagcucaaccagcucgccgccuaccccuacgccgucugguacuacccccagaucaugcaguacguccccuucccccccuucuccgacaucuccaaccccaccgcccacgagaacuacgagaagaacaacgucaugcuccagugguga

SEQ ID NO: 41817 - RNA, 681 nt, Artificial Sequence
  derived and/or modified sequence opt2 from CSN2__Homo_sapiens__XP_011529920
augaagguccucauccucgccugccucgucgcccucgcccucgcccgcgagaccaucgagucccucuccuccuccgaggaguccaucaccgaguacaagcagaaggucgagaaggucaagcacgaggaccagcagcagggcgaggacgagcaccaggacaagaucuaccccuccuuccagccccagccccucaucuaccccuucgucgagcccauccccuacggcuuccucccccagaacauccucccccucgcccagcccgccgucguccuccccgucccccagcccgagaucauggagguccccaaggccaaggacaccgucuacaccaagggccgcgucaugcccguccucaagucccccaccauccccuucuucgacccccagauccccaagcucaccgaccucgagaaccuccaccucccccucccccuccuccagccccucaugcagcaggucccccagcccaucccccagacccucgcccuccccccccagccccucugguccgucccccagcccaagguccuccccaucccccagcaggucguccccuacccccagcgcgccguccccguccaggcccuccuccucaaccaggagcuccuccucaaccccacccaccagaucuaccccgucacccagccccucgcccccguccacaaccccaucuccgucuga

SEQ ID NO: 41818 - RNA, 549 nt, Artificial Sequence
  derived and/or modified sequence opt2 from CSN3__Homo_sapiens__NP_005203
augaaguccuuccuccucgucgucaacgcccucgcccucacccuccccuuccucgccgucgagguccagaaccagaagcagcccgccugccacgagaacgacgagcgccccuucuaccagaagaccgcccccuacguccccauguacuacguccccaacuccuaccccuacuacggcaccaaccucuaccagcgccgccccgccaucgccaucaacaaccccuacgucccccgcaccuacuacgccaaccccgccgucguccgcccccacgcccagaucccccagcgccaguaccuccccaacucccacccccccaccgucguccgccgccccaaccuccaccccuccuucaucgccaucccccccaagaagauccaggacaagaucaucauccccaccaucaacaccaucgccaccgucgagcccacccccgcccccgccaccgagcccaccgucgacuccgucgucacccccgaggccuucuccgaguccaucaucaccuccacccccgagaccaccaccgucgccgucaccccccccaccgccuga

SEQ ID NO: 41819 - RNA, 1098 nt, Artificial Sequence
  derived and/or modified sequence opt2 from CSNK1A1__Homo_sapiens__NP_001020276
auggccuccuccuccggcuccaaggccgaguucaucgucggcggcaaguacaagcucguccgcaagaucggcuccggcuccuucggcgacaucuaccucgccaucaacaucaccaacggcgaggaggucgccgucaagcucgagucccagaaggcccgccacccccagcuccucuacgaguccaagcucuacaagauccuccagggcggcgucggcaucccccacauccgcugguacggccaggagaaggacuacaacguccucgucauggaccuccucggccccucccucgaggaccucuucaacuucugcucccgccgcuucaccaugaagaccguccucaugcucgccgaccagaugaucucccgcaucgaguacguccacaccaagaacuucauccaccgcgacaucaagcccgacaacuuccucaugggcaucggccgccacugcaacaagugccucgagucccccgucggcaagcgcaagcgcuccaugaccgucuccaccucccaggaccccuccuucuccggccucaaccagcucuuccucaucgacuucggccucgccaagaaguaccgcgacaaccgcacccgccagcacauccccuaccgcgaggacaagaaccucaccggcaccgcccgcuacgccuccaucaacgcccaccucggcaucgagcagucccgccgcgacgacauggagucccucggcuacguccucauguacuucaaccgcaccucccuccccuggcagggccucaaggccgccaccaagaagcagaaguacgagaagaucuccgagaagaagauguccacccccgucgagguccucugcaagggcuuccccgccgaguucgccauguaccucaacuacugccgcggccuccgcuucgaggaggcccccgacuacauguaccuccgccagcucuuccgcauccucuuccgcacccucaaccaccaguacgacuacaccuucgacuggaccaugcucaagcagaaggccgcccagcaggccgccuccuccuccggccagggccagcaggcccagacccccaccggcaagcagaccgacaagaccaaguccaacaugaagggcuucuga

SEQ ID NO: 41820 - RNA, 1248 nt, Artificial Sequence
  derived and/or modified sequence opt2 from CSNK1D__Homo_sapiens__NP_001884
auggagcuccgcgucggcaaccgcuaccgccucggccgcaagaucggcuccggcuccuucggcgacaucuaccucggcaccgacaucgccgccggcgaggaggucgccaucaagcucgagugcgucaagaccaagcacccccagcuccacaucgaguccaagaucuacaagaugaugcagggcggcgucggcauccccaccauccgcuggugcggcgccgagggcgacuacaacgucauggucauggagcuccucggccccucccucgaggaccucuucaacuucugcucccgcaaguucucccucaagaccguccuccuccucgccgaccagaugaucucccgcaucgaguacauccacuccaagaacuucauccaccgcgacgucaagcccgacaacuuccucaugggccucggcaagaagggcaaccucgucuacaucaucgacuucggccucgccaagaaguaccgcgacgcccgcacccaccagcacauccccuaccgcgagaacaagaaccucaccggcaccgcccgcuacgccuccaucaacacccaccucggcaucgagcagucccgccgcgacgaccucgagucccucggcuacguccucauguacuucaaccucggcucccuccccuggcagggccucaaggccgccaccaagcgccagaaguacgagcgcaucuccgagaagaagauguccacccccaucgagguccucugcaagggcuaccccuccgaguucgccaccuaccucaacuucugccgcucccuccgcuucgacgacaagcccgacuacuccuaccuccgccagcucuuccgcaaccucuuccaccgccagggcuucuccuacgacuacgucuucgacuggaacaugcucaaguucggcgccucccgcgccgccgacgacgccgagcgcgagcgccgcgaccgcgaggagcgccuccgccacucccgcaaccccgccacccgcggccuccccuccaccgccuccggccgccuccgcggcacccaggaggucgccccccccaccccccucacccccaccucccacaccgccaacaccuccccccgccccgucuccggcauggagcgcgagcgcaaggucuccaugcgccuccaccgcggcgcccccgucaacaucuccuccuccgaccucaccggccgccaggacaccucccgcauguccaccucccagauccccggccgcgucgccuccuccggccuccaguccgucguccaccgcuga

SEQ ID NO: 41821 - RNA, 1272 nt, Artificial Sequence
  derived and/or modified sequence opt2 from CSNK1G3__Homo_sapiens__NP_001026982
auggagaacaagaagaaggacaaggacaaguccgacgaccgcauggcccgccccuccggccgcuccggccacaacacccgcggcaccggcuccuccuccuccggcguccucauggucggccccaacuuccgcgucggcaagaagaucggcugcggcaacuucggcgagcuccgccucggcaagaaccucuacaccaacgaguacgucgccaucaagcucgagcccaugaagucccgcgccccccagcuccaccucgaguaccgcuucuacaagcagcucggcuccggcgacggcaucccccaggucuacuacuucggccccugcggcaaguacaacgccaugguccucgagcuccucggccccucccucgaggaccucuucgaccucugcgaccgcaccuucucccucaagaccguccucaugaucgccauccagcucaucucccgcauggaguacguccacuccaagaaccucaucuaccgcgacgucaagcccgagaacuuccucaucggccgccccggcaacaagacccagcaggucauccacaucaucgacuucggccucgccaaggaguacaucgaccccgagaccaagaagcacauccccuaccgcgagcacaagucccucaccggcaccgcccgcuacauguccaucaacacccaccucggcaaggagcagucccgccgcgacgaccucgaggcccucggccacauguucauguacuuccuccgcggcucccuccccuggcagggccucaaggccgacacccucaaggagcgcuaccagaagaucggcgacaccaagcgcgccacccccaucgagguccucugcgagaacuuccccgagauggccaccuaccuccgcuacguccgccgccucgacuucuucgagaagcccgacuacgacuaccuccgcaagcucuucaccgaccucuucgaccgcaagggcuacauguucgacuacgaguacgacuggaucggcaagcagcuccccacccccgucggcgccguccagcaggaccccgcccucuccuccaaccgcgaggcccaccagcaccgcgacaagaugcagcaguccaagaaccaggucgucuccuccaccaacggcgagcucaacaccgacgaccccaccgccggccgcuccaacgcccccaucaccgcccccaccgaggucgaggucauggacgagaccaacugccagaagguccucaacauguggugcugcugcuucuucaagcgccgcaagcgcaagaccauccagcgccacaaguga

SEQ ID NO: 41822 - RNA, 1176 nt, Artificial Sequence
  derived and/or modified sequence opt2 from CSNK2A1__Homo_sapiens__XP_011527477
auguccggccccguccccucccgcgcccgcgucuacaccgacgucaacacccaccgcccccgcgaguacugggacuacgagucccacgucgucgaguggggcaaccaggacgacuaccagcucguccgcaagcucggccgcggcaaguacuccgaggucuucgaggccaucaacaucaccaacaacgagaaggucgucgucaagauccucaagcccgucaagaagaagaagaucaagcgcgagaucaagauccucgagaaccuccgcggcggccccaacaucaucacccucgccgacaucgucaaggaccccgucucccgcacccccgcccucgucuucgagcacgucaacaacaccgacuucaagcagcucuaccagacccucaccgacuacgacauccgcuucuacauguacgagauccucaaggcccucgacuacugccacuccaugggcaucaugcaccgcgacgucaagccccacaacgucaugaucgaccacgagcaccgcaagcuccgccucaucgacuggggccucgccgaguucuaccaccccggccaggaguacaacguccgcgucgccucccgcuacuucaagggccccgagcuccucgucgacuaccagauguacgacuacucccucgacauguggucccucggcugcaugcucgccuccaugaucuuccgcaaggagcccuucuuccacggccacgacaacuacgaccagcucguccgcaucgccaagguccucggcaccgaggaccucuacgacuacaucgacaaguacaacaucgagcucgacccccgcuucaacgacauccucggccgccacucccgcaagcgcugggagcgcuucguccacuccgagaaccagcaccucgucucccccgaggcccucgacuuccucgacaagcuccuccgcuacgaccaccagucccgccucaccgcccgcgaggccauggagcaccccuacuucuacaccgucgucaaggaccaggcccgcaugggcuccuccuccaugcccggcggcuccacccccgucuccuccgccaacaugauguccggcaucuccuccguccccacccccuccccccucggcccccucgccggcucccccgucaucgccgccgccaacccccucggcaugcccguccccgccgccgccggcgcccagcaguga

SEQ ID NO: 41823 - RNA, 1053 nt, Artificial Sequence
  derived and/or modified sequence opt2 from CSNK2A2__Homo_sapiens__NP_001887
augcccggccccgccgccggcucccgcgcccgcgucuacgccgaggucaacucccuccgcucccgcgaguacugggacuacgaggcccacguccccuccuggggcaaccaggacgacuaccagcucguccgcaagcucggccgcggcaaguacuccgaggucuucgaggccaucaacaucaccaacaacgagcgcgucgucgucaagauccucaagcccgucaagaagaagaagaucaagcgcgaggucaagauccucgagaaccuccgcggcggcaccaacaucaucaagcucaucgacaccgucaaggaccccgucuccaagacccccgcccucgucuucgaguacaucaacaacaccgacuucaagcagcucuaccagauccucaccgacuucgacauccgcuucuacauguacgagcuccucaaggcccucgacuacugccacuccaagggcaucaugcaccgcgacgucaagccccacaacgucaugaucgaccaccagcagaagaagcuccgccucaucgacuggggccucgccgaguucuaccaccccgcccaggaguacaacguccgcgucgccucccgcuacuucaagggccccgagcuccucgucgacuaccagauguacgacuacucccucgacauguggucccucggcugcaugcucgccuccaugaucuuccgccgcgagcccuucuuccacggccaggacaacuacgaccagcucguccgcaucgccaagguccucggcaccgaggagcucuacggcuaccucaagaaguaccacaucgaccucgacccccacuucaacgacauccucggccagcacucccgcaagcgcugggagaacuucauccacuccgagaaccgccaccucgucucccccgaggcccucgaccuccucgacaagcuccuccgcuacgaccaccagcagcgccucaccgccaaggaggccauggagcaccccuacuucuaccccgucgucaaggagcagucccagcccugcgccgacaacgccguccucuccuccggccucaccgccgcccgcuga

SEQ ID NO: 41824 - RNA, 648 nt, Artificial Sequence
  derived and/or modified sequence opt2 from CSNK2B__Homo_sapiens__NP_001311
auguccuccuccgaggaggucuccuggaucuccugguucugcggccuccgcggcaacgaguucuucugcgaggucgacgaggacuacauccaggacaaguucaaccucaccggccucaacgagcaggucccccacuaccgccaggcccucgacaugauccucgaccucgagcccgacgaggagcucgaggacaaccccaaccaguccgaccucaucgagcaggccgccgagaugcucuacggccucauccacgcccgcuacauccucaccaaccgcggcaucgcccagaugcucgagaaguaccagcagggcgacuucggcuacugcccccgcgucuacugcgagaaccagcccaugcuccccaucggccucuccgacauccccggcgaggccauggucaagcucuacugccccaagugcauggacgucuacacccccaaguccucccgccaccaccacaccgacggcgccuacuucggcaccggcuucccccacaugcucuucaugguccaccccgaguaccgccccaagcgccccgccaaccaguucgucccccgccucuacggcuucaagauccaccccauggccuaccagcuccagcuccaggccgccuccaacuucaagucccccgucaagaccauccgcuga

SEQ ID NO: 41825 - RNA, 6969 nt, Artificial Sequence
  derived and/or modified sequence opt2 from CSPG4__Homo_sapiens__NP_001888
augcaguccggcccccgccccccccuccccgcccccggccucgcccucgcccucacccucaccaugcucgcccgccucgccuccgccgccuccuucuucggcgagaaccaccucgagguccccgucgccaccgcccucaccgacaucgaccuccagcuccaguucuccaccucccagcccgaggcccuccuccuccucgccgccggccccgccgaccaccuccuccuccagcucuacuccggccgccuccagguccgccucguccucggccaggaggagcuccgccuccagacccccgccgagacccuccucuccgacuccaucccccacaccgucguccucaccgucgucgagggcugggccacccucuccgucgacggcuuccucaacgccuccuccgccguccccggcgccccccucgagguccccuacggccucuucgucggcggcaccggcacccucggccuccccuaccuccgcggcaccucccgcccccuccgcggcugccuccacgccgccacccucaacggccgcucccuccuccgcccccucacccccgacguccacgagggcugcgccgaggaguucuccgccuccgacgacgucgcccucggcuucuccggcccccacucccucgccgccuuccccgccuggggcacccaggacgagggcacccucgaguucacccucaccacccagucccgccaggccccccucgccuuccaggccggcggccgccgcggcgacuucaucuacgucgacaucuucgagggccaccuccgcgccgucgucgagaagggccagggcaccguccuccuccacaacuccguccccgucgccgacggccagccccacgaggucuccguccacaucaacgcccaccgccucgagaucuccgucgaccaguaccccacccacaccuccaaccgcggcguccucuccuaccucgagccccgcggcucccuccuccucggcggccucgacgccgaggccucccgccaccuccaggagcaccgccucggccucacccccgaggccaccaacgccucccuccucggcugcauggaggaccucuccgucaacggccagcgccgcggccuccgcgaggcccuccucacccgcaacauggccgccggcugccgccucgaggaggaggaguacgaggacgacgccuacggccacuacgaggccuucuccacccucgcccccgaggccuggcccgccauggagcuccccgagcccugcguccccgagcccggccucccccccgucuucgccaacuucacccagcuccucaccaucuccccccucgucgucgccgagggcggcaccgccuggcucgaguggcgccacguccagcccacccucgaccucauggaggccgagcuccgcaagucccagguccucuucuccgucacccgcggcgcccgccacggcgagcucgagcucgacauccccggcgcccaggcccgcaagauguucacccuccucgacgucgucaaccgcaaggcccgcuucauccacgacggcuccgaggacaccuccgaccagcucguccucgaggucuccgucaccgcccgcguccccaugcccuccugccuccgccgcggccagaccuaccuccuccccauccaggucaaccccgucaacgaccccccccacaucaucuucccccacggcucccucauggucauccucgagcacacccagaagccccucggccccgaggucuuccaggccuacgaccccgacuccgccugcgagggccucaccuuccagguccucggcaccuccuccggccuccccgucgagcgccgcgaccagcccggcgagcccgccaccgaguucuccugccgcgagcucgaggccggcucccucgucuacguccaccgcggcggccccgcccaggaccucaccuuccgcgucuccgacggccuccaggccuccccccccgccacccucaaggucgucgccauccgccccgccauccagauccaccgcuccaccggccuccgccucgcccagggcuccgccaugcccauccuccccgccaaccucuccgucgagaccaacgccgucggccaggacgucuccguccucuuccgcgucaccggcgcccuccaguucggcgagcuccagaagcagggcgccggcggcgucgagggcgccgaguggugggccacccaggccuuccaccagcgcgacgucgagcagggccgcguccgcuaccucuccaccgacccccagcaccacgccuacgacaccgucgagaaccucgcccucgagguccaggucggccaggagauccucuccaaccucuccuuccccgucaccauccagcgcgccaccgucuggaugcuccgccucgagccccuccacacccagaacacccagcaggagacccucaccaccgcccaccucgaggccacccucgaggaggccggccccuccccccccaccuuccacuacgaggucguccaggccccccgcaagggcaaccuccagcuccagggcacccgccucuccgacggccagggcuucacccaggacgacauccaggccggccgcgucaccuacggcgccaccgcccgcgccuccgaggccgucgaggacaccuuccgcuuccgcgucaccgccccccccuacuucuccccccucuacaccuuccccauccacaucggcggcgaccccgacgcccccguccucaccaacguccuccucgucguccccgagggcggcgagggcguccucuccgccgaccaccucuucgucaagucccucaacuccgccuccuaccucuacgaggucauggagcgcccccgccacggccgccucgccuggcgcggcacccaggacaagaccaccauggucaccuccuucaccaacgaggaccuccuccgcggccgccucgucuaccagcacgacgacuccgagaccaccgaggacgacauccccuucgucgccacccgccagggcgaguccuccggcgacauggccugggaggagguccgcggcgucuuccgcgucgccauccagcccgucaacgaccacgcccccguccagaccaucucccgcaucuuccacgucgcccgcggcggccgccgccuccucaccaccgacgacgucgccuucuccgacgccgacuccggcuucgccgacgcccagcucguccucacccgcaaggaccuccucuucggcuccaucgucgccgucgacgagcccacccgccccaucuaccgcuucacccaggaggaccuccgcaagcgccgcguccucuucguccacuccggcgccgaccgcggcuggauccagcuccaggucuccgacggccagcaccaggccaccgcccuccucgagguccaggccuccgagcccuaccuccgcgucgccaacggcuccucccucgucgucccccagggcggccagggcaccaucgacaccgccguccuccaccucgacaccaaccucgacauccgcuccggcgacgagguccacuaccacgucaccgccggcccccgcuggggccagcucguccgcgccggccagcccgccaccgccuucucccagcaggaccuccucgacggcgccguccucuacucccacaacggcucccucuccccccgcgacaccauggccuucuccgucgaggccggccccguccacaccgacgccacccuccaggucaccaucgcccucgagggcccccucgccccccucaagcucguccgccacaagaagaucuacgucuuccagggcgaggccgccgagauccgccgcgaccagcucgaggccgcccaggaggccgucccccccgccgacaucgucuucuccgucaaguccccccccuccgccggcuaccucgucauggucucccgcggcgcccucgccgacgagccccccucccucgaccccguccaguccuucucccaggaggccgucgacaccggccgcguccucuaccuccacucccgccccgaggccugguccgacgccuucucccucgacgucgccuccggccucggcgccccccucgagggcguccucgucgagcucgagguccuccccgccgccaucccccucgaggcccagaacuucuccguccccgagggcggcucccucacccucgcccccccccuccuccgcgucuccggccccuacuuccccacccuccucggccucucccuccagguccucgagcccccccagcacggcgcccuccagaaggaggacggcccccaggcccgcacccucuccgccuucuccuggcgcauggucgaggagcagcucauccgcuacguccacgacggcuccgagacccucaccgacuccuucguccucauggccaacgccuccgagauggaccgccagucccaccccgucgccuucaccgucaccguccuccccgucaacgaccagccccccauccucaccaccaacaccggccuccagaugugggagggcgccaccgcccccauccccgccgaggcccuccgcuccaccgacggcgacuccggcuccgaggaccucgucuacaccaucgagcagcccuccaacggccgcgucguccuccgcggcgcccccggcaccgagguccgcuccuucacccaggcccagcucgacggcggccucguccucuucucccaccgcggcacccucgacggcggcuuccgcuuccgccucuccgacggcgagcacaccucccccggccacuucuuccgcgucaccgcccagaagcagguccuccucucccucaagggcucccagacccucaccgucugccccggcuccguccagccccucuccucccagacccuccgcgccuccuccuccgccggcaccgacccccagcuccuccucuaccgcgucguccgcggcccccagcucggccgccucuuccacgcccagcaggacuccaccggcgaggcccucgucaacuucacccaggccgaggucuacgccggcaacauccucuacgagcacgagaugccccccgagcccuucugggaggcccacgacacccucgagcuccagcucuccuccccccccgcccgcgacgucgccgccacccucgccgucgccgucuccuucgaggccgccugcccccagcgccccucccaccucuggaagaacaagggccucuggguccccgagggccagcgcgcccgcaucaccgucgccgcccucgacgccuccaaccuccucgccuccguccccuccccccagcgcuccgagcacgacguccucuuccaggucacccaguuccccucccgcggccagcuccucgucuccgaggagccccuccacgccggccagccccacuuccuccagucccagcucgccgccggccagcucgucuacgcccacggcggcggcggcacccagcaggacggcuuccacuuccgcgcccaccuccagggccccgccggcgccuccgucgccggcccccagaccuccgaggccuucgccaucaccguccgcgacgucaacgagcgccccccccagccccaggccuccgucccccuccgccucacccgcggcucccgcgcccccaucucccgcgcccagcucuccgucgucgaccccgacuccgcccccggcgagaucgaguacgagguccagcgcgccccccacaacggcuuccucucccucgucggcggcggccucggccccgucacccgcuucacccaggccgacgucgacuccggccgccucgccuucgucgccaacggcuccuccgucgccggcaucuuccagcucuccauguccgacggcgccucccccccccuccccaugucccucgccgucgacauccuccccuccgccaucgagguccagcuccgcgccccccucgaggucccccaggcccucggccgcuccucccucucccagcagcagcuccgcgucgucuccgaccgcgaggagcccgaggccgccuaccgccucauccagggcccccaguacggccaccuccucgucggcggccgccccaccuccgccuucucccaguuccagaucgaccagggcgaggucgucuucgccuucaccaacuucuccuccucccacgaccacuuccgcguccucgcccucgcccgcggcgucaacgccuccgccgucgucaacgucaccguccgcgcccuccuccacgucugggccggcggccccuggccccagggcgccacccuccgccucgaccccaccguccucgacgccggcgagcucgccaaccgcaccggcuccgucccccgcuuccgccuccucgagggcccccgccacggccgcgucguccgcgucccccgcgcccgcaccgagcccggcggcucccagcucgucgagcaguucacccagcaggaccucgaggacggccgccucggccucgaggucggccgccccgagggccgcgcccccggccccgccggcgacucccucacccucgagcucugggcccagggcgucccccccgccgucgccucccucgacuucgccaccgagcccuacaacgccgcccgccccuacuccgucgcccuccucuccguccccgaggccgcccgcaccgaggccggcaagcccgaguccuccacccccaccggcgagcccggccccauggccuccucccccgagcccgccgucgccaagggcggcuuccucuccuuccucgaggccaacauguucuccgucaucauccccaugugccucguccuccuccuccucgcccucauccucccccuccucuucuaccuccgcaagcgcaacaagaccggcaagcacgacguccagguccucaccgccaagccccgcaacggccucgccggcgacaccgagaccuuccgcaaggucgagcccggccaggccaucccccucaccgccguccccggccagggccccccccccggcggccagcccgaccccgagcuccuccaguucugccgcacccccaaccccgcccucaagaacggccaguacugggucuga

SEQ ID NO: 41826 - RNA, 1206 nt, Artificial Sequence
  derived and/or modified sequence opt2 from CSPG5__Homo_sapiens__NP_001193871
augccccccgccauccccgaggccaccgaggccuccggcccccccucccccacccccggcgacaagcucucccccgccuccgagcuccccaaggaguccccccucgaggucuggcucaaccucggcggcuccacccccgacccccagggccccgagcucaccuaccccuuccagggcacccucgagccccagcccgccuccgacaucaucgacaucgacuacuucgagggccucgacggcgagggccgcggcgccgaccucggcuccuuccccggcucccccggcaccuccgagaaccaccccgacaccgagggcgagacccccuccuggucccuccucgaccucuacgacgacuucacccccuucgacgaguccgacuucuaccccaccaccuccuucuacgacgaccucgacgaggaggaggaggaggaggaggacgacaaggacgccgucggcggcggcgaccucgaggacgagaacgagcuccucguccccaccggcaagcccggccucggccccggcaccggccagcccaccucccgcuggcacgccguccccccccagcacacccucggcuccguccccggcuccuccaucgcccuccgcccccgccccggcgagcccggccgcgaccucgccuccuccgagaacggcaccgagugccgcuccggcuucguccgccacaacggcuccugccgcuccgucugcgaccucuuccccuccuacugccacaacggcggccagugcuaccucgucgagaacaucggcgccuucugccgcugcaacacccaggacuacaucuggcacaagggcaugcgcugcgaguccaucaucaccgacuuccaggucaugugcgucgccgucggcuccgccgcccucguccuccuccuccucuucaugaugaccgucuucuucgccaagaagcucuaccuccucaagaccgagaacaccaagcuccgccgcaccaacaaguuccgcacccccuccgagcuccacaacgacaacuucucccucuccaccaucgccgagggcucccaccccaacgacgaccccuccgccccccacaagauccaggagguccucaaguccugccucaaggaggaggaguccuucaacauccagaacuccaugucccccaagcucgagggcggcaagggcgaccaggccgaccucgacgucaacugccuccagaacaaccucaccuga

SEQ ID NO: 41827 - RNA, 2631 nt, Artificial Sequence
  derived and/or modified sequence opt2 from CSPP1__Homo_sapiens__NP_001278268
auggacgagcgcuuccgcuacgaguccgacuucgaccgccgccucucccgcgucuacaccaacgaccgcaugcaccgcaacaagcgcggcaacaugccccccauggagcacgacggcgacgucaucgagcaguccaacauccgcaucuccuccgccgagaacaaguccgcccccgacaacgagaccuccaaguccgccaaccaggacaccugcucccccuucgccggcaugcucuucggcggcgaggaccgcgagcucauccagcgccgcaaggagaaguaccgccucgagcuccucgagcagauggccgagcagcagcgcaacaagcgccgcgagaaggaccucgagcuccgcgucgccgccuccggcgcccaggaccccgagaagucccccgaccgccucaagcaguucuccgucgccccccgccacuucgaggagaugaucccccccgagcgcccccgcaucgccuuccagaccccccuccccccccucuccgcccccuccgucccccccauccccuccguccaccccguccccucccagaacgaggaccuccgcuccggccucuccuccgcccucggcgagauggucuccccccgcaucgccccccuccccccccccccccuccuccccccccucgccaccaacuaccgcacccccuacgacgacgccuacuacuucuacggcucccgcaacaccuucgaccccucccucgccuacuacggcuccggcaugaugggcguccagcccgccgccuacgucuccgcccccgucacccaccagcucgcccagcccgucgucaacaccgucggccagaacgagcucaagaucaccuccgaccaggucaucaacuccggccucaucuucgaggacaagcccaagcccuccaagcagucccuccaguccuaccaggaggcccuccagcagcagauccgcgagcgcgaggagcgccgcaagaaggagcgcgaggagaaggaggaguacgaggccaagcucgaggccgagaugcgcaccuacaaccccuggggcaagggcggcggcggcgccccccuccgcgacgccaagggcaaccucaucucccacaugcagacccaguccucccccuucgcccgcggcaacgucuucggcgagccccccaccgagcuccagaucaagcagcaggagcucuacaagaacuuccuccgcuuccagaucgaggagaagaagcagcgcgaggaggccgagcgcgagcgccuccgcaucgccgaggagaaggaggagcgccgccucgccgagcagcgcgcccgcauccagcaggaguacgaggaggagcaggagaagaagcgcgagaaggaggaggagcagcgccucaagaacgaggagcacauccgccucgccgaggagcgccagaaggaggccgagcgcaagaagaaggaggaggaggagaaguacaaccuccagcuccagcacuacugcgagcgcgacaaccucaucggcgaggagaccaagcacaugcgccagcccucccccaucguccccgcccuccagaacaagaucgccuccaagcuccagcgcccccccuccgucgacuccaucauccgcuccuucauccacgaguccuccaugucccgcgcccaguccccccccguccccgcccgcaagaaccagcuccgcgccgaggaggagaagaagaacgucaucauggagcucuccgagaugcgcaagcagcuccgcuccgaggagcgccgccuccaggagcgccuccuccacauggacuccgacgacgagauccccauccgcaagaaggagcgcaaccccauggacaucuucgacauggcccgccaccgccuccaggcccccguccgccgccagucccccaagggccucgacgccgccaccuuccagaacguccacgacuucaacgagcucaaggaccgcgacuccgagacccgcgucgaccucaaguucauguaccucgaccccccccgcgaccaccacacccucgagauccagcagcaggcccuccuccgcgagcagcagaagcgccucaaccgcaucaagaugcaggagggcgccaaggucgaccucgacgccauccccuccgccaagguccgcgagcagcgcaugccccgcgacgacaccuccgacuuccucaagaacucccuccucgaguccgacuccgccuucaucggcgccuacggcgagaccuaccccgccaucgaggacgacguccuccccccccccucccagcuccccuccgcccgcgagcgccgccgcaacaaguggaagggccucgacaucgacuccucccgccccaacgucgcccccgacggccucucccucaaguccaucuccuccgucaacgucgacgagcuccgcguccgcaacgaggagcgcaugcgccgccucaacgaguuccacaacaagcccaucaacaccgacgacgaguccucccucgucgaccccgacgacaucaugaagcacaucggcgacgacggcuccaacuccgucgccaccgagcccuggcuccgccccggcaccuccgagacccucaagcgcuucauggccgagcagcucaaccaggagcagcagcagauccccggcaagcccggcaccuucaccuggcagggccucuccaccgcccacggcuga

SEQ ID NO: 41828 - RNA, 1770 nt, Artificial Sequence
  derived and/or modified sequence opt2 from CSRNP1__Homo_sapiens__NP_149016
augaccggccuccucaagcgcaaguucgaccagcucgacgaggacaacuccuccgucuccuccuccuccuccuccuccggcugccagucccgcuccugcucccccuccuccuccgucucccgcgccugggacuccgaggaggagggccccugggaccagaugccccuccccgaccgcgacuucugcggcccccgcuccuucaccccccucuccauccucaagcgcgcccgccgcgagcgccccggccgcgucgccuucgacggcaucaccgucuucuacuucccccgcugccagggcuucaccuccguccccucccgcggcggcugcacccucggcauggcccuccgccacuccgccugccgccgcuucucccucgccgaguucgcccaggagcaggcccgcgcccgccacgagaagcuccgccagcgccucaaggaggagaagcucgagaugcuccaguggaagcucuccgccgccggcgucccccaggccgaggccggccucccccccgucgucgacgccaucgacgacgccuccgucgaggaggaccucgccgucgccgucgccggcggccgccucgaggaggucuccuuccuccagcccuaccccgcccgccgccgccgcgcccuccuccgcgccuccggcguccgccgcaucgaccgcgaggagaagcgcgagcuccaggcccuccgccagucccgcgaggacugcggcugccacugcgaccgcaucugcgaccccgagaccugcuccugcucccucgccggcaucaagugccagauggaccacaccgccuuccccugcggcugcugccgcgagggcugcgagaaccccaugggccgcgucgaguucaaccaggcccgcguccagacccacuucauccacacccucacccgccuccagcucgagcaggaggccgaguccuuccgcgagcucgaggcccccgcccagggcuccccccccucccccggcgaggaggcccucguccccaccuucccccucgccaagccccccaugaacaacgagcucggcgacaacuccugcuccuccgacaugaccgacuccuccaccgccuccuccuccgccuccggcaccuccgaggcccccgacugccccacccaccccggccuccccggccccggcuuccagcccggcgucgacgacgacucccucgcccgcauccucuccuucuccgacuccgacuucggcggcgaggaggaggaggaggaggagggcuccgucggcaaccucgacaaccucuccugcuuccaccccgccgacaucuucggcaccuccgaccccggcggccucgccuccuggacccacuccuacuccggcugcuccuucaccuccggcguccucgacgagaacgccaaccucgacgccuccugcuuccucaacggcggccucgagggcucccgcgagggcucccuccccggcaccuccgucccccccuccauggacgccggccgcuccuccuccgucgaccucucccucuccuccugcgacuccuucgagcuccuccaggcccuccccgacuacucccucggcccccacuacaccucccagaaggucuccgacucccucgacaacaucgaggccccccacuucccccuccccggccucuccccccccggcgacgccuccuccugcuuccucgagucccucaugggcuucuccgagcccgccgccgaggcccucgaccccuucaucgacucccaguucgaggacaccguccccgccucccucauggagcccguccccgucuga

SEQ ID NO: 41829 - RNA, 1758 nt, Artificial Sequence
  derived and/or modified sequence opt2 from CSRNP3__Homo_sapiens__NP_079245
auguccggcauccucaagcgcaaguucgaggaggucgacggcuccucccccugcuccuccguccgcgaguccgacgacgaggucuccuccuccgaguccgccgacuccggcgacuccgucaaccccuccaccuccucccacuucacccccuccuccauccucaagcgcgagaagcgccuccgcaccaagaacguccacuucuccugcgucaccgucuacuacuucacccgccgccagggcuucaccuccguccccucccagggcggcuccacccucggcauguccucccgccacaacuccguccgccaguacacccucggcgaguucgcccgcgagcaggagcgccuccaccgcgagaugcuccgcgagcaccuccgcgaggagaagcucaacucccucaagcucaagaugaccaagaacggcaccgucgaguccgaggaggccuccacccucacccucgacgacaucuccgacgacgacaucgaccucgacaacaccgaggucgacgaguacuucuuccuccagccccuccccaccaagaagcgccgcgcccuccuccgcgccuccggcgucaagaagaucgacgucgaggagaagcacgagcuccgcgccauccgccucucccgcgaggacugcggcugcgacugccgcgucuucugcgaccccgacaccugcaccugcucccucgccggcaucaagugccaggucgaccgcauguccuuccccugcggcugcaccaaggagggcugcuccaacaccgccggccgcaucgaguucaaccccauccgcguccgcacccacuuccuccacaccaucaugaagcucgagcucgagaagaaccgcgagcagcagauccccacccucaacggcugccacuccgagaucuccgcccacuccuccuccaugggccccgucgcccacuccgucgaguacuccaucgccgacuccuucgagaucgagaccgagccccaggccgccguccuccaccuccaguccgccgaggagcucgacugccagggcgaggaggaggaggaggaggaggacggcuccuccuucugcuccggcgucaccgacuccuccacccagucccucgcccccuccgaguccgacgaggaggaggaggaggaggaggaggaggaggaggaggaggacgacgacgacgacaagggcgacggcuucgucgagggccucggcacccacgccgaggucgucccccuccccuccguccucugcuacuccgacggcaccgccguccacgagucccacgccaagaacgccuccuucuacgccaacuccuccacccucuacuaccagaucgacucccacauccccggcacccccaaccagaucuccgagaacuacuccgagcgcgacaccgucaagaacggcacccucucccucguccccuacaccaugacccccgagcaguucgucgacuacgcccgccaggccgaggaggccuacggcgccucccacuaccccgccgccaaccccuccgucaucgucugcugcuccuccuccgagaacgacuccggcguccccugcaacucccucuaccccgagcaccgcuccaaccacccccaggucgaguuccacuccuaccucaagggccccucccaggagggcuucgucuccgcccucaacggcgacucccacaucuccgagcaccccgccgagaacucccucucccucgccgagaaguccauccuccacgaggagugcaucaagucccccgucgucgagaccguccccgucuga

SEQ ID NO: 41830 - RNA, 582 nt, Artificial Sequence
  derived and/or modified sequence opt2 from CSRP1__Homo_sapiens__NP_001180500
augcccaacuggggcggcggcaagaagugcggcgucugccagaagaccgucuacuucgccgaggagguccagugcgagggcaacuccuuccacaaguccugcuuccucugcauggucugcaagaagaaccucgacuccaccaccgucgccguccacggcgaggagaucuacugcaaguccugcuacggcaagaaguacggccccaagggcuacggcuacggccagggcgccggcacccucuccaccgacaagggcgagucccucggcaucaagcacgaggaggcccccggccaccgccccaccaccaaccccaacgccuccaaguucgcccagaagaucggcggcuccgagcgcugcccccgcugcucccaggccgucuacgccgccgagaaggucaucggcgccggcaaguccuggcacaaggccugcuuccgcugcgccaagugcggcaagggccucgaguccaccacccucgccgacaaggacggcgagaucuacugcaagggcugcuacgccaagaacuucggccccaagggcuucggcuucggccagggcgccggcgcccucguccacuccgaguga

SEQ ID NO: 41831 - RNA, 2349 nt, Artificial Sequence
  derived and/or modified sequence opt2 from CSRP2BP__Homo_sapiens__NP_065397
auggacuccuccauccaccucuccucccucaucucccgccacgacgacgaggccacccgcaccuccaccuccgagggccucgaggagggcgaggucgagggcgagacccuccucaucgucgaguccgaggaccaggccuccgucgaccucucccacgaccaguccggcgacucccucaacuccgacgagggcgacgucuccuggauggaggagcagcucuccuacuucugcgacaagugccagaaguggauccccgccucccagcuccgcgagcagcucuccuaccucaagggcgacaacuucuuccgcuucaccugcuccgacugcuccgccgacggcaaggagcaguacgagcgccucaagcucaccuggcagcaggucgucaugcucgccauguacaaccucucccucgagggcuccggccgccagggcuacuuccgcuggaaggaggacaucugcgccuucaucgagaagcacuggaccuuccuccucggcaaccgcaagaagaccuccaccuggugguccaccgucgccggcugccucuccgucggcucccccauguacuuccgcuccggcgcccaggaguucggcgagcccggcugguggaagcucguccacaacaagccccccaccaugaagcccgagggcgagaagcucuccgccuccacccucaagaucaaggccgccuccaagcccacccucgaccccaucaucaccgucgagggccuccgcaagcgcgccucccgcaaccccgucgaguccgccauggagcucaaggagaagcgcucccgcacccaggaggccaaggacauccgccgcgcccagaaggaggccgccggcuuccucgaccgcuccaccuccuccacccccgucaaguucaucucccgcggccgccgccccgacgucauccucgagaagggcgaggucaucgacuucuccucccucuccuccuccgaccgcaccccccucaccucccccucccccucccccucccucgacuucuccgcccccggcacccccgccucccacuccgccacccccucccuccucuccgaggccgaccucauccccgacgucaugcccccccaggcccucuuccacgacgacgacgagauggagggcgacggcgucaucgaccccggcauggaguacguccccccccccgccggcuccgucgccuccggccccgucgucggcggccgcaagaagguccgcggccccgagcagaucaagcaggaggucgaguccgaggaggagaagcccgaccgcauggacaucgacuccgaggacaccgacuccaacaccucccuccagacccgcgcccgcgagaagcgcaagccccagcucgagaaggacaccaagcccaaggagccccgcuacacccccgucuccaucuacgaggagaagcuccuccucaagcgccucgaggccugccccggcgccgucgccaugacccccgaggcccgccgccucaagcgcaagcucaucguccgccaggccaagcgcgaccgcggccucccccucuucgaccucgaccaggucgucaacgccgcccuccuccucgucgacggcaucuacggcgccaaggagggcggcaucucccgccuccccgccggccaggccaccuaccgcaccaccugccaggacuuccgcauccucgaccgcuaccagaccucccuccccucccgcaagggcuuccgccaccagaccaccaaguuccucuaccgccucgucggcuccgaggacauggccgucgaccaguccaucgucucccccuacaccucccgcauccucaagcccuacauccgccgcgacuacgagaccaagccccccaagcuccagcuccucucccagauccgcucccaccuccaccgcuccgacccccacuggacccccgagcccgacgccccccucgacuacugcuacguccgccccaaccacauccccaccaucaacuccaugugccaggaguucuucuggcccggcaucgaccucuccgagugccuccaguaccccgacuucuccgucgucguccucuacaagaaggucaucaucgccuucggcuucaugguccccgacgucaaguacaacgaggccuacaucuccuuccucuucguccaccccgaguggcgccgcgccggcaucgccaccuucaugaucuaccaccucauccagaccugcaugggcaaggacgucacccuccacgucuccgccuccaaccccgccaugcuccucuaccagaaguucggcuucaagaccgaggaguacguccucgacuucuacgacaaguacuacccccucgaguccaccgagugcaagcacgccuucuuccuccgccuccgccgcuga

SEQ ID NO: 41832 - RNA, 582 nt, Artificial Sequence
  derived and/or modified sequence opt2 from CSRP2__Homo_sapiens__NP_001287894
augcccgucuggggcggcggcaacaagugcggcgccugcggccgcaccgucuaccacgccgaggagguccagugcgacggccgcuccuuccaccgcugcugcuuccucugcauggucugccgcaagaaccucgacuccaccaccgucgccauccacgacgaggagaucuacugcaaguccugcuacggcaagaaguacggccccaagggcuacggcuacggccagggcgccggcacccucaacauggaccgcggcgagcgccucggcaucaagcccgaguccguccagccccaccgccccaccaccaaccccaacaccuccaaguucgcccagaaguacggcggcgccgagaagugcucccgcugcggcgacuccgucuacgccgccgagaagaucaucggcgccggcaagcccuggcacaagaacugcuuccgcugcgccaagugcggcaagucccucgaguccaccacccucaccgagaaggagggcgagaucuacugcaagggcugcuacgccaagaacuucggccccaagggcuucggcuacggccagggcgccggcgcccucguccacgcccaguga

SEQ ID NO: 41833 - RNA, 585 nt, Artificial Sequence
  derived and/or modified sequence opt2 from CSRP3__Homo_sapiens__NP_003467
augcccaacuggggcggcggcgccaagugcggcgccugcgagaagaccgucuaccacgccgaggagauccagugcaacggccgcuccuuccacaagaccugcuuccacugcauggccugccgcaaggcccucgacuccaccaccgucgccgcccacgaguccgagaucuacugcaaggucugcuacggccgccgcuacggccccaagggcaucggcuacggccagggcgccggcugccucuccaccgacaccggcgagcaccucggccuccaguuccagcagucccccaagcccgcccgcuccgucaccaccuccaaccccuccaaguucaccgccaaguucggcgaguccgagaagugcccccgcugcggcaaguccgucuacgccgccgagaaggucaugggcggcggcaagcccuggcacaagaccugcuuccgcugcgccaucugcggcaagucccucgaguccaccaacgucaccgacaaggacggcgagcucuacugcaaggucugcuacgccaagaacuucggccccaccggcaucggcuucggcggccucacccagcaggucgagaagaaggaguga

SEQ ID NO: 41834 - RNA, 426 nt, Artificial Sequence
  derived and/or modified sequence opt2 from CST1__Homo_sapiens__NP_001889
auggcccaguaccucuccacccuccuccuccuccucgccacccucgccgucgcccucgccuggucccccaaggaggaggaccgcaucauccccggcggcaucuacaacgccgaccucaacgacgaguggguccagcgcgcccuccacuucgccaucuccgaguacaacaaggccaccaaggacgacuacuaccgccgcccccuccgcguccuccgcgcccgccagcagaccgucggcggcgucaacuacuucuucgacgucgaggucggccgcaccaucugcaccaagucccagcccaaccucgacaccugcgccuuccacgagcagcccgagcuccagaagaagcagcucugcuccuucgagaucuacgagguccccugggagaaccgccgcucccucgucaagucccgcugccaggaguccuga

SEQ ID NO: 41835 - RNA, 426 nt, Artificial Sequence
  derived and/or modified sequence opt2 from CST2__Homo_sapiens__NP_001313
auggccuggccccucugcacccuccuccuccuccucgccacccaggccgucgcccucgccugguccccccaggaggaggaccgcaucaucgagggcggcaucuacgacgccgaccucaacgacgagcgcguccagcgcgcccuccacuucgucaucuccgaguacaacaaggccaccgaggacgaguacuaccgccgccuccuccgcguccuccgcgcccgcgagcagaucgucggcggcgucaacuacuucuucgacaucgaggucggccgcaccaucugcaccaagucccagcccaaccucgacaccugcgccuuccacgagcagcccgagcuccagaagaagcagcucugcuccuuccagaucuacgagguccccugggaggaccgcaugucccucgucaacucccgcugccaggaggccuga

SEQ ID NO: 41836 - RNA, 441 nt, Artificial Sequence
  derived and/or modified sequence opt2 from CST3__Homo_sapiens__NP_001275543
auggccggcccccuccgcgccccccuccuccuccucgccauccucgccgucgcccucgccgucucccccgccgccggcuccucccccggcaagcccccccgccucgucggcggccccauggacgccuccgucgaggaggagggcguccgccgcgcccucgacuucgccgucggcgaguacaacaaggccuccaacgacauguaccacucccgcgcccuccaggucguccgcgcccgcaagcagaucgucgccggcgucaacuacuuccucgacgucgagcucggccgcaccaccugcaccaagacccagcccaaccucgacaacugccccuuccacgaccagccccaccucaagcgcaaggccuucugcuccuuccagaucuacgccguccccuggcagggcaccaugacccucuccaaguccaccugccaggacgccuga

SEQ ID NO: 41837 - RNA, 426 nt, Artificial Sequence
  derived and/or modified sequence opt2 from CST4__Homo_sapiens__NP_001890
auggcccgcccccucugcacccuccuccuccucauggccacccucgccggcgcccucgccuccuccuccaaggaggagaaccgcaucauccccggcggcaucuacgacgccgaccucaacgacgaguggguccagcgcgcccuccacuucgccaucuccgaguacaacaaggccaccgaggacgaguacuaccgccgcccccuccagguccuccgcgcccgcgagcagaccuucggcggcgucaacuacuucuucgacgucgaggucggccgcaccaucugcaccaagucccagcccaaccucgacaccugcgccuuccacgagcagcccgagcuccagaagaagcagcucugcuccuucgagaucuacgagguccccugggaggaccgcaugucccucgucaacucccgcugccaggaggccuga

SEQ ID NO: 41838 - RNA, 429 nt, Artificial Sequence
  derived and/or modified sequence opt2 from CST5__Homo_sapiens__NP_001891
augauguggcccaugcacaccccccuccuccuccucaccgcccucauggucgccgucgccggcuccgccuccgcccagucccgcacccucgccggcggcauccacgccaccgaccucaacgacaaguccguccagugcgcccucgacuucgccaucuccgaguacaacaaggucaucaacaaggacgaguacuacucccgcccccuccaggucauggccgccuaccagcagaucgucggcggcgucaacuacuacuucaacgucaaguucggccgcaccaccugcaccaagucccagcccaaccucgacaacugccccuucaacgaccagcccaagcucaaggaggaggaguucugcuccuuccagaucaacgagguccccugggaggacaagaucuccauccucaacuacaagugccgcaaggucuga

SEQ ID NO: 41839 - RNA, 450 nt, Artificial Sequence
  derived and/or modified sequence opt2 from CST6__Homo_sapiens__NP_001314
auggcccgcuccaaccucccccucgcccucggccucgcccucgucgccuucugccuccucgcccucccccgcgacgcccgcgcccgcccccaggagcgcauggucggcgagcuccgcgaccucucccccgacgacccccagguccagaaggccgcccaggccgccgucgccuccuacaacaugggcuccaacuccaucuacuacuuccgcgacacccacaucaucaaggcccagucccagcucgucgccggcaucaaguacuuccucaccauggagaugggcuccaccgacugccgcaagacccgcgucaccggcgaccacgucgaccucaccaccugcccccucgccgccggcgcccagcaggagaagcuccgcugcgacuucgagguccucgucguccccuggcagaacuccucccagcuccucaagcacaacugcguccagauguga

SEQ ID NO: 41840 - RNA, 438 nt, Artificial Sequence
  derived and/or modified sequence opt2 from CST7__Homo_sapiens__NP_003641
augcgcgccgccggcacccuccucgccuucugcugccucguccucuccaccaccggcggccccucccccgacaccugcucccaggaccucaacucccgcgucaagcccggcuuccccaagaccaucaagaccaacgaccccggcguccuccaggccgcccgcuacuccgucgagaaguucaacaacugcaccaacgacauguuccucuucaaggagucccgcaucacccgcgcccucguccagaucgucaagggccucaaguacaugcucgaggucgagaucggccgcaccaccugcaagaagaaccagcaccuccgccucgacgacugcgacuuccagaccaaccacacccucaagcagacccucuccugcuacuccgaggucugggucguccccuggcuccagcacuucgagguccccguccuccgcugccacuga

SEQ ID NO: 41841 - RNA, 429 nt, Artificial Sequence
  derived and/or modified sequence opt2 from CST8__Homo_sapiens__NP_005483
augccccgcugccgcuggcucucccucauccuccucaccaucccccucgcccucgucgcccgcaaggaccccaagaagaacgagaccggcguccuccgcaagcucaagcccgucaacgccuccaacgccaacgucaagcagugccucugguucgccaugcaggaguacaacaaggaguccgaggacaaguacgucuuccucgucgucaagacccuccaggcccagcuccaggucaccaaccuccucgaguaccucaucgacgucgagaucgcccgcuccgacugccgcaagccccucuccaccaacgagaucugcgccauccaggagaacuccaagcucaagcgcaagcucuccugcuccuuccucgucggcgcccuccccuggaacggcgaguucaccgucauggagaagaagugcgaggacgccuga

SEQ ID NO: 41842 - RNA, 480 nt, Artificial Sequence
  derived and/or modified sequence opt2 from CST9__Homo_sapiens__NP_001008693
auguccuccccccagcgccgcaaggccaugcccugggcccucucccuccuccucaugggcuuccagcuccucgucaccuacgccuggugcuccgaggaggagaugggcggcaacaacaagaucguccaggaccccauguuccucgccaccgucgaguucgcccucaacaccuucaacguccaguccaaggaggagcacgccuaccgccuccuccgcguccucuccuccuggcgcgaggacuccauggaccgcaaguggcgcggcaagauggucuucuccaugaaccuccagcuccgccagaccgucugccgcaaguucgaggacgacaucgacaacugccccuuccaggagucccucgagcucaacaacguccgccagggcaucuccuucccccagguccacuccugcggcugcugcaugggcugcggcgucggcaccggcgccgccgacaaggccaucccccgcgacaagggcaaguga

SEQ ID NO: 41843 - RNA, 444 nt, Artificial Sequence
  derived and/or modified sequence opt2 from CST9L__Homo_sapiens__NP_542177
augcucggccuccccuggaagggcggccucuccugggcccuccuccuccuccuccucggcucccagauccuccucaucuacgccuggcacuuccacgagcagcgcgacugcgacgagcacaacgucauggcccgcuaccuccccgccaccgucgaguucgccguccacaccuucaaccagcaguccaaggacuacuacgccuaccgccucggccacauccucaacuccuggaaggagcaggucgaguccaagaccgucuucuccauggagcuccuccucggccgcacccgcugcggcaaguucgaggacgacaucgacaacugccacuuccaggaguccaccgagcucaacaacaccuucaccugcuucuucaccaucuccacccgccccuggaugacccaguucucccuccucaacaagaccugccucgagggcuuccacuga

SEQ ID NO: 41844 - RNA, 297 nt, Artificial Sequence
  derived and/or modified sequence opt2 from CSTA__Homo_sapiens__NP_005204
augauccccggcggccucuccgaggccaagcccgccacccccgagauccaggagaucgucgacaaggucaagccccagcucgaggagaagaccaacgagaccuacggcaagcucgaggccguccaguacaagacccaggucgucgccggcaccaacuacuacaucaagguccgcgccggcgacaacaaguacaugcaccucaaggucuucaagucccuccccggccagaacgaggaccucguccucaccggcuaccaggucgacaagaacaaggacgacgagcucaccggcuucuga

SEQ ID NO: 41845 - RNA, 297 nt, Artificial Sequence
  derived and/or modified sequence opt2 from CSTB__Homo_sapiens__NP_000091
augaugugcggcgcccccuccgccacccagcccgccaccgccgagacccagcacaucgccgaccagguccgcucccagcucgaggagaaggagaacaagaaguuccccgucuucaaggccgucuccuucaagucccaggucgucgccggcaccaacuacuucaucaagguccacgucggcgacgaggacuucguccaccuccgcgucuuccagucccucccccacgagaacaagccccucacccucuccaacuaccagaccaacaaggccaagcacgacgagcucaccuacuucuga

SEQ ID NO: 41846 - RNA, 1296 nt, Artificial Sequence
  derived and/or modified sequence opt2 from CSTF1__Homo_sapiens__NP_001315
auguaccgcaccaaggucggccucaaggaccgccagcagcucuacaagcucaucaucucccagcuccucuacgacggcuacaucuccaucgccaacggccucaucaacgagaucaagccccaguccgucugcgcccccuccgagcagcuccuccaccucaucaagcucggcauggagaacgacgacaccgccguccaguacgccaucggccgcuccgacaccgucgcccccggcaccggcaucgaccucgaguucgacgccgacguccagaccaugucccccgaggccuccgaguacgagaccugcuacgucaccucccacaagggccccugccgcgucgccaccuacucccgcgacggccagcucaucgccaccggcuccgccgacgccuccaucaagauccucgacaccgagcgcaugcucgccaaguccgccaugcccaucgaggucaugaugaacgagaccgcccagcagaacauggagaaccaccccgucauccgcacccucuacgaccacgucgacgaggucaccugccucgccuuccaccccaccgagcagauccucgccuccggcucccgcgacuacacccucaagcucuucgacuacuccaagcccuccgccaagcgcgccuucaaguacauccaggaggccgagaugcuccgcuccaucuccuuccaccccuccggcgacuucauccucgucggcacccagcaccccacccuccgccucuacgacaucaacaccuuccagugcuucgucuccugcaacccccaggaccagcacaccgacgccaucugcuccgucaacuacaacuccuccgccaacauguacgucaccggcuccaaggacggcugcaucaagcucugggacggcgucuccaaccgcugcaucaccaccuucgagaaggcccacgacggcgccgaggucugcuccgccaucuucuccaagaacuccaaguacauccucuccuccggcaaggacuccgucgccaagcucugggagaucuccaccggccgcacccucguccgcuacaccggcgccggccucuccggccgccagguccaccgcacccaggccgucuucaaccacaccgaggacuacguccuccuccccgacgagcgcaccaucucccucugcugcugggacucccgcaccgccgagcgccgcaaccuccucucccucggccacaacaacaucguccgcugcaucguccacucccccaccaaccccggcuucaugaccugcuccgacgacuuccgcgcccgcuucugguaccgccgcuccaccaccgacuga

SEQ ID NO: 41847 - RNA, 1734 nt, Artificial Sequence
  derived and/or modified sequence opt2 from CSTF2__Homo_sapiens__NP_001316
auggccggccucaccguccgcgaccccgccgucgaccgcucccuccgcuccgucuucgucggcaacauccccuacgaggccaccgaggagcagcucaaggacaucuucuccgaggucggccccgucgucuccuuccgccucgucuacgaccgcgagaccggcaagcccaagggcuacggcuucugcgaguaccaggaccaggagaccgcccucuccgccaugcgcaaccucaacggccgcgaguucuccggccgcgcccuccgcgucgacaacgccgccuccgagaagaacaaggaggagcucaagucccucggcaccggcgcccccgucaucgagucccccuacggcgagaccaucucccccgaggacgcccccgaguccaucuccaaggccgucgccucccucccccccgagcagauguucgagcucaugaagcagaugaagcucugcguccagaacuccccccaggaggcccgcaacaugcuccuccagaacccccagcucgccuacgcccuccuccaggcccaggucgucaugcgcaucgucgaccccgagaucgcccucaagauccuccaccgccagaccaacauccccacccucaucgccggcaacccccagcccguccacggcgccggccccggcuccggcuccaacgucuccaugaaccagcagaacccccaggccccccaggcccagucccucggcggcaugcacgucaacggcgcccccccccucaugcaggccuccaugcagggcggcguccccgcccccggccagaugcccgccgccgucaccggccccggccccggcucccucgcccccggcggcggcaugcaggcccaggucggcaugcccggcuccggccccgucuccauggagcgcggccagguccccaugcaggacccccgcgccgccaugcagcgcggcucccuccccgccaacguccccaccccccgcggccuccucggcgacgcccccaacgacccccgcggcggcacccuccucuccgucaccggcgaggucgagccccgcggcuaccucggccccccccaccagggcccccccaugcaccacguccccggccacgagucccgcggcccccccccccacgagcuccgcggcggcccccuccccgagccccgcccccucauggccgagccccgcggccccaugcucgaccagcgcggccccccccucgacggccgcggcggccgcgacccccgcggcaucgacgcccgcggcauggaggcccgcgccauggaggcccgcggccucgacgcccgcggccucgaggcccgcgccauggaggcccgcgccauggaggcccgcgccauggaggcccgcgccauggaggcccgcgccauggagguccgcggcauggaggcccgcggcauggacacccgcggccccguccccggcccccgcggccccauccccuccggcaugcagggccccucccccaucaacaugggcgccgucgucccccagggcucccgccagguccccgucaugcagggcaccggcaugcagggcgccuccauccagggcggcucccagcccggcggcuucucccccggccagaaccaggucaccccccaggaccacgagaaggccgcccucaucaugcagguccuccagcucaccgccgaccagaucgccaugcucccccccgagcagcgccaguccauccucauccucaaggagcagauccagaaguccaccggcgcccccuga

SEQ ID NO: 41848 - RNA, 1851 nt, Artificial Sequence
  derived and/or modified sequence opt2 from CSTF2T__Homo_sapiens__NP_056050
auguccucccucgccguccgcgaccccgccauggaccgcucccuccgcuccgucuucgucggcaacauccccuacgaggccaccgaggagcagcucaaggacaucuucuccgaggucggcuccgucgucuccuuccgccucgucuacgaccgcgagaccggcaagcccaagggcuacggcuucugcgaguaccaggaccaggagaccgcccucuccgccaugcgcaaccucaacggccgcgaguucuccggccgcgcccuccgcgucgacaacgccgccuccgagaagaacaaggaggagcucaagucccucggccccgccgcccccaucaucgacucccccuacggcgaccccaucgaccccgaggacgcccccgaguccaucacccgcgccgucgccucccucccccccgagcagauguucgagcucaugaagcagaugaagcucugcguccagaacucccaccaggaggcccgcaacaugcuccuccagaacccccagcucgccuacgcccuccuccaggcccaggucgucaugcgcaucauggaccccgagaucgcccucaagauccuccaccgcaagauccacgucaccccccucauccccggcaagucccaguccgucuccgucuccggccccggccccggccccggccccggccucugccccggccccaacguccuccucaaccagcagaacccccccgccccccagccccagcaccucgcccgccgccccgucaaggacauccccccccucaugcagacccccauccagggcggcauccccgcccccggccccauccccgccgccguccccggcgccggccccggcucccucacccccggcggcgccaugcagccccagcucggcaugcccggcgucggccccgucccccucgagcgcggccagguccagauguccgacccccgcgcccccaucccccgcggccccgucacccccggcggccuccccccccgcggccuccucggcgacgcccccaacgacccccgcggcggcacccuccucuccgucaccggcgaggucgagccccgcggcuaccucggccccccccaccagggcccccccaugcaccacgccuccggccacgacacccgcggccccuccucccacgagaugcgcggcggcccccucggcgacccccgccuccucaucggcgagccccgcggccccaugaucgaccagcgcggccuccccauggacggccgcggcggccgcgacucccgcgccauggagacccgcgccauggagaccgagguccucgagacccgcgucauggagcgccgcggcauggagaccugcgccauggagacccgcggcauggaggcccgcggcauggacgcccgcggccucgagaugcgcggccccguccccuccucccgcggccccaugaccggcggcauccagggccccggccccaucaacaucggcgccggcggccccccccagggcccccgccagguccccggcaucuccggcgucggcaaccccggcgccggcaugcagggcaccggcauccagggcaccggcaugcagggcgccggcauccagggcggcggcaugcagggcgccggcauccagggcgucuccauccagggcggcggcauccagggcggcggcauccagggcgccuccaagcagggcggcucccagcccuccuccuucucccccggccagucccaggucaccccccaggaccaggagaaggccgcccucaucaugcagguccuccagcucaccgccgaccagaucgccaugcucccccccgagcagcgccaguccauccucauccucaaggagcagauccagaaguccaccggcgccuccuga

SEQ ID NO: 41849 - RNA, 438 nt, Artificial Sequence
  derived and/or modified sequence opt2 from CSTL1__Homo_sapiens__NP_612140
augggcaucggcugcuggcgcaacccccuccuccuccucaucgcccucguccucuccgccaagcucggccacuuccagcgcugggagggcuuccagcagaagcucauguccaagaagaacaugaacuccacccucaacuucuucauccaguccuacaacaacgccuccaacgacaccuaccucuaccgcguccagcgccucauccgcucccagaugcagcucaccaccggcgucgaguacaucgucaccgucaagaucggcuggaccaagugcaagcgcaacgacaccuccaacuccuccugcccccuccaguccaagaagcuccgcaagucccucaucugcgagucccucaucuacaccaugcccuggaucaacuacuuccagcucuggaacaacuccugccucgaggccgagcacgucggccgcaaccuccgcuga

SEQ ID NO: 41850 - RNA, 570 nt, Artificial Sequence
  derived and/or modified sequence opt2 from CT45A1__Homo_sapiens__NP_001017417
augaccgacaagaccgagaaggucgccgucgaccccgagaccgucuucaagcgcccccgcgagugcgacucccccuccuaccagaagcgccagcgcauggcccuccucgcccgcaagcagggcgccggcgacucccucaucgccggcuccgccauguccaaggccaagaagcucaugaccggccacgccaucccccccucccagcucgacucccagaucgacgacuucaccggcuucuccaaggaccgcaugaugcagaagcccggcuccaacgcccccgucggcggcaacgucaccuccuccuucuccggcgacgaccucgagugccgcgagaccgccuccucccccaagucccagcgcgagaucaacgccgacaucaagcgcaagcucgucaaggagcuccgcugcgucggccagaaguacgagaagaucuucgagaugcucgagggcguccagggccccaccgccguccgcaagcgcuucuucgaguccaucaucaaggaggccgcccgcugcaugcgccgcgacuucgucaagcaccucaagaagaagcucaagcgcaugaucuga

SEQ ID NO: 41851 - RNA, 795 nt, Artificial Sequence
  derived and/or modified sequence opt2 from CT55__Homo_sapiens__NP_001026875
augcuccgccuccuccgccucgcccucgccuucuacggccgcaccgccgaccccgccgagcgccagggcccccagcagcagggccucccccagggcgacacccagcucaccaccguccagggcgucgucaccuccuucugcggcgacuacggcaugaucgacgaguccaucuacuucuccuccgacgucgucaccggcaacgucccccucaaggucggccagaaggucaacgucgucgucgaggaggacaagccccacuacggccuccgcgccaucaaggucgacgucgucccccgccaccucuacggcgccggccccuccgacuccggcacccgcguccucaucggcugcgucaccuccaucaacgaggacaacaucuacaucuccaacuccaucuacuucuccaucgccaucgucuccgaggacuucguccccuacaagggcgaccuccucgaggucgaguacuccaccgagcccggcaucuccaacaucaaggccaccuccgucaagcccauccgcugcauccacaccgaggaggucugcaucaccuccguccacggccgcaacggcgucaucgacuacaccaucuucuucacccucgacuccgucaagcuccccgacggcuacgucccccaggucgacgacaucgucaacgucgucauggucgaguccauccaguucugcuucaucuggcgcgccaucuccaucacccccguccacaaguccuccuccggcuuccaggacgacggcggccucggccgccccaagcgcgagcgccgcucccaguccaucuga

SEQ ID NO: 41852 - RNA, 342 nt, Artificial Sequence
  derived and/or modified sequence opt2 from CT83__Homo_sapiens__NP_001017978
augaacuucuaccuccuccucgccuccuccauccucugcgcccucaucgucuucuggaaguaccgccgcuuccagcgcaacaccggcgagauguccuccaacuccaccgcccucgcccucguccgccccuccuccuccggccucaucaacuccaacaccgacaacaaccucgccgucuacgaccucucccgcgacauccucaacaacuucccccacuccaucgcccgccagaagcgcauccucgucaaccucuccauggucgagaacaagcucgucgagcucgagcacacccuccucuccaagggcuuccgcggcgccuccccccaccgcaaguccaccuga

SEQ ID NO: 41853 - RNA, 543 nt, Artificial Sequence
  derived and/or modified sequence opt2 from CTAG1A__Homo_sapiens__NP_640343
augcaggccgagggccgcggcaccggcggcuccaccggcgacgccgacggccccggcggccccggcauccccgacggccccggcggcaacgccggcggccccggcgaggccggcgccaccggcggccgcggcccccgcggcgccggcgccgcccgcgccuccggccccggcggcggcgccccccgcggcccccacggcggcgccgccuccggccucaacggcugcugccgcugcggcgcccgcggccccgagucccgccuccucgaguucuaccucgccaugcccuucgccacccccauggaggccgagcucgcccgccgcucccucgcccaggacgcccccccccuccccguccccggcguccuccucaaggaguucaccgucuccggcaacauccucaccauccgccucaccgccgccgaccaccgccagcuccagcucuccaucuccuccugccuccagcagcucucccuccucauguggaucacccagugcuuccuccccgucuuccucgcccagccccccuccggccagcgccgcuga

SEQ ID NO: 41854 - RNA, 633 nt, Artificial Sequence
  derived and/or modified sequence opt2 from CTAG2__Homo_sapiens__NP_066274
augcaggccgagggccgcggcaccggcggcuccaccggcgacgccgacggccccggcggccccggcauccccgacggccccggcggcaacgccggcggccccggcgaggccggcgccaccggcggccgcggcccccgcggcgccggcgccgcccgcgccuccggcccccgcggcggcgccccccgcggcccccacggcggcgccgccuccgcccaggacggccgcugccccugcggcgcccgccgccccgacucccgccuccucgagcuccacaucaccaugcccuucuccucccccauggaggccgagcucguccgccgcauccucucccgcgacgccgccccccucccccgccccggcgccguccucaaggacuucaccgucuccggcaaccuccucuucauguccguccgcgaccaggaccgcgagggcgccggccgcaugcgcgucgucggcuggggccucggcuccgccucccccgagggccagaaggcccgcgaccuccgcacccccaagcacaaggucuccgagcagcgccccggcacccccggcccccccccccccgagggcgcccagggcgacggcugccgcggcgucgccuucaacgucauguucuccgccccccacaucuga

SEQ ID NO: 41855 - RNA, 2238 nt, Artificial Sequence
  derived and/or modified sequence opt2 from CTAGE1__Homo_sapiens__NP_758441
augcgccccgacucccaccccuacggcuuccccugggagcucgucauccgcgccgccgucgccggcuucuucgccguccucuuccucuggcgcuccuuccgcuccgucaccucccgccucuacguccgccgcgagaagaaguucgccgucgcccucuccggccucaucgaggagaagugcaagcuccucgagaaguucucccucguccagaaggaguacgagggcuacgaggucgaguccucccucaagaacgccuccuucgagaaggaggccaccgaggcccagucccucgaggccaccugcgagaagcucaaccgcuucaacuccgagcucguccacgagauccucugccucgagaaggagcucaaggaggagaaguccaagcacuccgagcagaacgagcucauggccgacaucuccaagcgcauccagucccucgaggacgaguccaagucccucaagucccaggucgccgaggccaagaugaccuucaagcgcuuccaggccaacgaggagcgccucgagaucgagauccaggacgccuggaaggagaacuccgagcuccaggagucccagaagcagcuccuccaggaggccgaggucuggaaggagcaggucuccgagcucaucaagcagaagcgcaccuucgaggacuccaagguccacgccgagcagguccucaacgacaaggagaaccacaucaagacccucaccgagcgccuccucaagaugaaggacggcgucgccaugcucgaggaggacgucaccgacgacgacaaccucgagcucgagaugaacuccgaguccgaggacggcgccuaccucgacaacccccccaagggcgcccucaagaagcucauccacgccgccaagcucaacgccucccucaagacccucgagggcgagcgcaaccagaucuacauccagcucuccgaggucgacaagaccaaggaggagcucaccgagcacaucaagaaccuccagaccgagcaggccucccuccaguccgagaacacccacuucgaguccgagaaccagaagcuccagcagaagcucaaggucaugaccgagcucuaccaggagaacgagaugaagcucuaccgcaagcucaucgucgaggagaagugccgccucgagaaggaggagaagcucuccaaggucgacgagaugaucucccacgccaccgaggagcucgagaccuaccgcaagcgcgccaaggaccucaaggaguucgagaagaccauccacuucuaccagaagaagaucauccuccacgagaagaaggcccacgacaacugguccgccgccuggaccgccgagcgcaaccucaacgaccuccgcaaggagaacgcccacaaccgccagaagcucaccgagaucgaguucaagaucaagcuccucgagaaggaccccuacggccucgacguccccaacaccgccuucggccgccagcacucccccuacggccccuccccccucggcuggcccuccuccgagacccgcgccucccucuacccccccacccuccucgagggcccccuccgccucuccccccuccucccccgcggcggcggccgcggcucccgcggccccggcaacccccccgaccaccagaucaccaaggagcgcggcgaguccuccugcgaccgccucaccgacccccaccgcgcccccuccgacgccggcccccucgccccccccugggagcaggacuaccgcaugauguuccccccccccggccaguccuaccccgacuccgcccuccccccccagcgccaggaccgcuucuacuccaacugcgcccgccucuccggccccgccgagcuccgcuccuucaacaugcccucccucgacaagauggacggcuccaugcccuccgagauggaguccucccgcaacgacaccaaggacaaccucggcaaccucaagguccccgacuccucccuccccgccgagaacgaggccaccggccccggcuucgucccccccccccucgcccccauccgcggccuccucuuccccgucgacacccgcggccccuucauccgccgcggcccccccuuccccccccccccccccggcaccgucuucggcgccucccccgacuacuucuccccccgcgacguccccggccccccccgcgcccccuucgccaugcgcaacgucuaccucccccgcggcuuccuccccuaccgccccccccgccccgccuucuucccccccgcccccaccuucuga

SEQ ID NO: 41856 - RNA, 2430 nt, Artificial Sequence
  derived and/or modified sequence opt2 from CTAGE5__Homo_sapiens__NP_001234918
auggaggagcccggcgucaccccccagcccuaccucggccuccuccucgaggagcuccgccgcgucgucgccgcccuccccgagggcaugcgccccgacuccaaccucuacggcuuccccugggagcucgucaucugcgccgccgucgucggcuucuucgccguccucuucuuccucuggcgcuccuuccgcuccguccgcucccgccucuacgucggccgcgagaagaagcucgcccucaugcucuccggccucaucgaggagaaguccaagcuccucgagaaguucucccucguccagaaggaguacgagggcuacgaggucgaguccucccucaaggacgccuccuucgagaaggaggccaccgaggcccagucccucgaggucgagaaccagauggccaccugcgagaagcucaaccgcuccaacuccgagcucgaggacgagauccucugccucgagaaggagcucaaggaggagaaguccaagcacuccgagcaggacgagcucauggccgacaucuccaagcgcauccagucccucgaggacgaguccaagucccucaagucccaggucgccgaggccaagaugaccuucaagaucuuccagaugaacgaggagcgccucaagaucgccaucaaggacgcccucaacgagaacucccagcuccaggagucccagaagcagcuccuccaggaggccgaggucuggaaggagcaggucuccgagcucaacaagcagaaggucaccuucgaggacuccaagguccacgccgagcagguccucaacgacaaggagucccacaucaagacccucaccgagcgccuccucaagaugaaggacugggccgccaugcucggcgaggacaucaccgacgacgacaaccucgagcucgagaugaacuccgaguccgagaacggcgccuaccucgacaacccccccaagggcgcccucaagaagcucauccacgccgccaagcucaacgccucccucaagacccucgagggcgagcgcaaccagaucuacauccagcucuccgaggucgacaagaccaaggaggagcucaccgagcacaucaagaaccuccagaccgagcaggccucccuccaguccgagaacacccacuucgagaacgagaaccagaagcuccagcagaagcucaaggucaugaccgagcucuaccaggagaacgagaugaagcuccaccgcaagcucaccgucgaggagaacuaccgccucgagaaggaggagaagcucuccaaggucgacgagaagaucucccacgccaccgaggagcucgagaccuaccgcaagcgcgccaaggaccucgaggaggagcucgagcgcaccauccacuccuaccagggccagaucaucucccacgagaagaaggcccacgacaacuggcucgccgcccgcaacgccgagcgcaaccucaacgaccuccgcaaggagaacgcccacaaccgccagaagcucaccgagaccgagcucaaguucgagcuccucgagaaggaccccuacgcccucgacguccccaacaccgccuucggccgcgagcacucccccuacggccccuccccccucggcuggcccuccuccgagacccgcgccuuccucuccccccccacccuccucgagggcccccuccgccucuccccccuccuccccggcggcggcggccgcggcucccgcggccccggcaacccccucgaccaccagaucaccaacgagcgcggcgaguccuccugcgaccgccucaccgacccccaccgcgcccccuccgacaccggcucccucuccccccccugggaccaggaccgccgcaugauguuccccccccccggccaguccuaccccgacuccgcccuccccccccagcgccaggaccgcuucugcuccaacuccggccgccucuccggccccgccgagcuccgcuccuucaacaugcccucccucgacaagauggacggcuccaugcccuccgagauggaguccucccgcaacgacaccaaggacgaccucggcaaccucaacguccccgacuccucccuccccgccgagaacgaggccaccggccccggcuucgucccccccccccucgcccccauccgcggcccccucuuccccgucgacgcccgcggccccuuccuccgccgcggcccccccuuccccccccccccccccggcgccauguucggcgccucccgcgacuacuucccccccggcgacuuccccggccccccccccgcccccuucgccaugcgcaacgucuaccccccccgcggcuucccccccuaccuccccccccgccccggcuucuuccccccccccccccacuccgagggccgcuccgaguuccccuccggccucaucccccccuccaacgagcccgccaccgagcaccccgagccccagcaggagaccuga

SEQ ID NO: 41857 - RNA, 1290 nt, Artificial Sequence
  derived and/or modified sequence opt2 from CTBP1__Homo_sapiens__NP_001012632
auguccggcguccgcccccccaucaugaacggcccccuccacccccgcccccucgucgcccuccucgacggccgcgacugcaccgucgagaugcccauccucaaggacgucgccaccgucgccuucugcgacgcccaguccacccaggagauccacgagaagguccucaacgaggccgucggcgcccucauguaccacaccaucacccucacccgcgaggaccucgagaaguucaaggcccuccgcaucaucguccgcaucggcuccggcuucgacaacaucgacaucaaguccgccggcgaccucggcaucgccgucugcaacguccccgccgccuccgucgaggagaccgccgacuccacccucugccacauccucaaccucuaccgccgcgccaccuggcuccaccaggcccuccgcgagggcacccgcguccaguccgucgagcagauccgcgaggucgccuccggcgccgcccgcauccgcggcgagacccucggcaucaucggccucggccgcgucggccaggccgucgcccuccgcgccaaggccuucggcuucaacguccucuucuacgaccccuaccucuccgacggcgucgagcgcgcccucggccuccagcgcgucuccacccuccaggaccuccucuuccacuccgacugcgucacccuccacugcggccucaacgagcacaaccaccaccucaucaacgacuucaccgucaagcagaugcgccagggcgccuuccucgucaacaccgcccgcggcggccucgucgacgagaaggcccucgcccaggcccucaaggagggccgcauccgcggcgccgcccucgacguccacgaguccgagcccuucuccuucucccagggcccccucaaggacgcccccaaccucaucugcaccccccacgccgccugguacuccgagcaggccuccaucgagaugcgcgaggaggccgcccgcgagauccgccgcgccaucaccggccgcauccccgacucccucaagaacugcgucaacaaggaccaccucaccgccgccacccacugggccuccauggaccccgccgucguccaccccgagcucaacggcgccgccuaccgcuacccccccggcgucgucggcgucgcccccaccggcauccccgccgccgucgagggcaucguccccuccgccaugucccucucccacggccucccccccgucgcccaccccccccacgcccccucccccggccagaccgucaagcccgaggccgaccgcgaccacgccuccgaccagcucuga

SEQ ID NO: 41858 - RNA, 1338 nt, Artificial Sequence
  derived and/or modified sequence opt2 from CTBP2__Homo_sapiens__NP_001277143
auggcccucgucgacaagcacaaggucaagcgccagcgccucgaccgcaucugcgagggcauccgcccccagaucaugaacggcccccuccacccccgcccccucgucgcccuccucgacggccgcgacugcaccgucgagaugcccauccucaaggaccucgccaccgucgccuucugcgacgcccaguccacccaggagauccacgagaagguccucaacgaggccgucggcgccaugauguaccacaccaucacccucacccgcgaggaccucgagaaguucaaggcccuccgcgucaucguccgcaucggcuccggcuacgacaacgucgacaucaaggccgccggcgagcucggcaucgccgucugcaacauccccuccgccgccgucgaggagaccgccgacuccaccaucugccacauccucaaccucuaccgccgcaacaccuggcucuaccaggcccuccgcgagggcacccgcguccaguccgucgagcagauccgcgaggucgccuccggcgccgcccgcauccgcggcgagacccucggccucaucggcuucggccgcaccggccaggccgucgccguccgcgccaaggccuucggcuucuccgucaucuucuacgaccccuaccuccaggacggcaucgagcgcucccucggcguccagcgcgucuacacccuccaggaccuccucuaccaguccgacugcgucucccuccacugcaaccucaacgagcacaaccaccaccucaucaacgacuucaccaucaagcagaugcgccagggcgccuuccucgucaacgccgcccgcggcggccucgucgacgagaaggcccucgcccaggcccucaaggagggccgcauccgcggcgccgcccucgacguccacgaguccgagcccuucuccuucgcccagggcccccucaaggacgcccccaaccucaucugcaccccccacaccgccugguacuccgagcaggccucccucgagaugcgcgaggccgccgccaccgagauccgccgcgccaucaccggccgcauccccgagucccuccgcaacugcgucaacaaggaguucuucgucaccuccgcccccugguccgucaucgaccagcaggccauccaccccgagcucaacggcgccaccuaccgcuacccccccggcaucgucggcgucgcccccggcggccuccccgccgccauggagggcaucauccccggcggcauccccgucacccacaaccuccccaccgucgcccaccccucccaggcccccucccccaaccagcccaccaagcacggcgacaaccgcgagcaccccaacgagcaguga

SEQ ID NO: 41859 - RNA, 3654 nt, Artificial Sequence
  derived and/or modified sequence opt2 from CTC1__Homo_sapiens__NP_079375
auggccgccggccgcgcccagguccccuccuccgagcaggccuggcucgaggacgcccaggucuucauccagaagacccucugccccgccgucaaggagcccaacguccagcucaccccccucgucaucgacugcgucaagaccgucuggcucucccagggccgcaaccagggcuccacccucccccucuccuacuccuucgucuccguccaggaccucaagacccaccagcgccuccccugcugcucccaccucuccugguccuccuccgccuaccaggccugggcccaggaggccggccccaacggcaacccccucccccgcgagcagcuccuccuccucggcacccucaccgaccucuccgccgaccucgagcaggagugccgcaacggcucccucuacguccgcgacaacaccggcguccucuccugcgagcucaucgaccucgaccucuccuggcucggccaccucuuccucuucccccgcugguccuaccucccccccgcccgcuggaacuccuccggcgagggccaccucgagcucugggacgcccccguccccgucuucccccucaccaucucccccggccccgucacccccauccccguccucuaccccgaguccgccuccugccuccuccgccuccgcaacaagcuccgcggcguccagcgcaaccucgccggcucccucguccgccucuccgcccucgucaaguccaagcagaaggccuacuucauccucucccucggccgcucccaccccgccgucacccacgucuccaucaucguccagguccccgcccagcucgucuggcaccgcgcccuccgccccggcaccgccuacguccucaccgagcuccgcgucuccaagauccgcggccagcgccagcacgucuggaugaccucccaguccucccgccuccuccuccucaagcccgagugcguccaggagcucgagcucgagcucgagggcccccuccucgaggccgaccccaagccccuccccaugcccuccaacuccgaggacaagaaggaccccgagucccucguccgcuacucccgccuccucuccuacuccggcgccgucaccggcguccucaacgagcccgccggccucuacgagcucgacggccagcucggccucugccucgccuaccagcaguuccgcggccuccgccgcgucaugcgccccggcgucugccuccagcuccaggacguccaccuccuccaguccgucggcggcggcacccgccgccccguccucgcccccugccuccgcggcgccguccuccuccaguccuucucccgccagaagcccggcgcccacuccucccgccaggccuacggcgccucccucuacgagcagcucgucugggagcgccagcucggccucccccucuaccucugggccaccaaggcccucgaggagcucgccugcaagcucugcccccacguccuccgccaccaccaguuccuccagcacuccucccccggcucccccucccucggccuccagcuccucgcccccacccucgaccuccucgccccccccggcucccccguccgcaacgcccacaacgagauccucgaggagccccaccacugcccccuccagaaguacacccgccuccagacccccuccuccuuccccacccucgccacccucaaggaggagggccagcgcaaggccugggccuccuucgaccccaaggcccuccucccccuccccgaggccuccuaccuccccuccugccagcucaaccgccgccucgccugguccuggcucugccuccuccccuccgccuucugccccgcccagguccuccucggcguccucgucgccuccucccacaagggcugccuccagcuccgcgaccaguccggcucccuccccugccuccuccucgccaagcacucccagccccucuccgacccccgccucaucggcugccucguccgcgccgagcgcuuccagcucaucgucgagcgcgacguccgcuccuccuuccccuccuggaaggagcucuccaugcccggcuucauccagaagcagcaggcccgcgucuacguccaguucuuccucgccgacgcccucauccuccccgucccccgccccugccuccacuccgccacccccuccaccccccagaccgaccccaccggccccgagggcccccaccucggccagucccgccucuuccuccucugccacaaggaggcccucaugaagcgcaacuucugcgucccccccggcgccucccccgagguccccaagcccgcccucuccuucuacguccucggcuccuggcucggcggcacccagcgcaaggagggcaccggcuggggccuccccgagccccagggcaacgacgacaacgaccagaagguccaccucaucuucuucggcuccuccguccgcugguucgaguuccuccaccccggccaggucuaccgccucaucgcccccggccccgccacccccaugcucuucgagaaggacggcuccuccugcaucucccgccgcccccucgagcucgccggcugcgccuccugccucaccguccaggacaacuggacccucgagcucgaguccucccaggacauccaggacguccucgacgccaacaagucccuccccgaguccucccucaccgaccuccucuccgacaacuucaccgacucccucgucuccuucuccgccgagauccucucccgcacccucugcgagccccucgucgccucccucuggaugaagcucggcaacaccggcgccaugcgccgcugcgucaagcucaccgucgcccucgagaccgccgagugcgaguuccccccccaccucgacgucuacaucgaggacccccaccucccccccucccucggccuccuccccggcgcccgcguccacuucucccagcucgagaagcgcgucucccgcucccacaacgucuacugcugcuuccgcuccuccaccuacguccagguccucuccuucccccccgagaccaccaucuccaucccccucccccacaucuaccucgccgagcuccuccagggcggccagucccccuuccaggccaccgccuccugccacaucgucuccgucuucucccuccagcucuucugggucugcgccuacugcaccuccaucugccgccagggcaagugcacccgccucggcuccaccugccccacccagaccgccaucucccaggccaucauccgccuccucgucgaggacggcaccgccgaggccgucgucaccugccgcaaccaccacgucgccgccgcccucggccucugcccccgcgagugggccucccuccucgacuucguccagguccccggccgcgucguccuccaguucgccggccccggcgcccagcucgaguccuccgcccgcgucgacgagcccaugaccauguuccucuggacccucugcaccucccccuccguccuccgccccaucguccucuccuucgagcucgagcgcaagcccuccaagaucgucccccucgagcccccccgccuccagcgcuuccagugcggcgagcuccccuuccucacccacgucaacccccgccuccgccucuccugccucuccauccgcgaguccgaguacuccuccucccucggcauccucgccuccuccugcuga

SEQ ID NO: 41860 - RNA, 1200 nt, Artificial Sequence
  derived and/or modified sequence opt2 from CTCF__Homo_sapiens__NP_001177951
auggccuucgucaccuccggcgagcucguccgccaccgccgcuacaagcacacccacgagaagcccuucaagugcuccaugugcgacuacgccuccgucgaggucuccaagcucaagcgccacauccgcucccacaccggcgagcgccccuuccagugcucccucugcuccuacgccucccgcgacaccuacaagcucaagcgccacaugcgcacccacuccggcgagaagcccuacgagugcuacaucugccacgcccgcuucacccaguccggcaccaugaagaugcacauccuccagaagcacaccgagaacgucgccaaguuccacugcccccacugcgacaccgucaucgcccgcaaguccgaccucggcguccaccuccgcaagcagcacuccuacaucgagcagggcaagaagugccgcuacugcgacgccgucuuccacgagcgcuacgcccucauccagcaccagaagucccacaagaacgagaagcgcuucaagugcgaccagugcgacuacgccugccgccaggagcgccacaugaucaugcacaagcgcacccacaccggcgagaagcccuacgccugcucccacugcgacaagaccuuccgccagaagcagcuccucgacaugcacuucaagcgcuaccacgaccccaacuucguccccgccgccuucgucugcuccaagugcggcaagaccuucacccgccgcaacaccauggcccgccacgccgacaacugcgccggccccgacggcgucgagggcgagaacggcggcgagaccaagaaguccaagcgcggccgcaagcgcaagaugcgcuccaagaaggaggacuccuccgacuccgagaacgccgagcccgaccucgacgacaacgaggacgaggaggagcccgccgucgagaucgagcccgagcccgagccccagcccgucacccccgcccccccccccgccaagaagcgccgcggccgcccccccggccgcaccaaccagcccaagcagaaccagcccaccgccaucauccaggucgaggaccagaacaccggcgccaucgagaacaucaucgucgaggucaagaaggagcccgacgccgagcccgccgagggcgaggaggaggaggcccagcccgccgccaccgacgcccccaacggcgaccucacccccgagaugauccucuccaugauggaccgcuga

SEQ ID NO: 41861 - RNA, 1992 nt, Artificial Sequence
  derived and/or modified sequence opt2 from CTCFL__Homo_sapiens__NP_001255970
auggccgccaccgagaucuccguccucuccgagcaguucaccaagaucaaggagcucgagcucaugcccgagaagggccucaaggaggaggagaaggacggcgucugccgcgagaaggaccaccgcucccccuccgagcucgaggccgagcgcaccuccggcgccuuccaggacuccguccucgaggaggaggucgagcucguccucgcccccuccgaggaguccgagaaguacauccucacccuccagaccguccacuucaccuccgaggccgucgagcuccaggacaugucccuccucuccauccagcagcaggagggcguccaggucgucguccagcagcccggccccggccuccucuggcucgaggagggcccccgccagucccuccagcagugcgucgccaucuccauccagcaggagcucuacuccccccaggagauggagguccuccaguuccacgcccucgaggagaacgucauggucgccuccgaggacuccaagcucgccgucucccucgccgagaccaccggccucaucaagcucgaggaggagcaggagaagaaccagcuccucgccgagcgcaccaaggagcagcucuucuucgucgagaccauguccggcgacgagcgcuccgacgagaucguccucaccgucuccaacuccaacgucgaggagcaggaggaccagcccaccgccggccaggccgacgccgagaaggccaaguccaccaagaaccagcgcaagaccaagggcgccaagggcaccuuccacugcgacgucugcauguucaccuccucccgcauguccuccuucaaccgccacaugaagacccacaccuccgagaagccccaccucugccaccucugccucaagaccuuccgcaccgucacccuccuccgcaaccacgucaacacccacaccggcacccgccccuacaagugcaacgacugcaacauggccuucgucaccuccggcgagcucguccgccaccgccgcuacaagcacacccacgagaagcccuucaagugcuccaugugcaaguacgccuccgucgaggccuccaagcucaagcgccacguccgcucccacaccggcgagcgccccuuccagugcugccagugcuccuacgccucccgcgacaccuacaagcucaagcgccacaugcgcacccacuccggcgagaagcccuacgagugccacaucugccacacccgcuucacccaguccggcaccaugaagauccacauccuccagaagcacggcgagaacguccccaaguaccagugcccccacugcgccaccaucaucgcccgcaaguccgaccuccgcguccacaugcgcaaccuccacgccuacuccgccgccgagcucaagugccgcuacugcuccgccgucuuccacgagcgcuacgcccucauccagcaccagaagacccacaagaacgagaagcgcuucaagugcaagcacugcuccuacgccugcaagcaggagcgccacaugaccgcccacauccgcacccacaccggcgagaagcccuucaccugccucuccugcaacaagugcuuccgccagaagcagcuccucaacgcccacuuccgcaaguaccacgacgccaacuucauccccaccgucuacaagugcuccaagugcggcaagggcuucucccgcuggaucaaccuccaccgccacuccgagaagugcggcuccggcgaggccaaguccgccgccuccggcaagggccgccgcacccgcaagcgcaagcagaccauccucaaggaggccaccaagggccagaaggaggccgccaagggcuggaaggaggccgccaacggcgacgaggccgccgccgaggaggccuccaccaccaagggcgagcaguuccccggcgagauguuccccgucgccugccgcgagaccaccgcccgcgucaaggaggaggucgacgagggcgucaccugcgagaugcuccucaacaccauggacaaguga

SEQ ID NO: 41862 - RNA, 2886 nt, Artificial Sequence
  derived and/or modified sequence opt2 from CTDP1__Homo_sapiens__NP_004706
auggagguccccgccgccggccgcguccccgccgagggcgcccccaccgccgccgucgccgagguccgcugccccggccccgccccccuccgccuccucgaguggcgcgucgccgccggcgccgccguccgcaucggcuccguccucgccgucuucgaggccgccgccuccgcccaguccuccggcgccucccagucccgcgucgccuccggcggcugcguccgccccgcccgccccgagcgccgccuccgcuccgagcgcgccggcgucguccgcgagcucugcgcccagcccggccaggucgucgcccccggcgccguccucguccgccucgagggcugcucccaccccgucgucaugaagggccucugcgccgagugcggccaggaccucacccagcuccaguccaagaacggcaagcagcaggucccccucuccaccgccaccgucuccaugguccacuccguccccgagcucauggucuccuccgagcaggccgagcagcucggccgcgaggaccagcagcgccuccaccgcaaccgcaagcucguccucauggucgaccucgaccagacccucauccacaccaccgagcagcacugccagcagauguccaacaagggcaucuuccacuuccagcucggccgcggcgagcccaugcuccacacccgccuccgcccccacugcaaggacuuccucgagaagaucgccaagcucuacgagcuccacgucuucaccuucggcucccgccucuacgcccacaccaucgccggcuuccucgaccccgagaagaagcucuucucccaccgcauccucucccgcgacgagugcaucgaccccuucuccaagaccggcaaccuccgcaaccucuuccccugcggcgacuccauggucugcaucaucgacgaccgcgaggacgucuggaaguucgcccccaaccucaucaccgucaagaaguacgucuacuuccagggcaccggcgacaugaacgccccccccggcucccgcgagucccagacccgcaagaaggucaaccacucccgcggcaccgaggucuccgagcccuccccccccguccgcgaccccgagggcgucacccaggcccccggcgucgagcccuccaacggccucgagaagcccgcccgcgagcucaacggcuccgaggccgccaccccccgcgacuccccccgccccggcaagcccgacgagcgcgacaucuggccccccgcccaggcccccaccuccucccaggagcucgccggcgcccccgagccccagggcuccugcgcccagggcggccgcgucgcccccggccagcgccccgcccagggcgccaccggcaccgaccucgacuucgaccucuccuccgacuccgaguccuccuccgaguccgagggcaccaaguccuccuccuccgccuccgacggcgaguccgagggcaagcgcggccgccagaagcccaaggccgcccccgagggcgccggcgcccucgcccagggcuccucccucgagcccggccgccccgccgcccccucccuccccggcgaggccgagcccggcgcccacgcccccgacaaggagcccgagcucggcggccaggaggagggcgagcgcgacggccucugcggccucggcaacggcugcgccgaccgcaaggaggccgagaccgagucccagaacuccgagcucuccggcgucaccgccggcgagucccucgaccaguccauggaggaggaggaggaggaggacaccgacgaggacgaccaccucaucuaccucgaggagauccucguccgcguccacaccgacuacuacgccaaguacgaccgcuaccucaacaaggagaucgaggaggcccccgacauccgcaagaucguccccgagcucaaguccaagguccucgccgacgucgccaucaucuucuccggccuccaccccaccaacuuccccaucgagaagacccgcgagcacuaccacgccaccgcccucggcgccaagauccucacccgccucguccucucccccgacgcccccgaccgcgccacccaccucaucgccgcccgcgccggcaccgagaagguccuccaggcccaggagugcggccaccuccacgucgucaaccccgacuggcucugguccugccucgagcgcugggacaaggucgaggagcagcucuucccccuccgcgacgaccacaccaaggcccagcgcgagaacucccccgccgccuuccccgaccgcgagggcgucccccccaccgcccucuuccaccccaugcccguccuccccaaggcccagcccggccccgagguccgcaucuacgacuccaacaccggcaagcucauccgcaccggcgcccgcggcccccccgcccccuccuccucccuccccauccgccaggagcccuccuccuuccgcgccgucccccccccccagccccagauguucggcgaggagcuccccgacgcccaggacggcgagcagcccggccccucccgccgcaagcgccagcccuccauguccgagaccaugccccucuacacccucugcaaggaggaccucgaguccauggacaaggaggucgacgacauccucggcgagggcuccgacgacuccgacuccgagaagcgccgccccgaggagcaggaggaggagccccagccccgcaagcccggcacccgccgcgagcgcacccucggcgcccccgccuccuccgagcgcuccgccgccggcggccgcggcccccgcggccacaagcgcaagcucaacgaggaggacgccgccuccgaguccucccgcgaguccuccaacgaggacgagggcuccuccuccgaggccgacgagauggccaaggcccucgaggccgagcucaacgaccucauguga

SEQ ID NO: 41863 - RNA, 783 nt, Artificial Sequence
  derived and/or modified sequence opt2 from CTDSP1__Homo_sapiens__NP_001193807
auggucgccgcccccugggccacccaggagcaggaggagggccgcggcauccagcccggcgaccgcggcgaccagaaguccgccgccucccagaagccccgcucccgcggcauccuccacucccucuucugcugcgucugccgcgacgacggcgaggcccuccccgcccacuccggcgccccccuccucgucgaggagaacggcgccauccccaagacccccguccaguaccuccuccccgaggccaaggcccaggacuccgacaagaucugcgucgucaucgaccucgacgagacccucguccacuccuccuucaagcccgucaacaacgccgacuucaucauccccgucgagaucgacggcgucguccaccaggucuacguccucaagcgcccccacgucgacgaguuccuccagcgcaugggcgagcucuucgagugcguccucuucaccgccucccucgccaaguacgccgaccccgucgccgaccuccucgacaaguggggcgccuuccgcgcccgccucuuccgcgaguccugcgucuuccaccgcggcaacuacgucaaggaccucucccgccucggccgcgaccuccgccgcguccucauccucgacaacucccccgccuccuacgucuuccaccccgacaacgccguccccgucgccuccugguucgacaacauguccgacaccgagcuccacgaccuccuccccuucuucgagcagcucucccgcgucgacgacgucuacuccguccuccgccagccccgccccggcuccuga

SEQ ID NO: 41864 - RNA, 816 nt, Artificial Sequence
  derived and/or modified sequence opt2 from CTDSP2__Homo_sapiens__NP_005721
auggagcacggcuccaucaucacccaggcccgccgcgaggacgcccucguccucaccaagcagggccucgucuccaaguccucccccaagaagccccgcggccgcaacaucuucaaggcccucuucugcugcuuccgcgcccagcacgucggccaguccuccuccuccaccgagcucgccgccuacaaggaggaggccaacaccaucgccaaguccgaccuccuccagugccuccaguaccaguucuaccagauccccggcaccugccuccuccccgaggucaccgaggaggaccagggccgcaucugcgucgucaucgaccucgacgagacccucguccacuccuccuucaagcccaucaacaacgccgacuucaucguccccaucgagaucgagggcaccacccaccaggucuacguccucaagcgccccuacgucgacgaguuccuccgccgcaugggcgagcucuucgagugcguccucuucaccgccucccucgccaaguacgccgaccccgucaccgaccuccucgaccgcugcggcgucuuccgcgcccgccucuuccgcgaguccugcgucuuccaccagggcugcuacgucaaggaccucucccgccucggccgcgaccuccgcaagacccucauccucgacaacucccccgccuccuacaucuuccaccccgagaacgccguccccguccaguccugguucgacgacauggccgacaccgagcuccucaaccucauccccaucuucgaggagcucuccggcgccgaggacgucuacaccucccucggccagcuccgcgcccccuga

SEQ ID NO: 41865 - RNA, 831 nt, Artificial Sequence
  derived and/or modified sequence opt2 from CTDSPL__Homo_sapiens__NP_001008393
auggacggccccgccaucaucacccaggucaccaaccccaaggaggacgagggccgccuccccggcgccggcgagaaggccucccagugcaacgucucccucaagaagcagcgcucccgcuccauccucuccuccuucuucugcugcuuccgcgacuacaacgucgaggcccccccccccuccucccccuccguccuccccccccucgucgaggagaacggcggccuccagaagggcgaccagcgccaggucauccccauccccuccccccccgccaaguaccuccuccccgaggucaccguccucgacuacggcaagaagugcgucgucaucgaccucgacgagacccucguccacuccuccuucaagcccaucuccaacgccgacuucaucguccccgucgagaucgacggcaccauccaccaggucuacguccucaagcgcccccacgucgacgaguuccuccagcgcaugggccagcucuucgagugcguccucuucaccgccucccucgccaaguacgccgaccccgucgccgaccuccucgaccgcuggggcgucuuccgcgcccgccucuuccgcgaguccugcgucuuccaccgcggcaacuacgucaaggaccucucccgccucggccgcgagcucuccaaggucaucaucgucgacaacucccccgccuccuacaucuuccaccccgagaacgccguccccguccaguccugguucgacgacaugaccgacaccgagcuccucgaccucauccccuucuucgagggccucucccgcgaggacgacgucuacuccaugcuccaccgccucugcaaccgcuga

SEQ ID NO: 41866 - RNA, 603 nt, Artificial Sequence
  derived and/or modified sequence opt2 from CTF1__Homo_sapiens__NP_001136016
augucccgccgcgagggcucccucgacccccagaccgacuccuccgucucccuccucccccaccucgaggccaagauccgccagacccacucccucgcccaccuccucaccaaguacgccgagcagcuccuccaggaguacguccagcuccagggcgaccccuucggccuccccuccuucucccccccccgccuccccgucgccggccucuccgcccccgcccccucccacgccggccuccccguccacgagcgccuccgccucgacgccgccgcccucgccgcccuccccccccuccucgacgccgucugccgccgccaggccgagcucaacccccgcgccccccgccuccuccgccgccucgaggacgccgcccgccaggcccgcgcccucggcgccgccgucgaggcccuccucgccgcccucggcgccgccaaccgcggcccccgcgccgagccccccgccgccaccgccuccgccgccuccgccaccggcgucuuccccgccaagguccucggccuccgcgucugcggccucuaccgcgaguggcucucccgcaccgagggcgaccucggccagcuccuccccggcggcuccgccuga

SEQ ID NO: 41867 - RNA, 1050 nt, Artificial Sequence
  derived and/or modified sequence opt2 from CTGF__Homo_sapiens__NP_001892
augaccgccgccuccaugggccccguccgcgucgccuucgucguccuccucgcccucugcucccgccccgccgucggccagaacugcuccggccccugccgcugccccgacgagcccgccccccgcugccccgccggcgucucccucguccucgacggcugcggcugcugccgcgucugcgccaagcagcucggcgagcucugcaccgagcgcgaccccugcgacccccacaagggccucuucugcgacuucggcucccccgccaaccgcaagaucggcgucugcaccgccaaggacggcgcccccugcaucuucggcggcaccgucuaccgcuccggcgaguccuuccaguccuccugcaaguaccagugcaccugccucgacggcgccgucggcugcaugccccucugcuccauggacguccgccuccccucccccgacugccccuucccccgccgcgucaagcuccccggcaagugcugcgaggagugggucugcgacgagcccaaggaccagaccgucgucggccccgcccucgccgccuaccgccucgaggacaccuucggccccgaccccaccaugauccgcgccaacugccucguccagaccaccgagugguccgccugcuccaagaccugcggcaugggcaucuccacccgcgucaccaacgacaacgccuccugccgccucgagaagcagucccgccucugcaugguccgccccugcgaggccgaccucgaggagaacaucaagaagggcaagaagugcauccgcacccccaagaucuccaagcccaucaaguucgagcucuccggcugcaccuccaugaagaccuaccgcgccaaguucugcggcgucugcaccgacggccgcugcugcaccccccaccgcaccaccacccuccccgucgaguucaagugccccgacggcgaggucaugaagaagaacaugauguucaucaagaccugcgccugccacuacaacugccccggcgacaacgacaucuucgagucccucuacuaccgcaagauguacggcgacauggccuga

SEQ ID NO: 41868 - RNA, 690 nt, Artificial Sequence
  derived and/or modified sequence opt2 from CTHRC1__Homo_sapiens__NP_001243028
auguggccccccggccgcuccaucaccgucaagcuccgcgagaagaccgucucccgcaagcucgagaugaacggccccuccgccuuccagggccucaucugcggcaaguacaacggcaugugccuccagggccccgccggcguccccggccgcgacggcucccccggcgccaacggcauccccggcacccccggcauccccggccgcgacggcuucaagggcgagaagggcgagugccuccgcgaguccuucgaggaguccuggacccccaacuacaagcagugcuccugguccucccucaacuacggcaucgaccucggcaagaucgccgagugcaccuucaccaagaugcgcuccaacuccgcccuccgcguccucuucuccggcucccuccgccucaagugccgcaacgccugcugccagcgcugguacuucaccuucaacggcgccgagugcuccggcccccuccccaucgaggccaucaucuaccucgaccagggcucccccgagaugaacuccaccaucaacauccaccgcaccuccuccgucgagggccucugcgagggcaucggcgccggccucgucgacgucgccaucugggucggcaccugcuccgacuaccccaagggcgacgccuccaccggcuggaacuccgucucccgcaucaucaucgaggagcuccccaaguga

SEQ ID NO: 41869 - RNA, 1803 nt, Artificial Sequence
  derived and/or modified sequence opt2 from CTIF__Homo_sapiens__NP_001135869
auggagaacuccuccgccgccuccgccuccuccgaggccggcuccucccgcucccaggagaucgaggagcucgagcgcuucaucgacuccuacguccucgaguaccagguccagggccuccucgccgacaagaccgagggcgacggcgaguccgagcgcacccagucccacaucucccaguggaccgccgacugcuccgagccccucgacuccuccugcuccuucucccgcggccgcgcccccccccagcagaacggcuccaaggacaacucccucgacaugcucggcaccgacaucugggccgccaacaccuucgacuccuucuccggcgccaccugggaccuccagcccgagaagcucgacuucacccaguuccaccgcaagguccgccacacccccaagcagccccucccccacaucgaccgcgagggcugcggcaagggcaagcucgaggacggcgacggcaucaaccucaacgacaucgagaagguccuccccgccuggcagggcuaccaccccaugccccacgaggucgagaucgcccacaccaagaagcucuuccgccgccgccgcaacgaccgccgccgccagcagcgcccccccggcggcaacaagccccagcagcacggcgaccaccagcccggcuccgccaagcacaaccgcgaccaccagaaguccuaccagggcggcuccgccccccaccccuccggccgccccacccaccacggcuacucccagaaccgccgcuggcaccacggcaacaugaagcacccccccggcgacaagggcgaggccggcgcccaccgcaacgccaaggagaccaugaccaucgagaaccccaagcucgaggacaccgccggcgacaccggccacuccucccucgaggccccccgcucccccgacacccucgcccccgucgccuccgagcgccuccccccccagcaguccggcggccccgaggucgagaccaagcgcaaggacuccauccuccccgagcgcaucggcgagcgccccaagaucacccuccuccaguccuccaaggaccgccuccgccgccgccucaaggagaagguccccgacgaggucgccgucgagaccaccaccccccagcagaacaagauggacaagcucaucgagauccucaacuccaugcgcaacaacuccuccgacgucgacaccaagcucaccaccuucauggaggaggcccagaacuccaccaacuccgaggagaugcucggcgagaucguccgcaccaucuaccagaaggccgucuccgaccgcuccuucgccuucaccgccgccaagcucugcgacaagauggcccucuucauggucgagggcaccaaguuccgcucccuccuccucaacaugcuccagaaggacuucaccguccgcgaggagcuccagcagcaggacgucgagcgcuggcucggcuucaucaccuuccucugcgaggucuucggcaccaugcgcuccuccaccggcgagcccuuccgcguccucgucugccccaucuacaccugccuccgcgagcuccuccagucccaggacgucaaggaggacgccguccucugcugcuccauggagcuccaguccaccggccgccuccucgaggagcagcuccccgagaugaugaccgagcuccucgccuccgcccgcgacaagaugcucugccccuccgaguccaugcucacccgcucccuccuccucgaggucaucgagcuccacgccaacuccuggaacccccucaccccccccaucacccaguacuacaaccgcaccauccagaagcucaccgccuga

SEQ ID NO: 41870 - RNA, 525 nt, Artificial Sequence
  derived and/or modified sequence opt2 from CTLA4__Homo_sapiens__NP_001032720
auggccugccucggcuuccagcgccacaaggcccagcucaaccucgccacccgcaccuggcccugcacccuccucuucuuccuccucuucauccccgucuucugcaaggccaugcacgucgcccagcccgccgucguccucgccuccucccgcggcaucgccuccuucgucugcgaguacgccucccccggcaaggccaccgagguccgcgucaccguccuccgccaggccgacucccaggucaccgaggucugcgccgccaccuacaugaugggcaacgagcucaccuuccucgacgacuccaucugcaccggcaccuccuccggcaaccaggucaaccucaccauccagggccuccgcgccauggacaccggccucuacaucugcaaggucgagcucauguaccccccccccuacuaccucggcaucggcaacggcacccagaucuacgucaucgccaaggagaagaagcccuccuacaaccgcggccucugcgagaacgcccccaaccgcgcccgcauguga

SEQ ID NO: 41871 - RNA, 2526 nt, Artificial Sequence
  derived and/or modified sequence opt2 from CTNNA1__Homo_sapiens__NP_001277236
augaccgccguccacgccggcaacaucaacuucaagugggaccccaagucccucgagauccgcacccucgccgucgagcgccuccucgagccccucgucacccaggucaccacccucgucaacaccaacuccaagggccccuccaacaagaagcgcggccgcuccaagaaggcccacguccucgccgccuccgucgagcaggccaccgagaacuuccucgagaagggcgacaagaucgccaaggagucccaguuccucaaggaggagcucgucgccgccgucgaggacguccgcaagcagggcgaccucaugaaggccgccgccggcgaguucgccgacgaccccugcuccuccgucaagcgcggcaacaugguccgcgccgcccgcgcccuccucuccgccgucacccgccuccucauccucgccgacauggccgacgucuacaagcuccucguccagcucaaggucgucgaggacggcauccucaagcuccgcaacgccggcaacgagcaggaccucggcauccaguacaaggcccucaagcccgaggucgacaagcucaacaucauggccgccaagcgccagcaggagcucaaggacgucggccaccgcgaccagauggccgccgcccgcggcauccuccagaagaacguccccauccucuacaccgccucccaggccugccuccagcaccccgacgucgccgccuacaaggccaaccgcgaccucaucuacaagcagcuccagcaggccgucaccggcaucuccaacgccgcccaggccaccgccuccgacgacgccucccagcaccagggcggcggcggcggcgagcucgccuacgcccucaacaacuucgacaagcagaucaucgucgacccccucuccuucuccgaggagcgcuuccgccccucccucgaggagcgccucgaguccaucaucuccggcgccgcccucauggccgacuccuccugcacccgcgacgaccgccgcgagcgcaucgucgccgagugcaacgccguccgccaggcccuccaggaccuccucuccgaguacaugggcaacgccggccgcaaggagcgcuccgacgcccucaacuccgccaucgacaagaugaccaagaagacccgcgaccuccgccgccagcuccgcaaggccgucauggaccacgucuccgacuccuuccucgagaccaacgucccccuccucguccucaucgaggccgccaagaacggcaacgagaaggaggucaaggaguacgcccaggucuuccgcgagcacgccaacaagcucaucgaggucgccaaccucgccugcuccaucuccaacaacgaggagggcgucaagcucguccgcauguccgccucccagcucgaggcccucugcccccaggucaucaacgccgcccucgcccucgccgccaagccccaguccaagcucgcccaggagaacauggaccucuucaaggagcagugggagaagcagguccgcguccucaccgacgccgucgacgacaucaccuccaucgacgacuuccucgccgucuccgagaaccacauccucgaggacgucaacaagugcgucaucgcccuccaggagaaggacgucgacggccucgaccgcaccgccggcgccauccgcggccgcgccgcccgcgucauccacgucgucaccuccgagauggacaacuacgagcccggcgucuacaccgagaagguccucgaggccaccaagcuccucuccaacaccgucaugccccgcuucaccgagcaggucgaggccgccgucgaggcccucuccuccgaccccgcccagcccauggacgagaacgaguucaucgacgccucccgccucgucuacgacggcauccgcgacauccgcaaggccguccucaugauccgcacccccgaggagcucgacgacuccgacuucgagaccgaggacuucgacguccgcucccgcaccuccguccagaccgaggacgaccagcucaucgccggccaguccgcccgcgccaucauggcccagcucccccaggagcagaaggccaagaucgccgagcaggucgccuccuuccaggaggagaaguccaagcucgacgccgaggucuccaagugggacgacuccggcaacgacaucaucguccucgccaagcagaugugcaugaucaugauggagaugaccgacuucacccgcggcaagggcccccucaagaacaccuccgacgucaucuccgccgccaagaagaucgccgaggccggcucccgcauggacaagcucggccgcaccaucgccgaccacugccccgacuccgccugcaagcaggaccuccucgccuaccuccagcgcaucgcccucuacugccaccagcucaacaucugcuccaaggucaaggccgagguccagaaccucggcggcgagcucgucgucuccggcaacugcgacaccugcggcgcccuccagggccucaagggcuggccccccccccucugcuggccccucaccggcuggaccgcccccugccccuga

SEQ ID NO: 41872 - RNA, 2583 nt, Artificial Sequence
  derived and/or modified sequence opt2 from CTNNA2__Homo_sapiens__NP_001158355
augaccuccgccaccucccccaucauccucaagugggaccccaagucccucgagauccgcacccucaccgucgagcgccuccucgagccccucgucacccaggucaccacccucgucaacaccuccaacaagggccccuccggcaagaagaagggccgcuccaagaaggcccacguccucgccgccuccgucgagcaggccacccagaacuuccucgagaagggcgagcagaucgccaaggagucccaggaccucaaggaggagcucgucgccgccgucgaggacguccgcaagcagggcgagaccaugcgcaucgccuccuccgaguucgccgacgaccccugcuccuccgucaagcgcggcaccaugguccgcgccgcccgcgcccuccucuccgccgucacccgccuccucauccucgccgacauggccgacgucaugcgccuccucucccaccucaagaucgucgaggaggcccucgaggccgucaagaacgccaccaacgagcaggaccucgccaaccgcuucaaggaguucggcaaggagauggucaagcucaacuacgucgccgcccgccgccagcaggagcucaaggacccccacugccgcgacgagauggccgccgcccgcggcgcccucaagaagaacgccaccaugcucuacaccgccucccaggccuuccuccgccaccccgacgucgccgccacccgcgccaaccgcgacuacgucuucaagcagguccaggaggccaucgccggcaucuccaacgccgcccaggccaccucccccaccgacgaggccaagggccacaccggcaucggcgagcucgccgccgcccucaacgaguucgacaacaagaucauccucgaccccaugaccuucuccgaggcccgcuuccgccccucccucgaggagcgccucgaguccaucaucuccggcgccgcccucauggccgacuccuccugcacccgcgacgaccgccgcgagcgcaucgucgccgagugcaacgccguccgccaggcccuccaggaccuccucuccgaguacaugaacaacaccggccgcaaggagaagggcgacccccucaacaucgccaucgacaagaugaccaagaagacccgcgaccuccgccgccagcuccgcaaggccgucauggaccacaucuccgacuccuuccucgagaccaacgucccccuccucguccucaucgaggccgccaaguccggcaacgagaaggaggucaaggaguacgcccaggucuuccgcgagcacgccaacaagcucgucgaggucgccaaccucgccugcuccaucuccaacaacgaggagggcgucaagcucguccgcauggccgccacccagaucgacucccucugcccccaggucaucaacgccgcccucacccucgccgcccgcccccaguccaaggucgcccaggacaacauggacgucuucaaggaccagugggagaagcagguccgcguccucaccgaggccgucgacgacaucaccuccgucgacgacuuccucuccgucuccgagaaccacauccucgaggacgucaacaagugcgucaucgcccuccaggagggcgacgucgacacccucgaccgcaccgccggcgccauccgcggccgcgccgcccgcgucauccacaucaucaacgccgagauggagaacuacgaggccggcgucuacaccgagaagguccucgaggccaccaagcuccucuccgagaccgucaugccccgcuucgccgagcaggucgaggucgccaucgaggcccucuccgccaacgucccccagcccuucgaggagaacgaguucaucgacgccucccgccucgucuacgacggcguccgcgacauccgcaaggccguccucaugauccgcacccccgaggagcucgaggacgacuccgacuucgagcaggaggacuacgacguccgcucccgcaccuccguccagaccgaggacgaccagcucaucgccggccaguccgcccgcgccaucauggcccagcucccccaggaggagaaggccaagaucgccgagcaggucgagaucuuccaccaggagaaguccaagcucgacgccgaggucgccaagugggacgacuccggcaacgacaucaucguccucgccaagcagaugugcaugaucaugauggagaugaccgacuucacccgcggcaagggcccccucaagaacaccuccgacgucaucaacgccgccaagaagaucgccgaggccggcucccgcauggacaagcucgcccgcgccgucgccgaccagcucgacuccgccaccucccucauccaggccgccaagaaccucaugaacgccgucguccucaccgucaaggccuccuacgucgccuccaccaaguaccagaaggucuacggcaccgccgccgucaacucccccgucgucuccuggaagaugaaggcccccgagaagaagccccucgucaagcgcgagaagcccgaggaguuccagacccgcguccgccgcggcucccagaagaagcacaucucccccguccaggcccucuccgaguucaaggccauggacuccuucuga

SEQ ID NO: 41873 - RNA, 1167 nt, Artificial Sequence
  derived and/or modified sequence opt2 from CTNNA3__Homo_sapiens__NP_001278062
augaaguccacccagcgccgcgagaagcagggcuccauguccgccgagacccccaucacccucaacaucgacccccaggaccuccagguccagaccuucaccgucgagaagcuccucgagccccucaucauccaggucaccacccucgucaacugcccccagaaccccuccucccgcaagaagggccgcuccaagcgcgccuccguccuccucgccuccgucgaggaggccaccuggaaccuccucgacaagggcgagaagaucgcccaggaggccaccguccucaaggacgagcucaccgccucccucgaggagguccgcaaggaguccgaggcccucaaggucuccgccgagcgcuucaccgacgaccccugcuuccuccccaagcgcgaggccgucguccaggccgcccgcgcccuccucgccgccgucacccgccuccucauccucgccgacaugaucgacgucaugugccuccuccagcacgucuccgccuuccagcgcaccuucgagucccucaagaacgucgccaacaaguccgaccuccagaagaccuaccagaagcucggcaaggagcucgagaaccucgacuaccucgccuucaagcgccagcaggaccucaagucccccaaccagcgcgacgagaucgccggcgcccgcgccucccucaaggagaacuccccccuccuccacuccaucugcuccgccugccucgagcacuccgacgucgccucccucaaggccuccaaggacaccgucugcgaggagauccagaacgcccucaacgucaucuccaacgccucccagggcauccagaacaugaccaccccccccgagccccaggccgccacccucggcuccgcccucgacgagcucgagaaccucaucguccucaacccccucaccgucaccgaggaggagauccgccccucccucgagaagcgccucgaggccaucaucuccggcgccgcccuccucgccgacuccuccugcacccgcgaccuccaccgcgagcgcaucaucgccgagugcaacgccauccgccaggcccuccaggaccuccucuccgaguacaugaacaaccucugcaaccagaaguccgaccucggccucaccggcgucaagaucaagcuccucgaggagugcaucaucuucuggucccucuga

SEQ ID NO: 41874 - RNA, 2157 nt, Artificial Sequence
  derived and/or modified sequence opt2 from CTNNAL1__Homo_sapiens__NP_001273903
auggccgccucccccggccccgccggcgucggcggcgccggcgccgucuacggcuccggcuccuccggcuucgcccucgacuccggccucgagaucaagacccgcuccgucgagcagacccuccucccccucgucucccagaucaccacccucaucaaccacaaggacaacaccaagaaguccgacaagacccuccaggccauccagcgcgucggccaggccgucaaccucgccgucggccgcuucgucaaggucggcgaggccaucgccaacgagaacugggaccucaaggaggagaucaacaucgccugcaucgaggccaagcaggccggcgagaccaucgccgcccucaccgacaucaccaaccucaaccaccucgaguccgacggccagaucaccaucuucaccgacaagaccggcgucaucaaggccgcccgccuccuccucuccuccgucaccaagguccuccuccucgccgaccgcgucgucaucaagcagaucaucaccucccgcaacaagguccucgccaccauggagcgccucgagaaggucaacuccuuccaggaguucguccagaucuucucccaguucggcaacgagauggucgaguucgcccaccucuccggcgaccgccagaacgaccucaaggacgagaagaagaaggccaagauggccgccgcccgcgccguccucgagaagugcaccaugaugcuccucaccgccuccaagaccugccuccgccaccccaacugcgaguccgcccacaagaacaaggagggcgucuucgaccgcaugaaggucgcccucgacaaggucaucgagaucgucaccgacugcaagcccaacggcgagaccgacaucuccuccaucuccaucuucaccggcaucaaggaguucaagaugaacaucgaggcccuccgcgagaaccucuacuuccaguccaaggagaaccucuccgucacccucgaggucauccucgagcgcauggaggacuucaccgacuccgccuacaccucccacgagcaccgcgagcgcauccucgagcucuccacccaggcccgcauggagcuccagcagcucaucuccgucuggauccaggcccaguccaagaagaccaaguccaucgccgaggagcucgagcucuccauccucaagaucucccacucccucaacgagcucaagaaggagcuccacuccaccgccacccagcucgccgccgaccuccucaaguaccacgccgaccacgucguccucaaggcccucaagcucaccggcgucgagggcaaccucgaggcccucgccgaguacgccugcaagcucuccgagcagaaggagcagcucgucgagaccugccgccuccuccgccacaucuccggcaccgagccccucgagaucaccugcauccacgccgaggagaccuuccaggucaccggccagcagaucaucuccgccgccgagacccucacccuccaccccuccuccaagaucgccaaggagaaccucgacgucuucugcgaggccugggagucccagaucuccgacauguccacccuccuccgcgagaucaacgacgucuucgagggccgccgcggcgagaaguacggcuaccucucccuccccaagcccaugaagaacaacgccaaccucaagucccucaagcccgacaagcccgacuccgaggagcaggccaagaucgccaagcucggccucaagcucggccuccucaccuccgacgccgacugcgagaucgagaagugggaggaccaggagaacgagaucguccaguacggccgcaacauguccuccauggccuacucccucuaccucuucacccgcggcgagggcccccucaagaccucccaggaccucauccaccagcucgaggucuucgccgccgagggccucaagcucaccuccuccguccaggccuucuccaagcagcucaaggacgacgacaagcucaugcuccuccucgagaucaacaagcucaucccccucugccaccagcuccagaccgucaccaagaccucccuccagaacaaggucuuccucaaggucgacaagugcaucaccaagacccgcuccaugauggcccuccucguccagcuccucucccucugcuacaagcuccucaagaaguccgagacccgcuacuga

SEQ ID NO: 41875 - RNA, 2346 nt, Artificial Sequence
  derived and/or modified sequence opt2 from CTNNB1__Homo_sapiens__NP_001091679
auggccacccaggccgaccucauggagcucgacauggccauggagcccgaccgcaaggccgccgucucccacuggcagcagcaguccuaccucgacuccggcauccacuccggcgccaccaccaccgcccccucccucuccggcaagggcaaccccgaggaggaggacgucgacaccucccagguccucuacgagugggagcagggcuucucccaguccuucacccaggagcaggucgccgacaucgacggccaguacgccaugacccgcgcccagcgcguccgcgccgccauguuccccgagacccucgacgagggcaugcagauccccuccacccaguucgacgccgcccaccccaccaacguccagcgccucgccgagcccucccagaugcucaagcacgccgucgucaaccucaucaacuaccaggacgacgccgagcucgccacccgcgccauccccgagcucaccaagcuccucaacgacgaggaccaggucgucgucaacaaggccgccgucaugguccaccagcucuccaagaaggaggccucccgccacgccaucaugcgcuccccccagauggucuccgccaucguccgcaccaugcagaacaccaacgacgucgagaccgcccgcugcaccgccggcacccuccacaaccucucccaccaccgcgagggccuccucgccaucuucaaguccggcggcauccccgcccucgucaagaugcucggcucccccgucgacuccguccucuucuacgccaucaccacccuccacaaccuccuccuccaccaggagggcgccaagauggccguccgccucgccggcggccuccagaagauggucgcccuccucaacaagaccaacgucaaguuccucgccaucaccaccgacugccuccagauccucgccuacggcaaccaggaguccaagcucaucauccucgccuccggcggcccccaggcccucgucaacaucaugcgcaccuacaccuacgagaagcuccucuggaccaccucccgcguccucaagguccucuccgucugcuccuccaacaagcccgccaucgucgaggccggcggcaugcaggcccucggccuccaccucaccgaccccucccagcgccucguccagaacugccucuggacccuccgcaaccucuccgacgccgccaccaagcaggagggcauggagggccuccucggcacccucguccagcuccucggcuccgacgacaucaacgucgucaccugcgccgccggcauccucuccaaccucaccugcaacaacuacaagaacaagaugauggucugccaggucggcggcaucgaggcccucguccgcaccguccuccgcgccggcgaccgcgaggacaucaccgagcccgccaucugcgcccuccgccaccucaccucccgccaccaggaggccgagauggcccagaacgccguccgccuccacuacggccuccccgucgucgucaagcuccuccacccccccucccacuggccccucaucaaggccaccgucggccucauccgcaaccucgcccucugccccgccaaccacgccccccuccgcgagcagggcgccaucccccgccucguccagcuccucguccgcgcccaccaggacacccagcgccgcaccuccaugggcggcacccagcagcaguucgucgagggcguccgcauggaggagaucgucgagggcugcaccggcgcccuccacauccucgcccgcgacguccacaaccgcaucgucauccgcggccucaacaccaucccccucuucguccagcuccucuacucccccaucgagaacauccagcgcgucgccgccggcguccucugcgagcucgcccaggacaaggaggccgccgaggccaucgaggccgagggcgccaccgccccccucaccgagcuccuccacucccgcaacgagggcgucgccaccuacgccgccgccguccucuuccgcauguccgaggacaagccccaggacuacaagaagcgccucuccgucgagcucaccuccucccucuuccgcaccgagcccauggccuggaacgagaccgccgaccucggccucgacaucggcgcccagggcgagccccucggcuaccgccaggacgaccccuccuaccgcuccuuccacuccggcggcuacggccaggacgcccucggcauggaccccaugauggagcacgagaugggcggccaccaccccggcgccgacuaccccgucgacggccuccccgaccucggccacgcccaggaccucauggacggccucccccccggcgacuccaaccagcucgccugguucgacaccgaccucuga

SEQ ID NO: 41876 - RNA, 1611 nt, Artificial Sequence
  derived and/or modified sequence opt2 from CTNNBL1__Homo_sapiens__NP_001268424
augcgccgcaagcagaccggcacccgcgagcgcggccgcuaccgcgaggaggagaugaccgucgucgaggaggccgacgacgacaagaagcgccuccuccagaucaucgaccgcgacggcgaggaggaggaggaggaggaggagccccucgacgaguccuccgucaagaagaugauccucaccuucgagaagcgcuccuacaagaaccaggagcuccgcaucaaguuccccgacaaccccgagaaguucauggaguccgagcucgaccucaacgacaucauccaggagaugcacgucgucgccaccaugcccgaccucuaccaccuccucgucgagcucaacgccguccagucccuccucggccuccucggccacgacaacaccgacgucuccaucgccgucgucgaccuccuccaggagcucaccgacaucgacacccuccacgaguccgaggagggcgccgagguccucaucgacgcccucgucgacggccaggucgucgcccuccucguccagaaccucgagcgccucgacgaguccgucaaggaggaggccgacggcguccacaacacccucgccaucgucgagaacauggccgaguuccgccccgagaugugcaccgagggcgcccagcagggccuccuccaguggcuccucaagcgccucaaggccaagaugcccuucgacgccaacaagcucuacugcuccgagguccucgccauccuccuccaggacaacgacgagaaccgcgagcuccucggcgagcucgacggcaucgacguccuccuccagcagcucuccgucuucaagcgccacaaccccuccaccgccgaggagcaggagaugauggagaaccucuucgacucccucugcuccugccucaugcucuccuccaaccgcgagcgcuuccucaagggcgagggccuccagcucaugaaccucaugcuccgcgagaagaagaucucccgcuccuccgcccucaagguccucgaccacgccaugaucggccccgagggcaccgacaacugccacaaguucgucgacauccucggccuccgcaccaucuucccccucuucaugaaguccccccgcaagaucaagaaggucggcaccaccgagaaggagcacgaggagcacgucugcuccauccucgccucccuccuccgcaaccuccgcggccagcagcgcacccgccuccucaacaaguucaccgagaacgacuccgagaaggucgaccgccucauggagcuccacuucaaguaccucggcgccaugcaggucgccgacaagaagaucgagggcgagaagcacgacaugguccgccgcggcgagaucaucgacaacgacaccgaggaggaguucuaccuccgccgccucgacgccggccucuucguccuccagcacaucugcuacaucauggccgagaucugcaacgccaacgucccccagauccgccagcgcguccaccagauccucaacaugcgcggcuccuccaucaagaucguccgccacaucaucaaggaguacgccgagaacaucggcgacggccgcucccccgaguuccgcgagaacgagcagaagcgcauccucggccuccucgagaacuucuga

SEQ ID NO: 41877 - RNA, 2907 nt, Artificial Sequence
  derived and/or modified sequence opt2 from CTNND1__Homo_sapiens__NP_001078927
auggacgacuccgaggucgaguccaccgccuccauccucgccuccgucaaggagcaggaggcccaguucgagaagcucacccgcgcccucgaggaggagcgccgccacgucuccgcccagcucgagcgcguccgcgucuccccccaggacgccaacccccucauggccaacggcacccucacccgccgccaccagaacggccgcuucgucggcgacgccgaccucgagcgccagaaguucuccgaccucaagcucaacggcccccaggaccacucccaccuccucuacuccaccaucccccgcaugcaggagcccggccagaucgucgagaccuacaccgaggaggaccccgagggcgccauguccgucgucuccgucgagaccuccgacgacggcaccacccgccgcaccgagaccaccgucaagaaggucgucaagaccgucaccacccgcaccguccagcccgucgccaugggccccgacggccuccccgucgacgccuccuccgucuccaacaacuacauccagacccucggccgcgacuuccgcaagaacggcaacggcggccccggccccuacgucggccaggccggcaccgccacccucccccgcaacuuccacuacccccccgacggcuacucccgccacuacgaggacggcuaccccggcggcuccgacaacuacggcucccucucccgcgucacccgcaucgaggagcgcuaccgccccuccauggagggcuaccgcgcccccucccgccaggacgucuacggcccccagccccagguccgcgucggcggcuccuccgucgaccuccaccgcuuccaccccgagcccuacggccucgaggacgaccagcgcuccaugggcuacgacgaccucgacuacggcaugauguccgacuacggcaccgcccgccgcaccggcacccccuccgacccccgccgccgccuccgcuccuacgaggacaugaucggcgaggagguccccuccgaccaguacuacugggccccccucgcccagcacgagcgcggcucccucgccucccucgacucccuccgcaagggcggcccccccccccccaacuggcgccagcccgagcuccccgaggucaucgccaugcucggcuuccgccucgacgccgucaaguccaacgccgccgccuaccuccagcaccucugcuaccgcaacgacaaggucaagaccgacguccgcaagcucaagggcauccccguccucgucggccuccucgaccaccccaagaaggagguccaccucggcgccugcggcgcccucaagaacaucuccuucggccgcgaccaggacaacaagaucgccaucaagaacugcgacggcguccccgcccucguccgccuccuccgcaaggcccgcgacauggaccucaccgaggucaucaccggcacccucuggaaccucuccucccacgacuccaucaagauggagaucgucgaccacgcccuccacgcccucaccgacgaggucaucaucccccacuccggcugggagcgcgagcccaacgaggacugcaagccccgccacaucgagugggaguccguccucaccaacaccgccggcugccuccgcaacgucuccuccgagcgcuccgaggcccgccgcaagcuccgcgagugcgacggccucgucgacgcccucaucuucaucguccaggccgagaucggccagaaggacuccgacuccaagcucgucgagaacugcgucugccuccuccgcaaccucuccuaccagguccaccgcgagaucccccaggccgagcgcuaccaggaggccgcccccaacgucgccaacaacaccggcccccacgccgccuccugcuucggcgccaagaagggcaaggacgagugguucucccgcggcaagaagcccaucgaggaccccgccaacgacaccgucgacuuccccaagcgcaccucccccgcccgcggcuacgagcuccucuuccagcccgaggucguccgcaucuacaucucccuccucaaggaguccaagacccccgccauccucgaggccuccgccggcgccauccagaaccucugcgccggccgcuggaccuacggccgcuacauccgcuccgcccuccgccaggagaaggcccucuccgccaucgccgaccuccucaccaacgagcacgagcgcgucgucaaggccgccuccggcgcccuccgcaaccucgccgucgacgcccgcaacaaggagcucaucggcaagcacgccauccccaaccucgucaagaaccuccccggcggccagcagaacuccuccuggaacuucuccgaggacaccgucaucuccauccucaacaccaucaacgaggucaucgccgagaaccucgaggccgccaagaagcuccgcgagacccagggcaucgagaagcucguccucaucaacaaguccggcaaccgcuccgagaaggagguccgcgccgccgcccucguccuccagaccaucuggggcuacaaggagcuccgcaagccccucgagaaggagggcuggaagaaguccgacuuccaggucaaccucaacaacgccucccgcucccaguccucccacuccuacgacgacuccacccucccccucaucgaccgcaaccagaaguccgacaagaagcccgaccgcgaggagauccagauguccaacaugggcuccaacaccaagucccucgacaacaacuacuccacccccaacgagcgcggcgaccacaaccgcacccucgaccgcuccggcgaccucggcgacauggagccccucaagggcaccaccccccucaugcaggacgagggccaggagucccucgaggaggagcucgacguccucguccucgacgacgagggcggccaggucuccuaccccuccaugcagaagaucuga

SEQ ID NO: 41878 - RNA, 3405 nt, Artificial Sequence
  derived and/or modified sequence opt2 from CTNND2__Homo_sapiens__NP_001275644
auguccuccauguccuccgccgaggagcaguuccaguggcagucccaggacggccagaaggacaucgaggacgagcucaccaccggccucgagcucgucgacuccugcauccgcucccuccaggaguccggcauccucgacccccaggacuacuccaccggcgagcgccccucccuccucucccaguccgcccuccagcucaacuccaagcccgagggcuccuuccaguaccccgccuccuaccacuccaaccagacccucgcccucggcgagaccacccccucccagcuccccgcccgcggcacccaggcccgcgccaccggccaguccuucucccagggcaccaccucccgcgccggccaccucgccggccccgagcccgccccccccccccccccccccccccgcgagcccuucgcccccucccucggcuccgccuuccaccuccccgacgccccccccgccgccgccgccgccgcccucuacuacuccuccuccacccuccccgcccccccccgcggcggcuccccccucgccgccccccagggcggcucccccaccaagcuccagcgcggcggcuccgcccccgagggcgccaccuacgccgccccccgcggcuccucccccaagcagucccccucccgccucgccaaguccuacuccaccuccucccccaucaacaucgucgucuccuccgccggccucucccccauccgcgucaccuccccccccaccguccaguccaccaucuccuccucccccauccaccagcucuccuccaccaucggcaccuacgccacccucucccccaccaagcgccucguccacgccuccgagcaguacuccaagcacucccaggagcucuacgccaccgccacccuccagcgccccggcucccucgccgccggcucccgcgccuccuacuccucccagcacggccaccucggccccgagcuccgcgcccuccagucccccgagcaccacaucgaccccaucuacgaggaccgcgucuaccagaagccccccaugcgcucccucucccagucccagggcgacccccucccccccgcccacaccggcaccuaccgcaccuccaccgcccccuccucccccggcgucgacuccgucccccuccagcgcaccggcucccagcacggcccccagaacgccgccgccgccaccuuccagcgcgccuccuacgccgccggccccgccuccaacuacgccgaccccuaccgccagcuccaguacugccccuccgucgagucccccuacuccaaguccggccccgcccucccccccgagggcacccucgcccgcucccccuccaucgacuccauccagaaggacccccgcgaguucggcuggcgcgaccccgagcuccccgaggucauccagaugcuccagcaccaguuccccuccguccaguccaacgccgccgccuaccuccagcaccucugcuucggcgacaacaagaucaaggccgagauccgccgccagggcggcauccagcuccucgucgaccuccucgaccaccgcaugaccgagguccaccgcuccgccugcggcgcccuccgcaaccucgucuacggcaaggccaacgacgacaacaagaucgcccucaagaacugcggcggcauccccgcccucguccgccuccuccgcaagaccaccgaccucgagauccgcgagcucgucaccggcguccucuggaaccucuccuccugcgacgcccucaagaugcccaucauccaggacgcccucgccguccucaccaacgccgucaucaucccccacuccggcugggagaacuccccccuccaggacgaccgcaagauccagcuccacuccucccagguccuccgcaacgccaccggcugccuccgcaacgucuccuccgccggcgaggaggcccgccgccgcaugcgcgagugcgacggccucaccgacgcccuccucuacgucauccaguccgcccucggcuccuccgagaucgacuccaagaccgucgagaacugcgucugcauccuccgcaaccucuccuaccgccucgccgccgagaccucccagggccagcacaugggcaccgacgagcucgacggccuccucugcggcgaggccaacggcaaggacgccgaguccuccggcugcuggggcaagaagaagaagaagaagaagucccaggaccagugggacggcgucggcccccuccccgacugcgccgagccccccaagggcauccagaugcucuggcaccccuccaucgucaagcccuaccucacccuccucuccgagugcuccaaccccgacacccucgagggcgccgccggcgcccuccagaaccucgccgccggcuccuggaagugguccgucuacauccgcgccgccguccgcaaggagaagggccuccccauccucgucgagcuccuccgcaucgacaacgaccgcgucgucugcgccgucgccaccgcccuccgcaacauggcccucgacguccgcaacaaggagcucaucggcaaguacgccaugcgcgaccucguccaccgccuccccggcggcaacaacuccaacaacaccgccuccaaggccauguccgacgacaccgucaccgccgucugcugcacccuccacgaggucaucaccaagaacauggagaacgccaaggcccuccgcgacgccggcggcaucgagaagcucgucggcaucuccaaguccaagggcgacaagcacucccccaaggucgucaaggccgccucccagguccucaacuccauguggcaguaccgcgaccuccgcucccucuacaagaaggacggcuggucccaguaccacuucgucgccuccuccuccaccaucgagcgcgaccgccagcgccccuacuccuccucccgcacccccuccaucucccccguccgcgucucccccaacaaccgcuccgccuccgcccccgccuccccccgcgagaugaucucccucaaggagcgcaagaccgacuacgagugcaccggcuccaacgccaccuaccacggcgccaagggcgagcacaccucccgcaaggacgccaugaccgcccagaacaccggcaucuccacccucuaccgcaacuccuacggcgcccccgccgaggacaucaagcacaaccaggucuccgcccagcccgucccccaggagcccucccgcaaggacuacgagaccuaccagcccuuccagaacuccacccgcaacuacgacgaguccuucuucgaggaccagguccaccaccgcccccccgccuccgaguacaccaugcaccucggccucaaguccaccggcaacuacgucgacuucuacuccgccgcccgccccuacuccgagcucaacuacgagaccucccacuaccccgccucccccgacuccugggucuga

SEQ ID NO: 41879 - RNA, 1203 nt, Artificial Sequence
  derived and/or modified sequence opt2 from CTNS__Homo_sapiens__NP_001026851
augauccgcaacuggcucaccaucuucauccucuucccccucaagcucgucgagaagugcgaguccuccgucucccucaccgucccccccgucgucaagcucgagaacggcuccuccaccaacgucucccucacccuccgccccccccucaacgccacccucgucaucaccuucgagaucaccuuccgcuccaagaacaucaccauccucgagcuccccgacgaggucgucgucccccccggcgucaccaacuccuccuuccaggucaccucccagaacgucggccagcucaccgucuaccuccacggcaaccacuccaaccagaccggcccccgcauccgcuuccucgucauccgcuccuccgccaucuccaucaucaaccaggucaucggcuggaucuacuucgucgccugguccaucuccuucuacccccaggucaucaugaacuggcgccgcaaguccgucaucggccucuccuucgacuucgucgcccucaaccucaccggcuucgucgccuacuccgucuucaacaucggccuccucuggguccccuacaucaaggagcaguuccuccucaaguaccccaacggcgucaaccccgucaacuccaacgacgucuucuucucccuccacgccgucguccucacccucaucaucaucguccagugcugccucuacgagcgcggcggccagcgcgucuccuggcccgccaucggcuuccucguccucgccuggcucuucgccuucgucaccaugaucgucgccgccgucggcgucaccaccuggcuccaguuccucuucugcuucuccuacaucaagcucgccgucacccucgucaaguacuucccccaggccuacaugaacuucuacuacaaguccaccgagggcugguccaucggcaacguccuccucgacuucaccggcggcuccuucucccuccuccagauguuccuccaguccuacaacaacgaccaguggacccucaucuucggcgaccccaccaaguucggccucggcgucuucuccaucgucuucgacgucgucuucuucauccagcacuucugccucuaccgcaagcgccccggccuccaggccgcccgcaccggcuccggcucccgccuccgccaggacugggcccccucccuccagcccaaggcccucccccagaccaccuccgucuccgccuccucccucaagggcuga

SEQ ID NO: 41880 - RNA, 1308 nt, Artificial Sequence
  derived and/or modified sequence opt2 from CTPS1__Homo_sapiens__NP_001288166
augcccuucaucgaggccuuccgccaguuccaguucaaggucaagcgcgagaacuucugcaacauccacgucucccucgucccccagcccuccuccaccggcgagcagaagaccaagcccacccagaacuccguccgcgagcuccgcggccucggccucucccccgaccucgucgucugccgcugcuccaacccccucgacaccuccgucaaggagaagaucuccauguucugccacgucgagcccgagcaggucaucugcguccacgacgucuccuccaucuaccgcgucccccuccuccucgaggagcagggcgucgucgacuacuuccuccgccgccucgaccuccccaucgagcgccagccccgcaagaugcucaugaaguggaaggagauggccgaccgcuacgaccgccuccucgagaccugcuccaucgcccucgucggcaaguacaccaaguucuccgacuccuacgccuccgucaucaaggcccucgagcacuccgcccucgccaucaaccacaagcucgagaucaaguacaucgacuccgccgaccucgagcccaucaccucccaggaggagcccguccgcuaccacgaggccuggcagaagcucugcuccgcccacggcguccucguccccggcggcuucggcguccgcggcaccgagggcaagauccaggccaucgccugggcccgcaaccagaagaagcccuuccucggcgucugccucggcaugcagcucgccgucgucgaguucucccgcaacguccucggcuggcaggacgccaacuccaccgaguucgaccccaccaccucccaccccgucgucgucgacaugcccgagcacaaccccggccagaugggcggcaccaugcgccucggcaagcgccgcacccucuuccagaccaagaacuccgucaugcgcaagcucuacggcgacgccgacuaccucgaggagcgccaccgccaccgcuucgaggucaaccccgucuggaagaagugccucgaggagcagggccucaaguucgucggccaggacgucgagggcgagcgcauggagaucgucgagcucgaggaccaccccuucuucgucggcguccaguaccaccccgaguuccucucccgccccaucaagcccuccccccccuacuucggccuccuccucgccuccgucggccgccucucccacuaccuccagaagggcugccgccucuccccccgcgacaccuacuccgaccgcuccggcuccuccucccccgacuccgagaucaccgagcucaaguuccccuccaucaaccacgacuga

SEQ ID NO: 41881 - RNA, 3522 nt, Artificial Sequence
  derived and/or modified sequence opt2 from CTR9__Homo_sapiens__NP_055448
augucccgcggcuccaucgagaucccccuccgcgacaccgacgaggucaucgagcucgacuucgaccagcuccccgagggcgacgaggucaucuccauccucaagcaggagcacacccagcuccacaucuggaucgcccucgcccucgaguacuacaagcagggcaagaccgaggaguucgucaagcuccucgaggccgcccgcaucgacggcaaccucgacuaccgcgaccacgagaaggaccagaugaccugccucgacacccucgccgccuacuacguccagcaggcccgcaaggagaagaacaaggacaacaagaaggaccucaucacccaggccacccuccucuacaccauggccgacaagaucaucauguacgaccagaaccaccuccucggccgcgccugcuucugccuccucgagggcgacaagauggaccaggccgacgcccaguuccacuucguccucaaccagucccccaacaacauccccgcccuccucggcaaggccugcaucuccuucaacaagaaggacuaccgcggcgcccucgccuacuacaagaaggcccuccgcaccaaccccggcugccccgccgagguccgccucggcaugggccacugcuucgucaagcucaacaagcucgagaaggcccgccucgccuucucccgcgcccucgagcucaacuccaagugcgucggcgcccucgucggccucgccguccucgagcucaacaacaaggaggccgacuccaucaagaacggcguccagcuccucucccgcgccuacaccaucgaccccuccaaccccaugguccucaaccaccucgccaaccacuucuucuucaagaaggacuacuccaagguccagcaccucgcccuccacgccuuccacaacaccgaggucgaggccaugcaggccgaguccugcuaccagcucgcccgcuccuuccacguccaggaggacuacgaccaggccuuccaguacuacuaccaggccacccaguucgccuccuccuccuucguccuccccuucuucggccucggccagauguacaucuaccgcggcgacaaggagaacgccucccagugcuucgagaagguccucaaggccuaccccaacaacuacgagaccaugaagauccucggcucccucuacgccgccuccgaggaccaggagaagcgcgacaucgccaagggccaccucaagaaggucaccgagcaguaccccgacgacgucgaggccuggaucgagcucgcccagauccucgagcagaccgacauccagggcgcccucuccgccuacggcaccgccacccgcauccuccaggagaagguccaggccgacgucccccccgagauccucaacaacgucggcgcccuccacuuccgccucggcaaccucggcgaggccaagaaguacuuccucgccucccucgaccgcgccaaggccgaggccgagcacgacgagcacuacuacaacgccaucuccgucaccaccuccuacaaccucgcccgccucuacgaggccaugugcgaguuccacgaggccgagaagcucuacaagaacauccuccgcgagcaccccaacuacgucgacugcuaccuccgccucggcgccauggcccgcgacaagggcaacuucuacgaggccuccgacugguucaaggaggcccuccagaucaaccaggaccaccccgacgccuggucccucaucggcaaccuccaccucgccaagcaggaguggggccccggccagaagaaguucgagcgcauccucaagcagcccuccacccaguccgacaccuacuccaugcucgcccucggcaacgucuggcuccagacccuccaccagcccacccgcgaccgcgagaaggagaagcgccaccaggaccgcgcccucgccaucuacaagcagguccuccgcaacgacgccaagaaccucuacgccgccaacggcaucggcgccguccucgcccacaagggcuacuuccgcgaggcccgcgacgucuucgcccagguccgcgaggccaccgccgacaucuccgacgucuggcucaaccucgcccacaucuacgucgagcagaagcaguacaucuccgccguccagauguacgagaacugccuccgcaaguucuacaagcaccagaacaccgaggucguccucuaccucgcccgcgcccucuucaagugcggcaagcuccaggagugcaagcagacccuccucaaggcccgccacgucgcccccuccgacaccguccucauguucaacgucgcccucguccuccagcgccucgccaccuccguccucaaggacgagaaguccaaccucaaggagguccucaacgccgucaaggagcucgagcucgcccaccgcuacuucuccuaccucuccaaggucggcgacaagaugcgcuucgaccucgcccucgccgccaccgaggcccgccagugcuccgaccuccucucccaggcccaguaccacgucgcccgcgcccgcaagcaggacgaggaggagcgcgagcuccgcgccaagcaggagcaggagaaggagcuccuccgccagaagcuccucaaggagcaggaggagaagcgccuccgcgagaaggaggagcagaagaagcuccucgagcagcgcgcccaguacgucgagaagaccaagaacauccucauguucaccggcgagaccgaggccaccaaggagaagaagcgcggcggcggcggcggccgccgcuccaagaagggcggcgaguucgacgaguucgucaacgacgacaccgacgacgaccuccccaucuccaagaagaagaagcgccgcaagggcuccggcuccgagcaggagggcgaggacgaggagggcggcgagcgcaagaagaagaagcgccgccgccaccccaagggcgaggagggcuccgacgacgacgagaccgagaacggccccaagcccaagaagcgccgcccccccaaggccgagaagaagaaggcccccaagcccgagcgccucccccccuccaugaagggcaagaucaaguccaaggccaucaucuccuccuccgacgacuccuccgacgaggacaagcucaagaucgccgacgagggccacccccgcaacuccaacuccaacuccgacuccgacgaggacgagcagcgcaagaagugcgccuccuccgaguccgacuccgacgagaaccagaacaaguccggcuccgaggccggcuccccccgccgcccccgccgccagcgcuccgaccaggacuccgacuccgaccagcccucccgcaagcgccgccccuccggcuccgagcaguccgacaacgaguccguccaguccggccgcucccacuccggcgucuccgagaacgacucccgccccgccucccccuccgccgaguccgaccacgaguccgagcgcggcuccgacaacgagggcuccggccagggcuccggcaacgaguccgagcccgagggcuccaacaacgaggccuccgaccgcggcuccgagcacggcuccgacgacuccgacuga

SEQ ID NO: 41882 - RNA, 792 nt, Artificial Sequence
  derived and/or modified sequence opt2 from CTRB1__Homo_sapiens__NP_001897
auggccucccucuggcuccucuccugcuucucccucgucggcgccgccuucggcugcggcguccccgccauccaccccguccucuccggccucucccgcaucgucaacggcgaggacgccguccccggcuccuggcccuggcaggucucccuccaggacaagaccggcuuccacuucugcggcggcucccucaucuccgaggacugggucgucaccgccgcccacugcggcguccgcaccuccgacgucgucgucgccggcgaguucgaccagggcuccgacgaggagaacauccagguccucaagaucgccaaggucuucaagaaccccaaguucuccauccucaccgucaacaacgacaucacccuccucaagcucgccacccccgcccgcuucucccagaccgucuccgccgucugccuccccuccgccgacgacgacuuccccgccggcacccucugcgccaccaccggcuggggcaagaccaaguacaacgccaacaagacccccgacaagcuccagcaggccgcccucccccuccucuccaacgccgagugcaagaaguccuggggccgccgcaucaccgacgucaugaucugcgccggcgccuccggcgucuccuccugcaugggcgacuccggcggcccccucgucugccagaaggacggcgccuggacccucgucggcaucgucuccuggggcuccgacaccugcuccaccuccucccccggcgucuacgcccgcgucaccaagcucauccccuggguccagaagauccucgccgccaacuga

SEQ ID NO: 41883 - RNA, 792 nt, Artificial Sequence
  derived and/or modified sequence opt2 from CTRB2__Homo_sapiens__NP_001020371
auggccuuccucuggcuccucuccugcugggcccuccucggcaccaccuucggcugcggcguccccgccauccaccccguccucuccggccucucccgcaucgucaacggcgaggacgccguccccggcuccuggcccuggcaggucucccuccaggacaagaccggcuuccacuucugcggcggcucccucaucuccgaggacugggucgucaccgccgcccacugcggcguccgcaccuccgacgucgucgucgccggcgaguucgaccagggcuccgacgaggagaacauccagguccucaagaucgccaaggucuucaagaaccccaaguucuccauccucaccgucaacaacgacaucacccuccucaagcucgccacccccgcccgcuucucccagaccgucuccgccgucugccuccccuccgccgacgacgacuuccccgccggcacccucugcgccaccaccggcuggggcaagaccaaguacaacgccaacaagacccccgacaagcuccagcaggccgcccucccccuccucuccaacgccgagugcaagaaguccuggggccgccgcaucaccgacgucaugaucugcgccggcgccuccggcgucuccuccugcaugggcgacuccggcggcccccucgucugccagaaggacggcgccuggacccucgucggcaucgucuccuggggcucccgcaccugcuccaccaccacccccgccgucuacgcccgcgucgccaagcucauccccuggguccagaagauccucgccgccaacuga

SEQ ID NO: 41884 - RNA, 843 nt, Artificial Sequence
  derived and/or modified sequence opt2 from CTRC__Homo_sapiens__XP_011538852
augcucggcaucaccguccucgccgcccuccucgccugcgccuccuccugcggcguccccuccuucccccccaaccucuccgcccgcgucgucggcggcgaggacgcccgcccccacuccuggcccuggcagaucucccuccaguaccucaagaacgacaccuggcgccacaccugcggcggcacccucaucgccuccaacuucguccucaccgccgcccacugcaucuccaacacccgcaccuaccgcgucgccgucggcaagaacaaccucgaggucgaggacgaggagggcucccucuucgucggcgucgacaccauccacguccacaagcgcuggaacgcccuccuccuccgcaacgacaucgcccucaucaagcucgccgagcacgucgagcucuccgacaccauccaggucgccugccuccccgagaaggacucccuccuccccaaggacuaccccugcuacgucaccggcuggggccgccucuggcgcggccuccgcuggcccaccgagcuccccgucggcgagcgcuuccucggcggcgucuggcaccgccagcucuggcuccccgccggccuccagcacccccaggaggccggcucccuccaccccggcguccgccuccaccgccucgaccagcgcgagaacgccgccgucaucugcugcugggagcgccgccagcgcguccccgccaccgccaucaacuuccuccuccucggcccccccggcucccucaucugcgccgccuccgucgccucccuccucuccggcgccgcccccuuccacaccauggagcccaagcgcgaccccacccagcccgucucccccacccuccacuga

SEQ ID NO: 41885 - RNA, 795 nt, Artificial Sequence
  derived and/or modified sequence opt2 from CTRL__Homo_sapiens__NP_001898
augcuccuccucucccucacccucucccucguccuccucggcuccuccuggggcugcggcauccccgccaucaagcccgcccucuccuucucccagcgcaucgucaacggcgagaacgccguccucggcuccuggcccuggcaggucucccuccaggacuccuccggcuuccacuucugcggcggcucccucaucucccaguccugggucgucaccgccgcccacugcaacgucucccccggccgccacuucgucguccucggcgaguacgaccgcuccuccaacgccgagccccuccagguccucuccgucucccgcgccaucacccaccccuccuggaacuccaccaccaugaacaacgacgucacccuccucaagcucgccucccccgcccaguacaccacccgcaucucccccgucugccucgccuccuccaacgaggcccucaccgagggccucaccugcgucaccaccggcuggggccgccucuccggcgucggcaacgucacccccgcccaccuccagcaggucgcccucccccucgucaccgucaaccagugccgccaguacuggggcuccuccaucaccgacuccaugaucugcgccggcggcgccggcgccuccuccugccagggcgacuccggcggcccccucgucugccagaagggcaacaccuggguccucaucggcaucgucuccuggggcaccaagaacugcaacguccgcgcccccgccgucuacacccgcgucuccaaguucuccaccuggaucaaccaggucaucgccuacaacuga

SEQ ID NO: 41886 - RNA, 1497 nt, Artificial Sequence
  derived and/or modified sequence opt2 from CTSA__Homo_sapiens__NP_000299
augaccuccuccccccgcgccccccccggcgagcagggccgcggcggcgccgagaugauccgcgccgccccccccccccucuuccuccuccuccuccuccuccuccuccucgucuccugggccucccgcggcgaggccgcccccgaccaggacgagauccagcgccuccccggccucgccaagcagcccuccuuccgccaguacuccggcuaccucaagggcuccggcuccaagcaccuccacuacugguucgucgagucccagaaggaccccgagaacucccccgucguccucuggcucaacggcggccccggcugcuccucccucgacggccuccucaccgagcacggccccuuccucguccagcccgacggcgucacccucgaguacaaccccuacuccuggaaccucaucgccaacguccucuaccucgagucccccgccggcgucggcuucuccuacuccgacgacaaguucuacgccaccaacgacaccgaggucgcccaguccaacuucgaggcccuccaggacuucuuccgccucuuccccgaguacaagaacaacaagcucuuccucaccggcgaguccuacgccggcaucuacauccccacccucgccguccucgucaugcaggaccccuccaugaaccuccagggccucgccgucggcaacggccucuccuccuacgagcagaacgacaacucccucgucuacuucgccuacuaccacggccuccucggcaaccgccucugguccucccuccagacccacugcugcucccagaacaagugcaacuucuacgacaacaaggaccucgagugcgucaccaaccuccaggaggucgcccgcaucgucggcaacuccggccucaacaucuacaaccucuacgcccccugcgccggcggcguccccucccacuuccgcuacgagaaggacaccgucgucguccaggaccucggcaacaucuucacccgccucccccucaagcgcauguggcaccaggcccuccuccgcuccggcgacaagguccgcauggacccccccugcaccaacaccaccgccgccuccaccuaccucaacaaccccuacguccgcaaggcccucaacauccccgagcagcucccccagugggacaugugcaacuuccucgucaaccuccaguaccgccgccucuaccgcuccaugaacucccaguaccucaagcuccucuccucccagaaguaccagauccuccucuacaacggcgacgucgacauggccugcaacuucaugggcgacgagugguucgucgacucccucaaccagaagauggagguccagcgccgccccuggcucgucaaguacggcgacuccggcgagcagaucgccggcuucgucaaggaguucucccacaucgccuuccucaccaucaagggcgccggccacaugguccccaccgacaagccccucgccgccuucaccauguucucccgcuuccucaacaagcagcccuacuga

SEQ ID NO: 41887 - RNA, 1020 nt, Artificial Sequence
  derived and/or modified sequence opt2 from CTSB__Homo_sapiens__NP_680093
auguggcagcucugggccucccucugcugccuccucguccucgccaacgcccgcucccgccccuccuuccacccccucuccgacgagcucgucaacuacgucaacaagcgcaacaccaccuggcaggccggccacaacuucuacaacgucgacauguccuaccucaagcgccucugcggcaccuuccucggcggccccaagcccccccagcgcgucauguucaccgaggaccucaagcuccccgccuccuucgacgcccgcgagcaguggccccagugccccaccaucaaggagauccgcgaccagggcuccugcggcuccugcugggccuucggcgccgucgaggccaucuccgaccgcaucugcauccacaccaacgcccacgucuccgucgaggucuccgccgaggaccuccucaccugcugcggcuccaugugcggcgacggcugcaacggcggcuaccccgccgaggccuggaacuucuggacccgcaagggccucgucuccggcggccucuacgagucccacgucggcugccgccccuacuccaucccccccugcgagcaccacgucaacggcucccgcccccccugcaccggcgagggcgacacccccaagugcuccaagaucugcgagcccggcuacucccccaccuacaagcaggacaagcacuacggcuacaacuccuacuccgucuccaacuccgagaaggacaucauggccgagaucuacaagaacggccccgucgagggcgccuucuccgucuacuccgacuuccuccucuacaaguccggcgucuaccagcacgucaccggcgagaugaugggcggccacgccauccgcauccucggcuggggcgucgagaacggcacccccuacuggcucgucgccaacuccuggaacaccgacuggggcgacaacggcuucuucaagauccuccgcggccaggaccacugcggcaucgaguccgaggucgucgccggcaucccccgcaccgaccaguacugggagaagaucuga

SEQ ID NO: 41888 - RNA, 426 nt, Artificial Sequence
  derived and/or modified sequence opt2 from CTSC__Homo_sapiens__NP_001107645
augggcgccggccccucccuccuccucgccgcccuccuccuccuccucuccggcgacggcgccguccgcugcgacacccccgccaacugcaccuaccucgaccuccucggcaccugggucuuccaggucggcuccuccggcucccagcgcgacgucaacugcuccgucaugggcccccaggagaagaaggucgucgucuaccuccagaagcucgacaccgccuacgacgaccucggcaacuccggccacuucaccaucaucuacaaccagggcuucgagaucguccucaacgacuacaagugguucgccuucuucaaggacgucaccgacuucaucucccaccucuucaugcagcucggcaccgucggcaucuacgaccucccccaccuccgcaacaagcucgccaugaaccgccgcuggggcuga

SEQ ID NO: 41889 - RNA, 1239 nt, Artificial Sequence
  derived and/or modified sequence opt2 from CTSD__Homo_sapiens__NP_001900
augcagcccuccucccuccucccccucgcccucugccuccucgccgcccccgccuccgcccucguccgcaucccccuccacaaguucaccuccauccgccgcaccauguccgaggucggcggcuccgucgaggaccucaucgccaagggccccgucuccaaguacucccaggccguccccgccgucaccgagggccccauccccgagguccucaagaacuacauggacgcccaguacuacggcgagaucggcaucggcacccccccccagugcuucaccgucgucuucgacaccggcuccuccaaccucuggguccccuccauccacugcaagcuccucgacaucgccugcuggauccaccacaaguacaacuccgacaaguccuccaccuacgucaagaacggcaccuccuucgacauccacuacggcuccggcucccucuccggcuaccucucccaggacaccgucuccguccccugccaguccgccuccuccgccuccgcccucggcggcgucaaggucgagcgccaggucuucggcgaggccaccaagcagcccggcaucaccuucaucgccgccaaguucgacggcauccucggcauggccuacccccgcaucuccgucaacaacguccuccccgucuucgacaaccucaugcagcagaagcucgucgaccagaacaucuucuccuucuaccucucccgcgaccccgacgcccagcccggcggcgagcucaugcucggcggcaccgacuccaaguacuacaagggcucccucuccuaccucaacgucacccgcaaggccuacuggcagguccaccucgaccaggucgaggucgccuccggccucacccucugcaaggagggcugcgaggccaucgucgacaccggcaccucccucauggucggccccgucgacgagguccgcgagcuccagaaggccaucggcgccgucccccucauccagggcgaguacaugauccccugcgagaaggucuccacccuccccgccaucacccucaagcucggcggcaagggcuacaagcucucccccgaggacuacacccucaaggucucccaggccggcaagacccucugccucuccggcuucaugggcauggacauccccccccccuccggcccccucuggauccucggcgacgucuucaucggccgcuacuacaccgucuucgaccgcgacaacaaccgcgucggcuucgccgaggccgcccgccucuga

SEQ ID NO: 41890 - RNA, 1191 nt, Artificial Sequence
  derived and/or modified sequence opt2 from CTSE__Homo_sapiens__NP_001901
augaagacccuccuccuccuccuccucguccuccucgagcucggcgaggcccagggcucccuccaccgcgucccccuccgccgccaccccucccucaagaagaagcuccgcgcccgcucccagcucuccgaguucuggaagucccacaaccucgacaugauccaguucaccgaguccugcuccauggaccaguccgccaaggagccccucaucaacuaccucgacauggaguacuucggcaccaucuccaucggcucccccccccagaacuucaccgucaucuucgacaccggcuccuccaaccucuggguccccuccgucuacugcaccucccccgccugcaagacccacucccgcuuccagcccucccaguccuccaccuacucccagcccggccaguccuucuccauccaguacggcaccggcucccucuccggcaucaucggcgccgaccaggucuccgucgagggccucaccgucgucggccagcaguucggcgaguccgucaccgagcccggccagaccuucgucgacgccgaguucgacggcauccucggccucggcuaccccucccucgccgucggcggcgucacccccgucuucgacaacaugauggcccagaaccucgucgaccuccccauguucuccgucuacauguccuccaaccccgagggcggcgccggcuccgagcucaucuucggcggcuacgaccacucccacuucuccggcucccucaacuggguccccgucaccaagcaggccuacuggcagaucgcccucgacaacauccaggucggcggcaccgucauguucugcuccgagggcugccaggccaucgucgacaccggcaccucccucaucaccggccccuccgacaagaucaagcagcuccagaacgccaucggcgccgcccccgucgacggcgaguacgccgucgagugcgccaaccucaacgucaugcccgacgucaccuucaccaucaacggcguccccuacacccucucccccaccgccuacacccuccucgacuucgucgacggcaugcaguucugcuccuccggcuuccagggccucgacauccacccccccgccggcccccucuggauccucggcgacgucuucauccgccaguucuacuccgucuucgaccgcggcaacaaccgcgucggccucgcccccgccguccccuga

SEQ ID NO: 41891 - RNA, 1455 nt, Artificial Sequence
  derived and/or modified sequence opt2 from CTSF__Homo_sapiens__NP_003784
auggcccccuggcuccagcuccucucccuccucggccuccuccccggcgccgucgccgcccccgcccagccccgcgccgccuccuuccaggccuggggcccccccucccccgagcuccucgcccccacccgcuucgcccucgagauguucaaccgcggccgcgccgccggcacccgcgccguccucggccucguccgcggccgcguccgccgcgccggccagggcucccucuacucccucgaggccacccucgaggagccccccugcaacgaccccauggucugccgccuccccgucuccaagaagacccuccucugcuccuuccagguccucgacgagcucggccgccacguccuccuccgcaaggacugcggccccgucgacaccaagguccccggcgccggcgagcccaaguccgccuucacccagggcuccgccaugaucuccucccucucccagaaccaccccgacaaccgcaacgagaccuucuccuccgucaucucccuccucaacgaggacccccucucccaggaccuccccgucaagauggccuccaucuucaagaacuucgucaucaccuacaaccgcaccuacgaguccaaggaggaggcccgcuggcgccucuccgucuucgucaacaacaugguccgcgcccagaagauccaggcccucgaccgcggcaccgcccaguacggcgucaccaaguucuccgaccucaccgaggaggaguuccgcaccaucuaccucaacacccuccuccgcaaggagcccggcaacaagaugaagcaggccaaguccgucggcgaccucgccccccccgagugggacuggcgcuccaagggcgccgucaccaaggucaaggaccagggcaugugcggcuccugcugggccuucuccgucaccggcaacgucgagggccagugguuccucaaccagggcacccuccucucccucuccgagcaggagcuccucgacugcgacaagauggacaaggccugcaugggcggccuccccuccaacgccuacuccgccaucaagaaccucggcggccucgagaccgaggacgacuacuccuaccagggccacaugcaguccugcaacuucuccgccgagaaggccaaggucuacaucaacgacuccgucgagcucucccagaacgagcagaagcucgccgccuggcucgccaagcgcggccccaucuccgucgccaucaacgccuucggcaugcaguucuaccgccacggcaucucccgcccccuccgcccccucugcucccccuggcucaucgaccacgccguccuccucgucggcuacggcaaccgcuccgacguccccuucugggccaucaagaacuccuggggcaccgacuggggcgagaagggcuacuacuaccuccaccgcggcuccggcgccugcggcgucaacaccauggccuccuccgccgucgucgacuga

SEQ ID NO: 41892 - RNA, 768 nt, Artificial Sequence
  derived and/or modified sequence opt2 from CTSG__Homo_sapiens__NP_001902
augcagccccuccuccuccuccucgccuuccuccuccccaccggcgccgaggccggcgagaucaucggcggccgcgagucccgcccccacucccgccccuacauggccuaccuccagauccagucccccgccggccagucccgcugcggcggcuuccucguccgcgaggacuucguccucaccgccgcccacugcuggggcuccaacaucaacgucacccucggcgcccacaacauccagcgccgcgagaacacccagcagcacaucaccgcccgccgcgccauccgccacccccaguacaaccagcgcaccauccagaacgacaucaugcuccuccagcucucccgccgcguccgccgcaaccgcaacgucaaccccgucgcccucccccgcgcccaggagggccuccgccccggcacccucugcaccgucgccggcuggggccgcgucuccaugcgccgcggcaccgacacccuccgcgagguccagcuccgcguccagcgcgaccgccagugccuccgcaucuucggcuccuacgacccccgccgccagaucugcgucggcgaccgccgcgagcgcaaggccgccuucaagggcgacuccggcggcccccuccucugcaacaacgucgcccacggcaucgucuccuacggcaaguccuccggcgucccccccgaggucuucacccgcgucuccuccuuccuccccuggauccgcaccaccaugcgcuccuucaagcuccucgaccagauggagaccccccucuga

SEQ ID NO: 41893 - RNA, 1008 nt, Artificial Sequence
  derived and/or modified sequence opt2 from CTSH__Homo_sapiens__NP_004381
augugggccacccucccccuccucugcgccggcgccuggcuccucggcguccccgucugcggcgccgccgagcucugcgucaacucccucgagaaguuccacuucaaguccuggauguccaagcaccgcaagaccuacuccaccgaggaguaccaccaccgccuccagaccuucgccuccaacuggcgcaagaucaacgcccacaacaacggcaaccacaccuucaagauggcccucaaccaguucuccgacauguccuucgccgagaucaagcacaaguaccucugguccgagccccagaacugcuccgccaccaaguccaacuaccuccgcggcaccggccccuacccccccuccgucgacuggcgcaagaagggcaacuucgucucccccgucaagaaccagggcgccugcggcuccugcuggaccuucuccaccaccggcgcccucgaguccgccaucgccaucgccaccggcaagaugcucucccucgccgagcagcagcucgucgacugcgcccaggacuucaacaaccacggcugccagggcggccuccccucccaggccuucgaguacauccucuacaacaagggcaucaugggcgaggacaccuaccccuaccagggcaaggacggcuacugcaaguuccagcccggcaaggccaucggcuucgucaaggacgucgccaacaucaccaucuacgacgaggaggccauggucgaggccgucgcccucuacaaccccgucuccuucgccuucgaggucacccaggacuucaugauguaccgcaccggcaucuacuccuccaccuccugccacaagacccccgacaaggucaaccacgccguccucgccgucggcuacggcgagaagaacggcauccccuacuggaucgucaagaacuccuggggcccccaguggggcaugaacggcuacuuccucaucgagcgcggcaagaacaugugcggccucgccgccugcgccuccuaccccaucccccucgucuga

SEQ ID NO: 41894 - RNA, 1002 nt, Artificial Sequence
  derived and/or modified sequence opt2 from CTSL__Homo_sapiens__XP_005251773
augaaccccacccucauccucgccgccuucugccucggcaucgccuccgccacccucaccuucgaccacucccucgaggcccaguggaccaaguggaaggccaugcacaaccgccucuacggcaugaacgaggagggcuggcgccgcgccgucugggagaagaacaugaagaugaucgagcuccacaaccaggaguaccgcgagggcaagcacuccuucaccauggccaugaacgccuucggcgacaugaccuccgaggaguuccgccaggucaugaacggcuuccagaaccgcaagccccgcaagggcaaggucuuccaggagccccucuucuacgaggccccccgcuccgucgacuggcgcgagaagggcuacgucacccccgucaagaaccagggccagugcggcuccugcugggccuucuccgccaccggcgcccucgagggccagauguuccgcaagaccggccgccucaucucccucuccgagcagaaccucgucgacugcuccggcccccagggcaacgagggcugcaacggcggccucauggacuacgccuuccaguacguccaggacaacggcggccucgacuccgaggaguccuaccccuacgaggccaccgaggaguccugcaaguacaaccccaaguacuccgucgccaacgacaccggcuucgucgacauccccaagcaggagaaggcccucaugaaggccgucgccaccgucggccccaucuccgucgccaucgacgccggccacgaguccuuccucuucuacaaggagggcaucuacuucgagcccgacugcuccuccgaggacauggaccacggcguccucgucgucggcuacggcuucgaguccaccgaguccgacaacaacaaguacuggcucgucaagaacuccuggggcgaggaguggggcaugggcggcuacgucaagauggccaaggaccgccgcaaccacugcggcaucgccuccgccgccuccuaccccaccgucuga

SEQ ID NO: 41895 - RNA, 966 nt, Artificial Sequence
  derived and/or modified sequence opt2 from CTSO__Homo_sapiens__NP_001325
auggacguccgcgcccuccccuggcuccccuggcuccucuggcuccucugccgcggcggcggcgacgccgacucccgcgcccccuucacccccaccuggccccgcucccgcgagcgcgaggccgccgccuuccgcgagucccucaaccgccaccgcuaccucaacucccucuuccccuccgagaacuccaccgccuucuacggcaucaaccaguucuccuaccucuuccccgaggaguucaaggccaucuaccuccgcuccaagcccuccaaguucccccgcuacuccgccgagguccacauguccauccccaacgucucccucccccuccgcuucgacuggcgcgacaagcaggucgucacccagguccgcaaccagcagaugugcggcggcugcugggccuucuccgucgucggcgccgucgaguccgccuacgccaucaagggcaagccccucgaggaccucuccguccagcaggucaucgacugcuccuacaacaacuacggcugcaacggcggcuccacccucaacgcccucaacuggcucaacaagaugcaggucaagcucgucaaggacuccgaguaccccuucaaggcccagaacggccucugccacuacuucuccggcucccacuccggcuucuccaucaagggcuacuccgccuacgacuucuccgaccaggaggacgagauggccaaggcccuccucaccuucggcccccucgucgucaucgucgacgccgucuccuggcaggacuaccucggcggcaucauccagcaccacugcuccuccggcgaggccaaccacgccguccucaucaccggcuucgacaagaccggcuccacccccuacuggaucguccgcaacuccuggggcuccuccuggggcgucgacggcuacgcccacgucaagaugggcuccaacgucugcggcaucgccgacuccgucuccuccaucuucgucuga

SEQ ID NO: 41896 - RNA, 1005 nt, Artificial Sequence
  derived and/or modified sequence opt2 from CTSV__Homo_sapiens__NP_001188504
augaaccucucccucguccucgccgccuucugccucggcaucgccuccgccguccccaaguucgaccagaaccucgacaccaagugguaccaguggaaggccacccaccgccgccucuacggcgccaacgaggagggcuggcgccgcgccgucugggagaagaacaugaagaugaucgagcuccacaacggcgaguacucccagggcaagcacggcuucaccauggccaugaacgccuucggcgacaugaccaacgaggaguuccgccagaugaugggcugcuuccgcaaccagaaguuccgcaagggcaaggucuuccgcgagccccucuuccucgaccuccccaaguccgucgacuggcgcaagaagggcuacgucacccccgucaagaaccagaagcagugcggcuccugcugggccuucuccgccaccggcgcccucgagggccagauguuccgcaagaccggcaagcucgucucccucuccgagcagaaccucgucgacugcucccgcccccagggcaaccagggcugcaacggcggcuucauggcccgcgccuuccaguacgucaaggagaacggcggccucgacuccgaggaguccuaccccuacgucgccgucgacgagaucugcaaguaccgccccgagaacuccgucgccaacgacaccggcuucaccgucgucgcccccggcaaggagaaggcccucaugaaggccgucgccaccgucggccccaucuccgucgccauggacgccggccacuccuccuuccaguucuacaaguccggcaucuacuucgagcccgacugcuccuccaagaaccucgaccacggcguccucgucgucggcuacggcuucgagggcgccaacuccaacaacuccaaguacuggcucgucaagaacuccuggggccccgaguggggcuccaacggcuacgucaagaucgccaaggacaagaacaaccacugcggcaucgccaccgccgccuccuaccccaacgucuga

SEQ ID NO: 41897 - RNA, 1131 nt, Artificial Sequence
  derived and/or modified sequence opt2 from CTSW__Homo_sapiens__NP_001326
auggcccucaccgcccaccccuccugccuccucgcccuccucgucgccggccucgcccagggcauccgcggcccccuccgcgcccaggaccucggcccccagccccucgagcucaaggaggccuucaagcucuuccagauccaguucaaccgcuccuaccucucccccgaggagcacgcccaccgccucgacaucuucgcccacaaccucgcccaggcccagcgccuccaggaggaggaccucggcaccgccgaguucggcgucacccccuucuccgaccucaccgaggaggaguucggccagcucuacggcuaccgccgcgccgccggcggcguccccuccaugggccgcgagauccgcuccgaggagcccgaggaguccguccccuucuccugcgacuggcgcaaggucgccggcgccaucucccccaucaaggaccagaagaacugcaacugcugcugggccauggccgccgccggcaacaucgagacccucuggcgcaucuccuucugggacuucgucgacgucuccguccaggagcuccucgacugcggccgcugcggcgacggcugccacggcggcuucgucugggacgccuucaucaccguccucaacaacuccggccucgccuccgagaaggacuaccccuuccagggcaagguccgcgcccaccgcugccaccccaagaaguaccagaaggucgccuggauccaggacuucaucaugcuccagaacaacgagcaccgcaucgcccaguaccucgccaccuacggccccaucaccgucaccaucaacaugaagccccuccagcucuaccgcaagggcgucaucaaggccacccccaccaccugcgacccccagcucgucgaccacuccguccuccucgucggcuucggcuccgucaaguccgaggagggcaucugggccgagaccgucuccucccagucccagccccagcccccccaccccacccccuacuggauccucaagaacuccuggggcgcccaguggggcgagaagggcuacuuccgccuccaccgcggcuccaacaccugcggcaucaccaaguucccccucaccgcccgcguccagaagcccgacaugaagccccgcgucuccugcccccccuga

SEQ ID NO: 41898 - RNA, 912 nt, Artificial Sequence
  derived and/or modified sequence opt2 from CTSZ__Homo_sapiens__NP_001327
auggcccgccgcggccccggcuggcgcccccuccuccuccucguccuccucgccggcgccgcccagggcggccucuacuuccgccgcggccagaccugcuaccgcccccuccgcggcgacggccucgccccccucggccgcuccaccuacccccgcccccacgaguaccucucccccgccgaccuccccaaguccugggacuggcgcaacgucgacggcgucaacuacgccuccaucacccgcaaccagcacaucccccaguacugcggcuccugcugggcccacgccuccaccuccgccauggccgaccgcaucaacaucaagcgcaagggcgccuggcccuccacccuccucuccguccagaacgucaucgacugcggcaacgccggcuccugcgagggcggcaacgaccucuccgucugggacuacgcccaccagcacggcauccccgacgagaccugcaacaacuaccaggccaaggaccaggagugcgacaaguucaaccagugcggcaccugcaacgaguucaaggagugccacgccauccgcaacuacacccucuggcgcgucggcgacuacggcucccucuccggccgcgagaagaugauggccgagaucuacgccaacggccccaucuccugcggcaucauggccaccgagcgccucgccaacuacaccggcggcaucuacgccgaguaccaggacaccaccuacaucaaccacgucgucuccgucgccggcuggggcaucuccgacggcaccgaguacuggaucguccgcaacuccuggggcgagcccuggggcgagcgcggcuggcuccgcaucgucaccuccaccuacaaggacggcaagggcgcccgcuacaaccucgccaucgaggagcacugcaccuucggcgaccccaucgucuga

SEQ ID NO: 41899 - RNA, 4992 nt, Artificial Sequence
  derived and/or modified sequence opt2 from CTTNBP2__Homo_sapiens__NP_219499
auggccaccgacggcgccuccugcgagcccgaccucucccgcgcccccgaggacgccgccggcgccgccgccgaggccgccaagaaggaguucgacgucgacacccucuccaaguccgagcuccgcaugcuccucuccgucauggagggcgagcucgaggcccgcgaccucgucaucgaggcccuccgcgcccgccgcaaggaggucuucauccaggagcgcuacggccgcuucaaccucaacgaccccuuccucgcccuccagcgcgacuacgaggccggcgccggcgacaaggagaagaagcccgucugcaccaacccccucuccauccucgaggccgucauggcccacugcaagaagaugcaggagcgcauguccgcccagcucgccgccgccgagucccgccagaagaagcucgagauggagaagcuccagcuccaggcccucgagcaggagcacaagaagcucgccgcccgccucgaggaggagcgcggcaagaacaagcaggucguccucaugcucgucaaggagugcaagcagcucuccggcaaggucaucgaggaggcccagaagcucgaggacgucauggccaagcucgaggaggagaagaagaagaccaacgagcucgaggaggagcucuccgccgagaagcgccgcuccaccgagauggaggcccagauggagaagcagcucuccgaguucgacaccgagcgcgagcagcuccgcgccaagcucaaccgcgaggaggcccacaccaccgaccucaaggaggagaucgacaagaugcgcaagaugaucgagcagcucaagcgcggcuccgacuccaagcccucccucucccucccccgcaagaccaaggaccgccgccucgucuccaucuccgucggcaccgagggcaccgucacccgcuccgucgccugccagaccgaccucgucaccgagaacgccgaccacaugaagaagcucccccucaccaugcccgucaagcccuccaccggcuccccccucgucuccgccaacgccaagggcuccgucugcaccuccgccaccauggcccgccccggcaucgaccgccaggccuccuacggcgaccucaucggcgccuccguccccgccuuccccccccccuccgccaacaagaucgaggagaacggccccuccaccggcuccacccccgaccccaccuccuccacccccccccuccccuccaacgccgccccccccaccgcccagacccccggcaucgccccccagaacucccaggccccccccaugcacucccuccacucccccugcgccaacaccucccuccaccccggccucaacccccgcauccaggccgcccgcuuccgcuuccagggcaacgccaacgaccccgaccagaacggcaacaccacccaguccccccccucccgcgacgucucccccaccucccgcgacaaccucgucgccaagcagcucgcccgcaacaccgucacccaggcccucucccgcuucaccuccccccaggccggcgcccccucccgccccggcgucccccccaccggcgacgucggcacccacccccccgucggccgcaccucccucaagacccacggcgucgcccgcgucgaccgcggcaaccccccccccaucccccccaagaagcccggccucucccagacccccucccccccccacccccagcucaaggucaucaucgacuccucccgcgccuccaacaccggcgccaaggucgacaacaagaccgucgccuccacccccuccucccucccccagggcaaccgcgucaucaacgaggagaaccuccccaaguccuccuccccccagcucccccccaagcccuccaucgaccucaccgucgcccccgccggcugcgccgucuccgcccucgccaccucccaggucggcgccuggcccgccgccacccccggccucaaccagcccgccugcuccgacuccucccucgucauccccaccaccaucgccuucugcuccuccaucaaccccgucuccgccuccuccugccgccccggcgccuccgacucccuccucgucaccgccuccggcuggucccccucccucaccccccuccucauguccggcggccccgccccccucgccggccgccccacccuccuccagcaggccgccgcccagggcaacgucacccuccucuccaugcuccucaacgaggagggccucgacaucaacuacuccugcgaggacggccacuccgcccucuacuccgccgccaagaacggccacaccgacugcguccgccuccuccucuccgccgaggcccaggucaacgccgccgacaagaacggcuucaccccccucugcgccgccgccgcccagggccacuucgagugcgucgagcuccucaucuccuacgacgccaacaucaaccacgccgccgacggcggccagaccccccucuaccucgccugcaagaacggcaacaaggagugcaucaagcuccuccucgaggccggcaccaaccgcuccgucaagaccaccgacggcuggacccccguccacgccgccgucgacaccggcaacgucgacucccucaagcuccucauguaccaccgcauccccgcccacggcaacuccuucaacgaggaggaguccgaguccuccgucuucgaccucgacggcggcgaggagucccccgagggcaucuccaagcccgucguccccgccgaccucaucaaccacgccaaccgcgagggcuggaccgccgcccacaucgccgccuccaagggcuucaagaacugccucgagauccucugccgccacggcggccucgagcccgagcgccgcgacaagugcaaccgcaccguccacgacgucgccaccgacgacugcaagcaccuccucgagaaccucaacgcccucaagaucccccuccgcaucuccgucggcgagaucgagcccuccaacuacggcuccgacgaccucgagugcgagaacaccaucugcgcccucaacauccgcaagcagaccuccugggacgacuucuccaaggccgucucccaggcccucaccaaccacuuccaggccaucuccuccgacggcugguggucccucgaggacgucaccugcaacaacaccaccgacuccaacaucggccucuccgcccgcuccauccgcuccaucacccucggcaacguccccugguccgucggccaguccuucgcccagucccccugggacuucaugcgcaagaacaaggccgagcacaucaccguccuccucuccggcccccaggagggcugccucuccuccgucaccuacgccuccaugaucccccuccagaugaugcagaacuaccuccgccucgucgagcaguaccacaacgucaucuuccacggccccgagggcucccuccaggacuacaucguccaccagcucgcccucugccucaagcaccgccagauggccgccggcuucuccugcgagaucguccgcgccgaggucgacgccggcuucuccaaggagcagcuccucgaccucuucaucuccuccgccugccucauccccgucaagcagucccccuccaagaagaagaucaucaucauccucgagaaccucgagaaguccucccucuccgagcuccuccgcgacuuccucgccccccucgagaaccgcuccaccgagucccccugcaccuuccagaagggcaacggccucuccgagugcuacuacuuccacgagaacugcuuccucaugggcaccaucgccaaggccugccuccagggcuccgaccuccucguccagcagcacuuccgcuggguccagcuccgcugggacggcgagcccaugcagggccuccuccagcgcuuccuccgccgcaaggucgucaacaaguucaagggccaggcccccucccccugcgaccccgucugcaagaucgucgacugggcccucuccgucuggcgccagcucaacuccugccucgcccgccucggcacccccgaggcccuccucggccccaaguacuuccucuccugccccgucguccccggccacgcccaggucaccgucaaguggauguccaagcucuggaacggcgucaucgccccccgcguccaggaggccauccucucccgcgccuccgucaagcgccagcccggcuucggccagaccaccgccaagcgccaccccucccagggccagcaggccgucgucaaggccgcccucuccauccuccucaacaaggccguccuccacggcugcccccucccccgcgccgagcucgaccagcacaccgccgacuucaagggcggcuccuucccccucuccaucgucuccuccuacaacaccugcaacaagaagaagggcgaguccggcgccuggcgcaaggucaacaccuccccccgccgcaaguccggccgcuucucccuccccaccuggaacaagcccgaccucuccaccgagggcaugaagaacaagaccaucucccagcucaacugcaaccgcaacgccucccucuccaagcagaagucccucgagaacgaccucucccucacccucaaccucgaccagcgccucucccucggcuccgacgacgaggccgaccucgucaaggagcuccaguccaugugcuccuccaaguccgaguccgacaucuccaagaucgccgacucccgcgacgaccuccgcauguucgacuccuccggcaacaaccccguccucuccgccaccaucaacaaccuccgcaugcccgucucccagaaggaggucuccccccucuccucccaccagaccaccgagugcuccaacuccaaguccaagaccgagcucggcgucucccgcgucaaguccuuccuccccgucccccgcuccaaggucacccagugcucccagaacaccaagcgcuccuccuccuccuccaacacccgccagaucgagaucaacaacaacuccaaggaggucaacuggaaccuccacaagaacgagcaccucgagaagcccaacaaguga

SEQ ID NO: 41900 - RNA, 1905 nt, Artificial Sequence
  derived and/or modified sequence opt2 from CTTN__Homo_sapiens__NP_001171669
auguggaaggccuccgccggccacgccgucuccaucgcccaggacgacgccggcgccgacgacugggagaccgaccccgacuucgucaacgacgucuccgagaaggagcagcgcuggggcgccaagaccguccagggcuccggccaccaggagcacaucaacauccacaagcuccgcgagaacgucuuccaggagcaccagacccucaaggagaaggagcucgagaccggccccaaggccucccacggcuacggcggcaaguucggcgucgagcaggaccgcauggacaaguccgccgucggccacgaguaccaguccaagcucuccaagcacugcucccaggucgacuccguccgcggcuucggcggcaaguucggcguccagauggaccgcgucgaccaguccgccgucggcuucgaguaccagggcaagaccgagaagcacgccucccagaaggacuacuccuccggcuucggcggcaaguacggcguccaggccgaccgcgucgacaaguccgccgucggcuucgacuaccagggcaagaccgagaagcacgagucccagcgcgacuacuccaagggcuucggcggcaaguacggcaucgacaaggacaaggucgacaaguccgccgucggcuucgaguaccagggcaagaccgagaagcacgagucccagaaggacuacgucaagggcuucggcggcaaguucggcguccagaccgaccgccaggacaagugcgcccucggcugggaccaccaggagaagcuccagcuccacgagucccagaaggacuacuccaagggcuucggcggcaaguacggcguccagaaggaccgcauggacaagaacgccuccaccuucgaggacgucacccaggucuccuccgccuaccagaagaccguccccgucgaggccgucaccuccaagaccuccaacauccgcgccaacuucgagaaccucgccaaggagaaggagcaggaggaccgccgcaaggccgaggccgagcgcgcccagcgcauggccaaggagcgccaggagcaggaggaggcccgccgcaagcucgaggagcaggcccgcgccaagacccagaccccccccgucucccccgccccccagcccaccgaggagcgccuccccuccucccccgucuacgaggacgccgccuccuucaaggccgagcucuccuaccgcggccccgucuccggcaccgagcccgagcccgucuacuccauggaggccgccgacuaccgcgaggccuccucccagcagggccucgccuacgccaccgaggccgucuacgaguccgccgaggcccccggccacuaccccgccgaggacuccaccuacgacgaguacgagaacgaccucggcaucaccgccgucgcccucuacgacuaccaggccgccggcgacgacgagaucuccuucgaccccgacgacaucaucaccaacaucgagaugaucgacgacggcugguggcgcggcgucugcaagggccgcuuccgcgagcucgccuucuccugcguccgcgucgcccucguccccaucaagugcucccgcgaccuccccggccaggcccgcggccuccgcuccgcccucuggcgcgucggccgcaaggacugcccccgccgcggcgccuccucccgcgucucccuccucggccgccgcggccucggccucauggaggucaaccccgagcucucccaccccgagcaccgcuccugccacguccgcugggagaucugccucugccacaccgucaccgcccgccgcauccgcaagcucaucuccuuccuccgcucccgcgaggccggccccguccccuccugcucccaggucggcggcgucuccuuccagaaggucaccuggaagugccucggcaccuggguccccgagugccccuga

SEQ ID NO: 41901 - RNA, 1047 nt, Artificial Sequence
  derived and/or modified sequence opt2 from CTU1__Homo_sapiens__NP_660275
augcccgccccccccugcgccuccugccacgccgcccgcgccgcccuccgccgcccccucuccggccaggcccucugcggcgccugcuucugcgccgccuucgaggccgagguccuccacaccguccucgccggccgccuccucccccccggcgccgucgucgccgucggcgccuccggcggcaaggacuccaccguccucgcccacguccuccgcgcccucgccccccgccucggcaucucccuccagcucgucgccgucgacgagggcaucggcggcuaccgcgacgccgcccucgccgccguccgccgccaggccgcccgcugggagcucccccucaccgucgucgccuacgaggaccucuucggcggcuggaccauggacgccgucgcccgcuccaccgccggcuccggccgcucccgcuccugcugcaccuucugcggcguccuccgccgccgcgcccucgaggagggcgcccgccgcgucggcgccacccacaucgucaccggccacaacgccgacgacauggccgagaccguccucaugaacuuccuccgcggcgacgccggccgccucgcccgcggcggcggccucggcucccccggcgagggcggcgcccucccccgcugccgcccccuccaguucgccucccagaaggaggucguccucuacgcccacuuccgccgccucgacuacuucuccgaggagugcgucuacgcccccgaggccuuccgcggccacgcccgcgaccuccucaagcgccucgaggccgcccgccccuccgccguccucgaccucguccacuccgccgagcgccucgcccucgcccccgccgcccgccccccccgccccggcgccugcucccgcugcggcgcccucgccucccgcgcccucugccaggccugcgcccuccucgacggccucaaccgcggccgcccccgccucgccaucggcaagggccgccgcggccucgacgaggaggccacccccggcacccccggcgaccccgcccgcccccccgccuccaaggccguccccaccuucuga

SEQ ID NO: 41902 - RNA, 246 nt, Artificial Sequence
  derived and/or modified sequence opt2 from CTXN3__Homo_sapiens__NP_001041717
auggacggcggccagcccauccccuccucccucgucccccucggcaacgaguccgccgacuccuccaugucccucgagcagaagaugaccuucgucuucgucauccuccucuucaucuuccucggcauccucaucguccgcugcuuccgcauccuccucgaccccuaccgcuccaugcccaccuccaccugggccgacggccucgagggccucgagaagggccaguucgaccacgcccucgccuga

SEQ ID NO: 41903 - RNA, 10872 nt, Artificial Sequence
  derived and/or modified sequence opt2 from CUBN__Homo_sapiens__NP_001072
augaugaacaugucccuccccuuccucuggucccuccucacccuccucaucuucgccgaggucaacggcgaggccggcgagcucgagcuccagcgccagaagcgcuccaucaaccuccagcagccccgcauggccaccgagcgcggcaaccucgucuuccucaccggcuccgcccagaacaucgaguuccgcaccggcucccucggcaagaucaagcucaacgacgaggaccucuccgagugccuccaccagauccagaagaacaaggaggacaucaucgagcucaagggcuccgccaucggccucccccagaacaucuccucccagaucuaccagcucaacuccaagcucgucgaccucgagcgcaaguuccagggccuccagcagaccgucgacaagaaggucugcuccuccaaccccugccagaacggcggcaccugccucaaccuccacgacuccuucuucugcaucugccccccccaguggaagggcccccucugcuccgccgacgucaacgagugcgagaucuacuccggcaccccccucuccugccagaacggcggcaccugcgucaacaccaugggcuccuacuccugccacugcccccccgagaccuacggcccccagugcgccuccaaguacgacgacugcgagggcggcuccgucgcccgcugcguccacggcaucugcgaggaccucaugcgcgagcaggccggcgagcccaaguacuccugcgucugcgacgccggcuggauguucucccccaacucccccgccugcacccucgaccgcgacgagugcuccuuccagcccggccccugcuccacccucguccagugcuucaacacccagggcuccuucuacugcggcgccugccccaccggcuggcagggcaacggcuacaucugcgaggacaucaacgagugcgagaucaacaacggcggcugcuccgucgccccccccgucgagugcgucaacacccccggcuccucccacugccaggccugcccccccggcuaccagggcgacggccgcgucugcacccucaccgacaucugcuccgucuccaacggcggcugccaccccgacgccuccugcuccuccacccucggcucccucccccucugcaccugccuccccggcuacaccggcaacggcuacggccccaacggcugcguccagcucuccaacaucugccucucccaccccugccucaacggccagugcaucgacaccgucuccggcuacuucugcaagugcgacuccggcuggaccggcgucaacugcaccgagaacaucaacgagugccucuccaaccccugccucaacggcggcaccugcgucgacggcgucgacuccuucuccugcgagugcacccgccucuggaccggcgcccucugccaggucccccagcaggucugcggcgagucccucuccggcaucaacggcuccuucuccuaccgcucccccgacgucggcuacguccacgacgucaacugcuucugggucaucaagaccgagaugggcaagguccuccgcaucaccuucaccuucuuccgccucgaguccauggacaacugcccccacgaguuccuccaggucuacgacggcgacuccuccuccgccuuccagcucggccgcuucugcggcuccucccucccccacgagcuccucuccuccgacaacgcccucuacuuccaccucuacuccgagcaccuccgcaacggccgcggcuucaccguccgcugggagacccagcagcccgagugcggcggcauccucaccggccccuacggcuccaucaagucccccggcuaccccggcaacuacccccccggccgcgacugcgucuggaucgucgucaccucccccgaccuccucgucaccuucaccuucggcacccucucccucgagcaccacgacgacugcaacaaggacuaccucgagauccgcgacggcccccucuaccaggacccccuccucggcaaguucugcaccaccuucuccguccccccccuccagaccaccggccccuucgcccgcauccacuuccacuccgacucccagaucuccgaccagggcuuccacaucaccuaccucaccucccccuccgaccuccgcugcggcggcaacuacaccgaccccgagggcgagcucuuccuccccgagcucuccggccccuucacccacacccgccagugcgucuacaugaugaagcagccccagggcgagcagauccagaucaacuucacccacgucgagcuccagugccaguccgacuccucccagaacuacaucgagguccgcgacggcgagacccuccucggcaaggucugcggcaacggcaccaucucccacaucaaguccaucaccaacuccgucuggauccgcuucaagaucgacgccuccgucgagaaggccuccuuccgcgccgucuaccaggucgccugcggcgacgagcucaccggcgagggcgucauccgcucccccuucuuccccaacgucuaccccggcgagcgcaccugccgcuggaccauccaccagccccagucccaggucauccuccucaacuucaccgucuucgagaucggcuccuccgcccacugcgagaccgacuacgucgagaucggcuccuccuccauccucggcucccccgagaacaagaaguacugcggcaccgacauccccuccuucaucaccuccgucuacaacuuccucuacgucaccuucgucaaguccuccuccaccgagaaccacggcuucauggccaaguucuccgccgaggaccucgccugcggcgagauccucaccgaguccaccggcaccauccagucccccggccaccccaacgucuacccccacggcaucaacugcaccuggcacauccucguccagcccaaccaccucauccaccucauguucgagaccuuccaccucgaguuccacuacaacugcaccaacgacuaccucgaggucuacgacaccgacuccgagaccucccucggccgcuacugcggcaaguccaucccccccucccucaccuccuccggcaacucccucaugcucgucuucgucaccgacuccgaccucgccuacgagggcuuccucaucaacuacgaggccaucuccgccgccaccgccugccuccaggacuacaccgacgaccucggcaccuucaccucccccaacuuccccaacaacuaccccaacaacugggagugcaucuaccgcaucaccguccgcaccggccagcucaucgccguccacuucaccaacuucucccucgaggaggccaucggcaacuacuacaccgacuuccucgagauccgcgacggcggcuacgagaaguccccccuccucggcaucuucuacggcuccaaccucccccccaccaucaucucccacuccaacaagcucuggcucaaguucaaguccgaccagaucgacacccgcuccggcuucuccgccuacugggacggcuccuccaccggcugcggcggcaaccucaccaccuccuccggcaccuucaucucccccaacuaccccaugcccuacuaccacuccuccgagugcuacugguggcucaaguccucccacggcuccgccuucgagcucgaguucaaggacuuccaccucgagcaccaccccaacugcacccucgacuaccucgccgucuacgacggccccuccuccaacucccaccuccucacccagcucugcggcgacgagaagcccccccucauccgcuccuccggcgacuccauguucaucaagcuccgcaccgacgagggccagcagggccgcggcuucaaggccgaguaccgccagaccugcgagaacgucgucaucgucaaccagaccuacggcauccucgaguccaucggcuaccccaaccccuacuccgagaaccagcacugcaacuggaccauccgcgccaccaccggcaacaccgucaacuacaccuuccucgccuucgaccucgagcaccacaucaacugcuccaccgacuaccucgagcucuacgacggcccccgccagaugggccgcuacugcggcgucgaccuccccccccccggcuccaccaccuccuccaagcuccagguccuccuccucaccgacggcgucggccgccgcgagaagggcuuccagaugcagugguucgucuacggcugcggcggcgagcucuccggcgccaccggcuccuucuccucccccggcuuccccaaccgcuacccccccaacaaggagugcaucugguacauccgcaccgaccccggcuccuccauccagcucaccauccacgacuucgacgucgaguaccacucccgcugcaacuucgacguccucgagaucuacggcggccccgacuuccacuccccccgcaucgcccagcucugcacccagcgcucccccgagaaccccaugcaggucuccuccaccggcaacgagcucgccauccgcuucaagaccgaccucuccaucaacggccgcggcuucaacgccuccuggcaggccgucaccggcggcugcggcggcaucuuccaggcccccuccggcgagauccacucccccaacuaccccucccccuaccgcuccaacaccgacugcuccugggucauccgcgucgaccgcaaccaccgcguccuccucaacuucaccgacuucgaccucgagccccaggacuccugcaucauggccuacgacggccucuccuccaccaugucccgccucgcccgcaccugcggccgcgagcagcucgccaaccccaucgucuccuccggcaacucccucuuccuccgcuuccaguccggccccucccgccagaaccgcggcuuccgcgcccaguuccgccaggccugcggcggccacauccucaccuccuccuucgacaccgucuccuccccccgcuuccccgccaacuaccccaacaaccagaacugcuccuggaucauccaggcccagcccccccucaaccacaucacccucuccuucacccacuucgagcucgagcgcuccaccaccugcgcccgcgacuucgucgagauccucgacggcggccacgaggacgccccccuccgcggccgcuacugcggcaccgacaugccccaccccaucaccuccuucuccuccgcccucacccuccgcuucgucuccgacuccuccaucuccgccggcggcuuccacaccaccgucaccgccuccgucuccgccugcggcggcaccuucuacauggccgagggcaucuucaacucccccggcuaccccgacaucuacccccccaacgucgagugcgucuggaacaucgucuccucccccggcaaccgccuccagcucuccuucaucuccuuccagcucgaggacucccaggacugcucccgcgacuucgucgagauccgcgagggcaacgccaccggccaccucgucggccgcuacugcggcaacuccuucccccucaacuacuccuccaucgucggccacacccucuggguccgcuucaucuccgacggcuccggcuccggcaccggcuuccaggccaccuucaugaagaucuucggcaacgacaacaucgucggcacccacggcaaggucgccucccccuucuggcccgagaacuacccccacaacuccaacuaccaguggaccgucaacgucaacgccucccacgucguccacggccgcauccucgagauggacaucgaggagauccagaacugcuacuacgacaagcuccgcaucuacgacggccccuccauccacgcccgccucaucggcgccuacugcggcacccagaccgaguccuucuccuccaccggcaacucccucaccuuccacuucuacuccgacuccuccaucuccggcaagggcuuccuccucgagugguucgccgucgacgcccccgacggcguccuccccaccaucgcccccggcgccugcggcggcuuccuccgcaccggcgacgcccccgucuuccucuucucccccggcuggcccgacuccuacuccaaccgcgucgacugcaccuggcucauccaggcccccgacuccaccgucgagcucaacauccucucccucgacaucgagucccaccgcaccugcgccuacgacucccucgucauccgcgacggcgacaacaaccucgcccagcagcucgccguccucugcggccgcgagauccccggccccauccgcuccaccggcgaguacauguucauccgcuucaccuccgacuccuccgucacccgcgccggcuucaacgccuccuuccacaaguccugcggcggcuaccuccacgccgaccgcggcaucaucaccucccccaaguaccccgagaccuaccccuccaaccucaacugcuccuggcacguccucguccaguccggccucaccaucgccguccacuucgagcagcccuuccagauccccaacggcgacuccuccugcaaccagggcgacuaccucguccuccgcaacggccccgacaucugcucccccccccucggcccccccggcggcaacggccacuucugcggcucccacgccuccuccacccucuucaccuccgacaaccagauguucguccaguucaucuccgaccacuccaacgagggccagggcuucaagaucaaguacgaggccaagucccucgccugcggcggcaacgucuacauccacgacgccgacuccgccggcuacgucaccucccccaaccacccccacaacuaccccccccacgccgacugcaucuggauccucgccgccccccccgagacccgcauccagcuccaguucgaggaccgcuucgacaucgaggucacccccaacugcaccuccaacuaccucgagcuccgcgacggcgucgacuccgacgcccccauccucuccaaguucugcggcaccucccuccccuccucccagugguccuccggcgaggucauguaccuccgcuuccgcuccgacaacucccccacccacgucggcuucaaggccaaguacuccaucgcccagugcggcggccgcguccccggccaguccggcgucgucgaguccaucggccaccccacccuccccuaccgcgacaaccucuucugcgaguggcaccuccagggccucuccggccacuaccucaccaucuccuucgaggacuucaaccuccagaacuccuccggcugcgagaaggacuucgucgagaucugggacaaccacaccuccggcaacauccucggccgcuacugcggcaacaccauccccgacuccaucgacaccuccuccaacaccgccgucguccgcuucgucaccgacggcuccgucaccgccuccggcuuccgccuccgcuucgaguccuccauggaggagugcggcggcgaccuccagggcuccaucggcaccuucaccucccccaacuaccccaaccccaacccccacggccgcaucugcgaguggcgcaucaccgcccccgagggccgccgcaucacccucauguucaacaaccuccgccucgccacccaccccuccugcaacaacgagcacgucaucgucuucaacggcauccgcuccaacuccccccagcucgagaagcucugcuccuccgucaacgucuccaacgagaucaaguccuccggcaacaccaugaaggucaucuucuucaccgacggcucccgccccuacggcggcuucaccgccuccuacaccuccuccgaggacgccgucugcggcggcucccuccccaacacccccgagggcaacuucaccucccccggcuacgacggcguccgcaacuacucccgcaaccucaacugcgaguggacccucuccaaccccaaccagggcaacuccuccaucuccauccacuucgaggacuucuaccucgagucccaccaggacugccaguucgacguccucgaguuccgcgucggcgacgccgacggcccccucauguggcgccucugcggccccuccaagcccacccucccccucgucauccccuacucccaggucuggauccacuucgucaccaacgagcgcgucgagcacaucggcuuccacgccaaguacuccuucaccgacugcggcggcauccagaucggcgacuccggcgucaucaccucccccaacuaccccaacgccuacgacucccucacccacugcuccucccuccucgaggccccccagggccacaccaucacccucaccuucuccgacuucgacaucgagccccacaccaccugcgccugggacuccgucaccguccgcaacggcggcucccccgagucccccaucaucggccaguacugcggcaacuccaacccccgcaccauccaguccggcuccaaccagcucgucgucaccuucaacuccgaccacucccuccagggcggcggcuucuacgccaccuggaacacccagacccucggcugcggcggcaucuuccacuccgacaacggcaccauccgcuccccccacuggccccagaacuuccccgagaacucccgcugcuccuggaccgccaucacccacaaguccaagcaccucgagaucuccuucgacaacaacuuccucauccccuccggcgacggccagugccagaacuccuucgucaaggucugggccggcaccgaggaggucgacaaggcccuccucgccaccggcugcggcaacgucgcccccggccccgucaucacccccuccaacaccuucaccgccgucuuccagucccaggaggcccccgcccagggcuucuccgccuccuucgucucccgcugcggcuccaacuucaccggccccuccggcuacaucaucucccccaacuaccccaagcaguacgacaacaacaugaacugcaccuacgucaucgaggccaacccccucuccgucguccuccucaccuucgucuccuuccaccucgaggcccgcuccgccgucaccggcuccugcgucaacgacggcguccacaucauccgcggcuacuccgucauguccacccccuucgccaccgucugcggcgacgagaugcccgccccccucaccaucgccggccccguccuccucaacuucuacuccaacgagcagaucaccgacuucggcuucaaguucuccuaccgcaucaucuccugcggcggcgucuucaacuucuccuccggcaucaucaccucccccgccuacuccuacgccgacuaccccaacgacaugcacugccucuacaccaucaccgucuccgacgacaaggucaucgagcucaaguucuccgacuucgacgucguccccuccaccuccugcucccacgacuaccucgccaucuacgacggcgccaacaccuccgacccccuccucggcaaguucugcggcuccaagcgcccccccaacgucaaguccuccaacaacuccaugcuccucgucuucaagaccgacuccuuccagaccgccaagggcuggaagauguccuuccgccagacccucggcccccagcagggcugcggcggcuaccucaccggcuccaacaacaccuucgccucccccgacuccgacuccaacggcauguacgacaagaaccucaacugcgucuggaucaucaucgcccccgucaacaaggucauccaccucaccuucaacaccuucgcccucgaggccgccuccacccgccagcgcugccucuacgacuacgucaagcucuacgacggcgacuccgagaacgccaaccucgccggcaccuucugcggcuccaccguccccgcccccuucaucuccuccggcaacuuccucaccguccaguucaucuccgaccucacccucgagcgcgagggcuucaacgccaccuacaccaucauggacaugcccugcggcggcaccuacaacgccaccuggaccccccagaacaucuccucccccaacuccuccgaccccgacguccccuucuccaucugcaccugggucaucgacucccccccccaccagcaggucaagaucaccgucugggcccuccagcucaccucccaggacugcacccagaacuaccuccagcuccaggacuccccccagggccacggcaacucccgcuuccaguucugcggccgcaacgccuccgccguccccgucuucuacuccuccauguccaccgccauggucaucuucaaguccggcgucgucaaccgcaacucccgcauguccuucaccuaccagaucgccgacugcaaccgcgacuaccacaaggccuucggcaaccuccgcucccccggcuggcccgacaacuacgacaacgacaaggacugcaccgucacccucaccgccccccagaaccacaccaucucccucuucuuccacucccucggcaucgagaacuccgucgagugccgcaacgacuuccucgagguccgcaacggcuccaacuccaacuccccccuccucggcaaguacugcggcacccuccuccccaaccccgucuucucccagaacaacgagcucuaccuccgcuucaaguccgacuccgucaccuccgaccgcggcuacgagaucaucuggaccuccucccccuccggcugcggcggcacccucuacggcgaccgcggcuccuucaccucccccggcuaccccggcaccuaccccaacaacaccuacugcgaguggguccucgucgcccccgccggccgccucgucaccaucaacuucuacuucaucuccaucgacgaccccggcgacugcguccagaacuaccucacccucuacgacggccccaacgccuccucccccuccuccggccccuacugcggcggcgacaccuccaucgcccccuucgucgccuccuccaaccaggucuucaucaaguuccacgccgacuacgcccgccgccccuccgccuuccgccucaccugggacuccuga

SEQ ID NO: 41904 - RNA, 1161 nt, Artificial Sequence
  derived and/or modified sequence opt2 from CUEDC1__Homo_sapiens__NP_001278954
augaccucccucuuccgccgcuccuccuccggcuccggcggcggcggcaccgccggcgcccgcggcggcggcggcggcaccgccgccccccaggagcucaacaacucccgccccgcccgccagguccgccgccucgaguucaaccaggccauggacgacuucaagaccauguuccccaacauggacuacgacaucaucgagugcguccuccgcgccaacuccggcgccgucgacgccaccaucgaccagcuccuccagaugaaccucgagggcggcggcuccuccggcggcgucuacgaggacuccuccgacuccgaggacuccaucccccccgagauccucgagcgcacccucgagcccgacuccuccgacgaggagcccccccccgucuacuccccccccgccuaccacaugcacgucuucgaccgccccuacccccucgccccccccaccccccccccccgcaucgacgcccucggcuccggcgcccccaccucccagcgccgcuaccgcaacuggaaccccccccuccucggcaaccuccccgacgacuuccuccgcauccucccccagcagcucgacuccauccagggcaacgccggcggccccaagcccggcuccggcgagggcugcccccccgccauggccggccccggccccggcgaccaggagucccgcuggaagcaguaccucgaggacgagcgcaucgcccucuuccuccagaacgaggaguucaugaaggagcuccagcgcaaccgcgacuuccuccucgcccucgagcgcgaccgccucaaguacgagucccagaaguccaaguccuccuccgucgccgucggcaacgacuucggcuucuccucccccguccccggcaccggcgacgccaaccccgccgucuccgaggacgcccucuuccgcgacaagcucaagcacaugggcaaguccacccgccgcaagcucuucgagcucgcccgcgccuucuccgagaagaccaagaugcgcaaguccaagcgcaagcaccuccucaagcaccagucccucggcgccgccgccuccaccgccaaccuccucgacgacgucgagggccacgccugcgacgaggacuuccgcggccgccgccaggaggcccccaaggucgaggagggccuccgcgagggccaguga

SEQ ID NO: 41905 - RNA, 864 nt, Artificial Sequence
  derived and/or modified sequence opt2 from CUEDC2__Homo_sapiens__NP_076945
auggagcucgagcgcaucgucuccgccgcccuccucgccuucguccagacccaccuccccgaggccgaccucuccggccucgacgaggucaucuucuccuacguccucggcguccucgaggaccucggccccuccggccccuccgaggagaacuucgacauggaggccuucaccgagaugauggaggccuacguccccggcuucgcccacaucccccgcggcaccaucggcgacaugaugcagaagcucuccggccagcucuccgacgcccgcaacaaggagaaccuccagccccaguccuccggcguccagggccagguccccaucucccccgagccccuccagcgccccgagaugcucaaggaggagacccgcuccuccgccgccgccgccgccgacacccaggacgaggccaccggcgccgaggaggagcuccuccccggcgucgacguccuccucgaggucuuccccaccugcuccgucgagcaggcccaguggguccucgccaaggcccgcggcgaccucgaggaggccguccagaugcucgucgagggcaaggaggagggccccgccgccugggagggccccaaccaggaccucccccgccgccuccgcggcccccagaaggacgagcucaaguccuucauccuccagaaguacaugauggucgacuccgccgaggaccagaagauccaccgccccauggcccccaaggaggcccccaagaagcucauccgcuacaucgacaaccaggucgucuccaccaagggcgagcgcuucaaggacguccgcaaccccgaggccgaggagaugaaggccaccuacaucaaccucaagcccgcccgcaaguaccgcuuccacuga

SEQ ID NO: 41906 - RNA, 2331 nt, Artificial Sequence
  derived and/or modified sequence opt2 from CUL1__Homo_sapiens__XP_011514934
auguccuccacccgcucccagaacccccacggccucaagcagaucggccucgaccagaucugggacgaccuccgcgccggcauccagcaggucuacacccgccaguccauggccaagucccgcuacauggagcucuacacccacgucuacaacuacugcaccuccguccaccaguccaaccaggcccgcggcgccggcgucccccccuccaaguccaagaagggccagacccccggcggcgcccaguucgucggccucgagcucuacaagcgccucaaggaguuccucaagaacuaccucaccaaccuccucaaggacggcgaggaccucauggacgaguccguccucaaguucuacacccagcagugggaggacuaccgcuucuccuccaagguccucaacggcaucugcgccuaccucaaccgccacuggguccgccgcgagugcgacgagggccgcaagggcaucuacgagaucuacucccucgcccucgucaccuggcgcgacugccucuuccgcccccucaacaagcaggucaccaacgccguccucaagcucaucgagaaggagcgcaacggcgagaccaucaacacccgccucaucuccggcgucguccaguccuacgucgagcucggccucaacgaggacgacgccuucgccaagggccccacccucaccgucuacaaggaguccuucgagucccaguuccucgccgacaccgagcgcuucuacacccgcgaguccaccgaguuccuccagcagaaccccgucaccgaguacaugaagaaggccgaggcccgccuccucgaggagcagcgccgcguccaggucuaccuccacgaguccacccaggacgagcucgcccgcaagugcgagcagguccucaucgagaagcaccucgagaucuuccacaccgaguuccagaaccuccucgacgccgacaagaacgaggaccucggccgcauguacaaccucgucucccgcauccaggacggccucggcgagcucaagaagcuccucgagacccacauccacaaccagggccucgccgccaucgagaagugcggcgaggccgcccucaacgaccccaagauguacguccagaccguccucgacguccacaagaaguacaacgcccucgucauguccgccuucaacaacgacgccggcuucgucgccgcccucgacaaggccugcggccgcuucaucaacaacaacgccgucaccaagauggcccaguccuccuccaagucccccgagcuccucgcccgcuacugcgacucccuccucaagaaguccuccaagaaccccgaggaggccgagcucgaggacacccucaaccaggucauggucgucuucaaguacaucgaggacaaggacgucuuccagaaguucuacgccaagaugcucgccaagcgccucguccaccagaacuccgccuccgacgacgccgaggccuccaugaucuccaagcucaagcaggccugcggcuucgaguacaccuccaagcuccagcgcauguuccaggacaucggcgucuccaaggaccucaacgagcaguucaagaagcaccucaccaacuccgagccccucgaccucgacuucuccauccagguccucuccuccggcuccuggcccuuccagcaguccugcaccuucgcccuccccuccgagcucgagcgcuccuaccagcgcuucaccgccuucuacgccucccgccacuccggccgcaagcucaccuggcucuaccagcucuccaagggcgagcucgucaccaacugcuucaagaaccgcuacacccuccaggccuccaccuuccagauggccauccuccuccaguacaacaccgaggacgccuacaccguccagcagcucaccgacuccacccagaucaagauggacauccucgcccagguccuccagauccuccucaaguccaagcuccucguccucgaggacgagaacgccaacgucgacgaggucgagcucaagcccgacacccucaucaagcucuaccucggcuacaagaacaagaagcuccgcgucaacaucaacguccccaugaagaccgagcagaagcaggagcaggagaccacccacaagaacaucgaggaggaccgcaagcuccucauccaggccgccaucguccgcaucaugaagaugcgcaagguccucaagcaccagcagcuccucggcgagguccucacccagcucuccucccgcuucaagccccgcguccccgucaucaagaagugcaucgacauccucaucgagaaggaguaccucgagcgcgucgacggcgagaaggacaccuacuccuaccucgccuga

SEQ ID NO: 41907 - RNA, 2295 nt, Artificial Sequence
  derived and/or modified sequence opt2 from CUL2__Homo_sapiens__NP_001185707
auguaccgcgucaccugguccaccuucuggcuccgcuuccagcacuacaccugcaccaugucccucaagccccgcgucgucgacuucgacgagaccuggaacaagcuccucaccaccaucaaggccgucgucaugcucgaguacgucgagcgcgccaccuggaacgaccgcuucuccgacaucuacgcccucugcgucgccuaccccgagccccucggcgagcgccucuacaccgagaccaagaucuuccucgagaaccacguccgccaccuccacaagcgcguccucgaguccgaggagcagguccucgucauguaccaccgcuacugggaggaguacuccaagggcgccgacuacauggacugccucuaccgcuaccucaacacccaguucaucaagaagaacaagcucaccgaggccgaccuccaguacggcuacggcggcgucgacaugaacgagccccucauggagaucggcgagcucgcccucgacauguggcgcaagcucauggucgagccccuccaggccauccucauccgcaugcuccuccgcgagaucaagaacgaccgcggcggcgaggaccccaaccagaaggucauccacggcgucaucaacuccuucguccacgucgagcaguacaagaagaaguucccccucaaguucuaccaggagaucuucgagucccccuuccucaccgagaccggcgaguacuacaagcaggaggccuccaaccuccuccaggaguccaacugcucccaguacauggagaagguccucggccgccucaaggacgaggagauccgcugccgcaaguaccuccaccccuccuccuacaccaaggucauccacgagugccagcagcgcauggucgccgaccaccuccaguuccuccacgccgagugccacaacaucauccgccaggagaagaagaacgacauggccaacauguacguccuccuccgcgccgucuccaccggccucccccacaugauccaggagcuccagaaccacauccacgacgagggccuccgcgccaccuccaaccucacccaggagaacaugcccacccucuucgucgaguccguccucgagguccacggcaaguucguccagcucaucaacaccguccucaacggcgaccagcacuucauguccgcccucgacaaggcccucaccuccgucgucaacuaccgcgagcccaaguccgucugcaaggcccccgagcuccucgccaaguacugcgacaaccuccucaagaaguccgccaagggcaugaccgagaacgaggucgaggaccgccucaccuccuucaucaccgucuucaaguacaucgacgacaaggacgucuuccagaaguucuacgcccgcaugcucgccaagcgccucauccacggccucuccauguccauggacuccgaggaggccaugaucaacaagcucaagcaggccugcggcuacgaguucaccuccaagcuccaccgcauguacaccgacauguccgucuccgccgaccucaacaacaaguucaacaacuucaucaagaaccaggacaccgucaucgaccucggcaucuccuuccagaucuacguccuccaggccggcgccuggccccucacccaggcccccuccuccaccuucgccaucccccaggagcucgagaaguccguccagauguucgagcucuucuacucccagcacuucuccggccgcaagcucaccuggcuccacuaccucugcaccggcgaggucaagaugaacuaccucggcaagcccuacgucgccauggucaccaccuaccagauggccguccuccucgccuucaacaacuccgagaccgucuccuacaaggagcuccaggacuccacccagaugaacgagaaggagcucaccaagaccaucaagucccuccucgacgucaagaugaucaaccacgacuccgagaaggaggacaucgacgccgaguccuccuucucccucaacaugaacuucuccuccaagcgcaccaaguucaagaucaccaccuccaugcagaaggacaccccccaggagauggagcagacccgcuccgccgucgacgaggaccgcaagauguaccuccaggccgccaucguccgcaucaugaaggcccgcaagguccuccgccacaacgcccucauccaggaggucaucucccagucccgcgcccgcuucaaccccuccaucuccaugaucaagaagugcaucgagguccucaucgacaagcaguacaucgagcgcucccaggccuccgccgacgaguacuccuacgucgccuga

SEQ ID NO: 41908 - RNA, 2109 nt, Artificial Sequence
  derived and/or modified sequence opt2 from CUL3__Homo_sapiens__NP_001244126
auguccaaccucuccaagggcaccggcucccgcaaggacaccaagaugcgcauccgcgccuuccccguccgcgaggacguccucaacucccucaacaacaacuuccuccagacccucaaccaggccuggaacgaccaccagaccgccauggucaugauccgcgacauccucauguacauggaccgcgucuacguccagcagaacaacgucgagaacgucuacaaccucggccucaucaucuuccgcgaccaggucguccgcuacggcugcauccgcgaccaccuccgccagacccuccucgacaugaucgcccgcgagcgcaagggcgaggucgucgaccgcggcgccauccgcaacgccugccagaugcucaugauccucggccucgagggccgcuccgucuacgaggaggacuucgaggcccccuuccucgagauguccgccgaguucuuccagauggagucccagaaguuccucgccgagaacuccgccuccgucuacaucaagaaggucgaggcccgcaucaacgaggagaucgagcgcgucaugcacugccucgacaaguccaccgaggagcccaucgucaaggucgucgagcgcgagcucaucuccaagcacaugaagaccaucgucgagauggagaacuccggccucguccacaugcucaagaacggcaagaccgaggaccucggcugcauguacaagcucuucucccgcguccccaacggccucaagaccaugugcgagugcauguccuccuaccuccgcgagcagggcaaggcccucgucuccgaggagggcgagggcaagaaccccgucgacuacauccagggccuccucgaccucaagucccgcuucgaccgcuuccuccucgaguccuucaacaacgaccgccucuucaagcagaccaucgccggcgacuucgaguacuuccucaaccucaacucccgcucccccgaguaccucucccucuucaucgacgacaagcucaagaagggcgucaagggccucaccgagcaggaggucgagaccauccucgacaaggccaugguccucuuccgcuucaugcaggagaaggacgucuucgagcgcuacuacaagcagcaccucgcccgccgccuccucaccaacaaguccgucuccgacgacuccgagaagaacaugaucuccaagcucaagaccgagugcggcugccaguucaccuccaagcucgagggcauguuccgcgacauguccaucuccaacaccaccauggacgaguuccgccagcaccuccaggccaccggcgucucccucggcggcgucgaccucaccguccgcguccucaccaccggcuacuggcccacccaguccgccacccccaagugcaacaucccccccgccccccgccacgccuucgagaucuuccgccgcuucuaccucgccaagcacuccggccgccagcucacccuccagcaccacaugggcuccgccgaccucaacgccaccuucuacggccccgucaagaaggaggacggcuccgaggucggcgucggcggcgcccaggucaccggcuccaacacccgcaagcacauccuccaggucuccaccuuccagaugaccauccucaugcucuucaacaaccgcgagaaguacaccuucgaggagauccagcaggagaccgacauccccgagcgcgagcucguccgcgcccuccagucccucgccugcggcaagcccacccagcgcguccucaccaaggagcccaaguccaaggagaucgagaacggccacaucuucaccgucaacgaccaguucaccuccaagcuccaccgcgucaagauccagaccgucgccgccaagcagggcgaguccgaccccgagcgcaaggagacccgccagaaggucgacgacgaccgcaagcacgagaucgaggccgccaucguccgcaucaugaagucccgcaagaagaugcagcacaacguccucgucgccgaggucacccagcagcucaaggcccgcuuccuccccucccccgucgucaucaagaagcgcaucgagggccucaucgagcgcgaguaccucgcccgcacccccgaggaccgcaaggucuacaccuacgucgccuga

SEQ ID NO: 41909 - RNA, 2280 nt, Artificial Sequence
  derived and/or modified sequence opt2 from CUL4A__Homo_sapiens__NP_001008895
auggccgacgaggccccccgcaagggcuccuucuccgcccucgucggccgcaccaacggccucaccaagcccgccgcccucgccgccgcccccgccaagcccggcggcgccggcggcuccaagaagcucgucaucaagaacuuccgcgaccgcccccgccuccccgacaacuacacccaggacaccuggcgcaagcuccacgaggccguccgcgccguccaguccuccaccuccauccgcuacaaccucgaggagcucuaccaggccgucgagaaccucugcucccacaaggucucccccaugcucuacaagcagcuccgccaggccugcgaggaccacguccaggcccagauccuccccuuccgcgaggacucccucgacuccguccucuuccucaagaagaucaacaccugcuggcaggaccacugccgccagaugaucaugauccgcuccaucuuccucuuccucgaccgcaccuacguccuccagaacuccacccuccccuccaucugggacaugggccucgagcucuuccgcacccacaucaucuccgacaagaugguccaguccaagaccaucgacggcauccuccuccucaucgagcgcgagcgcuccggcgaggccgucgaccgcucccuccuccgcucccuccucggcaugcucuccgaccuccaggucuacaaggacuccuucgagcucaaguuccucgaggagaccaacugccucuacgccgccgagggccagcgccucaugcaggagcgcgagguccccgaguaccucaaccacgucuccaagcgccucgaggaggagggcgaccgcgucaucaccuaccucgaccacuccacccagaagccccucaucgccugcgucgagaagcagcuccucggcgagcaccucaccgccauccuccagaagggccucgaccaccuccucgacgagaaccgcguccccgaccucgcccagauguaccagcucuucucccgcguccgcggcggccagcaggcccuccuccagcacugguccgaguacaucaagaccuucggcaccgccaucgucaucaaccccgagaaggacaaggacaugguccaggaccuccucgacuucaaggacaaggucgaccacgucaucgaggucugcuuccagaagaacgagcgcuucgucaaccucaugaaggaguccuucgagaccuucaucaacaagcgccccaacaagcccgccgagcucaucgccaagcacgucgacuccaagcuccgcgccggcaacaaggaggccaccgacgaggagcucgagcgcacccucgacaagaucaugauccucuuccgcuucauccacggcaaggacgucuucgaggccuucuacaagaaggaccucgccaagcgccuccucgucggcaaguccgccuccgucgacgccgagaaguccaugcucuccaagcucaagcacgagugcggcgccgccuucaccuccaagcucgagggcauguucaaggacauggagcucuccaaggacaucaugguccacuucaagcagcacaugcagaaccaguccgacuccggccccaucgaccucaccgucaacauccucaccaugggcuacuggcccaccuacacccccauggagguccaccucacccccgagaugaucaagcuccaggaggucuucaaggccuucuaccucggcaagcacuccggccgcaagcuccaguggcagaccacccucggccacgccguccucaaggccgaguucaaggagggcaagaaggaguuccaggucucccucuuccagacccucguccuccucauguucaacgagggcgacggcuucuccuucgaggagaucaagauggccaccggcaucgaggacuccgagcuccgccgcacccuccagucccucgccugcggcaaggcccgcguccucaucaagucccccaagggcaaggaggucgaggacggcgacaaguucaucuucaacggcgaguucaagcacaagcucuuccgcaucaagaucaaccagauccagaugaaggagaccgucgaggagcaggucuccaccaccgagcgcgucuuccaggaccgccaguaccagaucgacgccgccaucguccgcaucaugaagaugcgcaagacccucggccacaaccuccucgucuccgagcucuacaaccagcucaaguuccccgucaagcccggcgaccucaagaagcgcaucgagucccucaucgaccgcgacuacauggagcgcgacaaggacaaccccaaccaguaccacuacgucgccuga

SEQ ID NO: 41910 - RNA, 2688 nt, Artificial Sequence
  derived and/or modified sequence opt2 from CUL4B__Homo_sapiens__NP_001073341
auguuccccaccggcuucuccucccccucccccuccgccgccgccgccgcccaggagguccgcuccgccaccgacggcaacaccuccaccaccccccccaccuccgccaagaagcgcaagcucaacuccuccuccuccuccuccuccaacuccuccaacgagcgcgaggacuucgacuccaccuccuccuccuccuccacccccccccuccagccccgcgacuccgccucccccuccaccuccuccuucugccucggcgucuccgucgccgccuccucccacguccccauccagaagaagcuccgcuucgaggacacccucgaguucgucggcuucgacgccaagauggccgaggaguccuccuccuccuccuccuccuccucccccaccgccgccaccucccagcagcagcagcucaagaacaaguccauccucaucuccuccgucgccuccguccaccacgccaacggccucgccaaguccuccaccaccgucuccuccuucgccaacuccaagcccggcuccgccaagaagcucgucaucaagaacuucaaggacaagcccaagcuccccgagaacuacaccgacgagaccuggcagaagcucaaggaggccgucgaggccauccagaacuccaccuccaucaaguacaaccucgaggagcucuaccaggccgucgagaaccucugcuccuacaagaucuccgccaaccucuacaagcagcuccgccagaucugcgaggaccacaucaaggcccagauccaccaguuccgcgaggacucccucgacuccguccucuuccucaagaagaucgaccgcugcuggcagaaccacugccgccagaugaucaugauccgcuccaucuuccucuuccucgaccgcaccuacguccuccagaacuccaugcuccccuccaucugggacaugggccucgagcucuuccgcgcccacaucaucuccgaccagaagguccagaacaagaccaucgacggcauccuccuccucaucgagcgcgagcgcaacggcgaggccaucgaccgcucccuccuccgcucccuccucuccaugcucuccgaccuccagaucuaccaggacuccuucgagcagcgcuuccucgaggagaccaaccgccucuacgccgccgagggccagaagcucaugcaggagcgcgagguccccgaguaccuccaccacgucaacaagcgccucgaggaggaggccgaccgccucaucaccuaccucgaccagaccacccagaagucccucaucgccaccgucgagaagcagcuccucggcgagcaccucaccgccauccuccagaagggccucaacaaccuccucgacgagaaccgcauccaggaccucucccuccucuaccagcucuucucccgcguccgcggcggcguccagguccuccuccagcaguggaucgaguacaucaaggccuucggcuccaccaucgucaucaaccccgagaaggacaagaccaugguccaggagcuccucgacuucaaggacaaggucgaccacaucaucgacaucugcuuccucaagaacgagaaguucaucaacgccaugaaggaggccuucgagaccuucaucaacaagcgccccaacaagcccgccgagcucaucgccaaguacgucgacuccaagcuccgcgccggcaacaaggaggccaccgacgaggagcucgagaagaugcucgacaagaucaugaucaucuuccgcuucaucuacggcaaggacgucuucgaggccuucuacaagaaggaccucgccaagcgccuccucgucggcaaguccgccuccgucgacgccgagaaguccaugcucuccaagcucaagcacgagugcggcgccgccuucaccuccaagcucgagggcauguucaaggacauggagcucuccaaggacaucaugauccaguucaagcaguacaugcagaaccagaacguccccggcaacaucgagcucaccgucaacauccucaccaugggcuacuggcccaccuacguccccauggagguccaccucccccccgagauggucaagcuccaggagaucuucaagaccuucuaccucggcaagcacuccggccgcaagcuccaguggcaguccacccucggccacugcguccucaaggccgaguucaaggagggcaagaaggagcuccaggucucccucuuccagacccucguccuccucauguucaacgagggcgaggaguucucccucgaggagaucaagcaggccaccggcaucgaggacggcgagcuccgccgcacccuccagucccucgccugcggcaaggcccgcguccucgccaagaaccccaagggcaaggacaucgaggacggcgacaaguucaucugcaacgacgacuucaagcacaagcucuuccgcaucaagaucaaccagauccagaugaaggagaccgucgaggagcaggccuccaccaccgagcgcgucuuccaggaccgccaguaccagaucgacgccgccaucguccgcaucaugaagaugcgcaagacccucucccacaaccuccucgucuccgaggucuacaaccagcucaaguuccccgucaagcccgccgaccucaagaagcgcaucgagucccucaucgaccgcgacuacauggagcgcgacaaggagaaccccaaccaguacaacuacaucgccuga

SEQ ID NO: 41911 - RNA, 2343 nt, Artificial Sequence
  derived and/or modified sequence opt2 from CUL5__Homo_sapiens__NP_003469
auggccaccuccaaccuccucaagaacaagggcucccuccaguucgaggacaagugggacuucaugcgccccaucguccucaagcuccuccgccaggaguccgucaccaagcagcagugguucgaccucuucuccgacguccacgccgucugccucugggacgacaagggccccgccaagauccaccaggcccucaaggaggacauccucgaguucaucaagcaggcccaggcccgcguccucucccaccaggacgacaccgcccuccucaaggccuacaucgucgaguggcgcaaguucuucacccagugcgacauccuccccaagcccuucugccagcucgagaucacccucaugggcaagcagggcuccaacaagaaguccaacgucgaggacuccaucguccgcaagcucaugcucgacaccuggaacgaguccaucuucuccaacaucaagaaccgccuccaggacuccgccaugaagcucguccacgccgagcgccucggcgaggccuucgacucccagcucgucaucggcguccgcgaguccuacgucaaccucugcuccaaccccgaggacaagcuccagaucuaccgcgacaacuucgagaaggccuaccucgacuccaccgagcgcuucuaccgcacccaggcccccuccuaccuccagcagaacggcguccagaacuacaugaaguacgccgacgccaagcucaaggaggaggagaagcgcgcccuccgcuaccucgagacccgccgcgagugcaacuccgucgaggcccucauggagugcugcgucaacgcccucgucaccuccuucaaggagaccauccucgccgagugccagggcaugaucaagcgcaacgagaccgagaagcuccaccucauguucucccucauggacaagguccccaacggcaucgagcccaugcucaaggaccucgaggagcacaucaucuccgccggccucgccgacauggucgccgccgccgagaccaucaccaccgacuccgagaaguacgucgagcagcuccucacccucuucaaccgcuucuccaagcucgucaaggaggccuuccaggacgacccccgcuuccucaccgcccgcgacaaggccuacaaggccgucgucaacgacgccaccaucuucaagcucgagcucccccucaagcagaagggcgucggccucaagacccagcccgaguccaagugccccgagcuccucgccaacuacugcgacaugcuccuccgcaagaccccccucuccaagaagcucaccuccgaggagaucgaggccaagcucaaggagguccuccucguccucaaguacguccagaacaaggacgucuucaugcgcuaccacaaggcccaccucacccgccgccucauccucgacaucuccgccgacuccgagaucgaggagaacauggucgaguggcuccgcgaggucggcaugcccgccgacuacgucaacaagcucgcccgcauguuccaggacaucaaggucuccgaggaccucaaccaggccuucaaggagaugcacaagaacaacaagcucgcccuccccgccgacuccgucaacaucaagauccucaacgccggcgccuggucccgcuccuccgagaaggucuucgucucccuccccaccgagcucgaggaccucauccccgaggucgaggaguucuacaagaagaaccacuccggccgcaagcuccacuggcaccaccucauguccaacggcaucaucaccuucaagaacgaggucggccaguacgaccucgaggucaccaccuuccagcucgccguccucuucgccuggaaccagcgcccccgcgagaagaucuccuucgagaaccucaagcucgccaccgagcuccccgacgccgagcuccgccgcacccucuggucccucgucgccuuccccaagcucaagcgccagguccuccucuacgagccccaggucaacucccccaaggacuucaccgagggcacccucuucuccgucaaccaggaguucucccucaucaagaacgccaagguccagaagcgcggcaagaucaaccucaucggccgccuccagcucaccaccgagcgcaugcgcgaggaggagaacgagggcaucguccagcuccgcauccuccgcacccaggaggccaucauccagaucaugaagaugcgcaagaagaucuccaacgcccagcuccagaccgagcucgucgagauccucaagaacauguuccucccccagaagaagaugaucaaggagcagaucgaguggcucaucgagcacaaguacauccgccgcgacgaguccgacaucaacaccuucaucuacauggccuga

SEQ ID NO: 41912 - RNA, 5349 nt, Artificial Sequence
  derived and/or modified sequence opt2 from CUL7__Homo_sapiens__NP_001161842
augucccgcggcuucuggcucgccgagccccucgccggcaccggcccccaccccgcccccgucgccgccgacucccgcggcugcuccuccgucccccgccgccacgcccccucccgccucuccgucuccacccccucccgcggccccggcgcccgcauggucggcgagcuccgcuaccgcgaguuccgcgucccccucggccccggccuccacgccuaccccgacgagcucauccgccagcgcgucggccacgacggccaccccgaguaccagauccgcuggcucauccuccgccgcggcgacgagggcgacggcggcuccggccaggucgacugcaaggccgagcacauccuccucuggauguccaaggacgagaucuacgccaacugccacaagaugcucggcgaggacggccaggucaucggccccucccaggaguccgccggcgaggucggcgcccucgacaaguccguccucgaggagauggagaccgacgucaagucccucauccagcgcgcccuccgccagcucgaggagugcgucggcaccaucccccccgccccccuccuccacaccguccacguccucuccgccuacgccuccaucgagccccucaccggcgucuucaaggacccccgcguccucgaccuccucaugcacaugcucuccucccccgacuaccagauccgcugguccgccggccgcaugauccaggcccucuccucccacgacgccggcgagggccagugcggcgaggagggcaaggccggcgagggccucggccgccuccgcgacucccaggacaccgucgccggcgccuccgaccucauccgcacccgcacccagauccuccucucccucucccagcaggaggccaucgagaagcaccucgacuucgacucccgcugcgcccuccucgcccucuucgcccaggccacccucuccgagcaccccauguccuucgagggcauccagcucccccagguccccggccgcguccucuucucccucgucaagcgcuaccuccacgucaccucccuccucgaccagcucaacgacuccgccgccgagcccggcgcccagaacaccuccgcccccgaggagcucuccggcgagcgcggccagcucgagcucgaguucuccauggccaugggcacccucaucuccgagcucguccaggccaugcgcugggaccaggccuccgaccgcccccgcuccuccgcccgcucccccggcuccaucuuccagccccagcucgccgacgucucccccggccuccccgccgcccaggcccagcccuccuuccgccgcucccgccgcuuccgcccccgcuccgaguucgccuccggcaacaccuacgcccucuacguccgcgacacccuccagcccggcaugcgcguccgcaugcucgacgacuacgaggagaucuccgccggcgacgagggcgaguuccgccaguccaacaacggcgucccccccguccaggucuucugggaguccaccggccgcaccuacuggguccacuggcacaugcucgagauccucggcuucgaggaggacaucgaggacauggucgaggccgacgaguaccagggcgccgucgccucccgcguccucggccgcgcccuccccgccuggcgcuggcgccccaugaccgagcucuacgccguccccuacguccuccccgaggacgaggacaccgaggagugcgagcaccucacccucgccgaguggugggagcuccucuucuucaucaagaagcucgacggccccgaccaccaggagguccuccagauccuccaggagaaccucgacggcgagauccucgacgacgagauccucgccgagcucgccguccccaucgagcucgcccaggaccuccuccucacccucccccagcgccucaacgacuccgcccuccgcgaccucaucaacugccacgucuacaagaaguacggccccgaggcccucgccggcaaccaggccuaccccucccuccucgaggcccaggaggacguccuccuccucgacgcccaggcccaggccaaggacuccgaggacgccgccaaggucgaggccaaggagccccccucccagucccccaacaccccccuccagcgccucgucgagggcuacggccccgccggcaagauccuccucgaccucgagcaggcccucuccuccgagggcacccaggagaacaaggucaagccccuccuccuccagcuccagcgccagccccagcccuuccucgcccucaugcagucccucgacacccccgagaccaaccgcacccuccaccucaccguccuccgcauccucaagcagcucgucgacuuccccgaggcccuccuccuccccuggcacgaggccgucgacgccugcauggccugccuccgcucccccaacaccgaccgcgagguccuccaggagcucaucuucuuccuccaccgccucaccuccgucucccgcgacuacgccgucguccucaaccagcucggcgcccgcgacgccaucuccaaggcccucgagaagcaccucggcaagcucgagcucgcccaggagcuccgcgacauggucuucaagugcgagaagcacgcccaccucuaccgcaagcucaucaccaacauccucggcggcugcauccagaugguccucggccagaucgaggaccaccgccgcacccaccagcccaucaacauccccuucuucgacgucuuccuccgcuaccucugccagggcuccuccgucgaggucaaggaggacaagugcugggagaaggucgaggucuccuccaacccccaccgcgccuccaagcucaccgaccacaaccccaagaccuacugggaguccaacggcuccgccggcucccacuacaucacccuccacaugcgccgcggcauccucauccgccagcucacccuccucgucgccuccgaggacuccuccuacaugcccgcccgcgucgucgucugcggcggcgacuccaccuccucccuccacaccgagcucaacuccgucaacgucaugcccuccgccucccgcgucauccuccucgagaaccucacccgcuucuggcccaucauccagauccgcaucaagcgcugccagcagggcggcaucgacacccgcauccgcggccucgagauccucggccccaagcccaccuucuggcccgucuuccgcgagcagcucugccgccacacccgccucuucuacaugguccgcgcccaggccuggucccaggacauggccgaggaccgccgcucccuccuccaccucuccucccgccucaacggcgcccuccgccaggagcagaacuucgccgaccgcuuccuccccgacgacgaggccgcccaggcccucggcaagaccugcugggaggcccucgucucccccgucguccagaacaucaccucccccgacgaggacggcaucuccccccucggcuggcuccucgaccaguaccucgagugccaggaggccgucuucaacccccagucccgcggccccgccuucuucucccgcguccgccgccucacccaccuccucguccacgucgagcccugcgaggcccccccccccgucgucgccaccccccgccccaagggccgcaaccgcucccacgacugguccucccucgccacccgcggccuccccuccuccaucaugcgcaaccucacccgcugcuggcgcgccgucgucgagaagcaggucaacaacuuccucaccuccuccuggcgcgacgacgacuucgucccccgcuacugcgagcacuucaacauccuccagaacuccuccuccgagcucuucggcccccgcgccgccuuccuccucgcccuccagaacggcugcgccggcgcccuccucaagcuccccuuccucaaggccgcccacgucuccgagcaguucgcccgccacaucgaccagcagauccagggcucccgcaucggcggcgcccaggagauggagcgccucgcccagcuccagcagugccuccaggccguccucaucuucuccggccucgagaucgccaccaccuucgagcacuacuaccagcacuacauggccgaccgccuccucggcgucgucuccuccuggcucgagggcgccguccucgagcagaucggccccugcuuccccaaccgccucccccagcagaugcuccagucccucuccaccuccaaggagcuccagcgccaguuccacgucuaccagcuccagcagcucgaccaggagcuccucaagcucgaggacaccgagaagaagauccaggucggccucggcgccuccggcaaggagcacaaguccgagaaggaggaggaggccggcgccgccgccgucgucgacgucgccgagggcgaggaggaggaggaggagaacgaggaccucuacuacgagggcgccaugcccgaggucuccguccucguccucucccgccacuccuggcccgucgccuccaucugccacacccucaacccccgcaccugccuccccuccuaccuccgcggcacccucaaccgcuacuccaacuucuacaacaagucccagucccaccccgcccucgagcgcggcucccagcgccgccuccaguggaccuggcucggcugggccgagcuccaguucggcaaccagacccuccacgucuccaccguccagauguggcuccuccucuaccucaacgaccucaaggccgucuccgucgagucccuccucgccuucuccggccucuccgccgacaugcucaaccaggccaucggcccccucaccuccucccgcggcccccucgaccuccacgagcagaaggacauccccggcggcguccucaagauccgcgacggcuccaaggagccccgcucccgcugggacaucguccgccucauccccccccagaccuaccuccaggccgagggcgaggacggccagaaccucgagaagcgccgcaaccuccucaacugccucaucguccgcauccucaaggcccacggcgacgagggccuccacaucgaccagcucgucugccucguccucgaggccuggcagaagggccccugccccccccgcggccucgucuccucccucggcaagggcuccgccugcuccuccaccgacguccucuccugcauccuccaccuccucggcaagggcacccuccgccgccacgacgaccgcccccagguccucuccuacgccguccccgucaccgucauggagccccacaccgagucccucaaccccggcuccuccggccccaaccccccccucaccuuccacacccuccagauccgcucccgcggcguccccuacgccuccugcaccgccacccaguccuucuccaccuuccgcuga

SEQ ID NO: 41913 - RNA, 7554 nt, Artificial Sequence
  derived and/or modified sequence opt2 from CUL9__Homo_sapiens__NP_055904
auggucggcgagcgccacgccggcgaccucauggucccccucggcccccgccuccaggccuaccccgaggagcucauccgccagcgccccggccacgacggccaccccgaguaccucauccgcugguccguccucaagugcggcgaggucggcaaggucggcgucgaggagggcaaggccgagcacauccucauguggcucuccgcccccgaggucuacgccaacugccccggccuccucggcgagcgcgcccucuccaagggccuccagcacgagcccgccggcgucuccggcuccuucccccgcgaccccggcggccucgacgaggucgccaugggcgagauggaggccgacguccaggcccucguccgccgcgccgcccgccagcucgccgaguccggcacccccucccucaccgccgccguccuccacaccauccacguccucuccgccuacgccuccaucggcccccucaccggcgucuuccgcgagaccggcgcccucgaccuccucaugcacaugcucugcaaccccgagccccagauccgccgcuccgccggcaagaugcuccaggcccucgccgcccacgacgccggcucccgcgcccacguccuccucucccucucccagcaggacggcaucgagcagcacauggacuucgacucccgcuacacccuccucgagcucuucgccgagaccaccuccuccgaggagcacugcauggccuucgagggcauccaccucccccagauccccggcaagcuccucuucucccucgucaagcgcuaccucugcgucaccucccuccucgaccagcucaacuccucccccgagcucggcgccggcgaccaguccucccccugcgccacccgcgagaagucccgcggccagcgcgagcucgaguucuccauggccgucggcaaccucaucuccgagcucguccgcuccaugggcugggcccgcaaccucuccgagcagggcaugucccccccccgccccacccgcuccaucuuccagcccuacaucuccggccccucccuccuccuccccaccaucgucaccaccccccgccgccagggcugggucuuccgccagcgcuccgaguucuccucccgcuccggcuacggcgaguacguccagcagacccuccagcccggcaugcgcguccgcaugcucgacgacuacgaggagaucuccgccggcgacgagggcgaguuccgccaguccaacaacggcaucccccccguccaggucuucuggcaguccaccggccgcaccuacuggguccacuggcacaugcucgagauccucggccccgaggaggccaccgaggacaaggccuccgccgccgucgagaagggcgccggcgccaccguccucggcaccgccuuccccuccugggacuggaaccccauggacggccucuacccccuccccuaccuccagcccgagccccagaagaacgagcgcgucggcuaccucacccaggccgaguggugggagcuccucuucuucaucaagaagcucgaccucugcgagcagcagcccaucuuccagaaccucuggaagaaccucgacgagacccucggcgagaaggcccucggcgagaucuccgucuccgucgagauggccgagucccuccuccagguccucuccucccgcuucgagggcuccacccucaacgaccuccucaacucccagaucuacaccaaguacggccuccucuccaacgagcccuccuccuccuccaccucccgcaaccacuccugcacccccgaccccgaggaggaguccaaguccgaggccuccuucuccgaggaggagaccgagucccucaaggccaaggccgaggcccccaagaccgaggccgagcccaccaagacccgcaccgagacccccauggcccaguccgacucccagcucuucaaccagcuccucgucaccgagggcaugacccuccccaccgagaugaaggaggccgccuccgagauggcccgcgcccuccgcggccccggcccccgcuccucccucgaccagcacgucgccgccgucgucgccaccguccagaucuccucccucgacaccaaccuccagcucuccggccucuccgcccucucccaggccgucgaggaggucaccgagcgcgaccacccccucguccgccccgaccgcucccuccgcgagaagcucgucaagaugcucgucgagcuccucaccaaccaggucggcgagaagauggucgucguccaggcccuccgccuccucuaccuccucaugaccaagcacgaguggcgcccccucuucgcccgcgagggcggcaucuacgccguccucgucugcaugcaggaguacaagaccuccguccucguccagcaggccggccucgccgcccucaagaugcucgccgucgccuccuccuccgagauccccaccuucgucaccggccgcgacuccauccacucccucuucgacgcccagaugacccgcgagaucuucgccuccaucgacuccgccacccgccccggcuccgagucccuccuccucaccguccccgccgccgucauccucaugcucaacaccgagggcugcuccuccgccgcccgcaacggccuccuccuccucaaccuccuccucugcaaccaccacacccucggcgaccagaucaucacccaggagcuccgcgacacccucuuccgccacuccggcaucgccccccgcaccgagcccaugcccaccacccgcaccauccucaugaugcuccucaaccgcuacuccgagccccccggcucccccgagcgcgccgcccucgagacccccaucauccagggccaggacggcucccccgagcuccucauccgcucccucgucggcggccccuccgccgagcuccuccucgaccucgagcgcguccucugccgcgagggcucccccggcggcgccguccgcccccuccucaagcgccuccagcaggagacccagcccuuccuccuccuccuccgcacccucgacgcccccggccccaacaagacccuccuccucuccguccuccgcgucaucacccgccuccucgacuuccccgaggccaugguccuccccuggcacgagguccucgagcccugccucaacugccucuccggccccuccuccgacuccgagaucguccaggagcucaccugcuuccuccaccgccucgccuccaugcacaaggacuacgccgucguccucugcugccucggcgccaaggagauccucuccaagguccucgacaagcacuccgcccagcuccuccucggcugcgagcuccgcgaccucgucaccgagugcgagaaguacgcccagcucuacuccaaccucaccuccuccauccucgccggcugcauccagaugguccucggccagaucgaggaccaccgccgcacccaccagcccaucaacauccccuucuucgacgucuuccuccgccaccucugccagggcuccuccgucgaggucaaggaggacaagugcugggagaaggucgaggucuccuccaacccccaccgcgccuccaagcucaccgaccacaaccccaagaccuacugggaguccaacggcuccaccggcucccacuacaucacccuccacaugcaccgcggcguccucguccgccagcucacccuccucgucgccuccgaggacuccuccuacaugcccgcccgcgucgucgucuucggcggcgacuccaccuccugcaucggcaccgagcucaacaccgucaacgucaugcccuccgccucccgcgucauccuccucgagaaccucaaccgcuucuggcccaucauccagauccgcaucaagcgcugccagcagggcggcaucgacacccgcguccgcggcgucgagguccucggccccaagcccaccuucuggccccucuuccgcgagcagcucugccgccgcaccugccucuucuacaccauccgcgcccaggccuggucccgcgacaucgccgaggaccaccgccgccuccuccagcucugcccccgccucaaccgcguccuccgccacgagcagaacuucgccgaccgcuuccuccccgacgacgaggccgcccaggcccucggcaagaccugcugggaggcccucgucuccccccucguccagaacaucaccucccccgacgccgagggcgucuccgcccucggcuggcuccucgaccaguaccucgagcagcgcgagaccucccgcaacccccucucccgcgccgccuccuucgccucccgcguccgccgccucugccaccuccucguccacgucgagcccccccccggccccucccccgagcccuccacccgccccuucuccaagaacuccaagggccgcgaccgcucccccgcccccucccccguccuccccuccuccucccuccgcaacaucacccagugcuggcucuccgucguccaggagcaggucucccgcuuccucgccgccgccuggcgcgcccccgacuucgucccccgcuacugcaagcucuacgagcaccuccagcgcgccggcuccgagcucuucggcccccgcgccgccuucaugcucgcccuccgcuccggcuucuccggcgcccuccuccagcaguccuuccucaccgccgcccacauguccgagcaguucgcccgcuacaucgaccagcagauccagggcggccucaucggcggcgcccccggcgucgagaugcucggccagcuccagcgccaccucgagcccaucaugguccucuccggccucgagcucgccaccaccuucgagcacuucuaccagcacuacauggccgaccgccuccucuccuucggcuccuccuggcucgagggcgccguccucgagcagaucggccucugcuuccccaaccgccucccccagcucaugcuccagucccucuccaccuccgaggagcuccagcgccaguuccaccucuuccagcuccagcgccucgacaagcucuuccucgagcaggaggacgaggaggagaagcgccucgaggaggaggaggaggaggaggaggaggaggaggccgagaaggagcucuucaucgaggaccccucccccgccaucuccauccucguccucuccccccgcugcuggcccgucuccccccucugcuaccucuaccacccccgcaagugccuccccaccgaguucugcgacgcccucgaccgcuucuccuccuucuacucccagucccagaaccaccccguccucgacaugggcccccaccgccgccuccaguggaccuggcucggccgcgccgagcuccaguucggcaagcagauccuccacgucuccaccguccagauguggcuccuccucaaguucaaccagaccgaggaggucuccgucgagacccuccucaaggacuccgaccucucccccgagcuccuccuccaggcccucgucccccucaccuccggcaacggcccccucacccuccacgagggccaggacuucccccacggcggcguccuccgccuccacgagcccggcccccagcgcuccggcgaggcccucuggcucauccccccccaggccuaccucaacgucgagaaggacgagggccgcacccucgagcagaagcgcaaccuccucuccugccuccucguccgcauccucaaggcccacggcgagaagggccuccacaucgaccagcucgucugccucguccucgaggccuggcagaagggccccaacccccccggcacccucggccacaccgucgccggcggcgucgccugcaccuccaccgacguccucuccugcauccuccaccuccucggccagggcuacgucaagcgccgcgacgaccgcccccagauccucauguacgccgcccccgagcccaugggccccugccgcggccaggccgacguccccuucugcggcucccaguccgagaccuccaagcccucccccgaggccgucgccacccucgccucccuccagcuccccgccggccgcaccauguccccccaggaggucgagggccucaugaagcagaccguccgccagguccaggagacccucaaccucgagcccgacgucgcccagcaccuccucgcccacucccacuggggcgccgagcagcuccuccaguccuacuccgaggaccccgagccccuccuccucgccgccggccucugcguccaccaggcccaggccguccccguccgccccgaccacugccccgucugcgucuccccccucggcugcgacgacgaccuccccucccucugcugcaugcacuacugcugcaaguccugcuggaacgaguaccucaccacccgcaucgagcagaaccucguccucaacugcaccugccccaucgccgacugccccgcccagcccaccggcgccuucauccgcgccaucgucuccucccccgaggucaucuccaaguacgagaaggcccuccuccgcggcuacgucgaguccugcuccaaccucaccuggugcaccaacccccagggcugcgaccgcauccucugccgccagggccucggcugcggcaccaccugcuccaagugcggcugggccuccugcuucaacugcuccuuccccgaggcccacuaccccgccuccugcggccacaugucccagugggucgacgacggcggcuacuacgacggcauguccgucgaggcccaguccaagcaccucgccaagcucaucuccaagcgcugccccuccugccaggcccccaucgagaagaacgagggcugccuccacaugaccugcgccaagugcaaccacggcuucugcuggcgcugccucaaguccuggaagcccaaccacaaggacuacuacaacugcuccgccauggucuccaaggccgcccgccaggagaagcgcuuccaggacuacaacgagcgcugcaccuuccaccaccaggcccgcgaguucgccgucaaccuccgcaaccgcgucuccgccauccacgaggucccccccccccgcuccuucaccuuccucaacgacgccugccagggccucgagcaggcccgcaagguccucgccuacgccugcgucuacuccuucuacucccaggacgccgaguacauggacgucgucgagcagcagaccgagaaccucgagcuccacaccaacgcccuccagauccuccucgaggagacccuccuccgcugccgcgaccucgccuccucccuccgccuccuccgcgccgacugccucuccaccggcauggagcuccuccgccgcauccaggagcgccuccucgccauccuccagcacuccgcccaggacuuccgcgucggccuccagucccccuccgucgaggccugggaggccaagggccccaacaugcccggcucccagccccaggccuccuccggccccgaggccgaggaggaggaggaggacgacgaggacgacguccccgaguggcagcaggacgaguucgacgaggagcucgacaacgacuccuucuccuacgacgaguccgagaaccucgaccaggagaccuucuucuucggcgacgaggaggaggacgaggacgaggccuacgacuga

SEQ ID NO: 41914 - RNA, 597 nt, Artificial Sequence
  derived and/or modified sequence opt2 from CUTA__Homo_sapiens__NP_001014433
augaucggcuccggccucgccggcuccggcggcgccggcggccccuccuccaccgucaccuggugcgcccucuucuccaaccacgucgccgccacccaggccucccuccuccucuccuucgucuggaugcccgcccuccuccccgucgccucccgccuccuccuccucccccgcguccuccucaccauggccuccggcuccccccccacccagcccucccccgccuccgacuccggcuccggcuacguccccggcuccgucuccgccgccuucgucaccugccccaacgagaaggucgccaaggagaucgcccgcgccgucgucgagaagcgccucgccgccugcgucaaccucaucccccagaucaccuccaucuacgaguggaagggcaagaucgaggaggacuccgagguccucaugaugaucaagacccaguccucccucguccccgcccucaccgacuucguccgcuccguccaccccuacgaggucgccgaggucaucgcccuccccgucgagcagggcaacuuccccuaccuccaguggguccgccaggucaccgaguccgucuccgacuccaucaccguccuccccuga

SEQ ID NO: 41915 - RNA, 4551 nt, Artificial Sequence
  derived and/or modified sequence opt2 from CUX1__Homo_sapiens__NP_001189472
auggccgccaacgucggcuccauguuccaguacuggaagcgcuucgaccuccagcagcuccagcgcgagcucgacgccaccgccaccguccucgccaaccgccaggacgaguccgagcagucccgcaagcgccucaucgagcagucccgcgaguucaagaagaacacccccgaggaccuccgcaagcaggucgccccccuccucaaguccuuccagggcgagaucgacgcccucuccaagcgcuccaaggaggccgaggccgccuuccucaacgucuacaagcgccucaucgacguccccgaccccguccccgcccucgaccucggccagcagcuccagcucaagguccagcgccuccacgacaucgagaccgagaaccagaagcuccgcgagacccucgaggaguacaacaaggaguucgccgaggucaagaaccaggaggucaccaucaaggcccucaaggagaagauccgcgaguacgagcagacccucaagaaccaggccgagaccaucgcccucgagaaggagcagaagcuccagaacgacuucgccgagaaggagcgcaagcuccaggagacccagauguccaccaccuccaagcucgaggaggccgagcacaagguccagucccuccagaccgcccucgagaagacccgcaccgagcucuucgaccucaagaccaaguacgacgaggagaccaccgccaaggccgacgagaucgagaugaucaugaccgaccucgagcgcgccaaccagcgcgccgaggucgcccagcgcgaggccgagacccuccgcgagcagcucuccuccgccaaccacucccuccagcucgccucccagauccagaaggcccccgacgucgagcaggccaucgagguccucacccgcuccucccucgaggucgagcucgccgccaaggagcgcgagaucgcccagcucgucgaggacguccagcgccuccaggccucccucaccaagcuccgcgagaacuccgccucccagaucucccagcucgagcagcagcucuccgccaagaacuccacccucaagcagcucgaggagaagcucaagggccaggccgacuacgaggaggucaagaaggagcucaacauccucaaguccauggaguucgcccccuccgagggcgccggcacccaggacgccgccaagccccucgagguccuccuccucgagaagaaccgcucccuccaguccgagaacgccgcccuccgcaucuccaacuccgaccucuccggcuccgcccgccgcaagggcaaggaccagcccgagucccgccgccccggcucccuccccgcccccccccccucccagcucccccgcaaccccggcgagcaggccuccaacaccaacggcacccaccaguucucccccgccggccucucccaggacuucuucuccuccucccucgccucccccucccucccccucgccuccaccggcaaguucgcccucaacucccuccuccagcgccagcucaugcaguccuucuacuccaaggccaugcaggaggccggcuccaccuccaugaucuucuccaccggccccuacuccaccaacuccaucuccucccaguccccccuccagcagucccccgacgucaacggcauggcccccucccccucccaguccgaguccgccggcuccgucuccgagggcgaggagauggacaccgccgagaucgcccgccaggucaaggagcagcucaucaagcacaacaucggccagcgcaucuucggccacuacguccucggccucucccagggcuccgucuccgagauccucgcccgccccaagcccuggaacaagcucaccguccgcggcaaggagcccuuccacaagaugaagcaguuccucuccgacgagcagaacauccucgcccuccgcuccauccagggccgccagcgcgagaaccccggccagucccucaaccgccucuuccaggagguccccaagcgccgcaacggcuccgagggcaacaucaccacccgcauccgcgccuccgagaccggcuccgacgaggccaucaaguccauccucgagcaggccaagcgcgagcuccagguccagaagaccgccgagcccgcccagcccuccuccgccuccggcuccggcaacuccgacgacgccauccgcuccauccuccagcaggcccgccgcgagauggaggcccagcaggccgcccucgaccccgcccucaagcaggccccccucucccaguccgacaucaccauccucacccccaagcuccucuccaccucccccaugcccaccgucuccuccuaccccccccucgccaucucccucaagaagcccuccgccgcccccgaggccggcgccuccgcccuccccaacccccccgcccucaagaaggaggcccaggacgcccccggccucgacccccagggcgccgccgacugcgcccagggcguccuccgccaggucaagaacgaggucggccgcuccggcgccuggaaggaccacuggugguccgccguccagcccgagcgccgcaacgccgccuccuccgaggaggccaaggccgaggagaccggcggcggcaaggagaagggcuccggcggcuccggcggcggcucccagccccgcgccgagcgcucccagcuccagggccccuccuccuccgaguacuggaaggaguggcccuccgccgagucccccuacucccaguccuccgagcucucccucaccggcgccucccgcuccgagaccccccagaacuccccccuccccuccucccccaucguccccauguccaagcccaccaagcccuccguccccccccucacccccgagcaguacgaggucuacauguaccaggaggucgacaccaucgagcucacccgccaggucaaggagaagcucgccaagaacggcaucugccagcgcaucuucggcgagaagguccucggccucucccagggcuccgucuccgacaugcucucccgccccaagcccugguccaagcucacccagaagggccgcgagcccuucauccgcaugcagcucuggcucaacggcgagcucggccagggcguccuccccguccagggccagcagcagggccccguccuccacuccgucaccucccuccaggacccccuccagcagggcugcgucuccuccgaguccacccccaagaccuccgccuccugcucccccgcccccgagucccccauguccuccuccgaguccgucaagucccucaccgagcucguccagcagcccugcccccccaucgaggccuccaaggacuccaagccccccgagcccuccgacccccccgccuccgacucccagcccaccaccccccucccccucuccggccacuccgcccucuccauccaggagcucgucgccaugucccccgagcucgacaccuacggcaucaccaagcgcgucaaggagguccucaccgacaacaaccucggccagcgccucuucggcgagaccauccucggccucacccagggcuccgucuccgaccuccucgcccgccccaagcccuggcacaagcucucccucaagggccgcgagcccuucguccgcaugcagcucuggcucaacgaccccaacaacgucgagaagcucauggacaugaagcgcauggagaagaaggccuacaugaagcgccgccacuccuccgucuccgacucccagcccugcgagccccccuccgucggcaccgaguacucccagggcgccuccccccagccccagcaccagcucaagaagccccgcgucguccucgcccccgaggagaaggaggcccucaagcgcgccuaccagcagaagcccuaccccucccccaagaccaucgaggaccucgccacccagcucaaccucaagaccuccaccgucaucaacugguuccacaacuaccgcucccgcauccgccgcgagcucuucaucgaggagauccaggccggcucccagggccaggccggcgccuccgacucccccuccgcccgcuccggccgcgccgcccccuccuccgagggcgacuccugcgacggcgucgaggccaccgagggccccggcuccgccgacaccgaggagcccaagucccagggcgaggccgagcgcgaggaggucccccgccccgccgagcagaccgagcccccccccuccggcacccccggccccgacgacgcccgcgacgacgaccacgagggcggccccgucgagggccccggcccccuccccucccccgccuccgccaccgccaccgccgcccccgccgcccccgaggacgccgccaccuccgccgccgccgcccccggcgagggccccgccgcccccuccuccgcccccccccccuccaacuccuccuccuccuccgccccccgccgccccuccucccuccagucccucuucggccuccccgaggccgccggcgcccgcgacucccgcgacaacccccuccgcaagaagaaggccgccaaccucaacuccaucauccaccgccucgagaaggccgccucccgcgaggagcccaucgagugggaguucuga

SEQ ID NO: 41916 - RNA, 4461 nt, Artificial Sequence
  derived and/or modified sequence opt2 from CUX2__Homo_sapiens__NP_056082
auggccgccaacgucggcuccauguuccaguacuggaagcgcuucgaccuccgccgccuccagaaggagcucaacuccgucgccuccgagcucuccgcccgccaggaggaguccgagcacucccacaagcaccucaucgagcuccgccgcgaguucaagaagaacguccccgaggagauccgcgagauggucgcccccguccucaaguccuuccaggccgaggucgucgcccucuccaagcgcucccaggaggccgaggccgccuuccucuccgucuacaagcagcucaucgaggcccccgaccccguccccgucuucgaggccgcccgcucccucgacgaccgccuccagccccccuccuucgaccccuccggccagccccgccgcgaccuccacaccuccuggaagcgcaaccccgagcuccucucccccaaggagcagcgcgagggcaccucccccgccggccccacccucaccgagggcucccgccuccccggcauccccggcaaggcccuccucaccgagacccuccuccagcgcaacgaggccgagaagcagaagggccuccaggagguccagaucacccucgccgcccgccucggcgaggccgaggagaagaucaagguccuccacuccgcccucaaggccacccaggccgagcuccucgagcuccgccgcaaguacgacgaggaggccgccuccaaggccgacgaggucggccucaucaugaccaaccucgagaaggccaaccagcgcgccgaggccgcccagcgcgaggucgagucccuccgcgagcagcucgccuccgucaacuccuccauccgccucgccugcugcuccccccagggccccuccggcgacaaggucaacuucacccucugcuccggcccccgccucgaggccgcccucgccuccaaggaccgcgagauccuccgccuccucaaggacguccagcaccuccaguccucccuccaggagcucgaggaggccuccgccaaccagaucgccgaccucgagcgccagcucaccgccaaguccgaggccaucgagaagcucgaggagaagcuccaggcccaguccgacuacgaggagaucaagaccgagcucuccauccucaaggccaugaagcucgccuccuccaccugcucccucccccagggcauggccaagcccgaggacucccuccucaucgccaaggaggccuucuuccccacccagaaguuccuccucgagaagcccucccuccucgccucccccgaggaggaccccuccgaggacgacuccaucaaggacucccucggcaccgagcaguccuaccccuccccccagcagcucccccccccccccggccccgaggacccccucucccccucccccggccagccccuccucggccccucccucggccccgacggcacccgcaccuucucccucucccccuuccccucccucgccuccggcgagcgccucaugaugccccccgccgccuucaagggcgaggccggcggccuccucgucuucccccccgccuucuacggcgccaagccccccaccgcccccgccacccccgcccccggccccgagccccucggcggccccgagcccgccgacggcggcggcggcggcgccgccggccccggcgccgaggaggagcagcucgacaccgccgagaucgccuuccaggucaaggagcagcuccucaagcacaacaucggccagcgcgucuucggccacuacguccucggccucucccagggcuccgucuccgagauccucgcccgccccaagcccuggcgcaagcucaccgucaagggcaaggagcccuucaucaagaugaagcaguuccucuccgacgagcagaacguccucgcccuccgcaccauccagguccgccagcgcggcuccaucaccccccgcauccgcacccccgagaccggcuccgacgacgccaucaaguccauccucgagcaggccaagaaggagaucgagucccagaagggcggcgagcccaagaccuccgucgccccccucuccaucgccaacggcaccacccccgccuccaccuccgaggacgccaucaaguccauccucgagcaggcccgccgcgagaugcaggcccagcagcaggcccuccucgagauggaggucgccccccgcggccgcuccgucccccccuccccccccgagcgccccucccucgccaccgccucccagaacggcgcccccgcccucgucaagcaggaggagggcuccggcggccccgcccaggccccccuccccguccucucccccgccgccuucguccaguccaucauccgcaaggucaaguccgagaucggcgacgccggcuacuucgaccaccacugggccuccgaccgcggccuccucucccgccccuacgccuccgucucccccucccucuccuccuccuccuccuccggcuacuccggccagcccaacggccgcgccuggccccgcggcgacgaggcccccgucccccccgaggacgaggccgccgccggcgccgaggacgagcccccccgcaccggcgagcucaaggccgagggcgccaccgccgaggccggcgcccgccuccccuacuaccccgccuacgucccccgcacccucaagcccaccguccccccccucacccccgagcaguacgagcucuacauguaccgcgaggucgacacccucgagcucacccgccaggucaaggagaagcucgccaagaacggcaucugccagcgcaucuucggcgagaagguccucggccucucccagggcuccgucuccgacaugcucucccgccccaagcccugguccaagcucacccagaagggccgcgagcccuucauccgcaugcagcucuggcucuccgaccagcucggccaggccgucggccagcagcccggcgccucccaggccucccccaccgagccccgcuccucccccucccccccccccucccccaccgagcccgagaaguccucccaggagccccucucccucucccucgaguccuccaaggagaaccagcagcccgagggccgcuccuccuccucccucuccggcaagauguacuccggcucccaggcccccggcggcauccaggagaucgucgccaugucccccgagcucgacaccuacuccaucaccaagcgcgucaaggagguccucaccgacaacaaccucggccagcgccucuucggcgaguccauccucggccucacccagggcuccgucuccgaccuccucucccgccccaagcccuggcacaagcucucccucaagggccgcgagcccuucguccgcaugcagcucuggcucaacgacccccacaacgucgagaagcuccgcgacaugaagaagcucgagaagaaggccuaccucaagcgccgcuacggccucaucuccaccggcuccgacuccgagucccccgccacccgcuccgagugccccucccccugccuccagccccaggaccucucccuccuccagaucaagaagccccgcgucguccucgcccccgaggagaaggaggcccuccgcaaggccuaccagcucgagcccuaccccucccagcagaccaucgagcuccucuccuuccagcucaaccucaagaccaacaccgucaucaacugguuccacaacuaccgcucccgcaugcgccgcgagaugcucgucgagggcacccaggacgagcccgaccucgaccccuccggcggccccggcauccucccccccggccacucccaccccgaccccaccccccagucccccgacuccgagaccgaggaccagaagcccaccgucaaggagcucgagcuccaggagggccccgaggagaacuccaccccccucaccacccaggacaaggcccagguccgcaucaagcaggagcagauggaggaggacgccgaggaggaggccggcucccagccccaggacuccggcgagcucgacaagggccagggcccccccaaggaggagcaccccgacccccccggcaacgacggccuccccaaggucgcccccggcccccuccuccccggcggcuccacccccgacugccccucccuccacccccagcaggaguccgaggccggcgagcgccuccaccccgacccccucuccuucaaguccgccuccgaguccucccgcugcucccucgaggucucccucaacucccccuccgccgccuccucccccggccucaugauguccgucucccccguccccuccuccuccgcccccaucucccccuccccccccggcgccccccccgccaagguccccuccgccucccccaccgccgacauggccggcgcccuccaccccuccgccaaggucaaccccaaccuccagcgccgccacgagaagauggccaaccucaacaacaucaucuaccgcgucgagcgcgccgccaaccgcgaggaggcccucgagugggaguucuga

SEQ ID NO: 41917 - RNA, 1824 nt, Artificial Sequence
  derived and/or modified sequence opt2 from CUZD1__Homo_sapiens__NP_071317
auggagcucguccgccgccucaugccccucacccuccucauccucuccugccucgccgagcucaccauggccgaggccgagggcaacgccuccugcaccgucucccucggcggcgccaacauggccgagacccacaaggccaugauccuccagcucaaccccuccgagaacugcaccuggaccaucgagcgccccgagaacaaguccauccgcaucaucuucuccuacguccagcucgaccccgacggcuccugcgaguccgagaacaucaaggucuucgacggcaccuccuccaacggcccccuccucggccaggucugcuccaagaacgacuacguccccgucuucgaguccuccuccuccacccucaccuuccagaucgucaccgacuccgcccgcauccagcgcaccgucuucgucuucuacuacuucuucucccccaacaucuccauccccaacugcggcggcuaccucgacacccucgagggcuccuucaccucccccaacuaccccaagccccaccccgagcucgccuacugcgucuggcacauccaggucgagaaggacuacaagaucaagcucaacuucaaggagaucuuccucgagaucgacaagcagugcaaguucgacuuccucgccaucuacgacggccccuccaccaacuccggccucaucggccaggucugcggccgcgucacccccaccuucgaguccuccuccaacucccucaccgucguccucuccaccgacuacgccaacuccuaccgcggcuucuccgccuccuacaccuccaucuacgccgagaacaucaacaccaccucccucaccugcuccuccgaccgcaugcgcgucaucaucuccaaguccuaccucgaggccuucaacuccaacggcaacaaccuccagcucaaggaccccaccugccgccccaagcucuccaacgucgucgaguucuccgucccccucaacggcugcggcaccauccgcaaggucgaggaccaguccaucaccuacaccaacaucaucaccuucuccgccuccuccaccuccgaggucaucacccgccagaagcagcuccagaucaucgucaagugcgagaugggccacaacuccaccgucgagaucaucuacaucaccgaggacgacgucauccagucccagaacgcccucggcaaguacaacaccuccauggcccucuucgaguccaacuccuucgagaagaccauccucgagucccccuacuacgucgaccucaaccagacccucuucguccaggucucccuccacaccuccgaccccaaccucgucgucuuccucgacaccugccgcgccucccccaccuccgacuucgccucccccaccuacgaccucaucaaguccggcugcucccgcgacgagaccugcaaggucuacccccucuucggccacuacggccgcuuccaguucaacgccuucaaguuccuccgcuccauguccuccgucuaccuccagugcaagguccucaucugcgacuccuccgaccaccagucccgcugcaaccagggcugcgucucccgcuccaagcgcgacaucuccuccuacaaguggaagaccgacuccaucaucggccccauccgccucaagcgcgaccgcuccgccuccggcaacuccggcuuccagcacgagacccacgccgaggagacccccaaccagcccuucaacuccguccaccucuucuccuucaugguccucgcccucaacgucgucaccgucgccaccaucaccguccgccacuucgucaaccagcgcgccgacuacaaguaccagaagcuccagaacuacuga

SEQ ID NO: 41918 - RNA, 2727 nt, Artificial Sequence
  derived and/or modified sequence opt2 from CWC22__Homo_sapiens__NP_065994
augaaguccuccgucgcccagaucaagcccuccuccggccacgaccgccgcgagaaccucaacuccuaccagcgcaacuccucccccgaggaccgcuacgaggagcaggagcgcuccccccgcgaccgcgacuacuucgacuacucccgcuccgacuacgagcacucccgccgcggccgcuccuacgacuccuccauggagucccgcaaccgcgaccgcgagaagcgccgcgagcgcgagcgcgacaccgaccgcaagcgcucccgcaagucccccucccccggccgccgcaaccccgagaccuccgucacccaguccuccuccgcccaggacgagcccgccaccaagaagaagaaggacgagcucgacccccuccucacccgcaccggcggcgccuacaucccccccgccaagcuccgcaugaugcaggagcagaucaccgacaagaacucccucgccuaccagcgcauguccugggaggcccucaagaaguccaucaacggccucaucaacaaggucaacaucuccaacaucuccaucaucauccaggagcuccuccaggagaacaucguccgcggccgcggccuccucucccgcuccguccuccaggcccaguccgccucccccaucuucacccacgucuacgccgcccucgucgccaucaucaacuccaaguucccccagaucggcgagcucauccucaagcgccucauccucaacuuccgcaagggcuaccgccgcaacgacaagcagcucugccucaccgccuccaaguucgucgcccaccucaucaaccagaacgucgcccacgagguccucugccucgagaugcucacccuccuccucgagcgccccaccgacgacuccgucgaggucgccaucggcuuccucaaggagugcggccucaagcucacccaggucuccccccgcggcaucaacgccaucuucgagcgccuccgcaacauccuccacgaguccgagaucgacaagcgcguccaguacaugaucgaggucauguucgccguccgcaaggacggcuucaaggaccaccccaucauccucgagggccucgaccucgucgaggaggacgaccaguucacccacaugcucccccucgaggacgacuacaaccccgaggacguccucaacgucuucaagauggaccccaacuucauggagaacgaggagaaguacaaggccaucaagaaggagauccucgacgagggcgacaccgacuccaacaccgaccaggacgccggcuccuccgaggaggacgaggaggaggaggaggaggagggcgaggaggacgaggagggccagaaggucaccauccacgacaagaccgagaucaaccucgucuccuuccgccgcaccaucuaccucgccauccaguccucccucgacuucgaggagugcgcccacaagcuccucaagauggaguuccccgagucccagaccaaggagcucugcaacaugauccucgacugcugcgcccagcagcgcaccuacgagaaguucuucggccuccucgccggccgcuucugcaugcucaagaaggaguacauggaguccuucgagggcaucuucaaggagcaguacgacaccauccaccgccucgagaccaacaagcuccgcaacgucgccaagauguucgcccaccuccucuacaccgacucccuccccugguccguccucgagugcaucaagcucuccgaggagaccaccaccuccuccucccgcaucuucgucaagaucuucuuccaggagcucugcgaguacaugggccuccccaagcucaacgcccgccucaaggacgagacccuccagcccuucuucgagggccuccucccccgcgacaacccccgcaacacccgcuucgccaucaacuucuucaccuccaucggccucggcggccucaccgacgagcuccgcgagcaccucaagaacacccccaaggucaucgucgcccagaagcccgacgucgagcagaacaaguccucccccuccuccuccuccuccgccuccuccuccuccgaguccgacuccuccgacuccgacuccgacuccuccgacuccuccuccgaguccuccuccgaggaguccgacuccuccuccaucuccucccacuccuccgccuccgccaacgacguccgcaagaagggccacggcaagacccgcuccaaggaggucgacaagcucauccgcaaccagcagaccaacgaccgcaagcagaaggagcgccgccaggagcacggccaccaggagacccgcaccgagcgcgagcgccgcuccgagaagcaccgcgaccagaacuccuccggcuccaacuggcgcgaccccaucaccaaguacaccuccgacaaggacguccccuccgagcgcaacaacuacucccgcgucgccaacgaccgcgaccaggagaugcacaucgaccucgagaacaagcacggcgaccccaagaagaagcgcggcgagcgccgcaacuccuucuccgagaacgagaagcacacccaccgcaucaaggacuccgagaacuuccgccgcaaggaccgcuccaaguccaaggagaugaaccgcaagcacuccggcucccgcuccgacgaggaccgcuaccagaacggcgccgagcgccgcugggagaaguccucccgcuacuccgagcagucccgcgaguccaagaagaaccaggaccgccgccgcgagaagucccccgccaagcagaaguga

SEQ ID NO: 41919 - RNA, 1176 nt, Artificial Sequence
  derived and/or modified sequence opt2 from CWC27__Homo_sapiens__NP_001284573
auguccaacaucuacauccaggagccccccaccaacggcaagguccuccucaagaccaccgccggcgacaucgacaucgagcucugguccaaggaggcccccaaggccugccgcaacuucauccagcucugccucgaggccuacuacgacaacaccaucuuccaccgcgucguccccggcuucaucguccagggcggcgaccccaccggcaccggcuccggcggcgaguccaucuacggcgcccccuucaaggacgaguuccacucccgccuccgcuucaaccgccgcggccucgucgccauggccaacgccggcucccacgacaacggcucccaguucuucuucacccucggccgcgccgacgagcucaacaacaagcacaccaucuucggcaaggucaccggcgacaccgucuacaacaugcuccgccucuccgaggucgacaucgacgacgacgagcgcccccacaacccccacaagaucaaguccugcgagguccucuucaaccccuucgacgacaucaucccccgcgagaucaagcgccucaagaaggagaagcccgaggaggaggucaagaagcucaagcccaagggcaccaagaacuucucccuccucuccuucggcgaggaggccgaggaggaggaggaggaggucaaccgcgucucccaguccaugaagggcaaguccaaguccucccacgaccuccucaaggacgacccccaccucuccuccguccccgucgucgaguccgagaagggcgacgcccccgaccucgucgacgacggcgaggacgaguccgccgagcacgacgaguacaucgacggcgacgagaagaaccucaugcgcgagcgcaucgccaagaagcucaagaaggacaccuccgccaacgucaaguccgccggcgagggcgaggucgagaagaaguccgucucccgcuccgaggagcuccgcaaggaggcccgccagcucaagcgcgagcuccucgccgccaagcagaagaaggucgagaacgccgccaagcaggccgagaagcgcuccgaggaggaggaggccccccccgacggcgccgucgccgaguaccgccgcgagaagcagaaguacgaggcccuccgcaagcagcaguccaagaagggcaccucccgcgaggaccaggacgucaccugcaccuccgucuga

SEQ ID NO: 41920 - RNA, 1497 nt, Artificial Sequence
  derived and/or modified sequence opt2 from CWF19L1__Homo_sapiens__NP_001290333
auggcccagaagccccuccgccuccucgccugcggcgacgucgagggcaaguucgacauccucuucaaccgcguccaggccauccagaagaaguccggcaacuucgaccuccuccucugcgucggcaacuucuucggcuccacccaggacgccgagugggaggaguacaagaccggcaucaagaaggcccccauccagaccuacguccucggcgccaacaaccaggagaccgucaaguacuuccaggacgccgacggcugcgagcucgccgagaacaucaccuaccucggccgcaagggcaucuucaccggcuccuccggccuccagaucgucuaccucuccggcaccgagucccucaacgagcccguccccggcuacuccuucucccccaaggacgucuccucccuccgcaugaugcucugcaccaccucccaguucaagggcgucgacauccuccucaccucccccuggcccaagugcgucggcaacuucggcaacuccuccggcgaggucgacaccaagaagugcggcuccgcccucgucuccucccucgccaccggccucaagccccgcuaccacuucgccgcccucgagaagaccuacuacgagcgccuccccuaccgcaaccacaucauccuccaggagaacgcccagcacgccacccgcuucaucgcccucgccaacgucggcaaccccgagaagaagaaguaccucuacgccuucuccaucguccccaugaagcucauggacgccgccgagcucgucaagcagccccccgacgucaccgagaaccccuaccgcaaguccggccaggaggccuccaucggcaagcagauccucgcccccgucgaggaguccgccugccaguucuucuucgaccucaacgagaagcagggccgcaagcgcuccuccaccggccgcgacuccaaguccuccccccaccccaagcagccccgcaagcccccccagccccccggccccugcugguucugccucgccucccccgaggucgagaagcaccucgucgucaacaucggcacccacugcuaccucgcccucgccaagggcggccucuccgacgaccacguccucauccuccccaucggccacuaccaguccgucgucgagcucuccgccgaggucgucgaggaggucgagaaguacaaggccacccuccgccgcuucuucaagucccgcggcaaguggugcgucgucuucgagcgcaacuacaagucccaccaccuccagcuccagaucgcccagcccggcgccgccuacuucuacgucgagcucgacaccggcgagaagcucuuccaccgcaucaagaagaacuucccccuccaguucggccgcgagguccucgccuccgaggccauccucaacguccccgacaaguccgacuggcgccagugccagaucuccaaggaggacgaggagacccucgcccgccgcuuccgcaaggacuucgagcccuacgacuucacccucgacgacuga

SEQ ID NO: 41921 - RNA, 2685 nt, Artificial Sequence
  derived and/or modified sequence opt2 from CWF19L2__Homo_sapiens__NP_689647
auggccaccuccauggccgccgccuccggccgcuucgaguccgccaaguccaucgaggagcgcaaggagcagacccgcaacgcccgcgccgagguccuccgccaggccaaggccaacuucgagaaggaggagcgccgcaaggagcucaagcgccuccgcggcgaggacaccuggaugcuccccgacgucaacgagcgcaucgagcaguucucccaggagcacuccgucaagaagaagaagaagaaggacaagcacuccaagaaggccaagaaggagaagaagaagaaguccaagaagcagaaguacgagaagaacaacgaguccuccgacuccuccuccuccuccgaggacgagugggucgaggccguccccucccagacccccgacaaggagaaggccuggaaggucaaggacgagaaguccggcaaggacgacacccagaucaucaagcgcgacgaguggaugaccgucgacuucauguccgucaagaccgucuccuccuccucccucaaggccgagaaggagaccaugcgcaagaucgagcaggagaagaaccaggcccucgagcaguccaagcucauggagcgcgagcucaaccccuacuggaaggacggcggcaccggccucccccccgaggacugcuccgucuccuccaucaccaaggucuccgucgucgaggacggcggccucuccuggcuccgcaaguccuaccuccgcaugaaggagcaggccgagaagcagucccgcaacuucgaggacaucgucgccgagcgcuacggcuccauggagaucuuccaguccaagcucgaggacgccgagaaggccgccuccaccaaggaggacuaccgccgcgagcgcuggcgcaagcccaccuacuccgacaaggcccagaacugccaggagucccgcgaguccgaccucgucaaguacggcaacuccucccgcgaccgcuacgccaccaccgacaccgccaagaacuccaacaacgagaaguucaucggcgacgagaaggacaagcgccccggcucccucgagaccugccgccgcgaguccaacccccgccagaaccaggaguucuccuucggcaaccuccgcgccaaguuccuccgccccuccgacgacgaggagcucuccuuccacuccaagggccgcaaguucgagccccucuccuccuccuccgcccucgucgcccagggcucccucugcuccggcuuccgcaagcccaccaagaacuccgaggagcgccucaccuccuggucccgcuccgacggccgcggcgacaagaagcacuccaaccagaagcccuccgagaccuccaccgacgagcaccagcacguccccgaggacccccgcgagaagucccaggacgagguccuccgcgacgacccccccaagaaggagcaccuccgcgacaccaaguccaccuucgccggcucccccgagcgcgaguccauccacauccucuccgucgacgagaagaacaagcucggcgccaagaucaucaaggccgagaugaugggcaacauggagcucgccgagcagcucaagguccagcucgagaaggccaacaaguucaaggagaccaucacccagauccccaagaaguccggcgucgagaacgaggaccagcaggaggucauccucguccgcaccgaccaguccggccgcgucuggcccgucaacacccccggcaagucccucgagucccagggcggccgccgcaagcgccagauggucuccacccacgaggagcgcgagcgcguccgcuacuuccacgacgacgacaaccucucccucaacgaccucgucaagaacgagaagaugggcaccgccgagaaccagaacaagcucuucaugcgcauggccuccaaguucaugggcaagaccgacggcgacuacuacacccucgacgacauguucgucuccaaggccgccgagcgcgagcgccucggcgaggaggaggagaaccagcgcaagaaggccaucgccgagcaccgcucccucgccgcccagauggagaagugccucuacugcuucgacuccucccaguuccccaagcaccucaucgucgccaucggcgucaaggucuaccucugccuccccaacguccgcucccucaccgagggccacugccucaucgucccccuccagcaccaccgcgccgccacccuccucgacgaggacaucugggaggagauccagauguuccgcaagucccucgucaagauguucgaggacaagggccucgacugcaucuuccucgagaccaacauguccaugaagaagcaguaccacauggucuacgagugcaucccccuccccaaggaggucggcgacauggcccccaucuacuucaagaaggccaucauggaguccgacgaggagugguccaugaacaagaagcucaucgaccucuccuccaaggacauccgcaaguccgucccccgcggccuccccuacuucuccgucgacuucggccuccacggcggcuucgcccacgucaucgaggaccagcacaaguucccccacuacuucggcaaggagaucaucggcggcaugcucgacaucgagccccgccucuggcgcaagggcauccgcgaguccuucgaggaccagcgcaagaaggcccuccaguucgcccagugguggaagcccuacgacuucaccaaguccaagaacuacuga

SEQ ID NO: 41922 - RNA, 2100 nt, Artificial Sequence
  derived and/or modified sequence opt2 from CWH43__Homo_sapiens__NP_079363
augcccucccucuggcgcgagauccuccucgagucccuccucggcugcgucuccuggucccucuaccacgaccucggccccaugaucuacuacuucccccuccagacccucgagcucaccggccucgagggcuucuccaucgccuuccucucccccaucuuccucaccaucacccccuucuggaagcucgucaacaagaaguggaugcucacccuccuccgcaucaucaccaucggcuccaucgccuccuuccaggcccccaacgccaagcuccgccucaugguccucgcccucggcgucuccuccucccucaucguccaggccgucaccuggugguccggcucccaccuccagcgcuaccuccgcaucuggggcuucauccucggccagaucguccucgucguccuccgcaucugguacaccucccucaaccccaucugguccuaccagauguccaacaaggucauccucacccucuccgccaucgccacccucgaccgcaucggcaccgacggcgacugcuccaagcccgaggagaagaagaccggcgaggucgccaccggcauggccucccgccccaacuggcuccucgccggcgccgccuucggcucccucgucuuccucacccacugggucuucggcgaggucucccucgucucccgcugggccgucuccggccacccccaccccggccccgaccccaaccccuucggcggcgccguccuccucugccucgccuccggccucaugcuccccuccugccucugguuccgcggcaccggccucaucuggugggucaccggcaccgccuccgccgccggccuccucuaccuccacaccugggccgccgccgucuccggcugcgucuucgccaucuucaccgccuccauguggccccagacccucggccaccucaucaacuccggcaccaaccccggcaagaccaugaccaucgccaugaucuucuaccuccucgagaucuucuucugcgccuggugcaccgccuucaaguucguccccggcggcgucuacgcccgcgagcgcuccgacguccuccucggcaccaugaugcucaucaucggccucaacaugcucuucggccccaagaagaaccucgaccuccuccuccagaccaagaacuccuccaagguccucuuccgcaaguccgagaaguacaugaagcucuuccucuggcuccucgucggcgucggccuccucggccucggccuccgccacaaggccuacgagcgcaagcucggcaaggucgcccccaccaaggaggucuccgccgccaucuggcccuuccgcuucggcuacgacaacgagggcugguccucccucgagcgcuccgcccaccuccucaacgagaccggcgccgacuucaucaccauccucgaguccgacgccuccaagcccuacaugggcaacaacgaccucaccauguggcucggcgagaagcucggcuucuacaccgacuucggccccuccacccgcuaccacaccuggggcaucauggcccucucccgcuaccccaucgucaaguccgagcaccaccuccuccccucccccgagggcgagaucgcccccgccaucacccucaccgucaacaucuccggcaagcucgucgacuucgucgucacccacuucggcaaccacgaggacgaccucgaccgcaagcuccaggccaucgccgucuccaagcuccucaaguccuccuccaaccaggucaucuuccucggcuacaucaccuccgcccccggcucccgcgacuaccuccagcucaccgagcacggcaacgucaaggacaucgacuccaccgaccacgaccgcuggugcgaguacaucauguaccgcggccucauccgccucggcuacgcccgcaucucccacgccgagcucuccgacuccgagauccagauggccaaguuccgcauccccgacgaccccaccaacuaccgcgacaaccagaaggucgucaucgaccaccgcgaggucuccgagaagauccacuucaacccccgcuucggcuccuacaaggagggccacaacuacgagaacaaccaccacuuccacaugaacacccccaaguacuuccucuga

SEQ ID NO: 41923 - RNA, 1194 nt, Artificial Sequence
  derived and/or modified sequence opt2 from CX3CL1__Homo_sapiens__NP_002987
auggcccccaucucccucuccuggcuccuccgccucgccaccuucugccaccucaccguccuccucgccggccagcaccacggcgucaccaagugcaacaucaccugcuccaagaugaccuccaagauccccgucgcccuccucauccacuaccagcagaaccaggccuccugcggcaagcgcgccaucauccucgagacccgccagcaccgccucuucugcgccgaccccaaggagcagugggucaaggacgccaugcagcaccucgaccgccaggccgccgcccucacccgcaacggcggcaccuucgagaagcagaucggcgaggucaagccccgcaccacccccgccgccggcggcauggacgaguccgucguccucgagcccgaggccaccggcgaguccuccucccucgagcccacccccuccucccaggaggcccagcgcgcccucggcaccucccccgagcuccccaccggcgucaccggcuccuccggcacccgccucccccccacccccaaggcccaggacggcggccccgucggcaccgagcucuuccgcgucccccccgucuccaccgccgccaccuggcaguccuccgccccccaccagcccggccccucccucugggccgaggccaagaccuccgaggcccccuccacccaggaccccuccacccaggccuccaccgccuccucccccgcccccgaggagaacgcccccuccgagggccagcgcgucuggggccagggccaguccccccgccccgagaacucccucgagcgcgaggagaugggccccguccccgcccacaccgacgccuuccaggacuggggccccggcuccauggcccacgucuccgucguccccgucuccuccgagggcacccccucccgcgagcccgucgccuccggcuccuggacccccaaggccgaggagcccauccacgccaccauggacccccagcgccucggcguccucaucacccccguccccgacgcccaggccgccacccgccgccaggccgucggccuccucgccuuccucggccuccucuucugccucggcgucgccauguucaccuaccagucccuccagggcugcccccgcaagauggccggcgagauggccgagggccuccgcuacaucccccgcuccugcggcuccaacuccuacguccucguccccgucuga

SEQ ID NO: 41924 - RNA, 1164 nt, Artificial Sequence
  derived and/or modified sequence opt2 from CX3CR1__Homo_sapiens__NP_001164645
augcgcgagccccucgaggccuucaagcucgccgaccucgacuuccgcaaguccucccucgccuccggcuggcgcauggccuccggcgccuucaccauggaccaguuccccgaguccgucaccgagaacuucgaguacgacgaccucgccgaggccugcuacaucggcgacaucgucgucuucggcaccgucuuccucuccaucuucuacuccgucaucuucgccaucggccucgucggcaaccuccucgucgucuucgcccucaccaacuccaagaagcccaaguccgucaccgacaucuaccuccucaaccucgcccucuccgaccuccucuucgucgccacccuccccuucuggacccacuaccucaucaacgagaagggccuccacaacgccaugugcaaguucaccaccgccuucuucuucaucggcuucuucggcuccaucuucuucaucaccgucaucuccaucgaccgcuaccucgccaucguccucgccgccaacuccaugaacaaccgcaccguccagcacggcgucaccaucucccucggcgucugggccgccgccauccucgucgccgccccccaguucauguucaccaagcagaaggagaacgagugccucggcgacuaccccgagguccuccaggagaucuggcccguccuccgcaacgucgagaccaacuuccucggcuuccuccucccccuccucaucauguccuacugcuacuuccgcaucauccagacccucuucuccugcaagaaccacaagaaggccaaggccaucaagcucauccuccucgucgucaucgucuucuuccucuucuggacccccuacaacgucaugaucuuccucgagacccucaagcucuacgacuucuuccccuccugcgacaugcgcaaggaccuccgccucgcccucuccgucaccgagaccgucgccuucucccacugcugccucaacccccucaucuacgccuucgccggcgagaaguuccgccgcuaccucuaccaccucuacggcaagugccucgccguccucugcggccgcuccguccacgucgacuucuccuccuccgagucccagcgcucccgccacggcuccguccucuccuccaacuucaccuaccacaccuccgacggcgacgcccuccuccuccucuga

SEQ ID NO: 41925 - RNA, 603 nt, Artificial Sequence
  derived and/or modified sequence opt2 from CXADR__Homo_sapiens__NP_001193993
auggcccuccuccucugcuucguccuccucugcggcgucgucgacuucgcccgcucccucuccaucaccacccccgaggagaugaucgagaaggccaagggcgagaccgccuaccuccccugcaaguucacccucucccccgaggaccagggcccccucgacaucgaguggcucaucucccccgccgacaaccagaaggucgaccaggucaucauccucuacuccggcgacaagaucuacgacgacuacuaccccgaccucaagggccgcguccacuucaccuccaacgaccucaaguccggcgacgccuccaucaacgucaccaaccuccagcucuccgacaucggcaccuaccagugcaaggucaagaaggcccccggcgucgccaacaagaagauccaccucgucguccucggcaagaugugccaccuccagcgcgccguccgcccccuccccgaggccaccuccgccgucaucauccaccccuggggccccugccuccuccccaccuggaaggacaucccccgccucuccaucaccaaguaccaggucaagacccucaacgcccuccuccgcguccgccucucccaccuccuccgcuga

SEQ ID NO: 41926 - RNA, 297 nt, Artificial Sequence
  derived and/or modified sequence opt2 from CXCL10__Homo_sapiens__NP_001556
augaaccagaccgccauccucaucugcugccucaucuuccucacccucuccggcauccagggcgucccccucucccgcaccguccgcugcaccugcaucuccaucuccaaccagcccgucaacccccgcucccucgagaagcucgagaucauccccgccucccaguucugcccccgcgucgagaucaucgccaccaugaagaagaagggcgagaagcgcugccucaaccccgaguccaaggccaucaagaaccuccucaaggccgucuccaaggagcgcuccaagcgcucccccuga

SEQ ID NO: 41927 - RNA, 285 nt, Artificial Sequence
  derived and/or modified sequence opt2 from CXCL11__Homo_sapiens__NP_005400
auguccgucaagggcauggccaucgcccucgccgucauccucugcgccaccgucguccagggcuuccccauguucaagcgcggccgcugccucugcaucggccccggcgucaaggccgucaaggucgccgacaucgagaaggccuccaucauguaccccuccaacaacugcgacaagaucgaggucaucaucacccucaaggagaacaagggccagcgcugccucaaccccaaguccaagcaggcccgccucaucaucaagaaggucgagcgcaagaacuucuga

SEQ ID NO: 41928 - RNA, 282 nt, Artificial Sequence
  derived and/or modified sequence opt2 from CXCL12__Homo_sapiens__NP_000600
augaacgccaaggucgucgucguccucguccucguccucaccgcccucugccucuccgacggcaagcccgucucccucuccuaccgcugccccugccgcuucuucgagucccacgucgcccgcgccaacgucaagcaccucaagauccucaacacccccaacugcgcccuccagaucgucgcccgccucaagaacaacaaccgccaggucugcaucgaccccaagcucaaguggauccaggaguaccucgagaaggcccucaacaagcgcuucaagauguga

SEQ ID NO: 41929 - RNA, 330 nt, Artificial Sequence
  derived and/or modified sequence opt2 from CXCL13__Homo_sapiens__NP_006410
augaaguucaucuccaccucccuccuccucaugcuccucgucuccucccucucccccguccagggcguccucgaggucuacuacaccucccuccgcugccgcugcguccaggaguccuccgucuucaucccccgccgcuucaucgaccgcauccagauccucccccgcggcaacggcugcccccgcaaggagaucaucgucuggaagaagaacaaguccaucgucugcgucgacccccaggccgaguggauccagcgcaugauggagguccuccgcaagcgcuccuccuccacccuccccguccccgucuucaagcgcaagauccccuga

SEQ ID NO: 41930 - RNA, 336 nt, Artificial Sequence
  derived and/or modified sequence opt2 from CXCL14__Homo_sapiens__NP_004878
augucccuccucccccgccgcgccccccccgucuccaugcgccuccucgccgccgcccuccuccuccuccuccucgcccucuacaccgcccgcgucgacggcuccaagugcaagugcucccgcaagggccccaagauccgcuacuccgacgucaagaagcucgagaugaagcccaaguacccccacugcgaggagaagauggucaucaucaccaccaaguccgucucccgcuaccgcggccaggagcacugccuccaccccaagcuccaguccaccaagcgcuucaucaagugguacaacgccuggaacgagaagcgccgcgucuacgaggaguga

SEQ ID NO: 41931 - RNA, 822 nt, Artificial Sequence
  derived and/or modified sequence opt2 from CXCL16__Homo_sapiens__NP_001094282
auguccggcucccaguccgaggucgcccccuccccccaguccccccgcucccccgagaugggccgcgaccuccgccccggcucccgcguccuccuccuccuccuccuccuccuccucgucuaccucacccagcccggcaacggcaacgagggcuccgucaccggcuccugcuacugcggcaagcgcaucuccuccgacuccccccccuccguccaguucaugaaccgccuccgcaagcaccuccgcgccuaccaccgcugccucuacuacacccgcuuccagcuccucuccugguccgucugcggcggcaacaaggaccccuggguccaggagcucauguccugccucgaccucaaggagugcggccacgccuacuccggcaucgucgcccaccagaagcaccuccuccccaccuccccccccaucucccaggccuccgagggcgccuccuccgacauccacacccccgcccagaugcuccucuccacccuccaguccacccagcgccccacccuccccgucggcucccucuccuccgacaaggagcucacccgccccaacgagaccaccauccacaccgccggccacucccucgccgccggccccgaggccggcgagaaccagaagcagcccgagaagaacgccggccccaccgcccgcaccuccgccaccguccccguccucugccuccucgccaucaucuucauccucaccgccgcccucuccuacguccucugcaagcgccgccgcggccaguccccccaguccucccccgaccuccccguccacuacauccccgucgcccccgacuccaacaccuga

SEQ ID NO: 41932 - RNA, 360 nt, Artificial Sequence
  derived and/or modified sequence opt2 from CXCL17__Homo_sapiens__NP_940879
augaagguccucaucuccucccuccuccuccuccucccccucaugcucauguccauggucuccuccucccucaaccccggcgucgcccgcggccaccgcgaccgcggccaggccucccgccgcuggcuccaggagggcggccaggagugcgagugcaaggacugguuccuccgcgccccccgccgcaaguucaugaccgucuccggccuccccaagaagcagugccccugcgaccacuucaagggcaacgucaagaagacccgccaccagcgccaccaccgcaagcccaacaagcacucccgcgccugccagcaguuccucaagcagugccagcuccgcuccuucgcccucccccucuga

SEQ ID NO: 41933 - RNA, 324 nt, Artificial Sequence
  derived and/or modified sequence opt2 from CXCL1__Homo_sapiens__NP_001502
auggcccgcgccgcccucuccgccgcccccuccaacccccgccuccuccgcgucgcccuccuccuccuccuccucgucgccgccggccgccgcgccgccggcgccuccgucgccaccgagcuccgcugccagugccuccagacccuccagggcauccaccccaagaacauccaguccgucaacgucaagucccccggcccccacugcgcccagaccgaggucaucgccacccucaagaacggccgcaaggccugccucaaccccgccucccccaucgucaagaagaucaucgagaagaugcucaacuccgacaaguccaacuga

SEQ ID NO: 41934 - RNA, 324 nt, Artificial Sequence
  derived and/or modified sequence opt2 from CXCL2__Homo_sapiens__NP_002080
auggcccgcgccacccucuccgccgcccccuccaacccccgccuccuccgcgucgcccuccuccuccuccuccucgucgccgccucccgccgcgccgccggcgccccccucgccaccgagcuccgcugccagugccuccagacccuccagggcauccaccucaagaacauccaguccgucaaggucaagucccccggcccccacugcgcccagaccgaggucaucgccacccucaagaacggccagaaggccugccucaaccccgccucccccauggucaagaagaucaucgagaagaugcucaagaacggcaaguccaacuga

SEQ ID NO: 41935 - RNA, 324 nt, Artificial Sequence
  derived and/or modified sequence opt2 from CXCL3__Homo_sapiens__NP_002081
auggcccacgccacccucuccgccgcccccuccaacccccgccuccuccgcgucgcccuccuccuccuccuccucgucgccgccucccgccgcgccgccggcgccuccgucgucaccgagcuccgcugccagugccuccagacccuccagggcauccaccucaagaacauccaguccgucaacguccgcucccccggcccccacugcgcccagaccgaggucaucgccacccucaagaacggcaagaaggccugccucaaccccgccucccccaugguccagaagaucaucgagaagauccucaacaagggcuccaccaacuga

SEQ ID NO: 41936 - RNA, 345 nt, Artificial Sequence
  derived and/or modified sequence opt2 from CXCL5__Homo_sapiens__NP_002985
augucccuccucuccucccgcgccgcccgcguccccggccccuccuccucccucugcgcccuccucguccuccuccuccuccucacccagcccggccccaucgccuccgccggccccgccgccgccguccuccgcgagcuccgcugcgucugccuccagaccacccagggcguccaccccaagaugaucuccaaccuccaggucuucgccaucggcccccagugcuccaaggucgaggucgucgccucccucaagaacggcaaggagaucugccucgaccccgaggcccccuuccucaagaaggucauccagaagauccucgacggcggcaacaaggagaacuga

SEQ ID NO: 41937 - RNA, 345 nt, Artificial Sequence
  derived and/or modified sequence opt2 from CXCL6__Homo_sapiens__NP_002984
augucccuccccuccucccgcgccgcccgcguccccggccccuccggcucccucugcgcccuccucgcccuccuccuccuccucaccccccccggcccccucgccuccgccggccccgucuccgccguccucaccgagcuccgcugcaccugccuccgcgucacccuccgcgucaaccccaagaccaucggcaagcuccaggucuuccccgccggcccccagugcuccaaggucgaggucgucgccucccucaagaacggcaagcaggucugccucgaccccgaggcccccuuccucaagaaggucauccagaagauccucgacuccggcaacaagaagaacuga

SEQ ID NO: 41938 - RNA, 300 nt, Artificial Sequence
  derived and/or modified sequence opt2 from CXCL8__Homo_sapiens__NP_000575
augaccuccaagcucgccgucgcccuccucgccgccuuccucaucuccgccgcccucugcgagggcgccguccucccccgcuccgccaaggagcuccgcugccagugcaucaagaccuacuccaagcccuuccaccccaaguucaucaaggagcuccgcgucaucgaguccggcccccacugcgccaacaccgagaucaucgucaagcucuccgacggccgcgagcucugccucgaccccaaggagaacuggguccagcgcgucgucgagaaguuccucaagcgcgccgagaacuccuga

SEQ ID NO: 41939 - RNA, 378 nt, Artificial Sequence
  derived and/or modified sequence opt2 from CXCL9__Homo_sapiens__NP_002407
augaagaaguccggcguccucuuccuccucggcaucauccuccucguccucaucggcguccagggcacccccgucguccgcaagggccgcugcuccugcaucuccaccaaccagggcaccauccaccuccagucccucaaggaccucaagcaguucgcccccucccccuccugcgagaagaucgagaucaucgccacccucaagaacggcguccagaccugccucaaccccgacuccgccgacgucaaggagcucaucaagaagugggagaagcaggucucccagaagaagaagcagaagaacggcaagaagcaccagaagaagaagguccucaagguccgcaagucccagcgcucccgccagaagaagaccaccuga

SEQ ID NO: 41940 - RNA, 1053 nt, Artificial Sequence
  derived and/or modified sequence opt2 from CXCR1__Homo_sapiens__NP_000625
auguccaacaucaccgacccccagaugugggacuucgacgaccucaacuucaccggcaugccccccgccgacgaggacuacucccccugcaugcucgagaccgagacccucaacaaguacgucgucaucaucgccuacgcccucgucuuccuccucucccuccucggcaacucccucgucaugcucgucauccucuacucccgcgucggccgcuccgucaccgacgucuaccuccucaaccucgcccucgccgaccuccucuucgcccucacccuccccaucugggccgccuccaaggucaacggcuggaucuucggcaccuuccucugcaaggucgucucccuccucaaggaggucaacuucuacuccggcauccuccuccucgccugcaucuccgucgaccgcuaccucgccaucguccacgccacccgcacccucacccagaagcgccaccucgucaaguucgucugccucggcugcuggggccucuccaugaaccucucccuccccuucuuccucuuccgccaggccuaccaccccaacaacuccucccccgucugcuacgagguccucggcaacgacaccgccaaguggcgcaugguccuccgcauccucccccacaccuucggcuucaucgucccccucuucgucaugcucuucugcuacggcuucacccuccgcacccucuucaaggcccacaugggccagaagcaccgcgccaugcgcgucaucuucgccgucguccucaucuuccuccucugcuggcuccccuacaaccucguccuccucgccgacacccucaugcgcacccaggucauccaggaguccugcgagcgccgcaacaacaucggccgcgcccucgacgccaccgagauccucggcuuccuccacuccugccucaaccccaucaucuacgccuucaucggccagaacuuccgccacggcuuccucaagauccucgccaugcacggccucgucuccaaggaguuccucgcccgccaccgcgucaccuccuacaccuccuccuccgucaacgucuccuccaaccucuga

SEQ ID NO: 41941 - RNA, 1083 nt, Artificial Sequence
  derived and/or modified sequence opt2 from CXCR2__Homo_sapiens__NP_001161770
auggaggacuucaacauggaguccgacuccuucgaggacuucuggaagggcgaggaccucuccaacuacuccuacuccuccacccucccccccuuccuccucgacgccgcccccugcgagcccgagucccucgagaucaacaaguacuucgucgucaucaucuacgcccucgucuuccuccucucccuccucggcaacucccucgucaugcucgucauccucuacucccgcgucggccgcuccgucaccgacgucuaccuccucaaccucgcccucgccgaccuccucuucgcccucacccuccccaucugggccgccuccaaggucaacggcuggaucuucggcaccuuccucugcaaggucgucucccuccucaaggaggucaacuucuacuccggcauccuccuccucgccugcaucuccgucgaccgcuaccucgccaucguccacgccacccgcacccucacccagaagcgcuaccucgucaaguucaucugccucuccaucuggggccucucccuccuccucgcccuccccguccuccucuuccgccgcaccgucuacuccuccaacgucucccccgccugcuacgaggacaugggcaacaacaccgccaacuggcgcaugcuccuccgcauccucccccaguccuucggcuucaucgucccccuccucaucaugcucuucugcuacggcuucacccuccgcacccucuucaaggcccacaugggccagaagcaccgcgccaugcgcgucaucuucgccgucguccucaucuuccuccucugcuggcuccccuacaaccucguccuccucgccgacacccucaugcgcacccaggucauccaggagaccugcgagcgccgcaaccacaucgaccgcgcccucgacgccaccgagauccucggcauccuccacuccugccucaacccccucaucuacgccuucaucggccagaaguuccgccacggccuccucaagauccucgccauccacggccucaucuccaaggacucccuccccaaggacucccgccccuccuucgucggcuccuccuccggccacaccuccaccacccucuga

SEQ ID NO: 41942 - RNA, 1248 nt, Artificial Sequence
  derived and/or modified sequence opt2 from CXCR3__Homo_sapiens__NP_001136269
auggagcuccgcaaguacggccccggccgccucgccggcaccgucaucggcggcgccgcccaguccaagucccagaccaaguccgacuccaucaccaaggaguuccuccccggccucuacaccgcccccuccucccccuucccccccucccaggucuccgaccaccagguccucaacgacgccgaggucgccgcccuccucgagaacuucuccuccuccuacgacuacggcgagaacgaguccgacuccugcugcaccuccccccccugcccccaggacuucucccucaacuucgaccgcgccuuccuccccgcccucuacucccuccucuuccuccucggccuccucggcaacggcgccgucgccgccguccuccucucccgccgcaccgcccucuccuccaccgacaccuuccuccuccaccucgccgucgccgacacccuccucguccucacccucccccucugggccgucgacgccgccguccagugggucuucggcuccggccucugcaaggucgccggcgcccucuucaacaucaacuucuacgccggcgcccuccuccucgccugcaucuccuucgaccgcuaccucaacaucguccacgccacccagcucuaccgccgcggcccccccgcccgcgucacccucaccugccucgccgucuggggccucugccuccucuucgcccuccccgacuucaucuuccucuccgcccaccacgacgagcgccucaacgccacccacugccaguacaacuucccccaggucggccgcaccgcccuccgcguccuccagcucgucgccggcuuccuccucccccuccucgucauggccuacugcuacgcccacauccucgccguccuccucgucucccgcggccagcgccgccuccgcgccaugcgccucgucgucgucgucgucgucgccuucgcccucugcuggacccccuaccaccucgucguccucgucgacauccucauggaccucggcgcccucgcccgcaacugcggccgcgagucccgcgucgacgucgccaaguccgucaccuccggccucggcuacaugcacugcugccucaacccccuccucuacgccuucgucggcgucaaguuccgcgagcgcauguggaugcuccuccuccgccucggcugccccaaccagcgcggccuccagcgccagcccuccuccucccgccgcgacuccuccugguccgagaccuccgaggccuccuacuccggccucuga

SEQ ID NO: 41943 - RNA, 1071 nt, Artificial Sequence
  derived and/or modified sequence opt2 from CXCR4__Homo_sapiens__NP_001008540
auguccaucccccucccccuccuccagaucuacaccuccgacaacuacaccgaggagaugggcuccggcgacuacgacuccaugaaggagcccugcuuccgcgaggagaacgccaacuucaacaagaucuuccuccccaccaucuacuccaucaucuuccucaccggcaucgucggcaacggccucgucauccucgucaugggcuaccagaagaagcuccgcuccaugaccgacaaguaccgccuccaccucuccgucgccgaccuccucuucgucaucacccuccccuucugggccgucgacgccgucgccaacugguacuucggcaacuuccucugcaaggccguccacgucaucuacaccgucaaccucuacuccuccguccucauccucgccuucaucucccucgaccgcuaccucgccaucguccacgccaccaacucccagcgcccccgcaagcuccucgccgagaaggucgucuacgucggcgucuggauccccgcccuccuccucaccauccccgacuucaucuucgccaacgucuccgaggccgacgaccgcuacaucugcgaccgcuucuaccccaacgaccucugggucgucgucuuccaguuccagcacaucauggucggccucauccuccccggcaucgucauccucuccugcuacugcaucaucaucuccaagcucucccacuccaagggccaccagaagcgcaaggcccucaagaccaccgucauccucauccucgccuucuucgccugcuggcuccccuacuacaucggcaucuccaucgacuccuucauccuccucgagaucaucaagcagggcugcgaguucgagaacaccguccacaaguggaucuccaucaccgaggcccucgccuucuuccacugcugccucaaccccauccucuacgccuuccucggcgccaaguucaagaccuccgcccagcacgcccucaccuccgucucccgcggcuccucccucaagauccucuccaagggcaagcgcggcggccacuccuccgucuccaccgaguccgaguccuccuccuuccacuccuccuga

SEQ ID NO: 41944 - RNA, 1119 nt, Artificial Sequence
  derived and/or modified sequence opt2 from CXCR5__Homo_sapiens__NP_001707
augaacuacccccucacccucgagauggaccucgagaaccucgaggaccucuucugggagcucgaccgccucgacaacuacaacgacaccucccucgucgagaaccaccucugccccgccaccgagggcccccucauggccuccuucaaggccgucuucguccccgucgccuacucccucaucuuccuccucggcgucaucggcaacguccucguccucgucauccucgagcgccaccgccagacccgcuccuccaccgagaccuuccucuuccaccucgccgucgccgaccuccuccucgucuucauccuccccuucgccgucgccgagggcuccgucggcuggguccucggcaccuuccucugcaagaccgucaucgcccuccacaaggucaacuucuacugcuccucccuccuccucgccugcaucgccgucgaccgcuaccucgccaucguccacgccguccacgccuaccgccaccgccgccuccucuccauccacaucaccugcggcaccaucuggcucgucggcuuccuccucgcccuccccgagauccucuucgccaaggucucccagggccaccacaacaacucccucccccgcugcaccuucucccaggagaaccaggccgagacccacgccugguucaccucccgcuuccucuaccacgucgccggcuuccuccuccccaugcucgucaugggcuggugcuacgucggcgucguccaccgccuccgccaggcccagcgccgcccccagcgccagaaggccguccgcgucgccauccucgucaccuccaucuucuuccucugcuggucccccuaccacaucgucaucuuccucgacacccucgcccgccucaaggccgucgacaacaccugcaagcucaacggcucccuccccgucgccaucaccaugugcgaguuccucggccucgcccacugcugccucaaccccaugcucuacaccuucgccggcgucaaguuccgcuccgaccucucccgccuccucaccaagcucggcugcaccggccccgccucccucugccagcucuuccccuccuggcgccgcuccucccucuccgaguccgagaacgccaccucccucaccaccuucuga

SEQ ID NO: 41945 - RNA, 1029 nt, Artificial Sequence
  derived and/or modified sequence opt2 from CXCR6__Homo_sapiens__NP_006555
auggccgagcacgacuaccacgaggacuacggcuucuccuccuucaacgacuccucccaggaggagcaccaggacuuccuccaguucuccaaggucuuccuccccugcauguaccucgucgucuucgucugcggccucgucggcaacucccucguccucgucaucuccaucuucuaccacaagcuccagucccucaccgacgucuuccucgucaaccucccccucgccgaccucgucuucgucugcacccuccccuucugggccuacgccggcauccacgagugggucuucggccaggucaugugcaagucccuccucggcaucuacaccaucaacuucuacaccuccaugcucauccucaccugcaucaccgucgaccgcuucaucgucgucgucaaggccaccaaggccuacaaccagcaggccaagcgcaugaccuggggcaaggucaccucccuccucaucugggucaucucccuccucgucucccucccccagaucaucuacggcaacgucuucaaccucgacaagcucaucugcggcuaccacgacgaggccaucuccaccgucguccucgccacccagaugacccucggcuucuuccucccccuccucaccaugaucgucugcuacuccgucaucaucaagacccuccuccacgccggcggcuuccagaagcaccgcucccucaagaucaucuuccucgucauggccgucuuccuccucacccagaugcccuucaaccucaugaaguucauccgcuccacccacugggaguacuacgccaugaccuccuuccacuacaccaucauggucaccgaggccaucgccuaccuccgcgccugccucaaccccguccucuacgccuucgucucccucaaguuccgcaagaacuucuggaagcucgucaaggacaucggcugccuccccuaccucggcgucucccaccaguggaaguccuccgaggacaacuccaagaccuucuccgccucccacaacgucgaggccaccuccauguuccagcucuga

SEQ ID NO: 41946 - RNA, 549 nt, Artificial Sequence
  derived and/or modified sequence opt2 from CXorf36__Homo_sapiens__NP_078965
auggagccccagcucggccccgaggccgccgcccuccgccccggcuggcucgcccuccuccucugggucuccgcccucuccugcuccuucucccuccccgccuccucccucuccucccucgucccccagguccgcaccuccuacaacuucggccgcaccuuccucggccucgacaagugcaacgccugcaucggcaccuccaucugcaagaaguucuucaaggaggagauccgcuccgacaacuggcucgccucccaccucggccucccccccgacucccuccucuccuaccccgccaacuacuccgacgacuccaagaucuggcgccccgucgagaucuuccgccucgucuccaaguaccagaacgagaucuccgaccgccgcaucugcgccuccgccuccgcccccaagaccugcuccaucgagcgcguccuccgcaagaccgagcgcuuccagaaguggcuccaggccaagcgccucacccccgaccucguccaggacugccaccagggccagcgcgagcucaaguuccucugcaugcuccgcuga

SEQ ID NO: 41947 - RNA, 1086 nt, Artificial Sequence
  derived and/or modified sequence opt2 from CXorf66__Homo_sapiens__NP_001013421
augaaccucgucaucugcguccuccuccucuccaucuggaagaacaacugcaugaccaccaaccagaccaacggcuccuccaccaccggcgacaagcccgucgaguccaugcagaccaagcucaacuaccuccgccgcaaccuccucauccucgucggcaucaucaucauggucuucgucuucaucugcuucugcuaccuccacuacaacugccucuccgacgacgccuccaaggccggcauggucaagaagaagggcaucgccgccaaguccuccaagaccuccuucuccgaggccaagaccgccucccagugcucccccgagacccagcccaugcucuccaccgccgacaaguccuccgacuccuccucccccgagcgcgccuccgcccaguccuccaccgagaagcucauccgccccuccucccuccagaagcccuccauccccaacuccgccggcaagcucacccgccccuccuaccccaagcgcuccuccaaguccuccugcuccaagaagcucuccaaguccucccaccucgagaaggcccacaagaagggcucccucgagaagcucugcaagcucgacuacgccugcaagcucgccuccuccgacaagcccguccgccccccccagcucuucaagccccucuacuccucccacccccagaacgagaucucccccuccaagcccuucggcccccaggagcucgccaagccccccaagcacuucaaccccaagcgcuccgucucccucggccgcgccgcccuccucuccaacuccgagcucgccgagaccugccagcccuacaagaagaagcaccucgucgccaagaccuaccgcccccucgucaacgacaucuccgaggccaaggagaagaacacccagaaccuccacgucuccuccaaggucaaguccuccucccgcuccuuccgcaagcucgacucccgcaacaacgccuacggcgaccacgucaacgacuccgacaccaugaaguacuacuccgaggucgacuccgacaaggucaucaucaucaccugcgaccgcggcuacaaccaggucaccuccgaggucacccucaacgacuga

SEQ ID NO: 41948 - RNA, 1512 nt, Artificial Sequence
  derived and/or modified sequence opt2 from CXorf67__Homo_sapiens__NP_981952
auggccacccaguccgacauggagaaggagcagaagcaccagcaggacgagggccagggcggccucaacaacgagaccgcccucgccuccggcgacgccugcggcaccggcaaccaggaccccgccgccuccgucaccaccgucuccucccaggccucccccuccggcggcgccgcccucuccuccuccaccgccggcuccuccgccgccgccgccaccuccgccgccaucuucaucaccgacgaggccuccggccuccccaucaucgccgccguccucaccgagcgccacuccgaccgccaggacugccgcuccccccacgaggucuucggcugcgucguccccgagggcggcucccaggccgccgucggcccccagaaggccaccggccacgccgacgagcaccucgcccagaccaagucccccggcaacucccgccgccgcaagcagcccugccgcaaccaggccgcccccgcccagaagccccccggccgccgccucuuccccgagccccucccccccuccucccccggcuuccgccccuccuccuaccccugcuccggcgccuccaccuccucccaggccacccagcccggccccgcccuccucucccacgccuccgaggcccgccccgccacccgcucccgcaucacccucgucgccuccgcccuccgccgccgcgccuccggccccggccccgucauccgcggcugcaccgcccagcccggccccgccuucccccaccgcgccacccaccucgaccccgcccgccucucccccgaguccgcccccggccccgcccgccgcggccgcgccuccguccccggccccgcccgccgcggcugcgacuccgcccccggccccgcccgccgcggccgcgacuccgcccccgucuccgccccccgcggccgcgacuccgcccccggcuccgcccgccgcggccgcgacuccgcccccggccccgcccuccgcguccgcaccgcccgcuccgacgccggccaccgcuccaccuccaccacccccggcaccggccuccgcucccgcuccacccagcagcgcuccgcccuccucucccgccgcucccucuccggcuccgccgacgagaaccccuccugcggcaccggcuccgagcgccucgccuuccagucccgcuccggcucccccgaccccgagguccccucccgcgccuccccccccgucuggcacgccguccgcaugcgcgccuccucccccuccccccccggccgcuucuuccuccccaucccccagcagugggacgaguccuccuccuccuccuacgccuccaacuccuccucccccucccgcucccccggccucucccccuccucccccucccccgaguuccucggccuccgcuccaucuccacccccucccccgagucccuccgcuacgcccucaugcccgaguucuacgcccucucccccgucccccccgaggagcaggccgagaucgaguccaccgcccaccccgccaccccccccgagcccuga

SEQ ID NO: 41949 - RNA, 1983 nt, Artificial Sequence
  derived and/or modified sequence opt2 from CXXC1__Homo_sapiens__NP_001095124
auggagggcgacggcuccgaccccgagccccccgacgccggcgaggacuccaaguccgagaacggcgagaacgcccccaucuacugcaucugccgcaagcccgacaucaacugcuucaugaucggcugcgacaacugcaacgagugguuccacggcgacugcauccgcaucaccgagaagauggccaaggccauccgcgagugguacugccgcgagugccgcgagaaggaccccaagcucgagauccgcuaccgccacaagaagucccgcgagcgcgacggcaacgagcgcgacuccuccgagccccgcgacgagggcggcggccgcaagcgccccguccccgaccccgaccuccagcgccgcgccggcuccggcaccggcgucggcgccaugcucgcccgcggcuccgccuccccccacaaguccuccccccagccccucgucgccacccccucccagcaccaccagcagcagcagcagcagaucaagcgcuccgcccgcaugugcggcgagugcgaggccugccgccgcaccgaggacugcggccacugcgacuucugccgcgacaugaagaaguucggcggccccaacaagauccgccagaagugccgccuccgccagugccagcuccgcgcccgcgaguccuacaaguacuuccccuccucccucucccccgucacccccuccgagucccucccccgcccccgccgcccccuccccacccagcagcagccccagcccucccagaagcucggccgcauccgcgaggacgagggcgccgucgccuccuccaccgucaaggagccccccgaggccaccgccacccccgagccccucuccgacgaggaccucccccucgaccccgaccucuaccaggacuucugcgccggcgccuucgacgaccacggccuccccuggauguccgacaccgaggagucccccuuccucgaccccgcccuccgcaagcgcgccgucaaggucaagcacgucaagcgccgcgagaagaaguccgagaagaaggucauggagcgcaaggaggagcgcuacaagcgccaccgccagaagcagaagcacaaggacaaguggaagcaccccgagcgcgccgacgccaaggaccccgccucccucccccagugccucggccccggcugcguccgccccgcccagcccuccuccaaguacugcuccgacgacugcggcaugaagcucgccgccaaccgcaucuacgagauccucccccagcgcauccagcaguggcagcagucccccugcaucgccgaggagcacggcaagaagcuccucgagcgcauccgccgcgagcagcaguccgcccgcacccgccuccaggagauggagcgccgcuuccacgagcucgaggccaucauccuccgcgccaagcagcaggccguccgcgaggacgaggaguccaacgagggcgacuccgacgacaccgaccuccagaucuucugcgucuccugcggccaccccaucaacccccgcgucgcccuccgccacauggagcgcugcuacgccaaguacgagucccagaccuccuucggcuccauguaccccacccgcaucgagggcgccacccgccucuucugcgacgucuacaacccccaguccaagaccuacugcaagcgccuccagguccucugccccgagcacucccgcgaccccaagguccccgccgacgaggucugcggcugcccccucguccgcgacgucuucgagcucaccggcgacuucugccgccuccccaagcgccagugcaaccgccacuacugcugggagaagcuccgccgcgccgaggucgaccucgagcgcguccgcgucugguacaagcucgacgagcucuucgagcaggagcgcaacguccgcaccgccaugaccaaccgcgccggccuccucgcccucaugcuccaccagaccauccagcacgacccccucaccaccgaccuccgcuccuccgccgaccgcuga

SEQ ID NO: 41950 - RNA, 1104 nt, Artificial Sequence
  derived and/or modified sequence opt2 from CXXC4__Homo_sapiens__NP_079488
augaacaccaacgucugcgucgagcccggccccucccccgaggcccccggccuccccaaggagucccaccuccccgagggcgcccucaacucccucgucgacuacaacuccgagauggagcgcuaccgcuccuucgccaccuccuucuacaagaccaacggcggcgccuucccccaggccgccaagaucgcccgcaucaccacccccaucuuccccuccuccgccgccgccgccgccgccgccgcccgcaucggcaugucccccuggaacugcgacaacgccgccaccgccgccgccgccaccgccaugcucuggggcuccggcggcggcggcggcggcggcggcggcggcggcggcggcggcggcggcggcggcggcggcggcggcggcggcggcggcggccgcaaguccuccuccgccgccgccuccuccuccgccuccuccuccuccgccauccuccccgccggcggcggcggcggcggcggcggcggcggcucccgcaccuccaugcaccaccgcaacgacucccagcgccucggcaaggccggcugcccccccgagcccucccuccagauggccaacaccaacuuccucuccacccucucccccgagcacugccgcccccucgccggcgagugcaugaacaagcucaagugcggcgccgccgaggccgagaucaugaaccuccccgagcgcgucggcaccuucuccgccauccccgcccucggcggcaucucccucccccccggcgucaucgucaugaccgcccuccacucccccgccgccgccuccgccgccgucaccgacuccgccuuccagaucgccaaccucgccgacugcccccagaaccacuccuccuccuccuccuccuccuccggcggcgccggcggcgccaaccccgccaagaagaagcgcaagcgcugcggcgucugcguccccugcaagcgccucaucaacugcggcgucugcuccuccugccgcaaccgcaagaccggccaccagaucugcaaguuccgcaagugcgaggagcucaagaagaagcccggcaccucccucgagcgcacccccguccccuccgccgaggccuuccgcugguucuucuga

SEQ ID NO: 41951 - RNA, 669 nt, Artificial Sequence
  derived and/or modified sequence opt2 from CYB561D2__Homo_sapiens__NP_001278213
auggcccucuccgccgagaccgagucccacaucuaccgcgcccuccgcaccgccuccggcgccgccgcccaccucgucgcccucggcuucaccaucuucgucgccguccucgcccgccccggcuccucccucuucuccuggcaccccguccucaugucccucgccuucuccuuccucaugaccgaggcccuccucgucuucucccccgaguccucccuccuccacucccucucccgcaagggccgcgcccgcugccacuggguccuccagcuccucgcccuccucugcgcccuccucggccucggccucgucauccuccacaaggagcagcucggcaaggcccaccucgucacccgccacggccaggccggccuccucgccguccucugggccggccuccagugcuccggcggcgucggccuccucuaccccaagcuccucccccgcuggccccucgccaagcucaagcucuaccacgccaccuccggccucgucggcuaccuccucggcuccgccucccuccuccucggcaugugcucccucugguucaccgccuccgucaccggcgccgccugguaccucgccguccucugccccguccucaccucccucgucaucaugaaccaggucuccaacgccuaccucuaccgcaagcgcauccagcccuga

SEQ ID NO: 41952 - RNA, 756 nt, Artificial Sequence
  derived and/or modified sequence opt2 from CYB561__Homo_sapiens__XP_005257148
auggagggcggcgccgccgccgccacccccaccgcccuccccuacuacgucgccuucucccagcuccucggccucacccucgucgccaugaccggcgccuggcucggccucuaccgcggcggcaucgccugggaguccgaccuccaguucaacgcccacccccucugcauggucaucggccucaucuuccuccagggcaacgcccuccucgucuaccgcgucuuccgcaacgaggccaagcgcaccaccaagguccuccacggccuccuccacaucuucgcccucgucaucgcccucgucggccucgucgccgucuucgacuaccaccgcaagaagggcuacgccgaccucuacucccuccacuccuggugcggcauccucgucuucguccucuacuucguccaguggcucgucggcuucuccuucuuccucuuccccggcgccuccuucucccuccgcucccgcuaccgcccccagcacaucuucuucggcgccaccaucuuccuccucuccgucggcaccgcccuccucggccucaaggaggcccuccucuucaaccucggcggcaaguacuccgccuucgagcccgagggcguccucgccaacguccucggccuccuccucgccugcuucggcggcgccguccucuacauccucacccgcgccgacuggaagcgccccucccaggccgaggagcaggcccucuccauggacuucaagacccucaccgagggcgacucccccggcucccaguga

SEQ ID NO: 41953 - RNA, 375 nt, Artificial Sequence
  derived and/or modified sequence opt2 from CYB5A__Homo_sapiens__NP_001177736
auggccgagcaguccgacgaggccgucaaguacuacacccucgaggagauccagaagcacaaccacuccaaguccaccuggcucauccuccaccacaaggucuacgaccucaccaaguuccucgaggagcaccccggcggcgaggagguccuccgcgagcaggccggcggcgacgccaccgagaacuucgaggacgucggccacuccaccgacgcccgcgagauguccaagaccuucaucaucggcgagcuccaccccgagacccucaucaccaccaucgacuccuccuccuccugguggaccaacugggucauccccgccaucuccgccgucgccgucgcccucauguaccgccucuacauggccgaggacuga

SEQ ID NO: 41954 - RNA, 453 nt, Artificial Sequence
  derived and/or modified sequence opt2 from CYB5B__Homo_sapiens__NP_085056
auguccggcuccauggccaccgccgaggccuccggcuccgacggcaagggccaggaggucgagaccuccgucaccuacuaccgccucgaggaggucgccaagcgcaacucccucaaggagcucuggcucgucauccacggccgcgucuacgacgucacccgcuuccucaacgagcaccccggcggcgaggagguccuccucgagcaggccggcgucgacgccuccgaguccuucgaggacgucggccacuccuccgacgcccgcgagaugcucaagcaguacuacaucggcgacauccaccccuccgaccucaagcccgaguccggcuccaaggaccccuccaagaacgacaccugcaaguccugcugggccuacuggauccuccccaucaucggcgccguccuccucggcuuccucuaccgcuacuacaccuccgaguccaaguccuccuga

SEQ ID NO: 41955 - RNA, 906 nt, Artificial Sequence
  derived and/or modified sequence opt2 from CYB5R3__Homo_sapiens__NP_000389
augggcgcccagcucuccacccucggccacaugguccucuuccccgucugguuccucuacucccuccucaugaagcucuuccagcgcuccacccccgccaucacccucgagucccccgacaucaaguacccccuccgccucaucgaccgcgagaucaucucccacgacacccgccgcuuccgcuucgcccuccccuccccccagcacauccucggccuccccgucggccagcacaucuaccucuccgcccgcaucgacggcaaccucgucguccgccccuacacccccaucuccuccgacgacgacaagggcuucgucgaccucgucaucaaggucuacuucaaggacacccaccccaaguuccccgccggcggcaagaugucccaguaccucgaguccaugcagaucggcgacaccaucgaguuccgcggccccuccggccuccucgucuaccagggcaagggcaaguucgccauccgccccgacaagaaguccaaccccaucauccgcaccgucaaguccgucggcaugaucgccggcggcaccggcaucacccccaugcuccaggucauccgcgccaucaugaaggaccccgacgaccacaccgucugccaccuccucuucgccaaccagaccgagaaggacauccuccuccgccccgagcucgaggagcuccgcaacaagcacuccgcccgcuucaagcucugguacacccucgaccgcgcccccgaggccugggacuacggccagggcuucgucaacgaggagaugauccgcgaccaccuccccccccccgaggaggagccccucguccucaugugcggccccccccccaugauccaguacgccugccuccccaaccucgaccacgucggccaccccaccgagcgcugcuucgucuucuga

SEQ ID NO: 41956 - RNA, 1566 nt, Artificial Sequence
  derived and/or modified sequence opt2 from CYB5R4__Homo_sapiens__NP_057314
augcucaacguccccucccaguccuuccccgccccccgcucccagcagcgcgucgccuccggcggccgcuccaaggucccccucaagcagggccgcucccucauggacuggauccgccucaccaaguccggcaaggaccucaccggccucaagggccgccucaucgaggucaccgaggaggagcucaagaagcacaacaagaaggacgacugcuggaucugcauccgcggcuucgucuacaacgucucccccuacauggaguaccaccccggcggcgaggacgagcucaugcgcgccgccggcuccgacggcaccgagcucuucgaccagguccaccgcugggucaacuacgaguccaugcucaaggagugccucgucggccgcauggccaucaagcccgccguccucaaggacuaccgcgaggaggagaagaagguccucaacggcaugcuccccaagucccaggucaccgacacccucgccaaggagggccccuccuaccccuccuacgacugguuccagaccgacucccucgucaccaucgccaucuacaccaagcagaaggacaucaaccucgacuccaucaucgucgaccaccagaacgacuccuuccgcgccgagaccaucaucaaggacugccucuaccucauccacaucggccucucccacgagguccaggaggacuucuccguccgcgucgucgaguccgucggcaagaucgagaucguccuccagaagaaggagaacaccuccugggacuuccucggccacccccucaagaaccacaacucccucaucccccgcaaggacaccggccucuacuaccgcaagugccagcucaucuccaaggaggacgucacccacgacacccgccucuucugccucaugcucccccccuccacccaccuccagguccccaucggccagcacgucuaccucaagcuccccaucaccggcaccgagaucgucaagcccuacacccccgucuccggcucccuccucuccgaguucaaggagcccguccuccccaacaacaaguacaucuacuuccucaucaagaucuaccccaccggccucuucacccccgagcucgaccgccuccagaucggcgacuucgucuccgucuccucccccgagggcaacuucaagaucuccaaguuccaggagcucgaggaccucuuccuccucgccgccggcaccggcuucacccccauggucaagauccucaacuacgcccucaccgacauccccucccuccgcaaggucaagcucauguucuucaacaagaccgaggacgacaucaucuggcgcucccagcucgagaagcucgccuucaaggacaagcgccucgacgucgaguucguccucuccgcccccaucuccgaguggaacggcaagcagggccacaucucccccgcccuccucuccgaguuccucaagcgcaaccucgacaaguccaagguccucgucugcaucugcggccccguccccuucaccgagcagggcguccgccuccuccacgaccucaacuucuccaagaacgagauccacuccuucaccgccuga

SEQ ID NO: 41957 - RNA, 588 nt, Artificial Sequence
  derived and/or modified sequence opt2 from CYBA__Homo_sapiens__NP_000092
augggccagaucgagugggccaugugggccaacgagcaggcccucgccuccggccucauccucaucaccggcggcaucgucgccaccgccggccgcuucacccagugguacuucggcgccuacuccaucgucgccggcgucuucgucugccuccucgaguacccccgcggcaagcgcaagaagggcuccaccauggagcgcuggggccagaaguacaugaccgccgucgucaagcucuucggccccuucacccgcaacuacuacguccgcgccguccuccaccuccuccucuccguccccgccggcuuccuccucgccaccauccucggcaccgccugccucgccaucgccuccggcaucuaccuccucgccgccguccgcggcgagcaguggacccccaucgagcccaagccccgcgagcgcccccagaucggcggcaccaucaagcagccccccuccaacccccccccccgcccccccgccgaggcccgcaagaagcccuccgaggaggaggccgccgucgccgccggcggcccccccggcggcccccaggucaaccccauccccgucaccgacgaggucgucuga

SEQ ID NO: 41958 - RNA, 1713 nt, Artificial Sequence
  derived and/or modified sequence opt2 from CYBB__Homo_sapiens__NP_000388
augggcaacugggccgucaacgagggccucuccaucuucgucauccucgucuggcucggccucaacgucuuccucuucgucugguacuaccgcgucuacgacaucccccccaaguucuucuacacccgcaagcuccucggcuccgcccucgcccucgcccgcgcccccgccgccugccucaacuucaacugcaugcucauccuccuccccgucugccgcaaccuccucuccuuccuccgcggcuccuccgccugcugcuccacccgcguccgccgccagcucgaccgcaaccucaccuuccacaagauggucgccuggaugaucgcccuccacuccgccauccacaccaucgcccaccucuucaacgucgaguggugcgucaacgcccgcgucaacaacuccgaccccuacuccgucgcccucuccgagcucggcgaccgccagaacgaguccuaccucaacuucgcccgcaagcgcaucaagaaccccgagggcggccucuaccucgccgucacccuccucgccggcaucaccggcgucgucaucacccucugccucauccucaucaucaccuccuccaccaagaccauccgccgcuccuacuucgaggucuucugguacacccaccaccucuucgucaucuucuucaucggccucgccauccacggcgccgagcgcaucguccgcggccagaccgccgagucccucgccguccacaacaucaccgucugcgagcagaagaucuccgaguggggcaagaucaaggagugccccaucccccaguucgccggcaacccccccaugaccuggaaguggaucgucggccccauguuccucuaccucugcgagcgccucguccgcuucuggcgcucccagcagaaggucgucaucaccaaggucgucacccaccccuucaagaccaucgagcuccagaugaagaagaagggcuucaagauggaggucggccaguacaucuucgucaagugccccaaggucuccaagcucgaguggcaccccuucacccucaccuccgcccccgaggaggacuucuucuccauccacauccgcaucgucggcgacuggaccgagggccucuucaacgccugcggcugcgacaagcaggaguuccaggacgccuggaagcuccccaagaucgccgucgacggccccuucggcaccgccuccgaggacgucuucuccuacgaggucgucaugcucgucggcgccggcaucggcgucacccccuucgccuccauccucaaguccgucugguacaaguacugcaacaacgccaccaaccucaagcucaagaagaucuacuucuacuggcucugccgcgacacccacgccuucgagugguucgccgaccuccuccagcuccucgagucccagaugcaggagcgcaacaacgccggcuuccucuccuacaacaucuaccucaccggcugggacgagucccaggccaaccacuucgccguccaccacgacgaggagaaggacgucaucaccggccucaagcagaagacccucuacggccgccccaacugggacaacgaguucaagaccaucgccucccagcaccccaacacccgcaucggcgucuuccucugcggccccgaggcccucgccgagacccucuccaagcaguccaucuccaacuccgaguccggcccccgcggcguccacuucaucuucaacaaggagaacuucuga

SEQ ID NO: 41959 - RNA, 474 nt, Artificial Sequence
  derived and/or modified sequence opt2 from CYBRD1__Homo_sapiens__NP_001120855
auggccauggagggcuacuggcgcuuccucgcccuccucggcuccgcccuccucgucggcuuccucuccgucaucuucgcccucgucuggguccuccacuaccgcgagggccucggcugggacggcuccgcccucgaguucaacuggcaccccguccucauggucaccggcuucgucuucauccagggcaucgccuccuuccgcuucuucucccucuccgccuccaugggcuccgccuucucccccuccaucucccacgcccacaccugccucuucuggaacugccaccucuggaacuccgacugcaacuccaccuacggcaucgaccgcgagaccgacuucuuccccgagcgcuccugcauccaguacauccccgcccgccgcugcuuccgcaaguacgccuggcccuccgaccccggcguccgcggcccccacuuccucgacucccaccagaccgccauggagaccuccuga

SEQ ID NO: 41960 - RNA, 978 nt, Artificial Sequence
  derived and/or modified sequence opt2 from CYC1__Homo_sapiens__NP_001907
auggccgccgccgccgccucccuccgcggcgucguccucggcccccgcggcgccggccuccccggcgcccgcgcccgcggccuccucugcuccgcccgccccggccagcucccccuccgcaccccccaggccgucgcccucuccuccaaguccggccucucccgcggccgcaaggucaugcucuccgcccucggcaugcucgccgccggcggcgccggccucgccgucgcccuccacuccgccgucuccgccuccgaccucgagcuccacccccccuccuaccccuggucccaccgcggccuccucuccucccucgaccacaccuccauccgccgcggcuuccaggucuacaagcaggucugcgccuccugccacuccauggacuucgucgccuaccgccaccucgucggcgucugcuacaccgaggacgaggccaaggagcucgccgccgaggucgagguccaggacggccccaacgaggacggcgagauguucaugcgccccggcaagcucuucgacuacuuccccaagcccuaccccaacuccgaggccgcccgcgccgccaacaacggcgcccucccccccgaccucuccuacaucguccgcgcccgccacggcggcgaggacuacgucuucucccuccucaccggcuacugcgagccccccaccggcgucucccuccgcgagggccucuacuucaaccccuacuuccccggccaggccaucgccauggccccccccaucuacaccgacguccucgaguucgacgacggcacccccgccaccaugucccagaucgccaaggacgucugcaccuuccuccgcugggccuccgagcccgagcacgaccaccgcaagcgcaugggccucaagaugcucaugaugauggcccuccucgucccccucgucuacaccaucaagcgccacaagugguccguccucaagucccgcaagcucgccuaccgcccccccaaguga

SEQ ID NO: 41961 - RNA, 318 nt, Artificial Sequence
  derived and/or modified sequence opt2 from CYCS__Homo_sapiens__NP_061820
augggcgacgucgagaagggcaagaagaucuucaucaugaagugcucccagugccacaccgucgagaagggcggcaagcacaagaccggccccaaccuccacggccucuucggccgcaagaccggccaggcccccggcuacuccuacaccgccgccaacaagaacaagggcaucaucuggggcgaggacacccucauggaguaccucgagaaccccaagaaguacauccccggcaccaagaugaucuucgucggcaucaagaagaaggaggagcgcgccgaccucaucgccuaccucaagaaggccaccaacgaguga

SEQ ID NO: 41962 - RNA, 3762 nt, Artificial Sequence
  derived and/or modified sequence opt2 from CYFIP1__Homo_sapiens__NP_001274739
auggccgcccaggucacccucgaggacgcccucuccaacgucgaccuccucgaggagcucccccuccccgaccagcagcccugcaucgagcccccccccuccucccuccucuaccagcccaacuucaacaccaacuucgaggaccgcaacgccuucgucaccggcaucgcccgcuacaucgagcaggccaccguccacuccuccaugaacgagaugcucgaggagggccaggaguacgccgucaugcucuacaccuggcgcuccugcucccgcgccaucccccaggucaagugcaacgagcagcccaaccgcgucgagaucuacgagaagaccgucgagguccucgagcccgaggucaccaagcucaugaacuucauguacuuccagcgcaacgccaucgagcgcuucugcggcgagguccgccgccucugccacgccgagcgccgcaaggacuucgucuccgaggccuaccucaucacccucggcaaguucaucaacauguucgccguccucgacgagcucaagaacaugaagugcuccgucaagaacgaccacuccgccuacaagcgcgccgcccaguuccuccgcaagauggccgacccccaguccauccaggagucccagaaccucuccauguuccucgccaaccacaacaagaucacccagucccuccagcagcagcucgaggucaucuccggcuacgaggagcuccucgccgacaucgucaaccucugcgucgacuacuacgagaaccgcauguaccucacccccuccgagaagcacaugcuccucaaggucaugggcuucggccucuaccucauggacggcuccgucuccaacaucuacaagcucgacgccaagaagcgcaucaaccucuccaagaucgacaaguacuucaagcagcuccaggucgucccccucuucggcgacaugcagaucgagcucgcccgcuacaucaagaccuccgcccacuacgaggagaacaagucccgcuggaccugcaccuccuccggcuccuccccccaguacaacaucugcgagcagaugauccagauccgcgaggaccacaugcgcuucaucuccgagcucgcccgcuacuccaacuccgaggucgucaccggcuccggccgccaggaggcccagaagaccgacgccgaguaccgcaagcucuucgaccucgcccuccagggccuccagcuccucucccagugguccgcccacgucauggaggucuacuccuggaagcucguccaccccaccgacaaguacuccaacaaggacugccccgacuccgccgaggaguacgagcgcgccacccgcuacaacuacaccuccgaggagaaguucgcccucgucgaggucaucgccaugaucaagggccuccagguccucaugggccgcauggaguccgucuucaaccacgccauccgccacaccgucuacgccgcccuccaggacuucucccaggucacccuccgcgagccccuccgccaggccaucaagaagaagaagaacgucauccaguccguccuccaggccauccgcaagaccgucugcgacugggagaccggccacgagcccuucaacgaccccgcccuccgcggcgagaaggaccccaaguccggcuucgacaucaaggucccccgccgcgccgucggccccuccuccacccagcucuacaugguccgcaccaugcucgagucccucaucgccgacaaguccggcuccaagaagacccuccgcuccucccucgagggccccaccauccucgacaucgagaaguuccaccgcgaguccuucuucuacacccaccucaucaacuucuccgagacccuccagcagugcugcgaccucucccagcucugguuccgcgaguucuuccucgagcucaccaugggccgccgcauccaguuccccaucgagauguccaugcccuggauccucaccgaccacauccucgagaccaaggaggccuccaugauggaguacguccucuacucccucgaccucuacaacgacuccgcccacuacgcccucacccgcuucaacaagcaguuccucuacgacgagaucgaggccgaggucaaccucugcuucgaccaguucgucuacaagcucgccgaccagaucuucgccuacuacaaggucauggccggcucccuccuccucgacaagcgccuccgcuccgagugcaagaaccagggcgccaccauccaccucccccccuccaaccgcuacgagacccuccucaagcagcgccacguccagcuccucggccgcuccaucgaccucaaccgccucaucacccagcgcgucuccgccgccauguacaagucccucgagcucgccaucggccgcuucgaguccgaggaccucaccuccaucgucgagcucgacggccuccucgagaucaaccgcaugacccacaagcuccucucccgcuaccucacccucgacggcuucgacgccauguuccgcgaggccaaccacaacgucuccgcccccuacggccgcaucacccuccacgucuucugggagcucaacuacgacuuccuccccaacuacugcuacaacggcuccaccaaccgcuucguccgcaccguccuccccuucucccaggaguuccagcgcgacaagcagcccaacgcccagccccaguaccuccacggcuccaaggcccucaaccucgccuacuccuccaucuacggcuccuaccgcaacuucgucggccccccccacuuccaggucaucugccgccuccucggcuaccagggcaucgccgucgucauggaggagcuccucaaggucgucaagucccuccuccagggcaccauccuccaguacgucaagacccucauggaggucaugcccaagaucugccgccucccccgccacgaguacggcucccccggcauccucgaguucuuccaccaccagcucaaggacaucgucgaguacgccgagcucaagaccgucugcuuccagaaccuccgcgaggucggcaacgccauccucuucugccuccucaucgagcagucccucucccucgaggaggucugcgaccuccuccacgccgcccccuuccagaacauccucccccgcguccacgucaaggagggcgagcgccucgacgccaagaugaagcgccucgaguccaaguacgccccccuccaccucgucccccucaucgagcgccucggcaccccccagcagaucgccaucgcccgcgagggcgaccuccucaccaaggagcgccucugcugcggccucuccauguucgaggucauccucacccgcauccgcuccuuccucgacgaccccaucuggcgcggcccccuccccuccaacggcgucaugcacgucgacgagugcgucgaguuccaccgccucugguccgccaugcaguucgucuacugcauccccgucggcacccacgaguucaccgucgagcagugcuucggcgacggccuccacugggccggcugcaugaucaucguccuccucggccagcagcgccgcuucgccguccucgacuucugcuaccaccuccucaagguccagaagcacgacggcaaggacgagaucaucaagaacgucccccucaagaagauggucgagcgcauccgcaaguuccagauccucaacgacgagaucaucaccauccucgacaaguaccucaaguccggcgacggcgagggcacccccgucgagcacguccgcugcuuccagccccccauccaccagucccucgccuccuccuga

SEQ ID NO: 41963 - RNA, 3684 nt, Artificial Sequence
  derived and/or modified sequence opt2 from CYFIP2__Homo_sapiens__NP_001278650
augaccacccacgucacccucgaggacgcccucuccaacgucgaccuccucgaggagcucccccuccccgaccagcagcccugcaucgagcccccccccuccuccaucauguaccaggccaacuucgacaccaacuucgaggaccgcaacgccuucgucaccggcaucgcccgcuacaucgagcaggccaccguccacuccuccauggucaagugcaacgagcagcccaaccgcgucgagaucuacgagaagaccgucgagguccucgagcccgaggucaccaagcucaugaaguucauguacuuccagcgcaaggccaucgagcgcuucugcuccgaggucaagcgccucugccacgccgagcgccgcaaggacuucgucuccgaggccuaccuccucacccucggcaaguucaucaacauguucgccguccucgacgagcucaagaacaugaagugcuccgucaagaacgaccacuccgccuacaagcgcgccgcccaguuccuccgcaagauggccgacccccaguccauccaggagucccagaaccucuccauguuccucgccaaccacaaccgcaucacccagugccuccaccagcagcucgaggucauccccggcuacgaggagcuccucgccgacaucgucaacaucugcgucgacuacuacgagaacaagauguaccucacccccuccgagaagcacaugcuccucaaggucaugggcuucggccucuaccucauggacggcaacgucuccaacaucuacaagcucgacgccaagaagcgcaucaaccucuccaagaucgacaaguucuucaagcagcuccaggucgucccccucuucggcgacaugcagaucgagcucgcccgcuacaucaagaccuccgcccacuacgaggagaacaaguccaaguggaccugcacccaguccuccaucuccccccaguacaacaucugcgagcagaugguccagauccgcgacgaccacauccgcuucaucuccgagcucgcccgcuacuccaacuccgaggucgucaccggcuccggccucgacucccagaaguccgacgaggaguaccgcgagcucuucgaccucgcccuccgcggccuccagcuccucuccaagugguccgcccacgucauggaggucuacuccuggaagcucguccaccccaccgacaaguucugcaacaaggacugccccggcaccgccgaggaguacgagcgcgccacccgcuacaacuacaccuccgaggagaaguucgccuucgucgaggucaucgccaugaucaagggccuccagguccucaugggccgcauggaguccgucuucaaccaggccauccgcaacaccaucuacgccgcccuccaggacuucgcccaggucacccuccgcgagccccuccgccaggccguccgcaagaagaagaacguccucaucuccguccuccaggccauccgcaagaccaucugcgacugggagggcggccgcgagccccccaacgaccccugccuccgcggcgagaaggaccccaagggcggcuucgacaucaaggucccccgccgcgccgucggccccuccuccacccagcucuacaugguccgcaccaugcucgagucccucaucgccgacaaguccggcuccaagaagacccuccgcuccucccucgacggccccaucguccucgccaucgaggacuuccacaagcaguccuucuucuucacccaccuccucaacaucuccgaggcccuccagcagugcugcgaccucucccagcucugguuccgcgaguucuuccucgagcucaccaugggccgccgcauccaguuccccaucgagauguccaugcccuggauccucaccgaccacauccucgagaccaaggagcccuccaugauggaguacguccucuacccccucgaccucuacaacgacuccgccuacuacgcccucaccaaguucaagaagcaguuccucuacgacgagaucgaggccgaggucaaccucugcuucgaccaguucgucuacaagcucgccgaccagaucuucgccuacuacaaggccauggccggcuccguccuccucgacaagcgcuuccgcgccgagugcaagaacuacggcgucaucauccccuacccccccuccaaccgcuacgagacccuccucaagcagcgccacguccagcuccucggccgcuccaucgaccucaaccgccucaucacccagcgcaucuccgccgccauguacaagucccucgaccaggccaucucccgcuucgaguccgaggaccucaccuccaucgucgagcucgaguggcuccucgagaucaaccgccucacccaccgccuccucugcaagcacaugacccucgacuccuucgacgccauguuccgcgaggccaaccacaacgucuccgcccccuacggccgcaucacccuccacgucuucugggagcucaacuucgacuuccuccccaacuacugcuacaacggcuccaccaaccgcuucguccgcaccgccauccccuucacccaggagccccagcgcgacaagcccgccaacguccagcccuacuaccucuacggcuccaagccccucaacaucgccuacucccacaucuacuccuccuaccgcaacuucgucggccccccccacuucaagaccaucugccgccuccucggcuaccagggcaucgccgucgucauggaggagcuccucaagaucgucaagucccuccuccagggcaccauccuccaguacgucaagacccucaucgaggucaugcccaagaucugccgccucccccgccacgaguacggcucccccggcauccucgaguucuuccaccaccagcucaaggacaucaucgaguacgccgagcucaagaccgacgucuuccagucccuccgcgaggucggcaacgccauccucuucugccuccucaucgagcaggcccucucccaggaggaggucugcgaccuccuccacgccgcccccuuccagaacauccucccccgcgucuacaucaaggagggcgagcgccucgagguccgcaugaagcgccucgaggccaaguacgccccccuccaccucgucccccucaucgagcgccucggcaccccccagcagaucgccaucgcccgcgagggcgaccuccucaccaaggagcgccucugcugcggccucuccauguucgaggucauccucacccgcauccgcuccuaccuccaggaccccaucuggcgcggccccccccccaccaacggcgucaugcacgucgacgagugcgucgaguuccaccgccucugguccgccaugcaguucgucuacugcauccccgucggcaccaacgaguucaccgccgagcagugcuucggcgacggccucaacugggccggcugcuccaucaucguccuccucggccagcagcgccgcuucgaccucuucgacuucugcuaccaccuccucaagguccagcgccaggacggcaaggacgagaucaucaagaacgucccccucaagaagauggccgaccgcauccgcaaguaccagauccucaacaacgaggucuucgccauccucaacaaguacaugaaguccgucgagaccgacuccuccaccgucgagcacguccgcugcuuccagccccccauccaccagucccucgccaccaccugcuga

SEQ ID NO: 41964 - RNA, 573 nt, Artificial Sequence
  derived and/or modified sequence opt2 from CYGB__Homo_sapiens__NP_599030
auggagaagguccccggcgagauggagaucgagcgccgcgagcgcuccgaggagcucuccgaggccgagcgcaaggccguccaggccaugugggcccgccucuacgccaacugcgaggacgucggcgucgccauccucguccgcuucuucgucaacuuccccuccgccaagcaguacuucucccaguucaagcacauggaggacccccucgagauggagcgcuccccccagcuccgcaagcacgccugccgcgucaugggcgcccucaacaccgucgucgagaaccuccacgaccccgacaaggucuccuccguccucgcccucgucggcaaggcccacgcccucaagcacaaggucgagcccgucuacuucaagauccucuccggcgucauccucgaggucgucgccgaggaguucgccuccgacuucccccccgagacccagcgcgccugggccaagcuccgcggccucaucuacucccacgucaccgccgccuacaaggaggucggcuggguccagcagguccccaacgccaccaccccccccgccacccuccccuccuccggccccuga

SEQ ID NO: 41965 - RNA, 1956 nt, Artificial Sequence
  derived and/or modified sequence opt2 from CYLC1__Homo_sapiens__NP_066941
augucccucccccgccuccucaaggucaacauccgcaccuacgacaacuccauccccaucuccgaguccucccgcaaguccuggaaccagaagcacuucgcccucaccuuccccaagccccuccagcgcggcaccaacgacaagucccgcccccucaagucccagaucaccgucacccgccacgacaagcgcaagcucgaggagggccagaagcccgcccacaaguggauccgccacuccuuccgcaagauccuccaguggccccccaucuacaccgccgcccgcgagcagacccccuuccgccaccucuacaccuccaagacccaccucaagaaggccgaguacaagaaguccaaggacgagaagggcggcaccccccucaagaaggacuccaagaagaagggcggcuccuacgccaccaaccccgaguccaagcagaucgucgaggagaagaccaagcgccagaacgaggccgacaagaccccccucaaguccucccacgagaacgagcaguccaagaaguccaaguccuccuccgagaccaaccccgagucccagaacuccaagaccgucuccaagaacugcucccagaaggacaagaaggacuccaagaacuccaagaagaccaacaccgaguuccuccacaccaagaacaaccccaagaaggaccucaagcgcuccaagaccuccaacgaccccaucuccgagaucugcuccgagaacucccucaacgucgacuuccucaugcucgucggccaguccgacgacgaguccaucaacuucgacgccuggcuccgcaacuacucccagaacaacuccaagaacuacucccucaaguacaccaaguacaccaagaaggacaccaagaagaacgccaagaaguccuccgacgccgaguccgaggacuccaaggacgccaagaaggacuccaagaaggucaagaagaacgucaagaaggacgacaagaagaaggacgucaagaaggacaccgaguccaccgacgccgaguccggcgacuccaaggacgagcgcaaggacaccaagaaggacaagaagaagcucaagaaggacgacaagaagaaggacaccaagaaguaccccgaguccaccgacaccgaguccggcgacgccaaggacgcccgcaacgacucccgcaaccucaagaaggccuccaagaacgacgacaagaagaaggacgccaagaagaucaccuucuccaccgacuccgaguccgagcucgaguccaaggagucccagaaggacgagaagaaggacaagaaggacuccaagaccgacaacaagaaguccgucaagaacgacgaggaguccaccgacgccgacuccgagcccaagggcgacuccaagaagggcaagaaggacgagaagaagggcaagaaggacuccaagaaggacgacaagaagaaggacgccaagaagaacgccgaguccaccgagauggaguccgaccucgagcucaagaaggacaagaagcacuccaaggagaagaagggcuccaagaaggacaucaagaaggacgcccgcaaggacaccgaguccaccgacgccgaguucgacgaguccuccaagaccggcuucaagaccuccaccaagaucaagggcuccgacaccgaguccgaggagucccucuacaagcccggcgccaagaagaagaucgacgaguccgacggcaccuccgccaacuccaagauggagggccucgaguccaagcgcggcuuccgcauguccuccaagaagaccaccuucaacgagaagggcgagaaggccuccaccggccgcgucccccccucccgcgagaagcccccccuccccgccugcgagcccucccuccccucccccaagguccgccgccucugcuggugcaagaugcccccccccccccccaagccccgcuacgccccccuccccgaggcccccuggauccacaagcuccucuga

SEQ ID NO: 41966 - RNA, 1047 nt, Artificial Sequence
  derived and/or modified sequence opt2 from CYLC2__Homo_sapiens__NP_001331
augucccucccccgcuuccagcgcgucaacuucggccccuacgacaacuacauccccgucuccgagcucuccaagaaguccuggaaccagcagcacuucgcccuccucuuccccaagccccagcgccccggcaccaagcgccgcuccaagcccucccagauccgcgacaacaccgucuccaucaucgacgaggagcagcuccgcggcgaccgccgccagccccucuggauguaccgcucccucaugcgcaucuccgagcgccccuccgucuaccucgccgcccgccgccagccccucaagcccacccgcaccgucgaggucgacuccaaggccgccgagaucggcaagaagggcgaggacaagaccacccagaaggacaccaccgacuccgaguccgagcucaagcagggcaagaaggacuccaagaagggcaaggacaucgagaagggcaaggaggagaagcucgacgccaagaaggacuccaagaagggcaagaaggacgccgagaagggcaaggacuccgccaccgaguccgaggacgagaagggcggcgccaagaaggacaacaagaaggacaagaaggacuccaacaagggcaaggacuccgccaccgaguccgagggcgagaagggcggcaccgagaaggacuccaagaagggcaagaaggacuccaagaagggcaaggacuccgccaucgagcuccaggccgucaaggccgacgagaagaaggacgaggacggcaagaaggacgccaacaagggcgacgaguccaaggacgccaagaaggacgccaaggagaucaagaagggcaagaaggacaagaagaagcccuccuccaccgacuccgacuccaaggacgacgucaagaaggaguccaagaaggacgccaccaaggacgccaagaaggucgccaagaaggacaccgagaaggaguccgccgacuccaagaaggacgccaagaagaacgccaagaaggacgccaagaaggacgccaagaagaacgccaagaaggacgagaagaaggacgccaagaagaagggcaaguga

SEQ ID NO: 41967 - RNA, 2862 nt, Artificial Sequence
  derived and/or modified sequence opt2 from CYLD__Homo_sapiens__NP_001035877
auguccuccggccucuggucccaggagaaggucaccucccccuacugggaggagcgcaucuucuaccuccuccuccaggagugcuccgucaccgacaagcagacccagaagcuccucaagguccccaagggcuccaucggccaguacauccaggaccgcuccgucggccacucccgcauccccuccgccaagggcaagaagaaccagaucggccucaagauccucgagcagccccacgccguccucuucgucgacgagaaggacgucgucgagaucaacgagaaguucaccgagcuccuccucgccaucaccaacugcgaggagcgcuucucccucuucaagaaccgcaaccgccucuccaagggccuccagaucgacgucggcugccccgucaagguccagcuccgcuccggcgaggagaaguuccccggcgucguccgcuuccgcggcccccuccucgccgagcgcaccgucuccggcaucuucuucggcgucgagcuccucgaggagggccgcggccagggcuucaccgacggcgucuaccagggcaagcagcucuuccagugcgacgaggacugcggcgucuucgucgcccucgacaagcucgagcucaucgaggacgacgacaccgcccucgaguccgacuacgccggccccggcgacaccaugcaggucgagcuccccccccucgagaucaacucccgcgucucccucaaggucggcgagaccaucgaguccggcaccgucaucuucugcgacguccuccccggcaaggagucccucggcuacuucgucggcgucgacauggacaaccccaucggcaacugggacggccgcuucgacggcguccagcucugcuccuucgccugcgucgaguccaccauccuccuccacaucaacgacaucauccccgaguccgucacccaggagcgccgcccccccaagcucgccuucaugucccgcggcgucggcgacaagggcuccuccucccacaacaagcccaaggccaccggcuccaccuccgaccccggcaaccgcaaccgcuccgagcucuucuacacccucaacggcuccuccgucgacucccagccccaguccaaguccaagaacaccugguacaucgacgaggucgccgaggaccccgccaagucccucaccgagaucuccaccgacuucgaccgcuccucccccccccuccagcccccccccgucaacucccucaccaccgagaaccgcuuccacucccuccccuucucccucaccaagaugcccaacaccaacggcuccaucggccacuccccccucucccucuccgcccaguccgucauggaggagcucaacaccgcccccguccaggagucccccccccucgccaugccccccggcaacucccacggccucgaggucggcucccucgccgaggucaaggagaacccccccuucuacggcgucauccgcuggaucggccagccccccggccucaacgagguccucgccggccucgagcucgaggacgagugcgccggcugcaccgacggcaccuuccgcggcacccgcuacuucaccugcgcccucaagaaggcccucuucgucaagcucaaguccugccgccccgacucccgcuucgccucccuccagcccgucuccaaccagaucgagcgcugcaacucccucgccuucggcggcuaccucuccgaggucgucgaggagaacaccccccccaagauggagaaggagggccucgagaucaugaucggcaagaagaagggcauccagggccacuacaacuccugcuaccucgacuccacccucuucugccucuucgccuucuccuccguccucgacaccguccuccuccgccccaaggagaagaacgacgucgaguacuacuccgagacccaggagcuccuccgcaccgagaucgucaacccccuccgcaucuacggcuacgucugcgccaccaagaucaugaagcuccgcaagauccucgagaaggucgaggccgccuccggcuucaccuccgaggagaaggaccccgaggaguuccucaacauccucuuccaccacauccuccgcgucgagccccuccucaagauccgcuccgccggccagaagguccaggacugcuacuucuaccagaucuucauggagaagaacgagaaggucggcguccccaccauccagcagcuccucgagugguccuucaucaacuccaaccucaaguucgccgaggcccccuccugccucaucauccagaugccccgcuucggcaaggacuucaagcucuucaagaagaucuuccccucccucgagcucaacaucaccgaccuccucgaggacaccccccgccagugccgcaucugcggcggccucgccauguacgagugccgcgagugcuacgacgaccccgacaucuccgccggcaagaucaagcaguucugcaagaccugcaacacccagguccaccuccaccccaagcgccucaaccacaaguacaaccccgucucccuccccaaggaccuccccgacugggacuggcgccacggcugcauccccugccagaacauggagcucuucgccguccucugcaucgagaccucccacuacgucgccuucgucaaguacggcaaggacgacuccgccuggcucuucuucgacuccauggccgaccgcgacggcggccagaacggcuucaacaucccccaggucacccccugccccgaggucggcgaguaccucaagaugucccucgaggaccuccacucccucgacucccgccgcauccagggcugcgcccgccgccuccucugcgacgccuacaugugcauguaccagucccccaccaugucccucuacaaguga

SEQ ID NO: 41968 - RNA, 1566 nt, Artificial Sequence
  derived and/or modified sequence opt2 from CYP11A1__Homo_sapiens__NP_000772
augcucgccaagggccuccccccccgcuccguccucgucaagggcugccagaccuuccucuccgccccccgcgagggccucggccgccuccgcguccccaccggcgagggcgccggcaucuccacccgcuccccccgccccuucaacgagauccccucccccggcgacaacggcuggcucaaccucuaccacuucuggcgcgagaccggcacccacaagguccaccuccaccacguccagaacuuccagaaguacggccccaucuaccgcgagaagcucggcaacgucgaguccgucuacgucaucgaccccgaggacgucgcccuccucuucaaguccgagggccccaaccccgagcgcuuccucaucccccccugggucgccuaccaccaguacuaccagcgccccaucggcguccuccucaagaaguccgccgccuggaagaaggaccgcgucgcccucaaccaggaggucauggcccccgaggccaccaagaacuuccucccccuccucgacgccgucucccgcgacuucgucuccguccuccaccgccgcaucaagaaggccggcuccggcaacuacuccggcgacaucuccgacgaccucuuccgcuucgccuucgaguccaucaccaacgucaucuucggcgagcgccagggcaugcucgaggaggucgucaaccccgaggcccagcgcuucaucgacgccaucuaccagauguuccacaccuccguccccaugcucaaccucccccccgaccucuuccgccucuuccgcaccaagaccuggaaggaccacgucgccgccugggacgucaucuucuccaaggccgacaucuacacccagaacuucuacugggagcuccgccagaagggcuccguccaccacgacuaccgcggcauccucuaccgccuccucggcgacuccaagauguccuucgaggacaucaaggccaacgucaccgagaugcucgccggcggcgucgacaccaccuccaugacccuccaguggcaccucuacgagauggcccgcaaccucaagguccaggacaugcuccgcgccgagguccucgccgcccgccaccaggcccagggcgacauggccaccaugcuccagcucgucccccuccucaaggccuccaucaaggagacccuccgccuccaccccaucuccgucacccuccagcgcuaccucgucaacgaccucguccuccgcgacuacaugauccccgccaagacccucguccaggucgccaucuacgcccucggccgcgagcccaccuucuucuucgaccccgagaacuucgaccccacccgcuggcucuccaaggacaagaacaucaccuacuuccgcaaccucggcuucggcuggggcguccgccagugccucggccgccgcaucgccgagcucgagaugaccaucuuccucaucaacaugcucgagaacuuccgcgucgagauccagcaccucuccgacgucggcaccaccuucaaccucauccucaugcccgagaagcccaucuccuucaccuucuggcccuucaaccaggaggccacccagcaguga

SEQ ID NO: 41969 - RNA, 1512 nt, Artificial Sequence
  derived and/or modified sequence opt2 from CYP11B1__Homo_sapiens__NP_000488
auggcccuccgcgccaaggccgaggucugcauggccguccccuggcucucccuccagcgcgcccaggcccucggcacccgcgccgcccgcgucccccgcaccguccuccccuucgaggccaugccccgccgccccggcaaccgcuggcuccgccuccuccagaucuggcgcgagcagggcuacgaggaccuccaccucgagguccaccagaccuuccaggagcucggccccaucuuccgcuacgaccucggcggcgccggcauggucugcgucaugcuccccgaggacgucgagaagcuccagcaggucgacucccuccacccccaccgcaugucccucgagcccugggucgccuaccgccagcaccgcggccacaagugcggcgucuuccuccucaacggccccgaguggcgcuucaaccgccuccgccucaaccccgagguccucucccccaacgccguccagcgcuuccuccccauggucgacgccgucgcccgcgacuucucccaggcccucaagaagaagguccuccagaacgcccgcggcucccucacccucgacguccagcccuccaucuuccacuacaccaucgaggccuccaaccucgcccucuucggcgagcgccucggccucgucggccacucccccuccuccgccucccucaacuuccuccacgcccucgaggucauguucaaguccaccguccagcucauguucaugccccgcucccucucccgcuggaccucccccaaggucuggaaggagcacuucgaggccugggacugcaucuuccaguacggcgacaacugcauccagaagaucuaccaggagcucgccuucucccgcccccagcaguacaccuccaucgucgccgagcuccuccucaacgccgagcucucccccgacgccaucaaggccaacuccauggagcucaccgccggcuccgucgacaccaccgucuucccccuccucaugacccucuucgagcucgcccgcaaccccaacguccagcaggcccuccgccaggagucccucgccgccgccgccuccaucuccgagcacccccagaaggccaccaccgagcucccccuccuccgcgccgcccucaaggagacccuccgccucuaccccgucggccucuuccucgagcgcgucgccuccuccgaccucguccuccagaacuaccacauccccgccggcacccucguccgcgucuuccucuacucccucggccgcaaccccgcccucuucccccgccccgagcgcuacaacccccagcgcuggcucgacauccgcggcuccggccgcaacuucuaccacguccccuucggcuucggcaugcgccagugccucggccgccgccucgccgaggccgagaugcuccuccuccuccaccacguccucaagcaccuccaggucgagacccucacccaggaggacaucaagauggucuacuccuucauccuccgccccuccauguucccccuccucaccuuccgcgccaucaacuga

SEQ ID NO: 41970 - RNA, 1512 nt, Artificial Sequence
  derived and/or modified sequence opt2 from CYP11B2__Homo_sapiens__NP_000489
auggcccuccgcgccaaggccgaggucugcgucgccgcccccuggcucucccuccagcgcgcccgcgcccucggcacccgcgccgcccgcgccccccgcaccguccuccccuucgaggccaugccccagcaccccggcaaccgcuggcuccgccuccuccagaucuggcgcgagcagggcuacgagcaccuccaccucgagaugcaccagaccuuccaggagcucggccccaucuuccgcuacaaccucggcggcccccgcauggucugcgucaugcuccccgaggacgucgagaagcuccagcaggucgacucccuccaccccugccgcaugauccucgagcccugggucgccuaccgccagcaccgcggccacaagugcggcgucuuccuccucaacggccccgaguggcgcuucaaccgccuccgccucaaccccgacguccucucccccaaggccguccagcgcuuccuccccauggucgacgccgucgcccgcgacuucucccaggcccucaagaagaagguccuccagaacgcccgcggcucccucacccucgacguccagcccuccaucuuccacuacaccaucgaggccuccaaccucgcccucuucggcgagcgccucggccucgucggccacucccccuccuccgccucccucaacuuccuccacgcccucgaggucauguucaaguccaccguccagcucauguucaugccccgcucccucucccgcuggaucucccccaaggucuggaaggagcacuucgaggccugggacugcaucuuccaguacggcgacaacugcauccagaagaucuaccaggagcucgccuucaaccgcccccagcacuacaccggcaucgucgccgagcuccuccucaaggccgagcucucccucgaggccaucaaggccaacuccauggagcucaccgccggcuccgucgacaccaccgccuucccccuccucaugacccucuucgagcucgcccgcaaccccgacguccagcagauccuccgccaggagucccucgccgccgccgccuccaucuccgagcacccccagaaggccaccaccgagcucccccuccuccgcgccgcccucaaggagacccuccgccucuaccccgucggccucuuccucgagcgcgucgucuccuccgaccucguccuccagaacuaccacauccccgccggcacccucguccaggucuuccucuacucccucggccgcaacgccgcccucuucccccgccccgagcgcuacaacccccagcgcuggcucgacauccgcggcuccggccgcaacuuccaccacguccccuucggcuucggcaugcgccagugccucggccgccgccucgccgaggccgagaugcuccuccuccuccaccacguccucaagcacuuccucgucgagacccucacccaggaggacaucaagauggucuacuccuucauccuccgccccggcaccuccccccuccucaccuuccgcgccaucaacuga

SEQ ID NO: 41971 - RNA, 1527 nt, Artificial Sequence
  derived and/or modified sequence opt2 from CYP17A1__Homo_sapiens__NP_000093
augugggagcucgucgcccuccuccuccucacccucgccuaccucuucuggcccaagcgccgcugccccggcgccaaguaccccaagucccuccucucccucccccucgucggcucccuccccuuccucccccgccacggccacaugcacaacaacuucuucaagcuccagaagaaguacggccccaucuacuccguccgcaugggcaccaagaccaccgucaucgucggccaccaccagcucgccaaggagguccucaucaagaagggcaaggacuucuccggccgcccccagauggccacccucgacaucgccuccaacaaccgcaagggcaucgccuucgccgacuccggcgcccacuggcagcuccaccgccgccucgccauggccaccuucgcccucuucaaggacggcgaccagaagcucgagaagaucaucugccaggagaucuccacccucugcgacaugcucgccacccacaacggccaguccaucgacaucuccuuccccgucuucgucgccgucaccaacgucaucucccucaucugcuucaacaccuccuacaagaacggcgaccccgagcucaacgucauccagaacuacaacgagggcaucaucgacaaccucuccaaggacucccucgucgaccucguccccuggcucaagaucuuccccaacaagacccucgagaagcucaagucccacgucaagauccgcaacgaccuccucaacaagauccucgagaacuacaaggagaaguuccgcuccgacuccaucaccaacaugcucgacacccucaugcaggccaagaugaacuccgacaacggcaacgccggccccgaccaggacuccgagcuccucuccgacaaccacauccucaccaccaucggcgacaucuucggcgccggcgucgagaccaccaccuccgucgucaaguggacccucgccuuccuccuccacaacccccaggucaagaagaagcucuacgaggagaucgaccagaacgucggcuucucccgcacccccaccaucuccgaccgcaaccgccuccuccuccucgaggccaccauccgcgagguccuccgccuccgccccgucgcccccaugcucaucccccacaaggccaacgucgacuccuccaucggcgaguucgccgucgacaagggcaccgaggucaucaucaaccucugggcccuccaccacaacgagaaggaguggcaccagcccgaccaguucaugcccgagcgcuuccucaaccccgccggcacccagcucaucucccccuccgucuccuaccuccccuucggcgccggcccccgcuccugcaucggcgagauccucgcccgccaggagcucuuccucaucauggccuggcuccuccagcgcuucgaccucgagguccccgacgacggccagcuccccucccucgagggcauccccaaggucgucuuccucaucgacuccuucaaggucaagaucaagguccgccaggccuggcgcgaggcccaggccgagggcuccaccuga

SEQ ID NO: 41972 - RNA, 1512 nt, Artificial Sequence
  derived and/or modified sequence opt2 from CYP19A1__Homo_sapiens__NP_112503
augguccucgagaugcucaaccccauccacuacaacaucaccuccaucguccccgaggccaugcccgccgccaccaugcccguccuccuccucaccggccucuuccuccucgucuggaacuacgagggcaccuccuccauccccggccccggcuacugcaugggcaucggcccccucaucucccacggccgcuuccucuggaugggcaucggcuccgccugcaacuacuacaaccgcgucuacggcgaguucaugcgcgucuggaucuccggcgaggagacccucaucaucuccaaguccuccuccauguuccacaucaugaagcacaaccacuacuccucccgcuucggcuccaagcucggccuccagugcaucggcaugcacgagaagggcaucaucuucaacaacaaccccgagcucuggaagaccacccgccccuucuucaugaaggcccucuccggccccggccucguccgcauggucaccgucugcgccgagucccucaagacccaccucgaccgccucgaggaggucaccaacgaguccggcuacgucgacguccucacccuccuccgccgcgucaugcucgacaccuccaacacccucuuccuccgcaucccccucgacgaguccgccaucgucgucaagauccagggcuacuucgacgccuggcaggcccuccucaucaagcccgacaucuucuucaagaucuccuggcucuacaagaaguacgagaaguccgucaaggaccucaaggacgccaucgagguccucaucgccgagaagcgccgccgcaucuccaccgaggagaagcucgaggagugcauggacuucgccaccgagcucauccucgccgagaagcgcggcgaccucacccgcgagaacgucaaccagugcauccucgagaugcucaucgccgcccccgacaccauguccgucucccucuucuucaugcucuuccucaucgccaagcaccccaacgucgaggaggccaucaucaaggagauccagaccgucaucggcgagcgcgacaucaagaucgacgacauccagaagcucaaggucauggagaacuucaucuacgaguccaugcgcuaccagcccgucgucgaccucgucaugcgcaaggcccucgaggacgacgucaucgacggcuaccccgucaagaagggcaccaacaucauccucaacaucggccgcaugcaccgccucgaguucuuccccaagcccaacgaguucacccucgagaacuucgccaagaacguccccuaccgcuacuuccagcccuucggcuucggcccccgcggcugcgccggcaaguacaucgccauggucaugaugaaggccauccucgucacccuccuccgccgcuuccacgucaagacccuccagggccagugcgucgaguccauccagaagauccacgaccucucccuccaccccgacgagaccaagaacaugcucgagaugaucuucaccccccgcaacuccgaccgcugccucgagcacuga

SEQ ID NO: 41973 - RNA, 1539 nt, Artificial Sequence
  derived and/or modified sequence opt2 from CYP1A1__Homo_sapiens__NP_000490
augcucuuccccaucuccauguccgccaccgaguuccuccucgccuccgucaucuucugccucgucuucugggucauccgcgccucccgcccccagguccccaagggccucaagaacccccccggccccuggggcuggccccucaucggccacaugcucacccucggcaagaacccccaccucgcccucucccgcaugucccagcaguacggcgacguccuccagauccgcaucggcuccacccccgucgucguccucuccggccucgacaccauccgccaggcccucguccgccagggcgacgacuucaagggccgccccgaccucuacaccuucacccucaucuccaacggccaguccauguccuucucccccgacuccggccccgucugggccgcccgccgccgccucgcccagaacggccucaaguccuucuccaucgccuccgaccccgccuccuccaccuccugcuaccucgaggagcacgucuccaaggaggccgagguccucaucuccacccuccaggagcucauggccggccccggccacuucaaccccuaccgcuacgucgucgucuccgucaccaacgucaucugcgccaucugcuucggccgccgcuacgaccacaaccaccaggagcuccucucccucgucaaccucaacaacaacuucggcgaggucgucggcuccggcaaccccgccgacuucauccccauccuccgcuaccuccccaaccccucccucaacgccuucaaggaccucaacgagaaguucuacuccuucaugcagaagauggucaaggagcacuacaagaccuucgagaagggccacauccgcgacaucaccgacucccucaucgagcacugccaggagaagcagcucgacgagaacgccaacguccagcucuccgacgagaagaucaucaacaucguccucgaccucuucggcgccggcuucgacaccgucaccaccgccaucuccuggucccucauguaccucgucaugaacccccgcguccagcgcaagauccaggaggagcucgacaccgucaucggccgcucccgccgcccccgccucuccgaccgcucccaccuccccuacauggaggccuucauccucgagaccuuccgccacuccuccuucguccccuucaccaucccccacuccaccacccgcgacaccucccucaagggcuucuacauccccaagggccgcugcgucuucgucaaccaguggcagaucaaccacgaccagaagcucugggucaaccccuccgaguuccuccccgagcgcuuccucacccccgacggcgccaucgacaagguccucuccgagaaggucaucaucuucggcaugggcaagcgcaagugcaucggcgagaccaucgcccgcugggaggucuuccucuuccucgccauccuccuccagcgcgucgaguucuccgucccccucggcgucaaggucgacaugacccccaucuacggccucaccaugaagcacgccugcugcgagcacuuccagaugcagcuccgcuccuga

SEQ ID NO: 41974 - RNA, 1551 nt, Artificial Sequence
  derived and/or modified sequence opt2 from CYP1A2__Homo_sapiens__NP_000752
auggcccucucccaguccguccccuucuccgccaccgagcuccuccucgccuccgccaucuucugccucgucuucuggguccucaagggccuccgcccccgcguccccaagggccucaaguccccccccgagcccuggggcuggccccuccucggccacguccucacccucggcaagaacccccaccucgcccucucccgcaugucccagcgcuacggcgacguccuccagauccgcaucggcuccacccccguccucguccucucccgccucgacaccauccgccaggcccucguccgccagggcgacgacuucaagggccgccccgaccucuacaccuccacccucaucaccgacggccagucccucaccuucuccaccgacuccggccccgucugggccgcccgccgccgccucgcccagaacgcccucaacaccuucuccaucgccuccgaccccgccuccuccuccuccugcuaccucgaggagcacgucuccaaggaggccaaggcccucaucucccgccuccaggagcucauggccggccccggccacuucgaccccuacaaccaggucgucgucuccgucgccaacgucaucggcgccaugugcuucggccagcacuuccccgaguccuccgacgagaugcucucccucgucaagaacacccacgaguucgucgagaccgccuccuccggcaacccccucgacuucuuccccauccuccgcuaccuccccaaccccgcccuccagcgcuucaaggccuucaaccagcgcuuccucugguuccuccagaagaccguccaggagcacuaccaggacuucgacaagaacuccguccgcgacaucaccggcgcccucuucaagcacuccaagaagggcccccgcgccuccggcaaccucaucccccaggagaagaucgucaaccucgucaacgacaucuucggcgccggcuucgacaccgucaccaccgccaucuccuggucccucauguaccucgucaccaagcccgagauccagcgcaagauccagaaggagcucgacaccgucaucggccgcgagcgccgcccccgccucuccgaccgcccccagcuccccuaccucgaggccuucauccucgagaccuuccgccacuccuccuuccuccccuucaccaucccccacuccaccacccgcgacaccacccucaacggcuucuacauccccaagaagugcugcgucuucgucaaccaguggcaggucaaccacgaccccgagcucugggaggaccccuccgaguuccgccccgagcgcuuccucaccgccgacggcaccgccaucaacaagccccucuccgagaagaugaugcucuucggcaugggcaagcgccgcugcaucggcgagguccucgccaagugggagaucuuccucuuccucgccauccuccuccagcagcucgaguucuccgucccccccggcgucaaggucgaccucacccccaucuacggccucaccaugaagcacgcccgcugcgagcacguccaggcccgccuccgcuucuccaucaacuga

SEQ ID NO: 41975 - RNA, 1632 nt, Artificial Sequence
  derived and/or modified sequence opt2 from CYP1B1__Homo_sapiens__NP_000095
augggcaccucccucucccccaacgaccccuggccccucaacccccucuccauccagcagaccacccuccuccuccuccucuccguccucgccaccguccacgucggccagcgccuccuccgccagcgccgccgccagcuccgcuccgccccccccggccccuucgccuggccccucaucggcaacgccgccgccgucggccaggccgcccaccucuccuucgcccgccucgcccgccgcuacggcgacgucuuccagauccgccucggcuccugccccaucgucguccucaacggcgagcgcgccauccaccaggcccucguccagcagggcuccgccuucgccgaccgccccgccuucgccuccuuccgcgucgucuccggcggccgcuccauggccuucggccacuacuccgagcacuggaagguccagcgccgcgccgcccacuccaugaugcgcaacuucuucacccgccagccccgcucccgccagguccucgagggccacguccucuccgaggcccgcgagcucgucgcccuccucguccgcggcuccgccgacggcgccuuccucgacccccgcccccucaccgucgucgccgucgccaacgucauguccgccgucugcuucggcugccgcuacucccacgacgaccccgaguuccgcgagcuccucucccacaacgaggaguucggccgcaccgucggcgccggcucccucgucgacgucaugcccuggcuccaguacuuccccaaccccguccgcaccgucuuccgcgaguucgagcagcucaaccgcaacuucuccaacuucauccucgacaaguuccuccgccacugcgagucccuccgccccggcgccgccccccgcgacaugauggacgccuucauccucuccgccgagaagaaggccgccggcgacucccacggcggcggcgcccgccucgaccucgagaacguccccgccaccaucaccgacaucuucggcgccucccaggacacccucuccaccgcccuccaguggcuccuccuccucuucacccgcuaccccgacguccagacccgcguccaggccgagcucgaccaggucgucggccgcgaccgccuccccugcaugggcgaccagcccaaccuccccuacguccucgccuuccucuacgaggccaugcgcuucuccuccuucguccccgucaccaucccccacgccaccaccgccaacaccuccguccucggcuaccacauccccaaggacaccgucgucuucgucaaccagugguccgucaaccacgacccccucaaguggcccaaccccgagaacuucgaccccgcccgcuuccucgacaaggacggccucaucaacaaggaccucaccucccgcgucaugaucuucuccgucggcaagcgccgcugcaucggcgaggagcucuccaagaugcagcucuuccucuucaucuccauccucgcccaccagugcgacuuccgcgccaaccccaacgagcccgccaagaugaacuucuccuacggccucaccaucaagcccaaguccuucaaggucaacgucacccuccgcgaguccauggagcuccucgacuccgccguccagaaccuccaggccaaggagaccugccaguga

SEQ ID NO: 41976 - RNA, 1488 nt, Artificial Sequence
  derived and/or modified sequence opt2 from CYP21A2__Homo_sapiens__NP_000491
augcuccuccucggccuccuccuccuccucccccuccucgccggcgcccgccuccucuggaacugguggaagcuccgcucccuccaccuccccccccucgcccccggcuuccuccaccuccuccagcccgaccuccccaucuaccuccucggccucacccagaaguucggccccaucuaccgccuccaccucggccuccaggacgucgucguccucaacuccaagcgcaccaucgaggaggccauggucaagaagugggccgacuucgccggccgccccgagccccucaccuacaagcucgucucccgcaacuaccccgaccucucccucggcgacuacucccuccucuggaaggcccacaagaagcucacccgcuccgcccuccuccucggcauccgcgacuccauggagcccgucgucgagcagcucacccaggaguucugcgagcgcaugcgcgcccagcccggcacccccgucgccaucgaggaggaguucucccuccucaccugcuccaucaucugcuaccucaccuucggcgacaagaucaaggacgacaaccucaugcccgccuacuacaagugcauccaggagguccucaagaccuggucccacugguccauccagaucgucgacgucauccccuuccuccgcuucuuccccaaccccggccuccgccgccucaagcaggccaucgagaagcgcgaccacaucgucgagaugcagcuccgccagcacaaggagucccucgucgccggccaguggcgcgacaugauggacuacaugcuccagggcgucgcccagcccuccauggaggagggcuccggccagcuccucgagggccacguccacauggccgccgucgaccuccucaucggcggcaccgagaccaccgccaacacccucuccugggccgucgucuuccuccuccaccaccccgagauccagcagcgccuccaggaggagcucgaccacgagcucggccccggcgccuccuccucccgcguccccuacaaggaccgcgcccgccucccccuccucaacgccaccaucgccgagguccuccgccuccgccccgucgucccccucgcccucccccaccgcaccacccgccccuccuccaucuccggcuacgacauccccgagggcaccgucaucauccccaaccuccagggcgcccaccucgacgagaccgucugggagcgcccccacgaguucuggcccgaccgcuuccucgagcccggcaagaacucccgcgcccucgccuucggcugcggcgcccgcgucugccucggcgagccccucgcccgccucgagcucuucgucguccucacccgccuccuccaggccuucacccuccuccccuccggcgacgcccuccccucccuccagccccucccccacugcuccgucauccucaagaugcagcccuuccagguccgccuccagccccgcggcaugggcgcccacucccccggccagucccaguga

SEQ ID NO: 41977 - RNA, 1545 nt, Artificial Sequence
  derived and/or modified sequence opt2 from CYP24A1__Homo_sapiens__NP_000773
auguccucccccaucuccaagucccgcucccucgccgccuuccuccagcagcuccgcuccccccgccagcccccccgccucgucaccuccaccgccuacaccuccccccagccccgcgagguccccgucugcccccucaccgccggcggcgagacccagaacgccgccgcccuccccggccccaccuccuggccccuccucggcucccuccuccagauccucuggaagggcggccucaagaagcagcacgacacccucgucgaguaccacaagaaguacggcaagaucuuccgcaugaagcucggcuccuucgaguccguccaccucggcucccccugccuccucgaggcccucuaccgcaccgaguccgccuacccccagcgccucgagaucaagcccuggaaggccuaccgcgacuaccgcaaggagggcuacggccuccucauccucgagggcgaggacuggcagcgcguccgcuccgccuuccagaagaagcucaugaagcccggcgaggucaugaagcucgacaacaagaucaacgagguccucgccgacuucaugggccgcaucgacgagcucugcgacgagcgcggccacgucgaggaccucuacuccgagcucaacaagugguccuucgaguccaucugccucguccucuacgagaagcgcuucggccuccuccagaagaacgccggcgacgaggccgucaacuucaucauggccaucaagaccaugauguccaccuucggccgcaugauggucacccccgucgagcuccacaagucccucaacaccaaggucuggcaggaccacacccucgccugggacaccaucuucaaguccgucaaggccugcaucgacaaccgccucgagaaguacucccagcagcccuccgccgacuuccucugcgacaucuaccaccagaaccgccucuccaagaaggagcucuacgccgccgucaccgagcuccagcucgccgccgucgagaccaccgccaacucccucauguggauccucuacaaccucucccgcaacccccagguccagcagaagcuccucaaggagauccaguccguccuccccgagaaccaggucccccgcgccgaggaccuccgcaacaugcccuaccucaaggccugccucaaggaguccaugcgccucacccccuccguccccuucaccacccgcacccucgacaaggccaccguccucggcgaguacgcccuccccaagggcaccguccucaugcucaacacccagguccucggcuccuccgaggacaacuucgaggacuccucccaguuccgccccgagcgcuggcuccaggagaaggagaagaucaaccccuucgcccaccuccccuucggcgucggcaagcgcaugugcaucggccgccgccucgccgagcuccagcuccaccucgcccucugcuggaucguccgcaaguacgacauccaggccaccgacaacgagcccgucgagaugcuccacuccggcacccucguccccucccgcgagcuccccaucgccuucugccagcgcuga

SEQ ID NO: 41978 - RNA, 1494 nt, Artificial Sequence
  derived and/or modified sequence opt2 from CYP26A1__Homo_sapiens__NP_000774
augggccuccccgcccuccucgccuccgcccucugcaccuucguccucccccuccuccucuuccucgccgccaucaagcucugggaccucuacugcgucuccggccgcgaccgcuccugcgcccucccccucccccccggcaccaugggcuuccccuucuucggcgagacccuccagaugguccuccagcgccgcaaguuccuccagaugaagcgccgcaaguacggcuucaucuacaagacccaccucuucggccgccccaccguccgcgucaugggcgccgacaacguccgccgcauccuccucggcgagcaccgccucgucuccguccacuggcccgccuccguccgcaccauccucggcuccggcugccucuccaaccuccacgacuccucccacaagcagcgcaagaaggucaucaugcgcgccuucucccgcgaggcccucgagugcuacguccccgucaucaccgaggaggucggcuccucccucgagcaguggcucuccugcggcgagcgcggccuccucgucuaccccgaggucaagcgccucauguuccgcaucgccaugcgcauccuccucggcugcgagccccagcucgccggcgacggcgacuccgagcagcagcucgucgaggccuucgaggagaugacccgcaaccucuucucccuccccaucgacguccccuucuccggccucuaccgcggcaugaaggcccgcaaccucauccacgcccgcaucgagcagaacauccgcgccaagaucugcggccuccgcgccuccgaggccggccagggcugcaaggacgcccuccagcuccucaucgagcacuccugggagcgcggcgagcgccucgacaugcaggcccucaagcaguccuccaccgagcuccucuucggcggccacgagaccaccgccuccgccgccaccucccucaucaccuaccucggccucuacccccacguccuccagaagguccgcgaggagcucaaguccaagggccuccucugcaaguccaaccaggacaacaagcucgacauggagauccucgagcagcucaaguacaucggcugcgucaucaaggagacccuccgccucaacccccccguccccggcggcuuccgcgucgcccucaagaccuucgagcucaacggcuaccagauccccaagggcuggaacgucaucuacuccaucugcgacacccacgacgucgccgagaucuucaccaacaaggaggaguucaaccccgaccgcuucaugcucccccaccccgaggacgccucccgcuucuccuucauccccuucggcggcggccuccgcuccugcgucggcaaggaguucgccaagauccuccucaagaucuucaccgucgagcucgcccgccacugcgacuggcagcuccucaacggcccccccaccaugaagaccucccccaccgucuaccccgucgacaaccuccccgcccgcuucacccacuuccacggcgagaucuga

SEQ ID NO: 41979 - RNA, 1314 nt, Artificial Sequence
  derived and/or modified sequence opt2 from CYP26B1__Homo_sapiens__NP_001264671
augcucuucgagggccucgaccucgucuccgcccucgccacccucgccgccugccucgucuccgucacccuccuccucgccgucucccagcagcucuggcagcuccgcugggccgccacccgcgacaaguccugcaagcuccccauccccaagggcuccaugggcuucccccucaucggcgagaccggccacuggcuccuccaggucuucuccaagaucuucucccacgaggcccucgaguccuaccuccccaagauccagcucgucauccaggacacccuccgcgccugguccucccaccccgaggccaucaacgucuaccaggaggcccagaagcucaccuuccgcauggccauccgcguccuccucggcuucuccauccccgaggaggaccucggccaccucuucgaggucuaccagcaguucgucgacaacgucuucucccuccccgucgaccuccccuucuccggcuaccgccgcggcauccaggcccgccagauccuccagaagggccucgagaaggccauccgcgagaagcuccagugcacccagggcaaggacuaccucgacgcccucgaccuccucaucgaguccuccaaggagcacggcaaggagaugaccaugcaggagcucaaggacggcacccucgagcucaucuucgccgccuacgccaccaccgccuccgccuccaccucccucaucaugcagcuccucaagcaccccaccguccucgagaagcuccgcgacgagcuccgcgcccacggcauccuccacuccggcggcugccccugcgagggcacccuccgccucgacacccucuccggccuccgcuaccucgacugcgucaucaaggaggucaugcgccucuucacccccaucuccggcggcuaccgcaccguccuccagaccuucgagcucgacggcuuccagauccccaagggcugguccgucauguacuccauccgcgacacccacgacaccgcccccgucuucaaggacgucaacgucuucgaccccgaccgcuucucccaggcccgcuccgaggacaaggacggccgcuuccacuaccuccccuucggcggcggcguccgcaccugccucggcaagcaccucgccaagcucuuccucaagguccucgccgucgagcucgccuccaccucccgcuucgagcucgccacccgcaccuucccccgcaucacccucguccccguccuccaccccgucgacggccucuccgucaaguucuucggccucgacuccaaccagaacgagauccuccccgagaccgaggccaugcucuccgccaccgucuga

SEQ ID NO: 41980 - RNA, 1569 nt, Artificial Sequence
  derived and/or modified sequence opt2 from CYP26C1__Homo_sapiens__NP_899230
auguuccccuggggccucuccugccucuccguccucggcgccgccggcaccgcccuccucugcgccggccuccuccucucccucgcccagcaccucuggacccuccgcuggaugcucucccgcgaccgcgccuccacccucccccuccccaagggcuccaugggcuggcccuucuucggcgagacccuccacuggcucguccagggcucccgcuuccacuccucccgccgcgagcgcuacggcaccgucuucaagacccaccuccucggccgccccgucauccgcgucuccggcgccgagaacguccgcaccauccuccucggcgagcaccgccucguccgcucccaguggccccaguccgcccacauccuccucggcucccacacccuccucggcgccgucggcgagccccaccgccgccgccgcaagguccucgcccgcgucuucucccgcgccgcccucgagcgcuacgucccccgccuccagggcgcccuccgccacgagguccgcuccuggugcgccgccggcggccccgucuccgucuacgacgccuccaaggcccucaccuuccgcauggccgcccgcauccuccucggccuccgccucgacgaggcccagugcgccacccucgcccgcaccuucgagcagcucgucgagaaccucuucucccucccccucgacguccccuucuccggccuccgcaagggcauccgcgcccgcgaccagcuccaccgccaccucgagggcgccaucuccgagaagcuccacgaggacaaggccgccgagcccggcgacgcccucgaccucaucauccacuccgcccgcgagcucggccacgagcccuccaugcaggagcucaaggaguccgccgucgagcuccucuucgccgccuucuucaccaccgccuccgccuccaccucccucguccuccuccuccuccagcaccccgccgccaucgccaagauccgcgaggagcucgucgcccagggccucggccgcgccugcggcugcgcccccggcgccgccggcggcuccgagggccccccccccgacugcggcugcgagcccgaccucucccucgccgcccucggccgccuccgcuacgucgacugcgucgucaaggagguccuccgccuccucccccccgucuccggcggcuaccgcaccgcccuccgcaccuucgagcucgacggcuaccagauccccaagggcugguccgucauguacuccauccgcgacacccacgagaccgccgccgucuaccgcuccccccccgagggcuucgaccccgagcgcuucggcgccgcccgcgaggacucccgcggcgccuccucccgcuuccacuacauccccuucggcggcggcgcccgcuccugccucggccaggagcucgcccaggccguccuccagcuccucgccgucgagcucguccgcaccgcccgcugggagcucgccacccccgccuuccccgccaugcagaccguccccaucguccaccccgucgacggccuccgccucuucuuccacccccucacccccuccgucgccggcaacggccucugccucuga

SEQ ID NO: 41981 - RNA, 1596 nt, Artificial Sequence
  derived and/or modified sequence opt2 from CYP27A1__Homo_sapiens__NP_000775
auggccgcccucggcugcgcccgccuccgcugggcccuccgcggcgccggccgcggccucugcccccacggcgcccgcgccaaggccgccauccccgccgcccuccccuccgacaaggccaccggcgcccccggcgccggccccggcguccgccgccgccagcgcucccucgaggagaucccccgccucggccagcuccgcuucuucuuccagcucuucguccagggcuacgcccuccagcuccaccagcuccagguccucuacaaggccaaguacggccccauguggauguccuaccucggcccccagaugcacgucaaccucgccuccgccccccuccucgagcaggucaugcgccaggagggcaaguaccccguccgcaacgacauggagcucuggaaggagcaccgcgaccagcacgaccucaccuacggccccuucaccaccgagggccaccacugguaccagcuccgccaggcccucaaccagcgccuccucaagcccgccgaggccgcccucuacaccgacgccuucaacgaggucaucgacgacuucaugacccgccucgaccagcuccgcgccgaguccgccuccggcaaccaggucuccgacauggcccagcucuucuacuacuucgcccucgaggccaucugcuacauccucuucgagaagcgcaucggcugccuccagcgcuccauccccgaggacaccgucaccuucguccgcuccaucggccucauguuccagaacucccucuacgccaccuuccuccccaaguggacccgccccguccuccccuucuggaagcgcuaccucgacggcuggaacgccaucuucuccuucggcaagaagcucaucgacgagaagcucgaggacauggaggcccagcuccaggccgccggccccgacggcauccaggucuccggcuaccuccacuuccuccucgccuccggccagcucuccccccgcgaggccaugggcucccuccccgagcuccucauggccggcgucgacaccaccuccaacacccucaccugggcccucuaccaccucuccaaggaccccgagauccaggaggcccuccacgaggaggucgucggcgucguccccgccggccaggucccccagcacaaggacuucgcccacaugccccuccucaaggccguccucaaggagacccuccgccucuaccccgucguccccaccaacucccgcaucaucgagaaggagaucgaggucgacggcuuccucuuccccaagaacacccaguucgucuucugccacuacgucgucucccgcgaccccaccgccuucuccgagcccgaguccuuccagccccaccgcuggcuccgcaacucccagcccgccaccccccgcauccagcaccccuucggcuccguccccuucggcuacggcguccgcgccugccucggccgccgcaucgccgagcucgagaugcagcuccuccucgcccgccucauccagaaguacaaggucguccucgcccccgagaccggcgagcucaaguccgucgcccgcaucguccucguccccaacaagaaggucggccuccaguuccuccagcgccagugcuga

SEQ ID NO: 41982 - RNA, 1527 nt, Artificial Sequence
  derived and/or modified sequence opt2 from CYP27B1__Homo_sapiens__NP_000776
augacccagacccucaaguacgccucccgcgucuuccaccgcguccgcugggcccccgagcucggcgccucccucggcuaccgcgaguaccacuccgcccgccgcucccucgccgacauccccggccccuccacccccuccuuccucgccgagcucuucugcaagggcggccucucccgccuccacgagcuccagguccagggcgccgcccacuucggccccgucuggcucgccuccuucggcaccguccgcaccgucuacgucgccgcccccgcccucgucgaggagcuccuccgccaggagggcccccgccccgagcgcugcuccuucucccccuggaccgagcaccgccgcugccgccagcgcgccugcggccuccucaccgccgagggcgaggaguggcagcgccuccgcucccuccucgccccccuccuccuccgcccccaggccgccgcccgcuacgccggcacccucaacaacgucgucugcgaccucguccgccgccuccgccgccagcgcggccgcggcaccggcccccccgcccucguccgcgacgucgccggcgaguucuacaaguucggccucgagggcaucgccgccguccuccucggcucccgccucggcugccucgaggcccaggucccccccgacaccgagaccuucauccgcgccgucggcuccgucuucgucuccacccuccucaccauggccaugccccacuggcuccgccaccucguccccggccccuggggccgccucugccgcgacugggaccagauguucgccuucgcccagcgccacgucgagcgccgcgaggccgaggccgccaugcgcaacggcggccagcccgagaaggaccucgaguccggcgcccaccucacccacuuccucuuccgcgaggagcuccccgcccaguccauccucggcaacgucaccgagcuccuccucgccggcgucgacaccgucuccaacacccucuccugggcccucuacgagcucucccgccaccccgagguccagaccgcccuccacuccgagaucaccgccgcccucucccccggcuccuccgccuaccccuccgccaccguccucucccagcucccccuccucaaggccgucgucaaggagguccuccgccucuaccccgucguccccggcaacucccgcguccccgacaaggacauccacgucggcgacuacaucauccccaagaacacccucgucacccucugccacuacgccaccucccgcgaccccgcccaguuccccgagcccaacuccuuccgccccgcccgcuggcucggcgagggccccaccccccaccccuucgccucccuccccuucggcuucggcaagcgcuccugcaugggccgccgccucgccgagcucgagcuccagauggcccucgcccagauccucacccacuucgagguccagcccgagcccggcgccgcccccguccgccccaagacccgcaccguccucguccccgagcgcuccaucaaccuccaguuccucgaccgcuga

SEQ ID NO: 41983 - RNA, 1119 nt, Artificial Sequence
  derived and/or modified sequence opt2 from CYP27C1__Homo_sapiens__NP_001001665
augcgcuccguccuccgccagcgcauccucaagcccaaggacgucgccaucuacuccggcgaggucaaccaggucaucgccgaccucaucaagcgcaucuaccuccuccgcucccaggccgaggacggcgagaccgucaccaacgucaacgaccucuucuucaaguacuccauggagggcgucgccaccauccucuacgagucccgccucggcugccucgagaacuccaucccccagcucaccgucgaguacaucgaggcccucgagcucauguucuccauguucaagaccuccauguacgccggcgccaucccccgcuggcuccgccccuucauccccaagcccuggcgcgaguucugccgcuccugggacggccucuucaaguucucccagauccacgucgacaacaagcuccgcgacauccaguaccagauggaccgcggccgccgcgucuccggcggccuccucaccuaccucuuccucucccaggcccucacccuccaggagaucuacgccaacgucaccgagaugcuccucgccggcgucgacaccaccuccuucacccucuccuggaccgucuaccuccucgcccgccaccccgagguccagcagaccgucuaccgcgagaucgucaagaaccucggcgagcgccacguccccaccgccgccgacguccccaaggucccccucguccgcgcccuccucaaggagacccuccgccucuuccccguccuccccggcaacggccgcgucacccaggaggaccucgucaucggcggcuaccucauccccaagggcacccagcucgcccucugccacuacgccaccuccuaccaggacgagaacuucccccgcgccaaggaguuccgccccgagcgcuggcuccgcaagggcgaccucgaccgcgucgacaacuucggcuccauccccuucggccacggcguccgcuccugcaucggccgccgcaucgccgagcucgagauccaccucgucgucauccagcuccuccagcacuucgagaucaagaccuccucccagaccaacgccguccacgccaagacccacggccuccucacccccggcggccccauccacguccgcuucgucaaccgcaaguga

SEQ ID NO: 41984 - RNA, 1485 nt, Artificial Sequence
  derived and/or modified sequence opt2 from CYP2A13__Homo_sapiens__NP_000757
augcucgccuccggccuccuccucgucacccuccucgccugccucaccgucaugguccucauguccgucuggcgccagcgcaagucccgcggcaagcucccccccggccccaccccccuccccuucaucggcaacuaccuccagcucaacaccgagcagauguacaacucccucaugaagaucuccgagcgcuacggccccgucuucaccauccaccucggcccccgccgcgucgucguccucugcggccacgacgccgucaaggaggcccucgucgaccaggccgaggaguucuccggccgcggcgagcaggccaccuucgacuggcucuucaagggcuacggcgucgccuucuccaacggcgagcgcgccaagcagcuccgccgcuucuccaucgccacccuccgcggcuucggcgucggcaagcgcggcaucgaggagcgcauccaggaggaggccggcuuccucaucgacgcccuccgcggcacccacggcgccaacaucgaccccaccuucuuccucucccgcaccgucuccaacgucaucuccuccaucgucuucggcgaccgcuucgacuacgaggacaaggaguuccucucccuccuccgcaugaugcucggcuccuuccaguucaccgccaccuccaccggccagcucuacgagauguucuccuccgucaugaagcaccuccccggcccccagcagcaggccuucaaggagcuccagggccucgaggacuucaucgccaagaaggucgagcacaaccagcgcacccucgaccccaacuccccccgcgacuucaucgacuccuuccucauccgcaugcaggaggaggagaagaaccccaacaccgaguucuaccucaagaaccucgucaugaccacccucaaccucuucuucgccggcaccgagaccgucuccaccacccuccgcuacggcuuccuccuccucaugaagcaccccgaggucgaggccaagguccacgaggagaucgaccgcgucaucggcaagaaccgccagcccaaguucgaggaccgcgccaagaugcccuacaccgaggccgucauccacgagauccagcgcuucggcgacaugcuccccaugggccucgcccaccgcgucaacaaggacaccaaguuccgcgacuucuuccuccccaagggcaccgaggucuuccccaugcucggcuccguccuccgcgacccccgcuucuucuccaacccccgcgacuucaacccccagcacuuccucgacaagaagggccaguucaagaaguccgacgccuucguccccuucuccaucggcaagcgcuacugcuucggcgagggccucgcccgcauggagcucuuccucuucuucaccaccaucaugcagaacuuccgcuucaaguccccccagucccccaaggacaucgacgucucccccaagcacgucggcuucgccaccaucccccgcaacuacaccauguccuuccucccccgcuga

SEQ ID NO: 41985 - RNA, 1485 nt, Artificial Sequence
  derived and/or modified sequence opt2 from CYP2A6__Homo_sapiens__NP_000753
augcucgccuccggcaugcuccucgucgcccuccucgucugccucaccgucaugguccucauguccgucuggcagcagcgcaaguccaagggcaagcucccccccggccccaccccccuccccuucaucggcaacuaccuccagcucaacaccgagcagauguacaacucccucaugaagaucuccgagcgcuacggccccgucuucaccauccaccucggcccccgccgcgucgucguccucugcggccacgacgccguccgcgaggcccucgucgaccaggccgaggaguucuccggccgcggcgagcaggccaccuucgacugggucuucaagggcuacggcgucgucuucuccaacggcgagcgcgccaagcagcuccgccgcuucuccaucgccacccuccgcgacuucggcgucggcaagcgcggcaucgaggagcgcauccaggaggaggccggcuuccucaucgacgcccuccgcggcaccggcggcgccaacaucgaccccaccuucuuccucucccgcaccgucuccaacgucaucuccuccaucgucuucggcgaccgcuucgacuacaaggacaaggaguuccucucccuccuccgcaugaugcucggcaucuuccaguucaccuccaccuccaccggccagcucuacgagauguucuccuccgucaugaagcaccuccccggcccccagcagcaggccuuccagcuccuccagggccucgaggacuucaucgccaagaaggucgagcacaaccagcgcacccucgaccccaacuccccccgcgacuucaucgacuccuuccucauccgcaugcaggaggaggagaagaaccccaacaccgaguucuaccucaagaaccucgucaugaccacccucaaccucuucaucggcggcaccgagaccgucuccaccacccuccgcuacggcuuccuccuccucaugaagcaccccgaggucgaggccaagguccacgaggagaucgaccgcgucaucggcaagaaccgccagcccaaguucgaggaccgcgccaagaugcccuacauggaggccgucauccacgagauccagcgcuucggcgacgucauccccaugucccucgcccgccgcgucaagaaggacaccaaguuccgcgacuucuuccuccccaagggcaccgaggucuaccccaugcucggcuccguccuccgcgaccccuccuucuucuccaacccccaggacuucaacccccagcacuuccucaacgagaagggccaguucaagaaguccgacgccuucguccccuucuccaucggcaagcgcaacugcuucggcgagggccucgcccgcauggagcucuuccucuucuucaccaccgucaugcagaacuuccgccucaaguccucccagucccccaaggacaucgacgucucccccaagcacgucggcuucgccaccaucccccgcaacuacaccauguccuuccucccccgcuga

SEQ ID NO: 41986 - RNA, 1485 nt, Artificial Sequence
  derived and/or modified sequence opt2 from CYP2A7__Homo_sapiens__NP_000755
augcucgccuccggccuccuccucgucgcccuccucgccugccucaccgucaugguccucauguccgucuggcagcagcgcaagucccgcggcaagcucccccccggccccaccccccuccccuucaucggcaacuaccuccagcucaacaccgagcacaucugcgacuccaucaugaaguucuccgagugcuacggccccgucuucaccauccaccucggcccccgccgcgucgucguccucugcggccacgacgccguccgcgaggcccucgucgaccaggccgaggaguucuccggccgcggcgagcaggccaccuucgacugggucuucaagggcuacggcgucgccuucuccaacggcgagcgcgccaagcagcuccuccgcuucgccaucgccacccuccgcgacuucggcgucggcaagcgcggcaucgaggagcgcauccaggaggaguccggcuuccucaucgaggccauccgcuccacccacggcgccaacaucgaccccaccuucuuccucucccgcaccgucuccaacgucaucuccuccaucgucuucggcgaccgcuucgacuacgaggacaaggaguuccucucccuccucuccaugaugcucggcaucuuccaguucaccuccaccuccaccggccagcucuacgagauguucuccuccgucaugaagcaccuccccggcccccagcagcaggccuucaagcuccuccagggccucgaggacuucaucgccaagaaggucgagcacaaccagcgcacccucgaccccaacuccccccaggacuucaucgacuccuuccucauccacaugcaggaggaggagaagaaccccaacaccgaguucuaccucaagaaccucaugauguccacccucaaccucuucaucgccggcaccgagaccgucuccaccacccuccgcuacggcuuccuccuccucaugaagcaccccgaggucgaggccaagguccacgaggagaucgaccgcgucaucggcaagaaccgccagcccaaguucgaggaccgcaccaagaugcccuacauggaggccgucauccacgagauccagcgcuucggcgacgucauccccaugucccucgcccgccgcgucaagaaggacaccaaguuccgcgacuucuuccuccccaagggcaccgaggucuuccccaugcucggcuccguccuccgcgaccccuccuucuucuccaacccccaggacuucaacccccagcacuuccucgacgacaagggccaguucaagaaguccgacgccuucguccccuucuccaucggcaagcgcaacugcuucggcgagggccucgcccgcauggagcucuuccucuucuucaccaccgucaugcagaacuuccgccucaaguccucccagucccccaaggacaucgacgucucccccaagcacgucgucuucgccaccaucccccgcaacuacaccauguccuuccucccccgcuga

SEQ ID NO: 41987 - RNA, 1476 nt, Artificial Sequence
  derived and/or modified sequence opt2 from CYP2B6__Homo_sapiens__NP_000758
auggagcucuccguccuccucuuccucgcccuccucaccggccuccuccuccuccucguccagcgccaccccaacacccacgaccgccucccccccggcccccgcccccucccccuccucggcaaccuccuccagauggaccgccgcggccuccucaaguccuuccuccgcuuccgcgagaaguacggcgacgucuucaccguccaccucggcccccgccccgucgucaugcucugcggcgucgaggccauccgcgaggcccucgucgacaaggccgaggccuucuccggccgcggcaagaucgccauggucgaccccuucuuccgcggcuacggcgucaucuucgccaacggcaaccgcuggaagguccuccgccgcuucuccgucaccaccaugcgcgacuucggcaugggcaagcgcuccgucgaggagcgcauccaggaggaggcccagugccucaucgaggagcuccgcaaguccaagggcgcccucauggaccccaccuuccucuuccaguccaucaccgccaacaucaucugcuccaucgucuucggcaagcgcuuccacuaccaggaccaggaguuccucaagaugcucaaccucuucuaccagaccuucucccucaucuccuccgucuucggccagcucuucgagcucuucuccggcuuccucaaguacuuccccggcgcccaccgccaggucuacaagaaccuccaggagaucaacgccuacaucggccacuccgucgagaagcaccgcgagacccucgaccccuccgcccccaaggaccucaucgacaccuaccuccuccacauggagaaggagaaguccaacgcccacuccgaguucucccaccagaaccucaaccucaacacccucucccucuucuucgccggcaccgagaccaccuccaccacccuccgcuacggcuuccuccucaugcucaaguacccccacgucgccgagcgcgucuaccgcgagaucgagcaggucaucggcccccaccgcccccccgagcuccacgaccgcgccaagaugcccuacaccgaggccgucaucuacgagauccagcgcuucuccgaccuccuccccaugggcgucccccacaucgucacccagcacaccuccuuccgcggcuacaucauccccaaggacaccgaggucuuccucauccucuccaccgcccuccacgacccccacuacuucgagaagcccgacgccuucaaccccgaccacuuccucgacgccaacggcgcccucaagaagaccgaggccuucauccccuucucccucggcaagcgcaucugccucggcgagggcaucgcccgcgccgagcucuuccucuucuucaccaccauccuccagaacuucuccauggccucccccgucgcccccgaggacaucgaccucaccccccaggagugcggcgucggcaagaucccccccaccuaccagauccgcuuccucccccgcuga

SEQ ID NO: 41988 - RNA, 1473 nt, Artificial Sequence
  derived and/or modified sequence opt2 from CYP2C18__Homo_sapiens__NP_000763
auggaccccgccgucgcccucguccucugccucuccugccucuuccuccucucccucuggcgccaguccuccggccgcggccgccuccccuccggccccaccccccuccccaucaucggcaacauccuccagcucgacgucaaggacauguccaagucccucaccaacuucuccaaggucuacggccccgucuucaccgucuacuucggccucaagcccaucgucguccuccacggcuacgaggccgucaaggaggcccucaucgaccacggcgaggaguucuccggccgcggcuccuuccccgucgccgagaaggucaacaagggccucggcauccucuucuccaacggcaagcgcuggaaggagauccgccgcuucugccucaugacccuccgcaacuucggcaugggcaagcgcuccaucgaggaccgcguccaggaggaggcccgcugccucgucgaggagcuccgcaagaccaacgccucccccugcgaccccaccuucauccucggcugcgcccccugcaacgucaucugcuccgucaucuuccacgaccgcuucgacuacaaggaccagcgcuuccucaaccucauggagaaguucaacgagaaccuccgcauccucuccucccccuggauccaggucugcaacaacuuccccgcccucaucgacuaccuccccggcucccacaacaagaucgccgagaacuucgccuacaucaaguccuacguccucgagcgcaucaaggagcaccaggagucccucgacaugaacuccgcccgcgacuucaucgacugcuuccucaucaagauggagcaggagaagcacaaccagcaguccgaguucaccgucgagucccucaucgccaccgucaccgacauguucggcgccggcaccgagaccaccuccaccacccuccgcuacggccuccuccuccuccucaaguaccccgaggucaccgccaagguccaggaggagaucgagugcgucgucggccgcaaccgcucccccugcaugcaggaccgcucccacaugcccuacaccgacgccgucguccacgagauccagcgcuacaucgaccuccuccccaccaaccucccccacgccgucaccugcgacgucaaguucaagaacuaccucauccccaagggcaccaccaucaucaccucccucaccuccguccuccacaacgacaaggaguuccccaaccccgagauguucgaccccggccacuuccucgacaaguccggcaacuucaagaaguccgacuacuucaugcccuucuccgccggcaagcgcaugugcaugggcgagggccucgcccgcauggagcucuuccucuuccucaccaccauccuccagaacuucaaccucaagucccaggucgaccccaaggacaucgacaucacccccaucgccaacgccuucggccgcguccccccccucuaccagcucugcuucauccccgucuga

SEQ ID NO: 41989 - RNA, 1473 nt, Artificial Sequence
  derived and/or modified sequence opt2 from CYP2C19__Homo_sapiens__NP_000760
auggaccccuucgucguccucguccucugccucuccugccuccuccuccucuccaucuggcgccaguccuccggccgcggcaagcucccccccggccccaccccccuccccgucaucggcaacauccuccagaucgacaucaaggacgucuccaagucccucaccaaccucuccaagaucuacggccccgucuucacccucuacuucggccucgagcgcauggucguccuccacggcuacgaggucgucaaggaggcccucaucgaccucggcgaggaguucuccggccgcggccacuucccccucgccgagcgcgccaaccgcggcuucggcaucgucuucuccaacggcaagcgcuggaaggagauccgccgcuucucccucaugacccuccgcaacuucggcaugggcaagcgcuccaucgaggaccgcguccaggaggaggcccgcugccucgucgaggagcuccgcaagaccaaggccucccccugcgaccccaccuucauccucggcugcgcccccugcaacgucaucugcuccaucaucuuccagaagcgcuucgacuacaaggaccagcaguuccucaaccucauggagaagcucaacgagaacauccgcaucgucuccacccccuggauccagaucugcaacaacuuccccaccaucaucgacuacuuccccggcacccacaacaagcuccucaagaaccucgccuucauggaguccgacauccucgagaaggucaaggagcaccaggaguccauggacaucaacaacccccgcgacuucaucgacugcuuccucaucaagauggagaaggagaagcagaaccagcaguccgaguucaccaucgagaaccucgucaucaccgccgccgaccuccucggcgccggcaccgagaccaccuccaccacccuccgcuacgcccuccuccuccuccucaagcaccccgaggucaccgccaagguccaggaggagaucgagcgcgucaucggccgcaaccgcucccccugcaugcaggaccgcggccacaugcccuacaccgacgccgucguccacgagguccagcgcuacaucgaccucauccccaccucccucccccacgccgucaccugcgacgucaaguuccgcaacuaccucauccccaagggcaccaccauccucaccucccucaccuccguccuccacgacaacaaggaguuccccaaccccgagauguucgacccccgccacuuccucgacgagggcggcaacuucaagaaguccaacuacuucaugcccuucuccgccggcaagcgcaucugcgucggcgagggccucgcccgcauggagcucuuccucuuccucaccuucauccuccagaacuucaaccucaagucccucaucgaccccaaggaccucgacaccacccccgucgucaacggcuucgccuccgucccccccuucuaccagcucugcuucauccccgucuga

SEQ ID NO: 41990 - RNA, 1473 nt, Artificial Sequence
  derived and/or modified sequence opt2 from CYP2C8__Homo_sapiens__NP_000761
auggagcccuucgucguccucguccucugccucuccuucaugcuccucuucucccucuggcgccaguccugccgccgccgcaagcucccccccggccccaccccccuccccaucaucggcaacaugcuccagaucgacgucaaggacaucugcaaguccuucaccaacuucuccaaggucuacggccccgucuucaccgucuacuucggcaugaaccccaucgucgucuuccacggcuacgaggccgucaaggaggcccucaucgacaacggcgaggaguucuccggccgcggcaacucccccaucucccagcgcaucaccaagggccucggcaucaucuccuccaacggcaagcgcuggaaggagauccgccgcuucucccucaccacccuccgcaacuucggcaugggcaagcgcuccaucgaggaccgcguccaggaggaggcccacugccucgucgaggagcuccgcaagaccaaggccucccccugcgaccccaccuucauccucggcugcgcccccugcaacgucaucugcuccgucgucuuccagaagcgcuucgacuacaaggaccagaacuuccucacccucaugaagcgcuucaacgagaacuuccgcauccucaacucccccuggauccaggucugcaacaacuucccccuccucaucgacugcuuccccggcacccacaacaagguccucaagaacgucgcccucacccgcuccuacauccgcgagaaggucaaggagcaccaggccucccucgacgucaacaacccccgcgacuucaucgacugcuuccucaucaagauggagcaggagaaggacaaccagaaguccgaguucaacaucgagaaccucgucggcaccgucgccgaccucuucgucgccggcaccgagaccaccuccaccacccuccgcuacggccuccuccuccuccucaagcaccccgaggucaccgccaagguccaggaggagaucgaccacgucaucggccgccaccgcucccccugcaugcaggaccgcucccacaugcccuacaccgacgccgucguccacgagauccagcgcuacuccgaccucguccccaccggcgucccccacgccgucaccaccgacaccaaguuccgcaacuaccucauccccaagggcaccaccaucauggcccuccucaccuccguccuccacgacgacaaggaguuccccaaccccaacaucuucgaccccggccacuuccucgacaagaacggcaacuucaagaaguccgacuacuucaugcccuucuccgccggcaagcgcaucugcgccggcgagggccucgcccgcauggagcucuuccucuuccucaccaccauccuccagaacuucaaccucaaguccgucgacgaccucaagaaccucaacaccaccgccgucaccaagggcaucgucucccucccccccuccuaccagaucugcuucauccccgucuga

SEQ ID NO: 41991 - RNA, 1473 nt, Artificial Sequence
  derived and/or modified sequence opt2 from CYP2C9__Homo_sapiens__NP_000762
auggacucccucgucguccucguccucugccucuccugccuccuccuccucucccucuggcgccaguccuccggccgcggcaagcucccccccggccccaccccccuccccgucaucggcaacauccuccagaucggcaucaaggacaucuccaagucccucaccaaccucuccaaggucuacggccccgucuucacccucuacuucggccucaagcccaucgucguccuccacggcuacgaggccgucaaggaggcccucaucgaccucggcgaggaguucuccggccgcggcaucuucccccucgccgagcgcgccaaccgcggcuucggcaucgucuucuccaacggcaagaaguggaaggagauccgccgcuucucccucaugacccuccgcaacuucggcaugggcaagcgcuccaucgaggaccgcguccaggaggaggcccgcugccucgucgaggagcuccgcaagaccaaggccucccccugcgaccccaccuucauccucggcugcgcccccugcaacgucaucugcuccaucaucuuccacaagcgcuucgacuacaaggaccagcaguuccucaaccucauggagaagcucaacgagaacaucaagauccucuccucccccuggauccagaucugcaacaacuucucccccaucaucgacuacuuccccggcacccacaacaagcuccucaagaacgucgccuucaugaaguccuacauccucgagaaggucaaggagcaccaggaguccauggacaugaacaacccccaggacuucaucgacugcuuccucaugaagauggagaaggagaagcacaaccagcccuccgaguucaccaucgagucccucgagaacaccgccgucgaccucuucggcgccggcaccgagaccaccuccaccacccuccgcuacgcccuccuccuccuccucaagcaccccgaggucaccgccaagguccaggaggagaucgagcgcgucaucggccgcaaccgcucccccugcaugcaggaccgcucccacaugcccuacaccgacgccgucguccacgagguccagcgcuacaucgaccuccuccccaccucccucccccacgccgucaccugcgacaucaaguuccgcaacuaccucauccccaagggcaccaccauccucaucucccucaccuccguccuccacgacaacaaggaguuccccaaccccgagauguucgacccccaccacuuccucgacgagggcggcaacuucaagaaguccaaguacuucaugcccuucuccgccggcaagcgcaucugcgucggcgaggcccucgccggcauggagcucuuccucuuccucaccuccauccuccagaacuucaaccucaagucccucgucgaccccaagaaccucgacaccacccccgucgucaacggcuucgccuccgucccccccuucuaccagcucugcuucauccccgucuga

SEQ ID NO: 41992 - RNA, 1494 nt, Artificial Sequence
  derived and/or modified sequence opt2 from CYP2D6__Homo_sapiens__NP_000097
augggccucgaggcccucgucccccucgccgucaucgucgccaucuuccuccuccucgucgaccucaugcaccgccgccagcgcugggccgcccgcuacccccccggcccccucccccuccccggccucggcaaccuccuccacgucgacuuccagaacacccccuacugcuucgaccagcuccgccgccgcuucggcgacgucuucucccuccagcucgccuggacccccgucgucguccucaacggccucgccgccguccgcgaggcccucgucacccacggcgaggacaccgccgaccgcccccccguccccaucacccagauccucggcuucggcccccgcucccagggcgucuuccucgcccgcuacggccccgccuggcgcgagcagcgccgcuucuccgucuccacccuccgcaaccucggccucggcaagaagucccucgagcagugggucaccgaggaggccgccugccucugcgccgccuucgccaaccacuccggccgccccuuccgccccaacggccuccucgacaaggccgucuccaacgucaucgccucccucaccugcggccgccgcuucgaguacgacgacccccgcuuccuccgccuccucgaccucgcccaggagggccucaaggaggaguccggcuuccuccgcgagguccucaacgccguccccguccuccuccacauccccgcccucgccggcaagguccuccgcuuccagaaggccuuccucacccagcucgacgagcuccucaccgagcaccgcaugaccugggaccccgcccagcccccccgcgaccucaccgaggccuuccucgccgagauggagaaggccaagggcaaccccgaguccuccuucaacgacgagaaccuccgcaucgucgucgccgaccucuucuccgccggcauggucaccaccuccaccacccucgccuggggccuccuccucaugauccuccaccccgacguccagcgccgcguccagcaggagaucgacgacgucaucggccagguccgccgccccgagaugggcgaccaggcccacaugcccuacaccaccgccgucauccacgagguccagcgcuucggcgacaucgucccccucggcgucacccacaugaccucccgcgacaucgagguccagggcuuccgcauccccaagggcaccacccucaucaccaaccucuccuccguccucaaggacgaggccgucugggagaagcccuuccgcuuccaccccgagcacuuccucgacgcccagggccacuucgucaagcccgaggccuuccuccccuucuccgccggccgccgcgccugccucggcgagccccucgcccgcauggagcucuuccucuucuucaccucccuccuccagcacuucuccuucuccguccccaccggccagccccgccccucccaccacggcgucuucgccuuccucgucucccccucccccuacgagcucugcgccgucccccgcuga

SEQ ID NO: 41993 - RNA, 1482 nt, Artificial Sequence
  derived and/or modified sequence opt2 from CYP2E1__Homo_sapiens__NP_000764
auguccgcccucggcgucaccgucgcccuccucgucugggccgccuuccuccuccucgucuccauguggcgccagguccacuccuccuggaaccucccccccggccccuucccccuccccaucaucggcaaccucuuccagcucgagcucaagaacauccccaaguccuucacccgccucgcccagcgcuucggccccgucuucacccucuacgucggcucccagcgcauggucgucaugcacggcuacaaggccgucaaggaggcccuccucgacuacaaggacgaguucuccggccgcggcgaccuccccgccuuccacgcccaccgcgaccgcggcaucaucuucaacaacggccccaccuggaaggacauccgccgcuucucccucaccacccuccgcaacuacggcaugggcaagcagggcaacgagucccgcauccagcgcgaggcccacuuccuccucgaggcccuccgcaagacccagggccagcccuucgaccccaccuuccucaucggcugcgcccccugcaacgucaucgccgacauccucuuccgcaagcacuucgacuacaacgacgagaaguuccuccgccucauguaccucuucaacgagaacuuccaccuccucuccacccccuggcuccagcucuacaacaacuuccccuccuuccuccacuaccuccccggcucccaccgcaaggucaucaagaacgucgccgaggucaaggaguacgucuccgagcgcgucaaggagcaccaccagucccucgaccccaacugcccccgcgaccucaccgacugccuccucgucgagauggagaaggagaagcacuccgccgagcgccucuacaccauggacggcaucaccgucaccgucgccgaccucuucuucgccggcaccgagaccaccuccaccacccuccgcuacggccuccucauccucaugaaguaccccgagaucgaggagaagcuccacgaggagaucgaccgcgucaucggccccucccgcauccccgccaucaaggaccgccaggagaugcccuacauggacgccgucguccacgagauccagcgcuucaucacccucguccccuccaaccucccccacgaggccacccgcgacaccaucuuccgcggcuaccucauccccaagggcaccgucgucguccccacccucgacuccguccucuacgacaaccaggaguuccccgaccccgagaaguucaagcccgagcacuuccucaacgagaacggcaaguucaaguacuccgacuacuucaagcccuucuccaccggcaagcgcgucugcgccggcgagggccucgcccgcauggagcucuuccuccuccucugcgccauccuccagcacuucaaccucaagccccucgucgaccccaaggacaucgaccucucccccauccacaucggcuucggcugcauccccccccgcuacaagcucugcgucaucccccgcuccuga

SEQ ID NO: 41994 - RNA, 1476 nt, Artificial Sequence
  derived and/or modified sequence opt2 from CYP2F1__Homo_sapiens__NP_000765
auggacuccaucuccaccgccauccuccuccuccuccucgcccucgucugccuccuccucacccucuccucccgcgacaagggcaagcucccccccggcccccgcccccucuccauccucggcaaccuccuccuccucugcucccaggacaugcucaccucccucaccaagcucuccaaggaguacggcuccauguacaccguccaccucggcccccgccgcgucgucguccucuccggcuaccaggccgucaaggaggcccucgucgaccagggcgaggaguucuccggccgcggcgacuaccccgccuucuucaacuucaccaagggcaacggcaucgccuucuccuccggcgaccgcuggaagguccuccgccaguucuccauccagauccuccgcaacuucggcaugggcaagcgcuccaucgaggagcgcauccucgaggagggcuccuuccuccucgccgagcuccgcaagaccgagggcgagcccuucgaccccaccuucguccucucccgcuccgucuccaacaucaucugcuccguccucuucggcucccgcuucgacuacgacgacgagcgccuccucaccaucauccgccucaucaacgacaacuuccagaucauguccucccccuggggcgagcucuacgacaucuuccccucccuccucgacuggguccccggcccccaccagcgcaucuuccagaacuucaagugccuccgcgaccucaucgcccacuccguccacgaccaccaggccucccucgacccccgcuccccccgcgacuucauccagugcuuccucaccaagauggccgaggagaaggaggacccccucucccacuuccacauggacacccuccucaugaccacccacaaccuccucuucggcggcaccaagaccgucuccaccacccuccaccacgccuuccucgcccucaugaaguaccccaagguccaggcccgcguccaggaggagaucgaccucgucgucggccgcgcccgccuccccgcccucaaggaccgcgccgccaugcccuacaccgacgccgucauccacgagguccagcgcuucgccgacaucauccccaugaaccucccccaccgcgucacccgcgacaccgccuuccgcggcuuccucauccccaagggcaccgacgucaucacccuccucaacaccguccacuacgaccccucccaguuccucaccccccaggaguucaaccccgagcacuuccucgacgccaaccaguccuucaagaagucccccgccuucaugcccuucuccgccggccgccgccucugccucggcgagucccucgcccgcauggagcucuuccucuaccucaccgccauccuccaguccuucucccuccagccccucggcgcccccgaggacaucgaccucaccccccucuccuccggccucggcaaccucccccgccccuuccagcucugccuccgcccccgcuga

SEQ ID NO: 41995 - RNA, 1506 nt, Artificial Sequence
  derived and/or modified sequence opt2 from CYP2R1__Homo_sapiens__NP_078790
auguggaagcucuggcgcgccgaggagggcgccgccgcccucggcggcgcccucuuccuccuccucuucgcccucggcguccgccagcuccucaagcagcgccgccccaugggcuucccccccggcccccccggccuccccuucaucggcaacaucuacucccucgccgccuccuccgagcucccccacgucuacaugcgcaagcagucccaggucuacggcgagaucuucucccucgaccucggcggcaucuccaccgucguccucaacggcuacgacgucgucaaggagugccucguccaccaguccgagaucuucgccgaccgccccugccucccccucuucaugaagaugaccaagaugggcggccuccucaacucccgcuacggccgcggcugggucgaccaccgccgccucgccgucaacuccuuccgcuacuucggcuacggccagaaguccuucgaguccaagauccucgaggagaccaaguucuucaacgacgccaucgagaccuacaagggccgccccuucgacuucaagcagcucaucaccaacgccgucuccaacaucaccaaccucaucaucuucggcgagcgcuucaccuacgaggacaccgacuuccagcacaugaucgagcucuucuccgagaacgucgagcucgccgccuccgccuccgucuuccucuacaacgccuuccccuggaucggcauccuccccuucggcaagcaccagcagcucuuccgcaacgccgccgucgucuacgacuuccucucccgccucaucgagaaggccuccgucaaccgcaagccccagcucccccagcacuucgucgacgccuaccucgacgagauggaccagggcaagaacgaccccuccuccaccuucuccaaggagaaccucaucuucuccgucggcgagcucaucaucgccggcaccgagaccaccaccaacguccuccgcugggccauccucuucauggcccucuaccccaacauccagggccagguccagaaggagaucgaccucaucaugggccccaacggcaagcccuccugggacgacaagugcaagaugcccuacaccgaggccguccuccacgagguccuccgcuucugcaacaucgucccccucggcaucuuccacgccaccuccgaggacgccgucguccgcggcuacuccauccccaagggcaccaccgucaucaccaaccucuacuccguccacuucgacgagaaguacuggcgcgaccccgaggucuuccaccccgagcgcuuccucgacuccuccggcuacuucgccaagaaggaggcccucguccccuucucccucggccgccgccacugccucggcgagcaccucgcccgcauggagauguuccucuucuucaccgcccuccuccagcgcuuccaccuccacuucccccacgagcucguccccgaccucaagccccgccucggcaugacccuccagccccagcccuaccucaucugcgccgagcgccgcuga

SEQ ID NO: 41996 - RNA, 1515 nt, Artificial Sequence
  derived and/or modified sequence opt2 from CYP2S1__Homo_sapiens__NP_085125
auggaggccaccggcaccugggcccuccuccucgcccucgcccuccuccuccuccucacccucgcccucuccggcacccgcgcccgcggccaccucccccccggccccaccccccucccccuccucggcaaccuccuccagcuccgccccggcgcccucuacuccggccucaugcgccucuccaagaaguacggccccgucuucaccaucuaccucggccccuggcgccccgucgucguccucgucggccaggaggccguccgcgaggcccucggcggccaggccgaggaguucuccggccgcggcaccgucgccaugcucgagggcaccuucgacggccacggcgucuucuucuccaacggcgagcgcuggcgccagcuccgcaaguucaccaugcucgcccuccgcgaccucggcaugggcaagcgcgagggcgaggagcucauccaggccgaggcccgcugccucgucgagaccuuccagggcaccgagggccgccccuucgaccccucccuccuccucgcccaggccaccuccaacgucgucugcucccuccucuucggccuccgcuucuccuacgaggacaaggaguuccaggccgucguccgcgccgccggcggcacccuccucggcgucuccucccagggcggccagaccuacgagauguucuccugguuccuccgcccccuccccggcccccacaagcagcuccuccaccacgucuccacccucgccgccuucaccguccgccagguccagcagcaccagggcaaccucgacgccuccggccccgcccgcgaccucgucgacgccuuccuccucaagauggcccaggaggagcagaaccccggcaccgaguucaccaacaagaacaugcucaugaccgucaucuaccuccucuucgccggcaccaugaccgucuccaccaccgucggcuacacccuccuccuccucaugaaguacccccacguccagaaguggguccgcgaggagcucaaccgcgagcucggcgccggccaggcccccucccucggcgaccgcacccgccuccccuacaccgacgccguccuccacgaggcccagcgccuccucgcccucguccccaugggcaucccccgcacccucaugcgcaccacccgcuuccgcggcuacacccucccccagggcaccgaggucuucccccuccucggcuccauccuccacgaccccaacaucuucaagcaccccgaggaguucaaccccgaccgcuuccucgacgccgacggccgcuuccgcaagcacgaggccuuccuccccuucucccucggcaagcgcgucugccucggcgagggccucgccaaggccgagcucuuccucuucuucaccaccauccuccaggccuucucccucgagucccccugcccccccgacacccucucccucaagcccaccgucuccggccucuucaacaucccccccgccuuccagcuccagguccgccccaccgaccuccacuccaccacccagacccgcuga

SEQ ID NO: 41997 - RNA, 1635 nt, Artificial Sequence
  derived and/or modified sequence opt2 from CYP2U1__Homo_sapiens__NP_898898
auguccucccccggccccucccagccccccgccgaggacccccccuggcccgcccgccuccuccgcgccccccucggccuccuccgccucgaccccuccggcggcgcccuccuccucugcggccucgucgcccuccucggcugguccuggcuccgccgccgccgcgcccgcggcaucccccccggccccacccccuggccccucgucggcaacuucggccacguccuccucccccccuuccuccgccgccgcuccuggcucuccucccgcacccgcgccgccggcaucgaccccuccgucaucggcccccagguccuccucgcccaccucgcccgcgucuacggcuccaucuucuccuucuucaucggccacuaccucgucgucguccucuccgacuuccacuccguccgcgaggcccucguccagcaggccgaggucuucuccgaccgcccccgcgucccccucaucuccaucgucaccaaggagaagggcgucgucuucgcccacuacggccccgucuggcgccagcagcgcaaguucucccacuccacccuccgccacuucggccucggcaagcucucccucgagcccaagaucaucgaggaguucaaguacgucaaggccgagaugcagaagcacggcgaggaccccuucugccccuucuccaucaucuccaacgccgucuccaacaucaucugcucccucugcuucggccagcgcuucgacuacaccaacuccgaguucaagaagaugcucggcuucaugucccgcggccucgagaucugccucaacucccagguccuccucgucaacaucugccccuggcucuacuaccuccccuucggccccuucaaggagcuccgccagaucgagaaggacaucaccuccuuccucaagaagaucaucaaggaccaccaggagucccucgaccgcgagaacccccaggacuucaucgacauguaccuccuccacauggaggaggagcgcaagaacaacuccaacuccuccuucgacgaggaguaccucuucuacaucaucggcgaccucuucaucgccggcaccgacaccaccaccaacucccuccucuggugccuccucuacaugucccucaaccccgacguccaggagaagguccacgaggagaucgagcgcgucaucggcgccaaccgcgcccccucccucaccgacaaggcccagaugcccuacaccgaggccaccaucauggagguccagcgccucaccgucgucgucccccucgccaucccccacaugaccuccgagaacaccguccuccagggcuacaccauccccaagggcacccucauccuccccaaccucugguccguccaccgcgaccccgccaucugggagaagcccgaggacuucuaccccaaccgcuuccucgacgaccagggccagcucaucaagaaggagaccuucauccccuucggcaucggcaagcgcgucugcaugggcgagcagcucgccaagauggagcucuuccucauguucgucucccucaugcaguccuucgccuucgcccuccccgaggacuccaagaagccccuccucaccggccgcuucggccucacccucgccccccaccccuucaacaucaccaucucccgccgcuga

SEQ ID NO: 41998 - RNA, 1473 nt, Artificial Sequence
  derived and/or modified sequence opt2 from CYP2W1__Homo_sapiens__NP_060251
auggcccuccuccuccuccucuuccucggccuccucggccucuggggccuccucugcgccugcgcccaggaccccucccccgccgcccgcuggccccccggcccccgcccccucccccucgucggcaaccuccaccuccuccgccucucccagcaggaccgcucccucauggagcucuccgagcgcuacggccccgucuucaccguccaccucggccgccagaagaccgucguccucaccggcuucgaggccgucaaggaggcccucgccggccccggccaggagcucgccgaccgcccccccaucgccaucuuccagcucauccagcgcggcggcggcaucuucuucuccuccggcgcccgcuggcgcgccgcccgccaguucaccguccgcgcccuccacucccucggcgucggccgcgagcccgucgccgacaagauccuccaggagcucaagugccucuccggccagcucgacggcuaccgcggccgccccuucccccucgcccuccucggcugggcccccuccaacaucaccuucgcccuccucuucggccgccgcuucgacuaccgcgaccccgucuucgucucccuccucggccucaucgacgaggucaugguccuccucggcucccccggccuccagcucuucaacgucuaccccuggcucggcgcccuccuccagcuccaccgccccguccuccgcaagaucgaggagguccgcgccauccuccgcacccuccucgaggcccgccgcccccacgucugccccggcgaccccgucugcuccuacgucgacgcccucauccagcagggccagggcgacgaccccgagggccucuucgccgaggccaacgccgucgccugcacccucgacauggucauggccggcaccgagaccaccuccgccacccuccagugggccgcccuccucaugggccgccaccccgacguccagggccgcguccaggaggagcucgaccgcguccucggccccggccgcaccccccgccucgaggaccagcaggcccuccccuacaccuccgccguccuccacgagguccagcgcuucaucacccuccucccccacgucccccgcugcaccgccgccgacacccagcucggcggcuuccuccuccccaagggcacccccgucaucccccuccucaccuccguccuccucgacgagacccaguggcagacccccggccaguucaaccccggccacuuccucgacgccaacggccacuucgucaagcgcgaggccuuccuccccuucuccgccggccgccgcgucugcgucggcgagcgccucgcccgcaccgagcucuuccuccucuucgccggccuccuccagcgcuaccgccuccuccccccccccggcgucucccccgccucccucgacaccacccccgcccgcgccuucaccaugcgcccccgcgcccaggcccucugcgccgucccccgccccuga

SEQ ID NO: 41999 - RNA, 1410 nt, Artificial Sequence
  derived and/or modified sequence opt2 from CYP39A1__Homo_sapiens__NP_057677
auggagcucaucucccccaccgucaucaucauccucggcugccucgcccucuuccuccuccuccagcgcaagaaccuccgccgcccccccugcaucaagggcuggauccccuggaucggcgucggcuucgaguucggcaaggccccccucgaguucaucgagaaggcccgcaucaaguacggccccaucuucaccgucuucgccaugggcaaccgcaugaccuucgucaccgaggaggagggcaucaacgucuuccucaaguccaagaaggucgacuucgagcucgccguccagaacaucgucuaccgcaccgccuccauccccaagaacgucuuccucgcccuccacgagaagcucuacaucaugcucaagggcaagaugggcaccgucaaccuccaccaguucaccggccagcucaccgaggagcuccacgagcagcucgagaaccucggcacccacggcaccauggaccucaacaaccucguccgccaccuccucuaccccgucaccgucaacaugcucuucaacaagucccucuucuccaccaacaagaagaagaucaaggaguuccaccaguacuuccaggucuacgacgaggacuucgaguacggcucccagcuccccgagugccuccuccgcaacugguccaaguccaagaagugguuccucgagcucuucgagaagaacauccccgacaucaaggccugcaaguccgccaaggacaacuccaugacccuccuccaggccacccucgacaucgucgagaccgagaccuccaaggagaacucccccaacuacggccuccuccuccucugggccucccucuccaacgccguccccgucgccuucuggacccucgccuacguccucucccaccccgacauccacaaggccaucauggagggcaucuccuccgucuucggcaaggccggcaaggacaagaucaaggucuccgaggacgaccucgagaaccuccuccucaucaaguggugcguccucgagaccauccgccucaaggcccccggcgucaucacccgcaaggucgucaagcccgucgagauccucaacuacaucauccccuccggcgaccuccucaugcucucccccuucuggcuccaccgcaaccccaaguacuuccccgagcccgagcucuucaagcccgagcgcuggaagaaggccaaccucgagaagcacuccuuccucgacugcuucauggccuucggcuccggcaaguuccagugccccgcccgcugguucgcccuccucgagguccagaugugcaucauccucauccucuacaaguacgacugcucccuccucgacccccuccccaagcaguccuaccuccaccucgucggcgucccccagcccgagggccagugccgcaucgaguacaagcagcgcaucuga

SEQ ID NO: 42000 - RNA, 1182 nt, Artificial Sequence
  derived and/or modified sequence opt2 from CYP3A43__Homo_sapiens__NP_001265850
auggaccucauccccaacuucgccauggagaccuggguccucgucgccaccucccucguccuccucuacaucuacggcacccacucccacaagcucuucaagaagcucggcauccccggccccaccccccuccccuuccucggcaccauccucuucuaccuccgccgcucccucaacaagauccccuccugggccugguggcucacccccgucauccccgcccucugggaggccgaggccggcggcucccccaagguccgcuccucccgccccgcccuccccaccugggucuucggcauccucaccgagaacgucaugaagaacaccgagaagugcggcgcccucuuccccuuccucacccccgucuucgaggcccucaacaucggccucuuccccaaggacgucacccacuuccucaagaacuccaucgagcgcaugaaggagucccgccucaaggacaagcagaagcaccgcgucgacuucuuccagcagaugaucgacucccagaacuccaaggagaccaagucccacaaggcccucuccgaccucgagcucgucgcccaguccaucaucaucaucuucgccgccuacgacaccaccuccaccacccuccccuucaucauguacgagcucgccacccaccccgacguccagcagaagcuccaggaggagaucgacgccguccuccccaacaaggcccccgucaccuacgacgcccucguccagauggaguaccucgacauggucgucaacgagacccuccgccucuuccccgucgucucccgcgucacccgcgucugcaagaaggacaucgagaucaacggcgucuucauccccaagggccucgccgucaugguccccaucuacgcccuccaccacgaccccaaguacuggaccgagcccgagaaguucugccccgagcgcuucuccaagaagaacaaggacuccaucgaccucuaccgcuacauccccuucggcgccggcccccgcaacugcaucggcaugcgcuucgcccucaccaacaucaagcucgccgucauccgcgcccuccagaacuucuccuucaagcccugcaaggagacccagaucccccucaagcucgacaaccuccccauccuccagcccgagaagcccaucguccucaagguccaccuccgcgacggcaucaccuccggccccuga

SEQ ID NO: 42001 - RNA, 1509 nt, Artificial Sequence
  derived and/or modified sequence opt2 from CYP3A4__Homo_sapiens__NP_001189784
auggcccucauccccgaccucgccauggagaccuggcuccuccucgccgucucccucguccuccucuaccucuacggcacccacucccacggccucuucaagaagcucggcauccccggccccaccccccuccccuuccucggcaacauccucuccuaccacaagggcuucugcauguucgacauggagugccacaagaaguacggcaaggucuggggcuucuacgacggccagcagcccguccucgccaucaccgaccccgacaugaucaagaccguccucgucaaggagugcuacuccgucuucaccaaccgccgccccuucggccccgucggcuucaugaaguccgccaucuccaucgccgaggacgaggaguggaagcgccuccgcucccuccucucccccaccuucaccuccggcaagcucaaggagaugguccccaucaucgcccaguacggcgacguccucguccgcaaccuccgccgcgaggccgagaccggcaagcccgucacccucaaggacgucuucggcgccuacuccauggacgucaucaccuccaccuccuucggcgucaacaucgacucccucaacaacccccaggaccccuucgucgagaacaccaagaagcuccuccgcuucgacuuccucgaccccuucuuccucuccaucaucuuccccuuccucauccccauccucgagguccucaacaucugcgucuucccccgcgaggucaccaacuuccuccgcaaguccgucaagcgcaugaaggagucccgccucgaggacacccagaagcaccgcgucgacuuccuccagcucaugaucgacucccagaacuccaaggagaccgagucccacaaggcccucuccgaccucgagcucgucgcccaguccaucaucuucaucuucgccggcuacgagaccaccuccuccguccucuccuucaucauguacgagcucgccacccaccccgacguccagcagaagcuccaggaggagaucgacgccguccuccccaacaaggccccccccaccuacgacaccguccuccagauggaguaccucgacauggucgucaacgagacccuccgccucuuccccaucgccaugcgccucgagcgcgucugcaagaaggacgucgagaucaacggcauguucauccccaagggcgucgucgucaugauccccuccuacgcccuccaccgcgaccccaaguacuggaccgagcccgagaaguuccuccccgagcgcuucuccaagaagaacaaggacaacaucgaccccuacaucuacacccccuucggcuccggcccccgcaacugcaucggcaugcgcuucgcccucaugaacaugaagcucgcccucauccgcguccuccagaacuucuccuucaagcccugcaaggagacccagaucccccucaagcucucccucggcggccuccuccagcccgagaagcccgucguccucaaggucgagucccgcgacggcaccgucuccggcgccuga

SEQ ID NO: 42002 - RNA, 1509 nt, Artificial Sequence
  derived and/or modified sequence opt2 from CYP3A5__Homo_sapiens__NP_000768
auggaccucauccccaaccucgccgucgagaccuggcuccuccucgccgucucccucguccuccucuaccucuacggcacccgcacccacggccucuucaagcgccucggcauccccggccccaccccccucccccuccucggcaacguccucuccuaccgccagggccucuggaaguucgacaccgagugcuacaagaaguacggcaagauguggggcaccuacgagggccagcuccccguccucgccaucaccgaccccgacgucauccgcaccguccucgucaaggagugcuacuccgucuucaccaaccgccgcucccucggccccgucggcuucaugaaguccgccaucucccucgccgaggacgaggaguggaagcgcauccgcucccuccucucccccaccuucaccuccggcaagcucaaggagauguuccccaucaucgcccaguacggcgacguccucguccgcaaccuccgccgcgaggccgagaagggcaagcccgucacccucaaggacaucuucggcgccuacuccauggacgucaucaccggcaccuccuucggcgucaacaucgacucccucaacaacccccaggaccccuucgucgaguccaccaagaaguuccucaaguucggcuuccucgacccccucuuccucuccaucauccucuuccccuuccucacccccgucuucgaggcccucaacgucucccucuuccccaaggacaccaucaacuuccucuccaaguccgucaaccgcaugaagaagucccgccucaacgacaagcagaagcaccgccucgacuuccuccagcucaugaucgacucccagaacuccaaggagaccgagucccacaaggcccucuccgaccucgagcucgccgcccaguccaucaucuucaucuucgccggcuacgagaccaccuccuccguccucuccuucacccucuacgagcucgccacccaccccgacguccagcagaagcuccagaaggagaucgacgccguccuccccaacaaggccccccccaccuacgacgccgucguccagauggaguaccucgacauggucgucaacgagacccuccgccucuuccccgucgccauccgccucgagcgcaccugcaagaaggacgucgagaucaacggcgucuucauccccaagggcuccauggucgucauccccaccuacgcccuccaccacgaccccaaguacuggaccgagcccgaggaguuccgccccgagcgcuucuccaagaagaaggacuccaucgaccccuacaucuacacccccuucggcaccggcccccgcaacugcaucggcaugcgcuucgcccucaugaacaugaagcucgcccucauccgcguccuccagaacuucuccuucaagcccugcaaggagacccagaucccccucaagcucgacacccagggccuccuccagcccgagaagcccaucguccucaaggucgacucccgcgacggcacccucuccggcgaguga

SEQ ID NO: 42003 - RNA, 1608 nt, Artificial Sequence
  derived and/or modified sequence opt2 from CYP3A7-CYP3A51P__Homo_sapiens__NP_001243426
auggaccucauccccaaccucgccgucgagaccuggcuccuccucgccgucucccucauccuccucuaccucuacggcacccgcacccacggccucuucaagaagcucggcauccccggccccaccccccuccccuuccucggcaacgcccucuccuuccgcaagggcuacuggaccuucgacauggagugcuacaagaaguaccgcaaggucuggggcaucuacgacugccagcagcccaugcucgccaucaccgaccccgacaugaucaagaccguccucgucaaggagugcuacuccgucuucaccaaccgccgccccuucggccccgucggcuucaugaagaacgccaucuccaucgccgaggacgaggaguggaagcgcauccgcucccuccucucccccaccuucaccuccggcaagcucaaggagaugguccccaucaucgcccaguacggcgacguccucguccgcaaccuccgccgcgaggccgagaccggcaagcccgucacccucaagcacgucuucggcgccuacuccauggacgucaucaccuccaccuccuucggcgucuccaucgacucccucaacaacccccaggaccccuucgucgagaacaccaagaagcuccuccgcuucaacccccucgaccccuucguccucuccaucaaggucuuccccuuccucacccccauccucgaggcccucaacaucaccgucuucccccgcaaggucaucuccuuccucaccaaguccgucaagcagaucaaggagggccgccucaaggagacccagaagcaccgcgucgacuuccuccagcucaugaucgacucccagaacuccaaggacuccgagacccacaaggcccucuccgaccucgagcucauggcccaguccaucaucuucaucuucgccggcuacgagaccaccuccuccguccucuccuucaucaucuacgagcucgccacccaccccgacguccagcagaagguccagaaggagaucgacaccguccuccccaacaaggccccccccaccuacgacaccguccuccagcucgaguaccucgacauggucgucaacgagacccuccgccucuuccccgucgccaugcgccucgagcgcgucugcaagaaggacgucgagaucaacggcauguucauccccaagggcgucgucgucaugauccccuccuacguccuccaccacgaccccaaguacuggaccgagcccgagaaguuccuccccgagcgcuucuccaagaagaacaaggacaacaucgaccccuacaucuacacccccuucggcuccggcccccgcaacugcaucggcaugcgcuucgcccucgucaacaugaagcucgcccucguccgcguccuccagaacuucuccuucaagcccugcaaggagacccagaucccccucaagcuccgcuucggcggccuccuccucaccgagaagcccaucguccucaaggccgagucccgcgacgagaccuucgucgacauggagcccauccacauggacuuccuccgcucccucgccuuccagggcccccaccucugcuucuucugggagcuccucugccccaccauccgcucccgcuga

SEQ ID NO: 42004 - RNA, 1512 nt, Artificial Sequence
  derived and/or modified sequence opt2 from CYP3A7__Homo_sapiens__NP_000756
auggaccucauccccaaccucgccgucgagaccuggcuccuccucgccgucucccucauccuccucuaccucuacggcacccgcacccacggccucuucaagaagcucggcauccccggccccaccccccuccccuuccucggcaacgcccucuccuuccgcaagggcuacuggaccuucgacauggagugcuacaagaaguaccgcaaggucuggggcaucuacgacugccagcagcccaugcucgccaucaccgaccccgacaugaucaagaccguccucgucaaggagugcuacuccgucuucaccaaccgccgccccuucggccccgucggcuucaugaagaacgccaucuccaucgccgaggacgaggaguggaagcgcauccgcucccuccucucccccaccuucaccuccggcaagcucaaggagaugguccccaucaucgcccaguacggcgacguccucguccgcaaccuccgccgcgaggccgagaccggcaagcccgucacccucaagcacgucuucggcgccuacuccauggacgucaucaccuccaccuccuucggcgucuccaucgacucccucaacaacccccaggaccccuucgucgagaacaccaagaagcuccuccgcuucaacccccucgaccccuucguccucuccaucaaggucuuccccuuccucacccccauccucgaggcccucaacaucaccgucuucccccgcaaggucaucuccuuccucaccaaguccgucaagcagaucaaggagggccgccucaaggagacccagaagcaccgcgucgacuuccuccagcucaugaucgacucccagaacuccaaggacuccgagacccacaaggcccucuccgaccucgagcucauggcccaguccaucaucuucaucuucgccggcuacgagaccaccuccuccguccucuccuucaucaucuacgagcucgccacccaccccgacguccagcagaagguccagaaggagaucgacaccguccuccccaacaaggccccccccaccuacgacaccguccuccagcucgaguaccucgacauggucgucaacgagacccuccgccucuuccccgucgccaugcgccucgagcgcgucugcaagaaggacgucgagaucaacggcauguucauccccaagggcgucgucgucaugauccccuccuacguccuccaccacgaccccaaguacuggaccgagcccgagaaguuccuccccgagcgcuucuccaagaagaacaaggacaacaucgaccccuacaucuacacccccuucggcuccggcccccgcaacugcaucggcaugcgcuucgcccucgucaacaugaagcucgcccucguccgcguccuccagaacuucuccuucaagcccugcaaggagacccagaucccccucaagcuccgcuucggcggccuccuccucaccgagaagcccaucguccucaaggccgagucccgcgacgagaccgucuccggcgccuga

SEQ ID NO: 42005 - RNA, 1503 nt, Artificial Sequence
  derived and/or modified sequence opt2 from CYP46A1__Homo_sapiens__NP_006659
augucccccggccuccuccuccucggcuccgccguccuccucgccuucggccucugcugcaccuucguccaccgcgcccgcucccgcuacgagcacauccccggccccccccgccccuccuuccuccucggccaccuccccugcuucuggaagaaggacgaggucggcggccgcguccuccaggacgucuuccucgacugggccaagaaguacggccccgucguccgcgucaacgucuuccacaagaccuccgucaucgucaccucccccgaguccgucaagaaguuccucauguccaccaaguacaacaaggacuccaagauguaccgcgcccuccagaccgucuucggcgagcgccucuucggccagggccucgucuccgagugcaacuacgagcgcuggcacaagcagcgccgcgucaucgaccucgccuucucccgcuccucccucgucucccucauggagaccuucaacgagaaggccgagcagcucgucgagauccucgaggccaaggccgacggccagacccccgucuccaugcaggacaugcucaccuacaccgccauggacauccucgccaaggccgccuucggcauggagaccuccaugcuccucggcgcccagaagccccucucccaggccgucaagcucaugcucgagggcaucaccgccucccgcaacacccucgccaaguuccuccccggcaagcgcaagcagcuccgcgagguccgcgaguccauccgcuuccuccgccaggucggccgcgacuggguccagcgccgccgcgaggcccucaagcgcggcgaggagguccccgccgacauccucacccagauccucaaggccgaggagggcgcccaggacgacgagggccuccucgacaacuucgucaccuucuucaucgccggccacgagaccuccgccaaccaccucgccuucaccgucauggagcucucccgccagcccgagaucgucgcccgccuccaggccgaggucgacgaggucaucggcuccaagcgcuaccucgacuucgaggaccucggccgccuccaguaccucucccagguccucaaggagucccuccgccucuacccccccgccuggggcaccuuccgccuccucgaggaggagacccucaucgacggcguccgcguccccggcaacaccccccuccucuucuccaccuacgucaugggccgcauggacaccuacuucgaggacccccucaccuucaaccccgaccgcuucggccccggcgcccccaagccccgcuucaccuacuuccccuucucccucggccaccgcuccugcaucggccagcaguucgcccagauggaggucaaggucgucauggccaagcuccuccagcgccucgaguuccgccucguccccggccagcgcuucggccuccaggagcaggccacccucaagccccucgaccccguccucugcacccuccgcccccgcggcuggcagcccgcccccccccccccccccugcuga

SEQ ID NO: 42006 - RNA, 804 nt, Artificial Sequence
  derived and/or modified sequence opt2 from CYP4A11__Homo_sapiens__XP_011539132
auguccgucuccguccucucccccucccgccuccucggcgacgucuccggcauccuccaggccgccucccuccucauccuccuccuccuccucaucaaggccguccagcucuaccuccaccgccaguggcuccucaaggcccuccagcaguuccccugcccccccucccacuggcucuucggccacauccaggagcuccagcaggaccaggagcuccagcgcauccagaagugggucgagaccuuccccuccgccugcccccacuggcucuggggcggcaagguccgcguccagcucuacgaccccgacuacaugaaggucauccucggccgcuccgcccucuccugccucuccgaccccaagucccacggcuccuaccgcuuccucgcccccuggaucggcuacggccuccuccuccucaacggccagaccugguuccagcaccgccgcaugcucacccccgccuuccacuacgacauccucaagcccuacgucggccucauggccgacuccguccgcgucaugcucgacaagugggaggagcuccucggccaggacuccccccucgaggucuuccagcacgucucccucaugacccucgacaccaucaugaagugcgccuucucccaccagggcuccauccaggucgaccgccccuccgaccccaccgaggagggcuccaccaccgagggcggcggcgccggcgaggaccaggaggaggaggccuucggcuucuccggcuaccccccccucggccagaacggcgagugggagcaccucguccgccagggcccccccugcuga

SEQ ID NO: 42007 - RNA, 1494 nt, Artificial Sequence
  derived and/or modified sequence opt2 from CYP4B1__Homo_sapiens__NP_001306090
augguccccuccuuccucucccucuccuucuccucccucggccucugggccuccggccucauccucguccucggcuuccucaagcucauccaccuccuccuccgccgccagacccucgccaaggccauggacaaguuccccggcccccccacccacuggcucuucggccacgcccucgagauccaggagaccggcucccucgacaaggucgucuccugggcccaccaguuccccuacgcccacccccucugguucggccaguucaucggcuuccucaacaucuacgagcccgacuacgccaaggccgucuacucccgcggcggccgcggccuccucguccucgagggccccaaguggcuccagcaccgcaagcuccucacccccggcuuccacuacgacguccucaagcccuacgucgccgucuucaccgaguccacccgcaucaugcucgacaagugggaggagaaggcccgcgagggcaaguccuucgacaucuucugcgacgucggccacauggcccucaacacccucaugaagugcaccuucggccgcggcgacaccggccucggccacucccgcgacuccuccuacuaccucgccgucuccgaccucacccuccucaugcagcagcgccucgucuccuuccaguaccacaacgacuucaucuacuggcucaccccccacggccgccgcuuccuccgcgccugccaggucgcccacgaccacaccgaccaggucauccgcgagcgcaaggccgcccuccaggacgagaagguccgcaagaagauccagaaccgccgccaccucgacuuccucgacauccuccucggcgcccgcgacgaggacgacaucaagcucuccgacgccgaccuccgcgccgaggucgacaccuucauguucgagggccacgacaccaccaccuccggcaucuccugguuccucuacugcauggcccucuaccccgagcaccagcaccgcugccgcgaggagguccgcgagauccucggcgaccaggacuucuuccagugggacgaccucggcaagaugaccuaccucaccaugugcaucaaggaguccuuccgccucuacccccccgucccccaggucuaccgccagcucuccaagcccgucaccuucgucgacggccgcucccuccccgccggcucccucaucuccaugcacaucuacgcccuccaccgcaacuccgccgucuggcccgaccccgaggucuucgacucccuccgcuucuccaccgagaacgccuccaagcgccaccccuucgccuucaugcccuucuccgccggcccccgcaacugcaucggccagcaguucgccauguccgagaugaaggucgucaccgccaugugccuccuccgcuucgaguucucccucgaccccucccgccuccccaucaagaugccccagcucguccuccgcuccaagaacggcuuccaccuccaccucaagccccucggccccggcuccggcaaguga

SEQ ID NO: 42008 - RNA, 1575 nt, Artificial Sequence
  derived and/or modified sequence opt2 from CYP4F11__Homo_sapiens__NP_067010
augccccagcucucccucuccuggcucggccucggccccgucgccgccucccccuggcuccuccuccuccucgucggcggcuccuggcuccucgcccgcguccucgccuggaccuacaccuucuacgacaacugccgccgccuccagugcuucccccagccccccaagcagaacugguucuggggccaccagggccucgucacccccaccgaggagggcaugaagacccucacccagcucgucaccaccuacccccagggcuucaagcucuggcucggccccaccuucccccuccucauccucugccaccccgacaucauccgccccaucaccuccgccuccgccgccgucgcccccaaggacaugaucuucuacggcuuccucaagcccuggcucggcgacggccuccuccucuccggcggcgacaaguggucccgccaccgccgcaugcucacccccgccuuccacuucaacauccucaagcccuacaugaagaucuucaacaaguccgucaacaucaugcacgacaaguggcagcgccucgccuccgagggcuccgcccgccucgacauguucgagcacaucucccucaugacccucgacucccuccagaagugcgucuucuccuucgaguccaacugccaggagaagcccuccgaguacaucgccgccauccucgagcucuccgccuucgucgagaagcgcaaccagcagauccuccuccacaccgacuuccucuacuaccucacccccgacggccagcgcuuccgccgcgccugccaccucguccacgacuucaccgacgccgucauccaggagcgccgcugcacccuccccacccagggcaucgacgacuuccucaagaacaaggccaaguccaagacccucgacuucaucgacguccuccuccucuccaaggacgaggacggcaaggagcucuccgacgaggacauccgcgccgaggccgacaccuucauguucgagggccacgacaccaccgccuccggccucuccuggguccucuaccaccucgccaagcaccccgaguaccaggagcagugccgccaggagguccaggagcuccucaaggaccgcgagcccaucgagaucgagugggacgaccucgcccagcuccccuuccucaccaugugcaucaaggagucccuccgccuccacccccccguccccgucaucucccgcugcugcacccaggacuucguccuccccgacggccgcgucauccccaagggcaucgucugccucaucaacaucaucggcauccacuacaaccccaccgucuggcccgaccccgaggucuacgaccccuuccgcuucgaccaggagaacaucaaggagcgcuccccccucgccuucauccccuucuccgccggcccccgcaacugcaucggccaggccuucgccauggccgagaugaaggucguccucgcccucacccuccuccacuuccgcauccuccccacccacaccgagccccgccgcaagcccgagcucauccuccgcgccgagggcggccucuggcuccgcgucgagccccucggcgccaacucccaguga

SEQ ID NO: 42009 - RNA, 1575 nt, Artificial Sequence
  derived and/or modified sequence opt2 from CYP4F12__Homo_sapiens__NP_076433
augucccuccucucccuccccuggcucggccuccgccccgucgccaccucccccuggcuccuccuccuccucgucgucggcuccuggcuccucgcccgcauccucgccuggaccuacgccuucuacaacaacugccgccgccuccagugcuucccccagccccccaagcgcaacugguucuggggccaccucggccucaucacccccaccgaggagggccucaagaacuccacccagauguccgccaccuacucccagggcuucaccgucuggcucggccccaucauccccuucaucguccucugccaccccgacaccauccgcuccaucaccaacgccuccgccgccaucgcccccaaggacaaccucuucauccgcuuccucaagcccuggcucggcgagggcauccuccucuccggcggcgacaaguggucccgccaccgccgcaugcucacccccgccuuccacuucaacauccucaaguccuacaucaccaucuucaacaaguccgccaacaucaugcucgacaaguggcagcaccucgccuccgagggcuccucccgccucgacauguucgagcacaucucccucaugacccucgacucccuccagaagugcaucuucuccuucgacucccacugccaggagcgccccuccgaguacaucgccaccauccucgagcucuccgcccucgucgagaagcgcucccagcacauccuccagcacauggacuuccucuacuaccucucccacgacggccgccgcuuccaccgcgccugccgccucguccacgacuucaccgacgccgucauccgcgagcgccgccgcacccuccccacccagggcaucgacgacuucuucaaggacaaggccaaguccaagacccucgacuucaucgacguccuccuccucuccaaggacgaggacggcaaggcccucuccgacgaggacauccgcgccgaggccgacaccuucauguucggcggccacgacaccaccgccuccggccucuccuggguccucuacaaccucgcccgccaccccgaguaccaggagcgcugccgccaggagguccaggagcuccucaaggaccgcgaccccaaggagaucgagugggacgaccucgcccagcuccccuuccucaccaugugcgucaaggagucccuccgccuccacccccccgcccccuucaucucccgcugcugcacccaggacaucguccuccccgacggccgcgucauccccaagggcaucaccugccucaucgacaucaucggcguccaccacaaccccaccgucuggcccgaccccgaggucuacgaccccuuccgcuucgaccccgagaacuccaagggccgcuccccccucgccuucauccccuucuccgccggcccccgcaacugcaucggccaggccuucgccauggccgagaugaaggucguccucgcccucaugcuccuccacuuccgcuuccuccccgaccacaccgagccccgccgcaagcucgagcucaucaugcgcgccgagggcggccucuggcuccgcgucgagccccucaacgucucccuccaguga

SEQ ID NO: 42010 - RNA, 1596 nt, Artificial Sequence
  derived and/or modified sequence opt2 from CYP4F22__Homo_sapiens__NP_775754
augcuccccaucaccgaccgccuccuccaccuccucggccucgagaagaccgccuuccgcaucuacgccgucuccacccuccuccucuuccuccucuucuuccucuuccgccuccuccuccgcuuccuccgccucugccgcuccuucuacaucaccugccgccgccuccgcugcuucccccagcccccccgccgcaacuggcuccucggccaccucggcauguaccuccccaacgaggccggccuccaggacgagaagaagguccucgacaacaugcaccacguccuccucgucuggaugggccccguccucccccuccucguccucguccaccccgacuacaucaagccccuccucggcgccuccgccgccaucgcccccaaggacgaccucuucuacggcuuccucaagcccuggcucggcgacggccuccuccucuccaagggcgacaaguggucccgccaccgccgccuccucacccccgccuuccacuucgacauccucaagcccuacaugaagaucuucaaccaguccgccgacaucaugcacgccaaguggcgccaccucgccgagggcuccgccgucucccucgacauguucgagcacaucucccucaugacccucgacucccuccagaagugcgucuucuccuacaacuccaacugccaggagaagauguccgacuacaucuccgccaucaucgagcucuccgcccucuccguccgccgccaguaccgccuccaccacuaccucgacuucaucuacuaccgcuccgccgacggccgccgcuuccgccaggccugcgacaugguccaccacuucaccaccgaggucauccaggagcgccgccgcgcccuccgccagcagggcgccgaggccuggcucaaggccaagcagggcaagacccucgacuucaucgacguccuccuccucgcccgcgacgaggacggcaaggagcucuccgacgaggacauccgcgccgaggccgacaccuucauguucgagggccacgacaccaccuccuccggcaucuccuggaugcucuucaaccucgccaaguaccccgaguaccaggagaagugccgcgaggagauccaggaggucaugaagggccgcgagcucgaggagcucgagugggacgaccucacccagcuccccuucaccaccaugugcaucaaggagucccuccgccaguacccccccgucacccucgucucccgccagugcaccgaggacaucaagcuccccgacggccgcaucauccccaagggcaucaucugccucgucuccaucuacggcacccaccacaaccccaccgucuggcccgacuccaaggucuacaaccccuaccgcuucgaccccgacaacccccagcagcgcuccccccucgccuacguccccuucuccgccggcccccgcaacugcaucggccaguccuucgccauggccgagcuccgcgucgucgucgcccucacccuccuccgcuuccgccucuccgucgaccgcacccgcaagguccgccgcaagcccgagcucauccuccgcaccgagaacggccucuggcucaaggucgagccccuccccccccgcgccuga

SEQ ID NO: 42011 - RNA, 1563 nt, Artificial Sequence
  derived and/or modified sequence opt2 from CYP4F2__Homo_sapiens__NP_001073
augucccagcucucccucuccuggcucggccucuggcccgucgccgccucccccuggcuccuccuccuccucgucggcgccuccuggcuccucgcccacguccucgccuggaccuacgccuucuacgacaacugccgccgccuccgcugcuucccccagcccccccgccgcaacugguucuggggccaccagggcauggucaaccccaccgaggagggcaugcgcguccucacccagcucgucgccaccuacccccagggcuucaaggucuggaugggccccaucuccccccuccucucccucugccaccccgacaucauccgcuccgucaucaacgccuccgccgccaucgcccccaaggacaaguucuucuacuccuuccucgagcccuggcucggcgacggccuccuccucuccgccggcgacaaguggucccgccaccgccgcaugcucacccccgccuuccacuucaacauccucaagcccuacaugaagaucuucaacgaguccgucaacaucaugcacgccaaguggcagcuccucgccuccgagggcuccgccugccucgacauguucgagcacaucucccucaugacccucgacucccuccagaagugcgucuucuccuucgacucccacugccaggagaagcccuccgaguacaucgccgccauccucgagcucuccgcccucgucuccaagcgccaccacgagauccuccuccacaucgacuuccucuacuaccucacccccgacggccagcgcuuccgccgcgccugccgccucguccacgacuucaccgacgccgucauccaggagcgccgccgcacccuccccucccagggcgucgacgacuuccuccaggccaaggccaaguccaagacccucgacuucaucgacguccuccuccucuccaaggacgaggacggcaagaagcucuccgacgaggacauccgcgccgaggccgacaccuucauguucgagggccacgacaccaccgccuccggccucuccuggguccucuaccaccucgccaagcaccccgaguaccaggagcgcugccgccaggagguccaggagcuccucaaggaccgcgagcccaaggagaucgagugggacgaccucgcccaccuccccuuccucaccaugugcaugaaggagucccuccgccuccacccccccguccccgucaucucccgccacgucacccaggacaucguccuccccgacggccgcgucauccccaagggcaucaucugccucaucuccgucuucggcacccaccacaaccccgccgucuggcccgaccccgaggucuacgaccccuuccgcuucgaccccgagaacaucaaggagcgcuccccccucgccuucauccccuucuccgccggcccccgcaacugcaucggccagaccuucgccauggccgagaugaaggucguccucgcccucacccuccuccgcuuccgcguccuccccgaccacaccgagccccgccgcaagcccgagcucguccuccgcgccgagggcggccucuggcuccgcgucgagccccucuccuga

SEQ ID NO: 42012 - RNA, 1563 nt, Artificial Sequence
  derived and/or modified sequence opt2 from CYP4F3__Homo_sapiens__NP_000887
augccccagcucucccucuccucccucggccucuggcccauggccgccucccccuggcuccuccuccuccucgucggcgccuccuggcuccucgcccgcauccucgccuggaccuacaccuucuacgacaacugcugccgccuccgcugcuucccccagccccccaagcgcaacugguuccucggccaccucggccucauccacuccuccgaggagggccuccucuacacccagucccucgccugcaccuucggcgacaugugcugcuggugggucggccccuggcacgccaucguccgcaucuuccaccccaccuacaucaagcccguccucuucgcccccgccgccaucguccccaaggacaaggucuucuacuccuuccucaagcccuggcucggcgacggccuccuccucuccgccggcgagaaguggucccgccaccgccgcaugcucacccccgccuuccacuucaacauccucaagcccuacaugaagaucuucaacgaguccgucaacaucaugcacgccaaguggcagcuccucgccuccgagggcuccgcccgccucgacauguucgagcacaucucccucaugacccucgacucccuccagaagugcgucuucuccuucgacucccacugccaggagaagcccuccgaguacaucgccgccauccucgagcucuccgcccucgucaccaagcgccaccagcagauccuccucuacaucgacuuccucuacuaccucacccccgacggccagcgcuuccgccgcgccugccgccucguccacgacuucaccgacgccgucauccaggagcgccgccgcacccuccccucccagggcgucgacgacuuccuccaggccaaggccaaguccaagacccucgacuucaucgacguccuccuccucuccaaggacgaggacggcaagaagcucuccgacgaggacauccgcgccgaggccgacaccuucauguucgagggccacgacaccaccgccuccggccucuccuggguccucuaccaccucgccaagcaccccgaguaccaggagcgcugccgccaggagguccaggagcuccucaaggaccgcgagcccaaggagaucgagugggacgaccucgcccagcuccccuuccucaccaugugcaucaaggagucccuccgccuccacccccccguccccgccgucucccgcugcugcacccaggacaucguccuccccgacggccgcgucauccccaagggcaucaucugccucaucuccgucuucggcacccaccacaaccccgccgucuggcccgaccccgaggucuacgaccccuuccgcuucgaccccaagaacaucaaggagcgcuccccccucgccuucauccccuucuccgccggcccccgcaacugcaucggccaggccuucgccauggccgagaugaaggucguccucggccucacccuccuccgcuuccgcguccuccccgaccacaccgagccccgccgcaagcccgagcucguccuccgcgccgagggcggccucuggcuccgcgucgagccccucuccuga

SEQ ID NO: 42013 - RNA, 1563 nt, Artificial Sequence
  derived and/or modified sequence opt2 from CYP4F8__Homo_sapiens__NP_009184
augucccuccucucccucuccuggcucggccuccgccccgucgccgccucccccuggcuccuccuccucgucgucggcgccuccuggcuccucgcccgcauccucgccuggaccuacgccuucuaccacaacggccgccgccuccgcugcuucccccagccccgcaagcagaacugguuccucggccaccucggccucgucacccccaccgaggagggccuccgcguccucacccagcucgucgccaccuacccccagggcuucguccgcuggcucggccccaucacccccaucaucaaccucugccaccccgacaucguccgcuccgucaucaacaccuccgacgccaucaccgacaaggacaucgucuucuacaagacccucaagcccuggcucggcgacggccuccuccucuccgucggcgacaaguggcgccaccaccgccgccuccucacccccgccuuccacuucaacauccucaagcccuacaucaagaucuucuccaaguccgccaacaucaugcacgccaaguggcagcgccucgccauggagggcuccaccugccucgacgucuucgagcacaucucccucaugacccucgacucccuccagaagugcaucuucuccuucgacuccaacugccaggagaagcccuccgaguacaucaccgccaucauggagcucuccgcccucgucgucaagcgcaacaaccaguucuuccgcuacaaggacuuccucuacuuccucacccccugcggccgccgcuuccaccgcgccugccgccucguccacgacuucaccgacgccgucauccaggagcgccgccgcacccucaccucccagggcgucgacgacuuccuccaggccaaggccaaguccaagacccucgacuucaucgacguccuccuccucuccgaggacaagaacggcaaggagcucuccgacgaggacauccgcgccgaggccgacaccuucauguucggcggccacgacaccaccgccuccggccucuccuggguccucuacaaccucgcccgccaccccgaguaccaggagcgcugccgccaggagguccaggagcuccucaaggaccgcgagcccaaggagaucgagugggacgaccucgcccagcuccccuuccucaccaugugccucaaggagucccuccgccuccacccccccauccccaccuucgcccgcggcugcacccaggacgucguccuccccgacucccgcgucauccccaagggcaacgucugcaacaucaacaucuucgccauccaccacaaccccuccgucuggcccgaccccgaggucuacgaccccuuccgcuucgaccccgagaacgcccagaagcgcucccccauggccuucauccccuucuccgccggcccccgcaacugcaucggccagaaguucgccauggccgagaugaaggucguccucgcccucacccuccuccgcuuccgcauccuccccgaccaccgcgagccccgccgcacccccgagaucguccuccgcgccgaggacggccucuggcuccgcgucgagccccucggcuga

SEQ ID NO: 42014 - RNA, 1578 nt, Artificial Sequence
  derived and/or modified sequence opt2 from CYP4V2__Homo_sapiens__NP_997235
auggccggccucuggcucggccucgucuggcagaagcuccuccucuggggcgccgccuccgcccucucccucgccggcgccucccucguccucucccuccuccagcgcgucgccuccuacgcccgcaaguggcagcagaugcgccccauccccaccgucgcccgcgccuacccccucgucggccacgcccuccucaugaagcccgacggccgcgaguucuuccagcagaucaucgaguacaccgaggaguaccgccacaugccccuccucaagcucugggucggccccguccccauggucgcccucuacaacgccgagaacgucgaggucauccucaccuccuccaagcagaucgacaaguccuccauguacaaguuccucgagcccuggcucggccucggccuccucaccuccaccggcaacaaguggcgcucccgccgcaagaugcucacccccaccuuccacuucaccauccucgaggacuuccucgacaucaugaacgagcaggccaacauccucgucaagaagcucgagaagcacaucaaccaggaggccuucaacugcuucuucuacaucacccucugcgcccucgacaucaucugcgagaccgccaugggcaagaacaucggcgcccaguccaacgacgacuccgaguacguccgcgccgucuaccgcauguccgagaugaucuuccgccgcaucaagaugcccuggcucuggcucgaccucugguaccucauguucaaggagggcugggagcacaagaagucccuccagauccuccacaccuucaccaacuccgucaucgccgagcgcgccaacgagaugaacgccaacgaggacugccgcggcgacggccgcggcuccgcccccuccaagaacaagcgccgcgccuuccucgaccuccuccucuccgucaccgacgacgagggcaaccgccucucccacgaggacauccgcgaggaggucgacaccuucauguucgagggccacgacaccaccgccgccgccaucaacuggucccucuaccuccucggcuccaaccccgagguccagaagaaggucgaccacgagcucgacgacgucuucggcaaguccgaccgccccgccaccgucgaggaccucaagaagcuccgcuaccucgagugcgucaucaaggagacccuccgccucuuccccuccgucccccucuucgcccgcuccgucuccgaggacugcgaggucgccggcuaccgcguccucaagggcaccgaggccgucaucauccccuacgcccuccaccgcgacccccgcuacuuccccaaccccgaggaguuccagcccgagcgcuucuuccccgagaacgcccagggccgccaccccuacgccuacguccccuucuccgccggcccccgcaacugcaucggccagaaguucgccgucauggaggagaagaccauccucuccugcauccuccgccacuucuggaucgaguccaaccagaagcgcgaggagcucggccucgagggccagcucauccuccgccccuccaacggcaucuggaucaagcucaagcgccgcaacgccgacgagcgcuga

SEQ ID NO: 42015 - RNA, 1530 nt, Artificial Sequence
  derived and/or modified sequence opt2 from CYP51A1__Homo_sapiens__NP_000777
auggccgccgccgccggcaugcuccuccucggccuccuccaggccggcggcuccguccucggccaggccauggagaaggucaccggcggcaaccuccucuccaugcuccucaucgccugcgccuucacccucucccucgucuaccucauccgccucgccgccggccaccucguccagcuccccgccggcgucaaguccccccccuacaucuucucccccauccccuuccucggccacgccaucgccuucggcaagucccccaucgaguuccucgagaacgccuacgagaaguacggccccgucuucuccuucaccauggucggcaagaccuucaccuaccuccucggcuccgacgccgccgcccuccucuucaacuccaagaacgaggaccucaacgccgaggacgucuacucccgccucaccacccccgucuucggcaagggcgucgccuacgacguccccaaccccgucuuccucgagcagaagaagaugcucaaguccggccucaacaucgcccacuucaagcagcacgucuccaucaucgagaaggagaccaaggaguacuucgaguccuggggcgaguccggcgagaagaacgucuucgaggcccucuccgagcucaucauccucaccgccucccacugccuccacggcaaggagauccgcucccagcucaacgagaaggucgcccagcucuacgccgaccucgacggcggcuucucccacgccgccuggcuccuccccggcuggcucccccuccccuccuuccgccgccgcgaccgcgcccaccgcgagaucaaggacaucuucuacaaggccauccagaagcgccgccagucccaggagaagaucgacgacauccuccagacccuccucgacgccaccuacaaggacggccgcccccucaccgacgacgaggucgccggcaugcucaucggccuccuccucgccggccagcacaccuccuccaccaccuccgccuggaugggcuucuuccucgcccgcgacaagacccuccagaagaagugcuaccucgagcagaagaccgucugcggcgagaaccuccccccccucaccuacgaccagcucaaggaccucaaccuccucgaccgcugcaucaaggagacccuccgccuccgcccccccaucaugaucaugaugcgcauggcccgcaccccccagaccgucgccggcuacaccaucccccccggccaccaggucugcgucucccccaccgucaaccagcgccucaaggacuccugggucgagcgccucgacuucaaccccgaccgcuaccuccaggacaaccccgccuccggcgagaaguucgccuacguccccuucggcgccggccgccaccgcugcaucggcgagaacuucgccuacguccagaucaagaccaucugguccaccaugcuccgccucuacgaguucgaccucaucgacggcuacuuccccaccgucaacuacaccaccaugauccacacccccgagaaccccgucauccgcuacaagcgccgcuccaaguga

SEQ ID NO: 42016 - RNA, 1515 nt, Artificial Sequence
  derived and/or modified sequence opt2 from CYP7A1__Homo_sapiens__NP_000771
augaugaccaccucccucaucuggggcaucgccaucgccgccugcugcugccucuggcucauccucggcauccgccgccgccagaccggcgagcccccccucgagaacggccucauccccuaccucggcugcgcccuccaguucggcgccaacccccucgaguuccuccgcgccaaccagcgcaagcacggccacgucuucaccugcaagcucaugggcaaguacguccacuucaucaccaacccccucuccuaccacaagguccucugccacggcaaguacuucgacuggaagaaguuccacuucgccaccuccgccaaggccuucggccaccgcuccaucgaccccauggacggcaacaccaccgagaacaucaacgacaccuucaucaagacccuccagggccacgcccucaacucccucaccgaguccaugauggagaaccuccagcgcaucaugcgcccccccgucuccuccaacuccaagaccgccgccugggucaccgagggcauguacuccuucugcuaccgcgucauguucgaggccggcuaccucaccaucuucggccgcgaccucacccgccgcgacacccagaaggcccacauccucaacaaccucgacaacuucaagcaguucgacaaggucuuccccgcccucgucgccggccuccccauccacauguuccgcaccgcccacaacgcccgcgagaagcucgccgagucccuccgccacgagaaccuccagaagcgcgaguccaucuccgagcucaucucccuccgcauguuccucaacgacacccucuccaccuucgacgaccucgagaaggccaagacccaccucgucguccucugggccucccaggccaacaccauccccgccaccuucuggucccucuuccagaugauccgcaaccccgaggccaugaaggccgccaccgaggaggucaagcgcacccucgagaacgccggccagaaggucucccucgagggcaaccccaucugccucucccaggccgagcucaacgaccuccccguccucgacuccaucaucaaggagucccuccgccucuccuccgccucccucaacauccgcaccgccaaggaggacuucacccuccaccucgaggacggcuccuacaacauccgcaaggacgacaucaucgcccucuacccccagcucaugcaccucgaccccgagaucuaccccgacccccucaccuucaaguacgaccgcuaccucgacgagaacggcaagaccaagaccaccuucuacugcaacggccucaagcucaaguacuacuacaugcccuucggcuccggcgccaccaucugccccggccgccucuucgccauccacgagaucaagcaguuccucauccucaugcucuccuacuucgagcucgagcucaucgagggccaggccaagugccccccccucgaccagucccgcgccggccucggcauccuccccccccucaacgacaucgaguucaaguacaaguucaagcaccucuga

SEQ ID NO: 42017 - RNA, 1521 nt, Artificial Sequence
  derived and/or modified sequence opt2 from CYP7B1__Homo_sapiens__NP_004811
auggccggcgaggucuccgccgccaccggccgcuucucccucgagcgccucggccuccccggccucgcccucgccgccgcccuccuccuccucgcccucugccuccucguccgccgcacccgccgccccggcgagcccccccucaucaagggcuggcuccccuaccucggcgucguccucaaccuccgcaaggacccccuccgcuucaugaagacccuccagaagcagcacggcgacaccuucaccguccuccucggcggcaaguacaucaccuucauccucgaccccuuccaguaccagcucgucaucaagaaccacaagcagcucuccuuccgcgucuucuccaacaagcuccucgagaaggccuucuccaucucccagcuccagaagaaccacgacaugaacgacgagcuccaccucugcuaccaguuccuccagggcaagucccucgacauccuccucgaguccaugaugcagaaccucaagcaggucuucgagccccagcuccucaagaccaccuccugggacaccgccgagcucuaccccuucugcuccuccaucaucuucgagaucaccuucaccaccaucuacggcaaggucaucgucugcgacaacaacaaguucaucuccgagcuccgcgacgacuuccucaaguucgacgacaaguucgccuaccucgucuccaacauccccaucgagcuccucggcaacgucaaguccauccgcgagaagaucaucaagugcuucuccuccgagaagcucgccaagaugcagggcugguccgaggucuuccagucccgccaggacguccucgagaaguacuacguccacgaggaccucgagaucggcgcccaccaccucggcuuccucugggccuccgucgccaacaccauccccaccauguucugggccauguacuaccuccuccgccaccccgaggccauggccgccguccgcgacgagaucgaccgccuccuccaguccaccggccagaagaagggcuccggcuuccccauccaccucacccgcgagcagcucgacucccucaucugccucgaguccuccaucuucgaggcccuccgccucuccuccuacuccaccaccauccgcuucgucgaggaggaccucacccucuccuccgagaccggcgacuacugcguccgcaagggcgaccucgucgccaucuucccccccguccuccacggcgaccccgagaucuucgaggcccccgaggaguuccgcuacgaccgcuucaucgaggacggcaagaagaagaccaccuucuucaagcgcggcaagaagcucaagugcuaccucaugcccuucggcaccggcaccuccaagugccccggccgcuucuucgcccucauggagaucaagcagcuccucgucauccuccucaccuacuucgaccucgagaucaucgacgacaagcccaucggccucaacuacucccgccuccucuucggcauccaguaccccgacuccgacguccucuuccgcuacaaggucaaguccuga

SEQ ID NO: 42018 - RNA, 1506 nt, Artificial Sequence
  derived and/or modified sequence opt2 from CYP8B1__Homo_sapiens__NP_004382
augguccucuggggccccguccucggcgcccuccucgucgucaucgccggcuaccucugccuccccggcaugcuccgccagcgccgccccugggagcccccccucgacaagggcaccguccccuggcucggccacgccauggccuuccgcaagaacauguucgaguuccucaagcgcaugcgcaccaagcacggcgacgucuucaccguccagcucggcggccaguacuucaccuucgucauggacccccucuccuucggcuccauccucaaggacacccagcgcaagcucgacuucggccaguacgccaagaagcucguccucaaggucuucggcuaccgcuccguccagggcgaccacgagaugauccacuccgccuccaccaagcaccuccgcggcgacggccucaaggaccucaacgagaccaugcucgacucccucuccuucgucaugcucaccuccaagggcuggucccucgacgccuccugcuggcacgaggacucccucuuccgcuucugcuacuacauccucuucaccgccggcuaccucucccucuucggcuacaccaaggacaaggagcaggaccuccuccaggccggcgagcucuucauggaguuccgcaaguucgaccuccucuucccccgcuucgucuacucccuccucuggccccgcgaguggcucgaggucggccgccuccagcgccucuuccacaagaugcucuccgucucccacucccaggagaaggagggcaucuccaacuggcucggcaacaugcuccaguuccuccgcgagcagggcguccccuccgccaugcaggacaaguucaacuucaugaugcucugggccucccagggcaacaccggccccaccuccuucugggcccuccucuaccuccucaagcaccccgaggccauccgcgccguccgcgaggaggccacccagguccucggcgaggcccgccucgagaccaagcaguccuucgccuucaagcucggcgcccuccagcacacccccguccucgacuccgucgucgaggagacccuccgccuccgcgccgcccccacccuccuccgccucguccacgaggacuacacccucaagauguccuccggccaggaguaccucuuccgccacggcgacauccucgcccucuuccccuaccucuccguccacauggaccccgacauccaccccgagcccaccgucuucaaguacgaccgcuuccucaaccccaacggcucccgcaaggucgacuucuucaagaccggcaagaagauccaccacuacaccaugcccuggggcuccggcgucuccaucugccccggccgcuucuucgcccucuccgaggucaagcucuucauccuccucauggucacccacuucgaccucgagcucgucgaccccgacaccccccucccccacgucgacccccagcgcuggggcuucggcaccaugcagcccucccacgacguccgcuuccgcuaccgccuccaccccaccgaguga

SEQ ID NO: 42019 - RNA, 477 nt, Artificial Sequence
  derived and/or modified sequence opt2 from CYS1__Homo_sapiens__NP_001032237
augggcuccggcuccucccgcuccucccgcacccuccgccgccgccgcucccccgagucccuccccgccggccccggcgccgccgcccucgagggcggcacccgccgccgcguccccgucgccgccgccgagguccccggcgccgccgccgaggaggcccccggccgcgaccccucccccgucgccccccccgacggccgcgacgagacccuccgccuccucgacgagcuccucgccgaguccgccgccuggggcccccccgagcccgccccccgccgccccgcccgccuccgccccaccgccgucgccggcuccgccgucugcgccgagcaguccaccgagggccaccccggcuccggcaacgucuccgaggcccccggcuccggccgcaagaagcccgagcgccccgccgccaucuccuacgaccacuccgaggagggccucauggccuccaucgagcgcgaguacugccgcuga

SEQ ID NO: 42020 - RNA, 1014 nt, Artificial Sequence
  derived and/or modified sequence opt2 from CYSLTR1__Homo_sapiens__NP_001269117
auggacgagaccggcaaccucaccgucuccuccgccaccugccacgacaccaucgacgacuuccgcaaccaggucuacuccacccucuacuccaugaucuccgucgucggcuucuucggcaacggcuucguccucuacguccucaucaagaccuaccacaagaaguccgccuuccaggucuacaugaucaaccucgccgucgccgaccuccucugcgucugcacccucccccuccgcgucgucuacuacguccacaagggcaucuggcucuucggcgacuuccucugccgccucuccaccuacgcccucuacgucaaccucuacugcuccaucuucuucaugaccgccauguccuucuuccgcugcaucgccaucgucuuccccguccagaacaucaaccucgucacccagaagaaggcccgcuucgucugcgucggcaucuggaucuucgucauccucaccuccucccccuuccucauggccaagccccagaaggacgagaagaacaacaccaagugcuucgagcccccccaggacaaccagaccaagaaccacguccucguccuccacuacgucucccucuucgucggcuucaucauccccuucgucaucaucaucgucugcuacaccaugaucauccucacccuccucaagaaguccaugaagaagaaccucuccucccacaagaaggccaucggcaugaucauggucgucaccgccgccuuccucgucuccuucaugcccuaccacauccagcgcaccauccaccuccacuuccuccacaacgagaccaagcccugcgacuccguccuccgcaugcagaaguccgucgucaucacccucucccucgccgccuccaacugcugcuucgacccccuccucuacuucuucuccggcggcaacuuccgcaagcgccucuccaccuuccgcaagcacucccucuccuccgucaccuacgucccccgcaagaaggccucccuccccgagaagggcgaggagaucugcaaggucuga

SEQ ID NO: 42021 - RNA, 1197 nt, Artificial Sequence
  derived and/or modified sequence opt2 from CYTH1__Homo_sapiens__NP_004753
auggaggaggacgacuccuacguccccuccgaccucaccgccgaggagcgccaggagcucgagaacauccgccgccgcaagcaggagcuccucgccgacauccagcgccucaaggacgagaucgccgaggucgccaacgagaucgagaaccucggcuccaccgaggagcgcaagaacaugcagcgcaacaagcaggucgccaugggccgcaagaaguucaacauggaccccaagaagggcauccaguuccucaucgagaacgaccuccucaagaacaccugcgaggacaucgcccaguuccucuacaagggcgagggccucaacaagaccgccaucggcgacuaccucggcgagcgcgacgaguucaacauccagguccuccacgccuucgucgagcuccacgaguucaccgaccucaaccucguccaggcccuccgccaguuccucugguccuuccgccuccccggcgaggcccagaagaucgaccgcaugauggaggccuucgcccagcgcuacugccagugcaacaacggcgucuuccaguccaccgacaccugcuacguccucuccuucgccaucaucaugcucaacaccucccuccacaaccccaacgucaaggacaagcccaccgucgagcgcuucaucgccaugaaccgcggcaucaacgacggcggcgaccuccccgaggagcuccuccgcaaccucuacgaguccaucaagaacgagcccuucaagauccccgaggacgacggcaacgaccucacccacaccuucuucaaccccgaccgcgagggcuggcuccucaagcucggcggcggccgcgucaagaccuggaagcgccgcugguucauccucaccgacaacugccucuacuacuucgaguacaccaccgacaaggagccccgcggcaucaucccccucgagaaccucuccauccgcgaggucgaggacuccaagaagcccaacugcuucgagcucuacauccccgacaacaaggaccaggucaucaaggccugcaagaccgaggccgacggccgcgucgucgagggcaaccacaccgucuaccgcaucuccgcccccacccccgaggagaaggaggaguggaucaagugcaucaaggccgccaucucccgcgaccccuucuacgagaugcucgccgcccgcaagaagaaggucuccuccaccaagcgccacuga

SEQ ID NO: 42022 - RNA, 1200 nt, Artificial Sequence
  derived and/or modified sequence opt2 from CYTH3__Homo_sapiens__NP_004218
auggacgaggacggcggcggcgagggcggcggcguccccgaggaccucucccucgaggagcgcgaggagcuccucgacauccgccgccgcaagaaggagcucaucgacgacaucgagcgccucaaguacgagaucgccgaggucaugaccgagaucgacaaccucaccuccgucgaggaguccaagaccacccagcgcaacaagcagaucgccaugggccgcaagaaguucaacauggaccccaagaagggcauccaguuccucaucgagaacgaccuccuccaguccucccccgaggacgucgcccaguuccucuacaagggcgagggccucaacaagaccgucaucggcgacuaccucggcgagcgcgacgaguucaacaucaagguccuccaggccuucgucgagcuccacgaguucgccgaccucaaccucguccaggcccuccgccaguuccucugguccuuccgccuccccggcgaggcccagaagaucgaccgcaugauggaggccuucgccucccgcuacugccucugcaaccccggcgucuuccaguccaccgacaccugcuacguccucuccuucgccaucaucaugcucaacaccucccuccacaaccacaacguccgcgacaagcccaccgccgagcgcuucaucgccaugaaccgcggcaucaacgagggcggcgaccuccccgaggagcuccuccgcaaccucuacgaguccaucaagaacgagcccuucaagauccccgaggacgacggcaacgaccucacccacaccuucuucaaccccgaccgcgagggcuggcuccucaagcucggcggccgcgucaagaccuggaagcgccgcugguucauccucaccgacaacugccucuacuacuucgaguacaccaccgacaaggagccccgcggcaucaucccccucgagaaccucuccauccgcgaggucgaggacccccgcaagcccaacugcuucgagcucuacaaccccucccacaagggccaggucaucaaggccugcaagaccgaggccgacggccgcgucgucgagggcaaccacgucgucuaccgcaucuccgcccccucccccgaggagaaggaggaguggaugaaguccaucaaggccuccaucucccgcgaccccuucuacgacaugcucgccacccgcaagcgccgcaucgccaacaagaaguga

SEQ ID NO: 42023 - RNA, 1080 nt, Artificial Sequence
  derived and/or modified sequence opt2 from CYTIP__Homo_sapiens__NP_004279
augucccuccagcgccuccuccagcacuccuccaacggcaaccucgccgacuucugcgccggccccgccuacuccuccuacuccacccucaccggcucccucaccauggacgacaaccgccgcauccagaugcucgccgacaccgucgccacccucccccgcggccgcaagcagcucgcccucacccgcuccuccucccucuccgacuucuccuggucccagcgcaagcucgucaccgucgagaagcaggacaacgagaccuucggcuucgagauccaguccuaccgcccccagaaccagaacgccugcuccuccgagauguucacccucaucugcaagauccaggaggacucccccgcccacugcgccggccuccaggccggcgacguccucgccaacaucaacggcgucuccaccgagggcuucaccuacaagcaggucgucgaccucauccgcuccuccggcaaccuccucaccaucgagacccucaacggcaccaugauccucaagcgcaccgagcucgaggccaagcuccagguccucaagcagacccucaagcagaagugggucgaguaccgcucccuccagcuccaggagcaccgccuccuccacggcgacgccgccaacugccccucccucgagaacauggaccucgacgagcucucccucuucggcccccuccccggccccggccccgcccucgucgaccgcaaccgccucuccuccgaguccuccugcaaguccuggcucuccuccaugaccauggacuccgaggacggcuaccagaccugcgucuccgaggacuccucccgcggcgccuucucccgccagaccuccaccgacgacgagugcuucauccccaaggagggcgacgacuuccuccgccgcuccuccucccgccgcaaccgcuccaucuccaacaccuccuccggcuccauguccccccucugggagggcaaccucuccuccauguucggcacccucccccgcaagucccgcaagggcuccguccgcaagcagcuccucaaguucauccccggccuccaccgcgccgucgaggaggaggagucccgcuucuga

SEQ ID NO: 42024 - RNA, 411 nt, Artificial Sequence
  derived and/or modified sequence opt2 from CYTL1__Homo_sapiens__NP_061129
augcgcacccccggcccccuccccguccuccuccuccuccucgccggcgcccccgccgcccgccccaccccccccaccugcuacucccgcaugcgcgcccucucccaggagaucacccgcgacuucaaccuccuccaggucuccgagcccuccgagcccugcguccgcuaccucccccgccucuaccucgacauccacaacuacugcguccucgacaagcuccgcgacuucgucgccuccccccccugcuggaaggucgcccaggucgacucccucaaggacaaggcccgcaagcucuacaccaucaugaacuccuucugccgccgcgaccucgucuuccuccucgacgacugcaacgcccucgaguaccccauccccgucaccaccguccuccccgaccgccagcgcuga

SEQ ID NO: 42025 - RNA, 789 nt, Artificial Sequence
  derived and/or modified sequence opt2 from CYYR1__Homo_sapiens__NP_443186
augaagugcgagcccggcuggccccgcacccccgaguggccccccuccccccgccucuccgccgucggccgcgacaaggagaccugggcccccuccgccgcccgccucggcccccgcgccccccagcuccgcggcgucccccagucccucgcccgcgacgcccccggccccggcucccucggccgccucccccgccaguggcccggccucugcuccacccgccucuccggcgcccuccucucccccuccgaccgcccccccuccucccccuucccccccguccccggcucccccuucgcccccucccuccgcccccccgccuggauggacgccccccgccuccccguccgccccggcguccuccuccccaagcucguccuccucuucgucuacgccgacgacugccucgcccagugcggcaaggacugcaaguccuacugcugcgacggcaccacccccuacugcugcuccuacuacgccuacaucggcaacauccucuccggcaccgccaucgccggcaucgucuucggcaucgucuucaucaugggcgucaucgccggcaucgccaucugcaucugcaugugcaugaagaaccaccgcgccacccgcgucggcauccuccgcaccacccacaucaacaccgucuccuccuaccccggccccccccccuacggccacgaccacgagauggaguacugcgccgaccuccccccccccuacucccccaccccccagggccccgcccagcgcuccccccccccccccuaccccggcaacgcccgcaaguga

SEQ ID NO: 42026 - RNA, 1164 nt, Artificial Sequence
  derived and/or modified sequence opt2 from D2HGDH__Homo_sapiens__NP_001274178
auggucggcggcuccguccccgucuucgacgagaucauccucuccaccgcccgcaugaaccgcguccucuccuuccacuccgucuccggcauccucgucugccaggccggcugcguccucgaggagcucucccgcuacgucgaggagcgcgacuucaucaugccccucgaccucggcgccaagggcuccugccacaucggcggcaacgucgccaccaacgccggcggccuccgcuuccuccgcuacggcucccuccacggcaccguccucggccucgaggucguccucgccgacggcaccguccucgacugccucaccucccuccgcaaggacaacaccggcuacgaccucaagcagcucuucaucggcuccgagggcacccucggcaucaucaccaccgucuccauccucugcccccccaagccccgcgccgucaacgucgccuuccucggcugccccggcuucgccgagguccuccagaccuucuccaccugcaagggcaugcucggcgagauccucuccgccuucgaguucauggacgccgucugcaugcagcucgucggccgccaccuccaccucgccucccccguccaggagucccccuucuacguccucaucgagaccuccggcuccaacgccggccacgacgccgagaagcucggccacuuccucgagcacgcccucggcuccggccucgucaccgacggcaccauggccaccgaccagcgcaaggucaagaugcucugggcccuccgcgagcgcaucaccgaggcccucucccgcgacggcuacgucuacaaguacgaccucucccuccccgucgagcgccucuacgacaucgucaccgaccuccgcgcccgccucggcccccacgccaagcacgucgucggcuacggccaccucggcgacggcaaccuccaccucaacgucaccgccgaggccuucucccccucccuccucgccgcccucgagccccacgucuacgaguggaccgccggccagcagggcuccgucuccgccgagcacggcgucggcuuccgcaagcgcgacguccucggcuacuccaagccccccggcgcccuccagcucaugcagcagcucaaggcccuccucgaccccaagggcauccucaaccccuacaagacccuccccucccaggccuga

SEQ ID NO: 42027 - RNA, 3207 nt, Artificial Sequence
  derived and/or modified sequence opt2 from DAAM1__Homo_sapiens__NP_001257449
auggccccccgcaagcgcggcggccgcggcaucuccuucaucuucugcugcuuccgcaacaacgaccaccccgagaucaccuaccgccuccgcaacgacuccaacuucgcccuccagaccauggagcccgcccuccccaugccccccgucgaggagcucgacgucauguucuccgagcucgucgacgagcucgaccucaccgacaagcaccgcgaggccauguucgcccuccccgccgagaagaaguggcagaucuacugcuccaagaagaaggaccaggaggagaacaagggcgccaccuccuggcccgaguucuacaucgaccagcucaacuccauggccgcccgcaagucccuccucgcccucgagaaggaggaggaggaggagcgcuccaagaccaucgagucccucaagaccgcccuccgcaccaagcccaugcgcuucgucacccgcuucaucgaccucgacggccucuccugcauccucaacuuccucaagaccauggacuacgagaccuccgagucccgcauccacaccucccucaucggcugcaucaaggcccucaugaacaacucccagggccgcgcccacguccucgcccacuccgaguccaucaacgucaucgcccagucccucuccaccgagaacaucaagaccaaggucgccguccucgagauccucggcgccgucugccucguccccggcggccacaagaagguccuccaggccaugcuccacuaccagaaguacgccuccgagcgcacccgcuuccagacccucaucaacgaccucgacaaguccaccggccgcuaccgcgacgaggucucccucaagaccgccaucauguccuucaucaacgccguccucucccagggcgccggcgucgagucccucgacuuccgccuccaccuccgcuacgaguuccucaugcucggcauccagcccgucaucgacaagcuccgcgagcacgagaacuccacccucgaccgccaccucgacuucuucgagaugcuccgcaacgaggacgagcucgaguucgccaagcgcuucgagcucguccacaucgacaccaaguccgccacccagauguucgagcucacccgcaagcgccucacccacuccgaggccuacccccacuucauguccauccuccaccacugccuccagaugcccuacaagcgcuccggcaacaccguccaguacuggcuccuccucgaccgcaucauccagcagaucgucauccagaacgacaagggccaggaccccgacuccaccccccucgagaacuucaacaucaagaacgucguccgcaugcucgucaacgagaacgaggucaagcaguggaaggagcaggccgagaagaugcgcaaggagcacaacgagcuccagcagaagcucgagaagaaggagcgcgagugcgacgccaagacccaggagaaggaggagaugaugcagacccucaacaagaugaaggagaagcucgagaaggagaccaccgagcacaagcaggucaagcagcaggucgccgaccucaccgcccagcuccacgagcucucccgccgcgccgucugcgccuccauccccggcggccccucccccggcgcccccggcggccccuuccccuccuccguccccggcucccuccucccccccccccccccccccccccuccccggcggcaugcuccccccccccccccccccccucccccccggcggccccccccccccccccggcccccccccccucggcgccaucaugcccccccccggcgcccccaugggccucgcccucaagaagaaguccaucccccagcccaccaacgcccucaaguccuucaacugguccaagcuccccgagaacaagcucgagggcaccgucuggaccgagaucgacgacaccaaggucuucaagauccucgaccucgaggaccucgagcgcaccuucuccgccuaccagcgccagcagaaggaggccgacgccaucgacgacacccucuccuccaagcucaaggucaaggagcucuccgucaucgacggccgccgcgcccagaacugcaacauccuccucucccgccucaagcucuccaacgacgagaucaagcgcgccauccucaccauggacgagcaggaggaccuccccaaggacaugcucgagcagcuccucaaguucguccccgagaaguccgacaucgaccuccucgaggagcacaagcacgagcucgaccgcauggccaaggccgaccgcuuccucuucgagaugucccgcaucaaccacuaccagcagcgccuccagucccucuacuucaagaagaaguucgccgagcgcgucgccgaggucaagcccaaggucgaggccauccgcuccggcuccgaggaggucuuccgcuccggcgcccucaagcagcuccucgaggucguccucgccuucggcaacuacaugaacaagggccagcgcggcaacgccuacggcuucaagaucuccucccucaacaagaucgccgacaccaaguccuccaucgacaagaacaucacccuccuccacuaccucaucaccaucgucgagaacaaguaccccuccguccucaaccucaacgaggagcuccgcgacaucccccaggccgccaaggucaacaugaccgagcucgacaaggagaucuccacccuccgcuccggccucaaggccgucgagaccgagcucgaguaccagaagucccagcccccccagcccggcgacaaguucgucuccgucgucucccaguucaucaccgucgccuccuucuccuucuccgacgucgaggaccuccucgccgaggccaaggaccucuucaccaaggccgucaagcacuucggcgaggaggccggcaagauccagcccgacgaguucuucggcaucuucgaccaguuccuccaggccgucuccgaggccaagcaggagaacgagaacaugcgcaagaagaaggaggaggaggagcgccgcgcccgcauggaggcccagcucaaggagcagcgcgagcgcgagcgcaagaugcgcaaggccaaggagaacuccgaggaguccggcgaguucgacgaccucgucuccgcccuccgcuccggcgaggucuucgacaaggaccucuccaagcucaagcgcaaccgcaagcgcaucaccaaccagaugaccgacuccucccgcgagcgccccaucaccaagcucaacuucuga

SEQ ID NO: 42028 - RNA, 3207 nt, Artificial Sequence
  derived and/or modified sequence opt2 from DAAM2__Homo_sapiens__NP_001188356
auggccccccgcaagcgcucccaccacggccucggcuuccucugcugcuucggcggcuccgacauccccgagaucaaccuccgcgacaaccacccccuccaguucauggaguucuccucccccauccccaacgccgaggagcucaacauccgcuucgccgagcucgucgacgagcucgaccucaccgacaagaaccgcgaggccauguucgcccucccccccgagaagaaguggcagaucuacugcuccaagaagaaggagcaggaggaccccaacaagcucgccaccuccuggcccgacuacuacaucgaccgcaucaacuccauggccgccaugcagucccucuacgccuucgacgaggaggagaccgagaugcgcaaccaggucgucgaggaccucaagaccgcccuccgcacccagcccaugcgcuucgucacccgcuucaucgagcucgagggccucaccugccuccucaacuuccuccgcuccauggaccacgccaccugcgagucccgcauccacaccucccucaucggcugcaucaaggcccucaugaacaacucccagggccgcgcccacguccucgcccagcccgaggccaucuccaccaucgcccagucccuccgcaccgagaacuccaagaccaaggucgccguccucgagauccucggcgccgucugccucguccccggcggccacaagaagguccuccaggccaugcuccacuaccaggucuacgccgccgagcgcacccgcuuccagacccuccucaacgagcucgaccgcucccucggccgcuaccgcgacgaggucaaccucaagaccgccaucauguccuucaucaacgccguccucaacgccggcgccggcgaggacaaccucgaguuccgccuccaccuccgcuacgaguuccucaugcucggcauccagcccgucaucgacaagcuccgccagcacgagaacgccauccucgacaagcaccucgacuucuucgagaugguccgcaacgaggacgaccucgagcucgcccgccgcuucgacaugguccacaucgacaccaaguccgccucccagauguucgagcucauccacaagaagcucaaguacaccgaggccuaccccugccuccucuccguccuccaccacugccuccagaugcccuacaagcgcaacggcggcuacuuccagcaguggcagcuccucgaccgcauccuccagcagaucguccuccaggacgagcgcggcgucgaccccgaccucgccccccucgagaacuucaacgucaagaacaucgucaacaugcucaucaacgagaacgaggucaagcaguggcgcgaccaggccgagaaguuccgcaaggagcacauggagcucgucucccgccucgagcgcaaggagcgcgagugcgagaccaagacccucgagaaggaggagaugaugcgcacccucaacaagaugaaggacaagcucgcccgcgagucccaggagcuccgccaggcccgcggccaggucgccgagcucgucgcccagcucuccgagcucuccaccggccccgucuccuccccccccccccccggcggcccccucacccucuccuccuccaugaccaccaacgaccuccccccccccccccccccccuccccuucgccugcugcccccccccccccccccccccccucccccccggcggcccccccaccccccccggcgccccccccugccucggcaugggccucccccucccccaggaccccuaccccuccuccgacgucccccuccgcaagaagcgcgucccccagcccucccacccccucaaguccuucaacugggucaagcucaacgaggagcgcguccccggcaccgucuggaacgagaucgacgacaugcaggucuuccgcauccucgaccucgaggacuucgagaagauguucuccgccuaccagcgccaccagaaggagcucggcuccaccgaggacaucuaccucgccucccgcaaggucaaggagcucuccgucaucgacggccgccgcgcccagaacugcaucauccuccucuccaagcucaagcucuccaacgaggagauccgccaggccauccucaagauggacgagcaggaggaccucgccaaggacaugcucgagcagcuccucaaguucauccccgagaaguccgacaucgaccuccucgaggagcacaagcacgagaucgagcgcauggcccgcgccgaccgcuuccucuacgagaugucccgcaucgaccacuaccagcagcgccuccaggcccucuucuucaagaagaaguuccaggagcgccucgccgaggccaagcccaaggucgaggccauccuccucgccucccgcgagcucguccgcuccaagcgccuccgccagaugcucgaggucauccucgccaucggcaacuucaugaacaagggccagcgcggcggcgccuacggcuuccgcgucgccucccucaacaagaucgccgacaccaaguccuccaucgaccgcaacaucucccuccuccacuaccucaucaugauccucgagaagcacuuccccgacauccucaacaugcccuccgagcuccagcaccuccccgaggccgccaaggucaaccucgccgagcucgagaaggaggucggcaaccuccgccgcggccuccgcgccgucgaggucgagcucgaguaccagcgccgccagguccgcgagcccuccgacaaguucguccccgucauguccgacuucaucaccgucuccuccuucuccuucuccgagcucgaggaccagcucaacgaggcccgcgacaaguucgccaaggcccucaugcacuucggcgagcacgacuccaagaugcagcccgacgaguucuucggcaucuucgacaccuuccuccaggccuucuccgaggcccgccaggaccucgaggccaugcgccgccgcaaggaggaggaggagcgccgcgcccgcauggaggccaugcucaaggagcagcgcgagcgcgagcgcuggcagcgccagcgcaagguccucgccgccggcuccucccucgaggagggcggcgaguucgacgaccucgucuccgcccuccgcuccggcgaggucuucgacaaggaccucugcaagcucaagcgcucccgcaagcgcuccggcucccaggcccucgaggucacccgcgagcgcgccaucaaccgccucaacuacuga

SEQ ID NO: 42029 - RNA, 2250 nt, Artificial Sequence
  derived and/or modified sequence opt2 from DAB2__Homo_sapiens__NP_001231800
auguccaacgaggucgagaccuccgccaccaacggccagcccgaccagcaggccgcccccaaggcccccuccaagaaggagaagaagaagggccccgagaagaccgacgaguaccuccucgcccgcuucaagggcgacggcgucaaguacaaggccaagcucaucggcaucgacgacguccccgacgcccgcggcgacaagaugucccaggacuccaugaugaagcucaagggcauggccgccgccggccgcucccagggccagcacaagcagcgcaucugggucaacaucucccucuccggcaucaagaucaucgacgagaagaccggcgucaucgagcacgagcaccccgucaacaagaucuccuucaucgcccgcgacgucaccgacaaccgcgccuucggcuacgucugcggcggcgagggccagcaccaguucuucgccaucaagaccggccagcaggccgagccccucgucgucgaccucaaggaccucuuccaggucaucuacaacgucaagaagaaggaggaggagaagaagaagaucgaggaggccuccaaggccgucgagaacggcuccgaggcccucaugauccucgacgaccagaccaacaagcucaaguccgaguccaaggacauccuccucgucgaccucaacuccgagaucgacaccaaccagaacucccuccgcgagaaccccuuccucaccaacggcaucaccuccugcucccucccccgccccaccccccaggccuccuuccuccccgagaacgccuucuccgccaaccucaacuucuuccccacccccaaccccgaccccuuccgcgacgaccccuucacccagcccgaccaguccacccccuccuccuucgacucccucaagucccccgaccagaagaaggagaacuccuccuccuccuccaccccccucuccaacggcccccucaacggcgacgucgacuacuucggccagcaguucgaccagaucuccaaccgcaccggcaagcaggaggcccaggccggccccuggcccuucuccuccucccagacccagcccgccguccgcacccagaacggcgucuccgagcgcgagcagaacggcuucuccgucaaguccucccccaaccccuucgucggcuccccccccaagggccucuccauccagaacggcgucaagcaggaccucgaguccuccguccaguccuccccccacgacuccaucgccaucaucccccccccccaguccaccaagcccggccgcggccgccgcaccgccaaguccuccgccaacgaccuccucgccuccgacaucuucgccccccccgucuccgagcccuccggccaggccucccccaccggccagcccaccgcccuccagcccaacccccucgaccucuucaagaccuccgcccccgcccccgucggcccccucgucggccucggcggcgucaccgucacccucccccaggccggccccuggaacaccgccucccucgucuucaaccagucccccuccauggcccccggcgccaugaugggcggccagcccuccggcuucucccagcccgucaucuucggcaccucccccgccgucuccggcuggaaccagcccucccccuucgccgccuccacccccccccccguccccgucgucuggggccccuccgccuccgucgcccccaacgccugguccaccaccuccccccucggcaaccccuuccaguccaacaucuuccccgcccccgccgucuccacccagccccccuccaugcacuccucccuccucgucacccccccccagccccccccccgcgccggcccccccaaggacaucuccuccgacgccuucaccgcccucgacccccucggcgacaaggagaucaaggacgucaaggagauguucaaggacuuccagcuccgccagccccccgccguccccgcccgcaagggcgagcagaccuccuccggcacccucuccgccuucgccuccuacuucaacuccaaggucggcaucccccaggagaacgccgaccacgacgacuucgacgccaaccagcuccucaacaagaucaacgagccccccaagcccgccccccgccaggucucccuccccgucaccaaguccaccgacaacgccuucgagaaccccuucuucaaggacuccuucggcuccucccaggccuccgucgccuccucccagcccgucuccuccgagauguaccgcgaccccuucggcaaccccuucgccuga

SEQ ID NO: 42030 - RNA, 3399 nt, Artificial Sequence
  derived and/or modified sequence opt2 from DAB2IP__Homo_sapiens__NP_115941
auggagcccgacucccuccucgaccaggacgacuccuacgaguccccccaggagcgccccggcucccgccgcucccuccccggcucccucuccgagaagucccccuccauggagcccuccgccgccacccccuuccgcgucaccggcuuccucucccgccgccucaagggcuccaucaagcgcaccaagucccagcccaagcucgaccgcaaccacuccuuccgccacauccuccccggcuuccgcuccgccgccgccgccgccgccgacaacgagcgcucccaccucaugccccgccucaaggagucccgcucccacgagucccuccucucccccuccuccgccgucgaggcccucgaccucuccauggaggaggaggucgucaucaagcccguccacuccuccauccucggccaggacuacugcuucgaggucaccaccuccuccggcuccaagugcuucuccugccgcuccgccgccgagcgcgacaaguggauggagaaccuccgccgcgccguccaccccaacaaggacaacucccgccgcgucgagcacauccucaagcucugggucaucgaggccaaggaccuccccgccaagaagaaguaccucugcgagcucugccucgacgacguccucuacgcccgcaccaccggcaagcucaagaccgacaacgucuucuggggcgagcacuucgaguuccacaaccuccccccccuccgcaccgucaccguccaccucuaccgcgagaccgacaagaagaagaagaaggagcgcaacuccuaccucggccucgucucccuccccgccgccuccgucgccggccgccaguucgucgagaagugguaccccgucgucacccccaaccccaagggcggcaagggccccggccccaugauccgcaucaaggcccgcuaccagaccaucaccauccuccccauggagauguacaaggaguucgccgagcacaucaccaaccacuaccucggccucugcgccgcccucgagcccauccucuccgccaagaccaaggaggagauggccuccgcccucguccacauccuccaguccaccggcaaggucaaggacuuccucaccgaccucaugauguccgaggucgaccgcugcggcgacaacgagcaccucaucuuccgcgagaacacccucgccaccaaggccaucgaggaguaccucaagcucgucggccagaaguaccuccaggacgcccucggcgaguucaucaaggcccucuacgaguccgacgagaacugcgaggucgaccccuccaagugcuccgccgccgaccuccccgagcaccagggcaaccucaagaugugcugcgagcucgccuucugcaagaucaucaacuccuacugcgucuucccccgcgagcucaaggaggucuucgccuccuggcgccaggagugcuccucccgcggccgccccgacaucuccgagcgccucaucuccgccucccucuuccuccgcuuccucugccccgccaucaugucccccucccucuucaaccuccuccaggaguaccccgacgaccgcaccgcccgcacccucacccucaucgccaaggucacccagaaccucgccaacuucgccaaguucggcuccaaggaggaguacauguccuucaugaaccaguuccucgagcacgaguggaccaacaugcagcgcuuccuccucgagaucuccaaccccgagacccucuccaacaccgccggcuucgagggcuacaucgaccucggccgcgagcucuccucccuccacucccuccucugggaggccgucucccagcucgagcaguccaucgucuccaagcucggcccccucccccgcauccuccgcgacguccacaccgcccucuccacccccggcuccggccagcuccccggcaccaacgaccucgccuccacccccggcuccggcuccuccuccaucuccgccggccuccagaagauggucaucgagaacgaccucuccggccucaucgacuucacccgccuccccucccccacccccgagaacaaggaccucuucuucgucacccgcuccuccggcguccagcccucccccgcccgcuccuccuccuacuccgaggccaacgagcccgaccuccagauggccaacggcggcaagucccucuccauggucgaccuccaggacgcccgcacccucgacggcgaggccggcucccccgccggccccgacguccuccccaccgacggccaggccgccgccgcccagcucgucgccggcuggcccgcccgcgccacccccgucaaccucgccggccucgccaccguccgccgcgccggccagacccccaccacccccggcaccuccgagggcgcccccggccgcccccagcuccucgccccccucuccuuccagaaccccgucuaccagauggccgccggccucccccucuccccccgcggccucggcgacuccggcuccgagggccacuccucccucuccucccacuccaacuccgaggagcucgccgccgccgccaagcucggcuccuucuccaccgccgccgaggagcucgcccgccgccccggcgagcucgcccgccgccagaugucccucaccgagaagggcggccagcccaccgucccccgccagaacuccgccggcccccagcgccgcaucgaccagccccccccccccccccccccccccccccccgccccccgcggccgcaccccccccaaccuccucuccacccuccaguacccccgccccuccuccggcacccucgccuccgccucccccgacugggucggccccuccacccgccuccgccagcaguccuccuccuccaagggcgacucccccgagcucaagccccgcgccguccacaagcagggccccucccccgucucccccaacgcccucgaccgcaccgccgccuggcuccucaccaugaacgcccagcuccucgaggacgagggccucggccccgaccccccccaccgcgaccgccuccgcuccaaggacgagcucucccaggccgagaaggaccucgccguccuccaggacaagcuccgcaucuccaccaagaagcucgaggaguacgagacccucuucaagugccaggaggagaccacccagaagcucguccucgaguaccaggcccgccucgaggagggcgaggagcgccuccgccgccagcaggaggacaaggacauccagaugaagggcaucaucucccgccucauguccgucgaggaggagcucaagaaggaccacgccgagaugcaggccgccgucgacuccaagcagaagaucaucgacgcccaggagaagcgcaucgccucccucgacgccgccaacgcccgccucauguccgcccucacccagcucaaggaguccaugcacuga

SEQ ID NO: 42031 - RNA, 1515 nt, Artificial Sequence
  derived and/or modified sequence opt2 from DACH1__Homo_sapiens__NP_004383
auggccguccccgccgcccucaucccccccacccagcucguccccccccagccccccaucuccaccuccgccuccuccuccggcaccaccaccuccaccuccuccgccaccuccucccccgcccccuccaucggcccccccgccuccuccggccccacccucuuccgccccgagcccaucgccuccgccgccgccgccgccgccaccgucaccuccaccggcggcggcggcggcggcggcggcuccggcggcggcggcggcuccuccggcaacggcggcggcggcggcggcggcggcggcggcuccaacugcaaccccaaccucgccgccgccuccaacggcuccggcggcggcggcggcggcaucuccgccggcggcggcgucgccuccuccacccccaucaacgccuccaccggcuccuccuccuccuccuccuccuccuccuccuccuccuccuccuccuccuccuccuccuccuccuccuccuccugcggcccccuccccggcaagcccgucuacuccacccccucccccgucgagaacaccccccagaacaacgagugcaagauggucgaccuccgcggcgccaaggucgccuccuucaccgucgagggcugcgagcucaucugccucccccaggccuucgaccucuuccucaagcaccucgucggcggccuccacaccgucuacaccaagcucaagcgccucgagaucacccccgucgucugcaacgucgagcagguccgcauccuccgcggccucggcgccauccagcccggcgucaaccgcugcaagcucaucucccgcaaggacuucgagacccucuacaacgacugcaccaacgccuccucccgccccggccgcccccccaagcgcacccaguccgucaccucccccgagaacucccacaucaugccccacuccguccccggccucaugucccccggcaucaucccccccaccgacgagaccccccucuccacccccaccgcccgcgacucccucgacaagcucucccucaccggccacggccagccccucccccccggcuuccccucccccuuccucuuccccgacggccucuccuccaucgagacccuccucaccaacauccagggccuccucaaggucgccaucgacaacgcccgcgcccaggagaagcagguccagcucgagaagaccgagcucaagauggacuuccuccgcgagcgcgagcuccgcgagacccucgagaagcagcucgccauggagcagaagaaccgcgccaucguccagaagcgccucaagaaggagaagaaggccaagcgcaagcuccaggaggcccucgaguucgagaccaagcgccgcgagcaggccgagcagacccucaagcaggccgccuccaccgacucccuccgcguccucaacgacucccucacccccgagaucgaggccgaccgcuccggcggccgcaccgacgccgagcgcaccauccaggacggccgccucuaccucaagaccaccgucauguacuga

SEQ ID NO: 42032 - RNA, 1716 nt, Artificial Sequence
  derived and/or modified sequence opt2 from DACH2__Homo_sapiens__NP_001132986
auggccgucuccgccucccccgucaucuccgccaccuccuccggcgccggcguccccggcggccucuuccgcgccgagccccucuacuccaccccccgcgagcccccccgccucacccccaacaugaucaacuccuucgucgucaacaaccacuccaacuccgccggcggcggcggccgcggcaacaccaacaccaacgagugccgcauggucgacaugcacggcaugaaggucgccuccuuccucauggacggccaggagcucaucugccucccccaggucuucgaccucuuccucaagcaccucgucggcggccuccacaccgucuacaccaagcucaagcgccucgacaucucccccgucgucugcaccgucgagcagguccgcauccuccgcggccucggcgccauccagcccggcgucaaccgcugcaagcucaucacccgcaaggacuucgagacccucuucaccgacugcaccaacgccuccucccgccccggccgcccccccaagcgcucccucggcguccuccaggagaacgcccgccuccucacccacgccguccccggccuccucucccccggccucaucacccccaccggcaucaccgccgccgccauggccgaggccaugaagcuccagaagaugaagcucauggccaugaacacccuccagggcaacggcucccagaacggcaccgaguccgagcccgacgaccucaacuccaacaccggcggcuccgaguccuccugggacaaggacaagaugcagucccccuucgccgcccccggcccccagcacggcaucgcccacgccgcccucgccggccagcccggcaucggcggcgcccccacccucaacccccuccagcagaaccaccuccucaccaaccgccucgaccuccccuucaugaugaugccccacccccuccuccccgucucccucccccccgccuccgucgccauggccaugaaccagaugaaccaccucaacaccaucgccaacauggccgccgccgcccagauccacuccccccucucccgcgccggcaccuccgucaucaaggagcgcauccccgagucccccucccccgcccccucccucgaggagaaccaccgccccggcucccagaccuccucccacaccuccuccuccgucuccuccucccccucccagauggaccaccaccucgagcgcauggaggagguccccguccagauccccaucaugaaguccccccucgacaagauccagcucacccccggccaggcccuccccgccggcuuccccggccccuucaucuucgccgacucccucuccuccgucgagacccuccucaccaacauccagggccuccucaaggucgcccucgacaacgcccgcauccaggagaagcagauccagcaggagaagaaggagcuccgccucgagcucuaccgcgagcgcgagauccgcgagaaccucgagcgccagcucgccgucgagcuccagucccgcaccaccaugcagaagcgccucaagaaggagaagaagaccaagcgcaagcuccaggaggcccucgaguucgaguccaagcgccgcgagcaggucgagcaggcccucaagcaggccaccaccuccgacuccggccuccgcaugcucaaggacaccggcauccccgacaucgagaucgagaacaacggcaccccccacgacuccgccgccaugcaggccuga

SEQ ID NO: 42033 - RNA, 2400 nt, Artificial Sequence
  derived and/or modified sequence opt2 from DACT1__Homo_sapiens__NP_001072988
augaagcccucccccgccggcaccgccaaggagcucgagccccccgcccccgcccgcggcgagcagcgcaccgccgagcccgagggccgcuggcgcgagaagggcgaggccgacaccgagcgccagcgcacccgcgagcgccaggaggccacccucgccggccucgccgagcucgaguaccuccgccagcgccaggagcuccucguccgcggcgcccuccgcggcgccggcggcgccggcgccgccgccccccgcgccggcgagcuccucggcgaggccgcccagcgcucccgccucgaggagaaguuccucgaggagaacauccuccuccuccgcaagcagcucaacugccuccgccgccgcgacgccggccuccucaaccagcuccaggagcucgacaagcagaucuccgaccuccgccucgacgucgagaagaccuccgaggagcaccucgagaccgacucccgccccuccuccggcuucuacgagcucuccgacggcgccuccggcucccucuccaacuccuccaacuccgucuucuccgagugccucuccuccugccacuccuccaccugcuucugcuccccccucgaggccacccucucccucuccgacggcugccccaaguccgccgacgucaaccccaaguaccagugcgaccucgucuccaagaacggcaacgacgucuaccgcuaccccuccccccuccacgccgucgccguccagucccccauguuccuccucugccucaccggcaacccccuccgcgaggaggaccgccucggcaaccacgccuccgacaucugcggcggcuccgagcucgacgccgucaagaccgacuccucccuccccucccccuccucccucugguccgccucccaccccuccuccuccaagaagauggacggcuacauccucucccucguccagaagaagacccaccccguccgcaccaacaagccccgcaccuccgucaacgccgaccccaccaagggccuccuccgcaacggcuccgucugcguccgcgcccccggcggcgucucccagggcaacuccgucaaccucaagaacuccaagcaggccugccuccccuccggcggcauccccucccucaacaacggcaccuucuccccccccaagcagugguccaaggaguccaaggccgagcaggccgaguccaagcgcgucccccuccccgagggcugccccuccggcgccgccuccgaccuccaguccaagcaccuccccaagaccgccaagcccgccucccaggagcacgcccgcugcuccgccaucggcaccggcgagucccccaaggaguccgcccagcucuccggcgccucccccaaggagucccccucccgcggccccgcccccccccaggagaacaaggucguccagccccucaagaagaugucccagaagaacucccuccagggcgucccccccgccacccccccccuccucuccaccgccuuccccgucgaggagcgccccgcccucgacuucaaguccgagggcuccucccagucccucgaggaggcccaccucgucaaggcccaguucauccccggccagcagcccuccguccgccuccaccgcggccaccgcaacaugggcgucgucaagaacuccucccucaagcaccgcggccccgcccuccagggccucgagaacggccuccccaccguccgcgagaagacccgcgccggcuccaagaagugccgcuuccccgacgaccucgacaccaacaagaagcucaagaaggccuccuccaagggccgcaaguccggcggcggccccgaggccggcguccccggccgccccgccggcggcggccaccgcgccggcucccgcgcccacggccacggccgcgaggccgucgucgccaagcccaagcacaagcgcaccgacuaccgccgcuggaaguccuccgccgagaucuccuacgaggaggcccuccgccgcgcccgccgcggccgccgcgagaacgucggccucuaccccgcccccgucccccuccccuacgccucccccuacgccuacgucgccuccgacuccgaguacuccgccgagugcgagucccucuuccacuccaccgucgucgacaccuccgaggacgagcaguccaacuacaccaccaacugcuucggcgacuccgaguccuccgucuccgagggcgaguucgucggcgaguccaccaccaccuccgacuccgaggaguccggcggccucaucuggucccaguucguccagacccuccccauccagaccgucaccgcccccgaccuccacaaccaccccgccaagaccuucgucaagaucaaggccucccacaaccucaagaagaagauccuccgcuuccgcuccggcucccucaagcucaugaccaccgucuga

SEQ ID NO: 42034 - RNA, 843 nt, Artificial Sequence
  derived and/or modified sequence opt2 from DACT2__Homo_sapiens__NP_001273280
auguggacccccggcggcccccccggcuccgccggcugggaccgccgccgccucggcgcccgccuccgcgccgccuucgccggccuccaggagcuccagggccuccgcgccacccagcaggagcgcguccgcggcgcccucgcccuccagcccccccccgcccccgccgcccccugcggcccccacggccuccacggccccgagcagcagcucgaggccgcccucgccgcccuccaggagcagcucucccgccuccgccagcaggacaucggccucaagacccaccucgaccagcucgaccuccagaucuccaagcuccagcucgacgucggcaccgccuccggcgaggcccucgacuccgacucccgccccuccuccggcuucuacgagauguccgacggcggcuccugcucccucuccaccuccugcgccuccgucugcuccgaccacaucucccccucccucggcucccuccuccccgucgcccaggcccacaaggcccgccccuccaugggcgacuggcgcccccgcuccgucgacgagaccaccguccccgccuggcgcccccaggccaccgaggagggcgcccgcccccccggcuccgucgaggacgccggccagcccuggggcaccuucuggccccgccccgucuccaccgagcucugcaacgcccccggcgagcucgacaugcacgccccccccgccggcugcaccuccuccucccucaccggcgucggcuccggccuccgcggcaagugcggccucugcggcugccagcuccccuucugcuccgucaacaccuccuccaagaccaaguccuccggcaucucccgccagcaguga

SEQ ID NO: 42035 - RNA, 1890 nt, Artificial Sequence
  derived and/or modified sequence opt2 from DACT3__Homo_sapiens__NP_659493
augauccgcgccuucuccuuccccgucucccccgagcgcggccgccuccgcggcuggcucgagggcucccucgccggccucugcgagcuccacuggcuccgcgagcgccaggaguaccgcguccagcaggcccuccgccucgcccagcccggcaugggcggcgccgaggccgaggacgaggaggacgccgacgaggacgaggacgccgccgccgcccgccgcgccgccgccgcccucgaggagcagcucgaggcccuccccggccucgucugggaccucggccagcagcucggcgaccucucccucgaguccggcggccucgagcaggaguccggccgcuccuccggcuucuacgaggaccccuccuccaccggcggccccgacuccccccccuccaccuucugcggcgacuccggcuucuccggcuccuccuccuacggccgccucggccccuccgagccccgcggcaucuacgccuccgagcgccccaagucccucggcgacgccucccccuccgcccccgaggucgucggcgcccgcgccgccgucccccgcuccuucuccgcccccuaccccaccgccggcggcuccgccggccccgaggccugcuccuccgccgagcgccgcgcccgcgccggccccuuccucacccccuccccccuccacgccgucgccaugcgcuccccccgccccugcggccgcccccccaccgacucccccgacgccggcggcgccggccgcccccucgacggcuacaucuccgcccuccuccgccgccgccgccgccgcggcgccggccagccccgcaccucccccggcggcgccgacggcggcccccgccgccagaacuccguccgccagcgcccccccgacgccucccccucccccggcuccgcccgccccgcccgcgagcccucccucgagcgcgucggcggccaccccaccucccccgccgcccucucccgcgccugggccuccuccugggaguccgaggccgcccccgagcccgccgccccccccgccgcccccuccccccccgacucccccgccgagggccgccucgucaaggcccaguacauccccggcgcccaggccgccacccgcggccuccccggccgcgccgcccgccgcaagccccccccccucacccgcggccgcuccgucgagcagucccccccccgcgagcgcccccgcgccgccggccgccgcggccgcauggccgaggccuccggccgccgcggcuccccccgcgcccgcaaggccucccgcucccaguccgagaccucccuccucggccgcgccuccgccguccccuccggcccccccaaguaccccaccgccgagcgcgaggagccccgccccccccgcccccgccgcggccccgcccccacccucgccgcccaggccgccggcuccugccgccgcuggcgcuccaccgccgagaucgacgccgccgacggccgccgcguccgcccccgcgcccccgccgcccgcguccccggccccggccccucccccuccgccccccagcgccgccuccucuacggcugcgccggcuccgacuccgagugcuccgccggccgccucggcccccucggccgccgcggccccgccggcggcgucggcggcggcuacggcgaguccgaguccuccgccuccgagggcgagucccccgccuucuccuccgccuccuccgacuccgacggcuccggcggccucgucuggccccagcagcucgucgccgccaccgccgccuccggcggcggcgccggcgccggcgcccccgccggccccgccaaggucuucgucaagaucaaggccucccacgcccucaagaagaagauccuccgcuuccgcuccggcucccucaaggucaugaccaccgucuga

SEQ ID NO: 42036 - RNA, 342 nt, Artificial Sequence
  derived and/or modified sequence opt2 from DAD1__Homo_sapiens__NP_001335
auguccgccuccgucgucuccgucaucucccgcuuccucgaggaguaccucuccuccaccccccagcgccucaagcuccucgacgccuaccuccucuacauccuccucaccggcgcccuccaguucggcuacugccuccucgucggcaccuuccccuucaacuccuuccucuccggcuucaucuccugcgucggcuccuucauccucgccgucugccuccgcauccagaucaacccccagaacaaggccgacuuccagggcaucucccccgagcgcgccuucgccgacuuccucuucgccuccaccauccuccaccucgucgucaugaacuucgucggcuga

SEQ ID NO: 42037 - RNA, 2688 nt, Artificial Sequence
  derived and/or modified sequence opt2 from DAG1__Homo_sapiens__NP_001171113
augcgcauguccgucggccucucccuccuccucccccucuggggccgcaccuuccuccuccuccucuccgucgucauggcccagucccacuggcccuccgagcccuccgaggccguccgcgacugggagaaccagcucgaggccuccaugcacuccguccucuccgaccuccacgaggccguccccaccgucgucggcauccccgacggcaccgccgucgucggccgcuccuuccgcgucaccauccccaccgaccucaucgccuccuccggcgacaucaucaaggucuccgccgccggcaaggaggcccuccccuccuggcuccacugggacucccagucccacacccucgagggccucccccucgacaccgacaagggcguccacuacaucuccgucuccgccacccgccucggcgccaacggcucccacaucccccagaccuccuccgucuucuccaucgaggucuaccccgaggaccacuccgagcuccaguccguccgcaccgccucccccgaccccggcgaggucgucuccuccgccugcgccgccgacgagcccgucaccguccucaccgucauccucgacgccgaccucaccaagaugacccccaagcagcgcaucgaccuccuccaccgcaugcgcuccuucuccgaggucgagcuccacaacaugaagcucguccccgucgucaacaaccgccucuucgacauguccgccuucauggccggccccggcaacgccaagaaggucgucgagaacggcgcccuccucuccuggaagcucggcugcucccucaaccagaacuccguccccgacauccacggcgucgaggcccccgcccgcgagggcgccauguccgcccagcucggcuaccccgucgucggcuggcacaucgccaacaagaagcccccccuccccaagcgcguccgccgccagauccacgccacccccacccccgucaccgccaucggcccccccaccaccgccauccaggagccccccucccgcaucguccccacccccaccucccccgccaucgccccccccaccgagaccauggccccccccguccgcgaccccguccccggcaagcccaccgucaccauccgcacccgcggcgccaucauccagacccccacccucggccccauccagcccacccgcgucuccgaggccggcaccaccguccccggccagauccgccccaccaugaccauccccggcuacgucgagcccaccgccgucgccaccccccccaccaccaccaccaagaagccccgcgucuccacccccaagcccgccacccccuccaccgacuccaccaccaccaccacccgccgccccaccaagaagccccgcaccccccgccccgucccccgcgucaccaccaaggucuccaucacccgccucgagaccgccuccccccccacccgcauccgcaccaccaccuccggcgucccccgcggcggcgagcccaaccagcgccccgagcucaagaaccacaucgaccgcgucgacgccugggucggcaccuacuucgaggucaagauccccuccgacaccuucuacgaccacgaggacaccaccaccgacaagcucaagcucacccucaagcuccgcgagcagcagcucgucggcgagaaguccuggguccaguucaacuccaacucccagcucauguacggccuccccgacuccucccacgucggcaagcacgaguacuucaugcacgccaccgacaagggcggccucuccgccgucgacgccuucgagauccacguccaccgccgcccccagggcgaccgcgcccccgcccgcuucaaggccaaguucgucggcgaccccgcccucguccucaacgacauccacaagaagaucgcccucgucaagaagcucgccuucgccuucggcgaccgcaacugcuccaccaucacccuccagaacaucacccgcggcuccaucgucgucgaguggaccaacaacacccucccccucgagcccugccccaaggagcagaucgccggccucucccgccgcaucgccgaggacgacggcaagccccgccccgccuucuccaacgcccucgagcccgacuucaaggccaccuccaucaccgucaccggcuccggcuccugccgccaccuccaguucauccccgucguccccccccgccgcguccccuccgaggccccccccaccgagguccccgaccgcgaccccgagaaguccuccgaggacgacgucuaccuccacaccgucauccccgccgucgucgucgccgccauccuccucaucgccggcaucaucgccaugaucugcuaccgcaagaagcgcaagggcaagcucacccucgaggaccaggccaccuucaucaagaagggcguccccaucaucuucgccgacgagcucgacgacuccaagcccccccccuccuccuccaugccccucauccuccaggaggagaaggccccccuccccccccccgaguaccccaaccaguccguccccgagaccaccccccucaaccaggacaccaugggcgaguacaccccccuccgcgacgaggaccccaacgccccccccuaccagccccccccccccuucaccgcccccauggagggcaagggcucccgccccaagaacaugacccccuaccgcucccccccccccuacgucccccccuga

SEQ ID NO: 42038 - RNA, 570 nt, Artificial Sequence
  derived and/or modified sequence opt2 from DAND5__Homo_sapiens__NP_689867
augcuccucggccagcucuccacccuccucugccuccucuccggcgcccuccccaccggcuccggccgccccgagccccaguccccccgcccccaguccugggccgccgccaaccagaccugggcccucggccccggcgcccuccccccccucguccccgccuccgcccucggcuccuggaaggccuuccucggccuccagaaggcccgccagcucggcaugggccgccuccagcgcggccaggacgaggucgccgccgucacccucccccucaacccccaggaggucauccagggcaugugcaaggccguccccuucguccaggucuucucccgccccggcugcuccgccauccgccuccgcaaccaccucugcuucggccacugcuccucccucuacauccccggcuccgaccccaccccccucguccucugcaacuccugcaugcccgcccgcaagcgcugggcccccgucguccucuggugccucaccggcuccuccgccucccgccgccgcgucaagaucuccaccaugcucaucgagggcugccacugcucccccaaggccuga

SEQ ID NO: 42039 - RNA, 378 nt, Artificial Sequence
  derived and/or modified sequence opt2 from DAOA__Homo_sapiens__NP_001155284
augcgcaccgccaucuggaaguggcaccgcggcaucuaccgcgaccacuacguccucggcucccucaccuuccucucccccaugcagcgcgccggcaccuccaaccaguggaacaugggcaaggucaugacccucgacuccggcgacgaggucaccuuccacaagaccuggcccaccgagaccggcucccccuaccgccucgaggaggucuccucccacgucggcaaggucuucauggcccgcaacuacgaguuccucgccuacgaggccuccaaggaccgccgccagccccucgagcgcauguggaccugcaacuacaaccagcagaaggaccaguccugcaaccacaaggagaucaccuccaccaaggccgaguga

SEQ ID NO: 42040 - RNA, 1044 nt, Artificial Sequence
  derived and/or modified sequence opt2 from DAO__Homo_sapiens__XP_011536307
augcgcgucgucgucaucggcgccggcgucaucggccucuccaccgcccucugcauccacgagcgcuaccacuccguccuccagccccucgacaucaaggucuacgccgaccgcuucaccccccucaccaccaccgacgucgccgccggccucuggcagcccuaccucuccgaccccaacaacccccaggaggccgacuggucccagcagaccuucgacuaccuccucucccacguccacucccccaacgccgagaaccucggccucuuccucaucuccggcuacaaccucuuccacgaggccauccccgaccccuccuggaaggacaccguccucggcuuccgcaagcucaccccccgcgagcucgacauguuccccgacuacggcuacggcugguuccacaccucccucauccucgagggcaagaacuaccuccaguggcucaccgagcgccucaccgagcgcggcgucaaguucuuccagcgcaaggucgaguccuucgaggaggucgcccgcgagggcgccgacgucaucgucaacugcaccggcgucugggccggcgcccuccagcgcgacccccuccuccagcccggccgcggccagaucaugaaggucgacgcccccuggaugaagcacuucauccucacccacgaccccgagcgcggcaucuacaacucccccuacaucauccccggcacccagaccgucacccucggcggcaucuuccagcucggcaacugguccgagcucaacaacauccaggaccacaacaccaucugggagggcugcugccgccucgagcccacccucaagaacgcccgcaucaucggcgagcgcaccggcuuccgccccguccgcccccagauccgccucgagcgcgagcagcuccgcaccggccccuccaacaccgaggucauccacaacuacggccacggcggcuacggccucaccauccacuggggcugcgcccucgaggccgccaagcucuucggccgcauccucgaggagaagaagcucucccgcaugccccccucccaccucuga

SEQ ID NO: 42041 - RNA, 1197 nt, Artificial Sequence
  derived and/or modified sequence opt2 from DAP3__Homo_sapiens__NP_001186778
augaugcucaagggcaucacccgccucaucucccgcauccacaagcucgaccccggccgcuuccuccacaugggcacccaggcccgccaguccaucgccgcccaccucgacaaccagguccccgucgaguccccccgcgccaucucccgcaccaacgagaacgaccccgccaagcacggcgaccagcacgagggccagcacuacaacaucuccccccaggaccucgagaccgucuucccccacggccuccccccccgcuucgucaugcaggucaagaccuucuccgaggccugccucaugguccgcaagcccgcccucgagcuccuccacuaccucaagaacaccuccuucgccuaccccgccauccgcuaccuccucuacggcgagaagggcaccggcaagacccucucccucugccacgucauccacuucugcgccaagcaggacuggcucauccuccacauccccgacgcccaccucugggucaagaacugccgcgaccuccuccaguccuccuacaacaagcagcgcuucgaccagccccucgaggccuccaccuggcucaagaacuucaagaccaccaacgagcgcuuccucaaccagaucaagguccaggagaaguacgucuggaacaagcgcgaguccaccgagaagggcuccccccucggcgaggucgucgagcagggcaucacccgcguccgcaacgccaccgacgccgucggcaucguccucaaggagcucaagcgccaguccucccucggcauguuccaccuccucgucgccgucgacggcaucaacgcccucuggggccgcaccacccucaagcgcgaggacaagucccccaucgcccccgaggagcucgcccucguccacaaccuccgcaagaugaugaagaacgacuggcacggcggcgccaucgucuccgcccucucccagaccggcucccucuucaagccccgcaaggccuaccucccccaggagcuccucggcaaggagggcuucgacgcccucgaccccuucauccccauccucgucuccaacuacaaccccaaggaguucgaguccugcauccaguacuaccucgagaacaacuggcuccagcacgagaaggcccccaccgaggagggcaagaaggagcuccucuuccucuccaacgccaaccccucccuccucgagcgccacugcgccuaccucuga

SEQ ID NO: 42042 - RNA, 615 nt, Artificial Sequence
  derived and/or modified sequence opt2 from DAP__Homo_sapiens__NP_001278892
auguccuccccccccgagggcaagcucgagaccaaggccggccacccccccgccgucaaggccggcggcaugcgcaucguccagaagcacccccacaccggcgacaccaaggaggagaaggacaaggacgaccaggagugggaguccccccgcgucaccaagaucuccccccgccgccuccgccgcuggcucacccgcucccgcaugccccccuggaccuccauccucccccaggagcccuccaccuccuccucccacgccuccgagcccggcguccaccagcccgcccccuggccccgccucugcugcaccugguacuuccccgaccgcgagaaccagcaguuccgccccaaccccacccuccucggcaaccuccgccagaaccagguccucugcccccuccccuacaucuccaucuucaagacccgcaacuccuccucccccaaccucgucuacggcgaguccggcuggauguccuucgaggaccacugcgccccccgcggcgccaucucccgcaucugccaggacccccgcaagauccucgcccucguccucuuccagcagucccccgacguccucgucuacggccucaagaacaagaaggcccacaucuga

SEQ ID NO: 42043 - RNA, 4293 nt, Artificial Sequence
  derived and/or modified sequence opt2 from DAPK1__Homo_sapiens__NP_004929
augaccgucuuccgccaggagaacgucgacgacuacuacgacaccggcgaggagcucggcuccggccaguucgccgucgucaagaagugccgcgagaaguccaccggccuccaguacgccgccaaguucaucaagaagcgccgcaccaaguccucccgccgcggcgucucccgcgaggacaucgagcgcgaggucuccauccucaaggagauccagcaccccaacgucaucacccuccacgaggucuacgagaacaagaccgacgucauccucauccucgagcucgucgccggcggcgagcucuucgacuuccucgccgagaaggagucccucaccgaggaggaggccaccgaguuccucaagcagauccucaacggcgucuacuaccuccacucccuccagaucgcccacuucgaccucaagcccgagaacaucaugcuccucgaccgcaacguccccaagccccgcaucaagaucaucgacuucggccucgcccacaagaucgacuucggcaacgaguucaagaacaucuucggcacccccgaguucgucgcccccgagaucgucaacuacgagccccucggccucgaggccgacaugugguccaucggcgucaucaccuacauccuccucuccggcgccucccccuuccucggcgacaccaagcaggagacccucgccaacgucuccgccgucaacuacgaguucgaggacgaguacuucuccaacaccuccgcccucgccaaggacuucauccgccgccuccucgucaaggaccccaagaagcgcaugaccauccaggacucccuccagcaccccuggaucaagcccaaggacacccagcaggcccucucccgcaaggccuccgccgucaacauggagaaguucaagaaguucgccgcccgcaagaaguggaagcaguccguccgccucaucucccucugccagcgccucucccgcuccuuccucucccgcuccaacauguccgucgcccgcuccgacgacacccucgacgaggaggacuccuucgucaugaaggccaucauccacgccaucaacgacgacaacguccccggccuccagcaccuccucggcucccucuccaacuacgacgucaaccagcccaacaagcacggcacccccccccuccucaucgccgccggcugcggcaacauccagauccuccagcuccucaucaagcgcggcucccgcaucgacguccaggacaagggcggcuccaacgccgucuacugggccgcccgccacggccacgucgacacccucaaguuccucuccgagaacaagugcccccucgacgucaaggacaaguccggcgagauggcccuccacgucgccgcccgcuacggccacgccgacgucgcccagcuccucugcuccuucggcuccaaccccaacauccaggacaaggaggaggagaccccccuccacugcgccgccuggcacggcuacuacuccgucgccaaggcccucugcgaggccggcugcaacgucaacaucaagaaccgcgagggcgagaccccccuccucaccgccuccgcccgcggcuaccacgacaucgucgagugccucgccgagcacggcgccgaccucaacgccugcgacaaggacggccacaucgcccuccaccucgccguccgccgcugccagauggaggucaucaagacccuccucucccagggcugcuucgucgacuaccaggaccgccacggcaacaccccccuccacgucgccugcaaggacggcaacaugcccaucgucgucgcccucugcgaggccaacugcaaccucgacaucuccaacaaguacggccgcaccccccuccaccucgccgccaacaacggcauccucgacgucguccgcuaccucugccucaugggcgccuccgucgaggcccucaccaccgacggcaagaccgccgaggaccucgcccgcuccgagcagcacgagcacgucgccggccuccucgcccgccuccgcaaggacacccaccgcggccucuucauccagcagcuccgccccacccagaaccuccagccccgcaucaagcucaagcucuucggccacuccggcuccggcaagaccacccucgucgagucccucaagugcggccuccuccgcuccuucuuccgccgccgccgcccccgccucuccuccaccaacuccucccgcuucccccccuccccccucgccuccaagcccaccgucuccgucuccaucaacaaccucuaccccggcugcgagaacgucuccguccgcucccgcuccaugauguucgagcccggccucaccaagggcaugcucgaggucuucgucgcccccacccaccacccccacugcuccgccgacgaccaguccaccaaggccaucgacauccagaacgccuaccucaacggcgucggcgacuucuccgucugggaguucuccggcaaccccgucuacuucugcugcuacgacuacuucgccgccaacgaccccaccuccauccacgucgucgucuucucccucgaggagcccuacgagauccagcucaaccaggucaucuucuggcucuccuuccucaagucccucguccccgucgaggagcccaucgccuucggcggcaagcucaagaacccccuccaggucguccucgucgccacccacgccgacaucaugaacgucccccgccccgccggcggcgaguucggcuacgacaaggacaccucccuccucaaggagauccgcaaccgcuucggcaacgaccuccacaucuccaacaagcucuucguccucgacgccggcgccuccggcuccaaggacaugaagguccuccgcaaccaccuccaggagauccgcucccagaucgucuccgucugcccccccaugacccaccucugcgagaagaucaucuccacccuccccuccuggcgcaagcucaacggccccaaccagcucaugucccuccagcaguucgucuacgacguccaggaccagcucaacccccucgccuccgaggaggaccuccgccgcaucgcccagcagcuccacuccaccggcgagaucaacaucaugcaguccgagaccguccaggacguccuccuccucgacccccgcuggcucugcaccaacguccucggcaagcuccucuccgucgagaccccccgcgcccuccaccacuaccgcggccgcuacaccgucgaggacauccagcgccucguccccgacuccgacgucgaggagcuccuccagauccucgacgccauggacaucugcgcccgcgaccucuccuccggcaccauggucgacguccccgcccucaucaagaccgacaaccuccaccgcuccugggccgacgaggaggacgaggucauggucuacggcggcguccgcaucguccccgucgagcaccucacccccuuccccugcggcaucuuccacaagguccaggucaaccucugccgcuggauccaccagcaguccaccgagggcgacgccgacauccgccucugggucaacggcugcaagcucgccaaccgcggcgccgagcuccucguccuccucgucaaccacggccagggcaucgagguccagguccgcggccucgagaccgagaagaucaagugcugccuccuccucgacuccgucugcuccaccaucgagaacgucauggccaccacccuccccggccuccucaccgucaagcacuaccucuccccccagcagcuccgcgagcaccacgagcccgucaugaucuaccagccccgcgacuucuuccgcgcccagacccucaaggagaccucccucaccaacaccaugggcggcuacaaggaguccuucuccuccaucaugugcuucggcugccacgacgucuacucccaggccucccucggcauggacauccacgccuccgaccucaaccuccucacccgccgcaagcucucccgccuccucgacccccccgacccccucggcaaggacuggugccuccucgccaugaaccucggccuccccgaccucgucgccaaguacaacaccuccaacggcgcccccaaggacuuccuccccuccccccuccacgcccuccuccgcgaguggaccaccuaccccgaguccaccgucggcacccucauguccaagcuccgcgagcucggccgccgcgacgccgccgacuuccuccucaaggccuccuccgucuucaagaucaaccucgacggcaacggccaggaggccuacgccuccuccugcaacuccggcaccuccuacaacuccaucuccuccgucgucucccgcuga

SEQ ID NO: 42044 - RNA, 1113 nt, Artificial Sequence
  derived and/or modified sequence opt2 from DAPK2__Homo_sapiens__NP_055141
auguuccaggccuccaugcgcucccccaacauggagcccuucaagcagcagaaggucgaggacuucuacgacaucggcgaggagcucggcuccggccaguucgccaucgucaagaagugccgcgagaaguccaccggccucgaguacgccgccaaguucaucaagaagcgccagucccgcgccucccgccgcggcgucucccgcgaggagaucgagcgcgaggucuccauccuccgccagguccuccaccacaacgucaucacccuccacgacgucuacgagaaccgcaccgacgucguccucauccucgagcucgucuccggcggcgagcucuucgacuuccucgcccagaaggagucccucuccgaggaggaggccaccuccuucaucaagcagauccucgacggcgucaacuaccuccacaccaagaagaucgcccacuucgaccucaagcccgagaacaucaugcuccucgacaagaacauccccaucccccacaucaagcucaucgacuucggccucgcccacgagaucgaggacggcgucgaguucaagaacaucuucggcacccccgaguucgucgcccccgagaucgucaacuacgagccccucggccucgaggccgacaugugguccaucggcgucaucaccuacauccuccucuccggcgccucccccuuccucggcgacaccaagcaggagacccucgccaacaucaccgccgucuccuacgacuucgacgaggaguucuucucccagaccuccgagcucgccaaggacuucauccgcaagcuccucgucaaggagacccgcaagcgccucaccauccaggaggcccuccgccaccccuggaucacccccgucgacaaccagcaggccaugguccgccgcgaguccgucgucaaccucgagaacuuccgcaagcaguacguccgccgccgcuggaagcucuccuucuccaucgucucccucugcaaccaccucacccgcucccucaugaagaagguccaccuccgccccgacgaggaccuccgcaacugcgaguccgacaccgaggaggacaucgcccgccgcaaggcccuccacccccgccgccgcuccuccaccuccuga

SEQ ID NO: 42045 - RNA, 1365 nt, Artificial Sequence
  derived and/or modified sequence opt2 from DAPK3__Homo_sapiens__XP_005259565
auguccaccuuccgccaggaggacgucgaggaccacuacgagaugggcgaggagcucggcuccggccaguucgccaucguccgcaagugccgccagaagggcaccggcaaggaguacgccgccaaguucaucaagaagcgccgccucuccuccucccgccgcggcgucucccgcgaggagaucgagcgcgaggucaacauccuccgcgagauccgccaccccaacaucaucacccuccacgacaucuucgagaacaagaccgacgucguccucauccucgagcucgucuccggcggcgagcucuucgacuuccucgccgagaaggagucccucaccgaggacgaggccacccaguuccucaagcagauccucgacggcguccacuaccuccacuccaagcgcaucgcccacuucgaccucaagcccgagaacaucaugcuccucgacaagaacguccccaacccccgcaucaagcucaucgacuucggcaucgcccacaagaucgaggccggcaacgaguucaagaacaucuucggcacccccgaguucgucgcccccgagaucgucaacuacgagccccucggccucgaggccgacaugugguccaucggcgucaucaccuacauccuccucuccggcgccucccccuuccucggcgagaccaagcaggagacccucaccaacaucuccgccgucaacuacgacuucgacgaggaguacuucuccaacaccuccgagcucgccaaggacuucauccgccgccuccucgucaaggaccccaagcgccgcaugaccaucgcccagucccucgagcacuccuggaucaaggccauccgccgccgcaacguccgcggcgaggacuccggccgcaagcccgagcgccgccgccucaagaccacccgccucaaggaguacaccaucaagucccacuccucccucccccccaacaacuccuacgccgacuucgagcgcuucuccaagguccucgaggaggccgccgccgccgaggagggccuccgcgagcuccagcgcucccgccgccucugccacgaggacgucgaggcccucgccgccaucuacgaggagaaggaggccugguaccgcgaggaguccgacucccucggccaggaccuccgccgccuccgccaggagcuccucaagaccgaggcccucaagcgccaggcccaggaggaggccaagggcgcccuccucggcaccuccggccucaagcgccgcuucucccgccucgagaaccgcuacgaggcccucgccaagcaggucgccuccgagaugcgcuucguccaggaccucguccgcgcccucgagcaggagaagcuccagggcgucgagugcggccuccgcuga

SEQ ID NO: 42046 - RNA, 1938 nt, Artificial Sequence
  derived and/or modified sequence opt2 from DARS2__Homo_sapiens__NP_060592
auguacuuccccuccuggcucucccagcucuaccgcggccucucccgccccauccgccgcaccacccagcccaucuggggcucccucuaccgcucccuccuccaguccucccagcgccgcauccccgaguucuccuccuucgucguccgcaccaacaccugcggcgagcuccgcuccucccaccucggccaggaggucacccucugcggcuggauccaguaccgccgccagaacaccuuccucguccuccgcgacuucgacggccucguccaggucaucaucccccaggacgaguccgccgccuccgucaagaagauccucugcgaggcccccgucgaguccgucguccaggucuccggcaccgucaucucccgccccgccggccaggagaaccccaagaugcccaccggcgagaucgagaucaaggucaagaccgccgagcuccucaacgccugcaagaagcuccccuucgagaucaagaacuucgucaagaagaccgaggcccuccgccuccaguaccgcuaccucgaccuccgcuccuuccagaugcaguacaaccuccgccuccgcucccagauggucaugaagaugcgcgaguaccucugcaaccuccacggcuucgucgacaucgagacccccacccucuucaagcgcacccccggcggcgccaaggaguuccucguccccucccgcgagcccggcaaguucuacucccucccccaguccccccagcaguucaagcagcuccucauggucggcggccucgaccgcuacuuccaggucgcccgcugcuaccgcgacgagggcucccgccccgaccgccagcccgaguucacccagaucgacaucgagauguccuucgucgaccagaccggcauccagucccucaucgagggccuccuccaguacuccuggcccaacgacaaggaccccgucgucguccccuuccccaccaugaccuucgccgagguccucgccaccuacggcaccgacaagcccgacacccgcuucggcaugaagaucaucgacaucuccgacgucuuccgcaacaccgagaucggcuuccuccaggacgcccucuccaagccccacggcaccgucaaggccaucugcauccccgagggcgccaaguaccucaagcgcaaggacaucgaguccauccgcaacuucgccgccgaccacuucaaccaggagauccuccccgucuuccucaacgccaaccgcaacuggaacucccccgucgccaacuucaucauggagucccagcgccucgagcucauccgccucauggagacccaggaggaggacgucguccuccucaccgccggcgagcacaacaaggccugcucccuccucggcaagcuccgccucgagugcgccgaccuccucgagacccgcggcgucguccuccgcgaccccacccucuucuccuuccucugggucgucgacuucccccucuuccuccccaaggaggagaacccccgcgagcucgaguccgcccaccaccccuucaccgccccccaccccuccgacauccaccuccucuacaccgagcccaagaaggcccgcucccagcacuacgaccucguccucaacggcaacgagaucggcggcggcuccauccgcauccacaacgccgagcuccagcgcuacauccucgccacccuccucaaggaggacgucaagaugcucucccaccuccuccaggcccucgacuacggcgcccccccccacggcggcaucgcccucggccucgaccgccucaucugccucgucaccggcucccccuccauccgcgacgucaucgccuuccccaaguccuuccgcggccacgaccucauguccaacacccccgacuccgucccccccgaggagcucaagcccuaccacauccgcgucuccaagcccaccgacuccaaggccgagcgcgcccacuga

SEQ ID NO: 42047 - RNA, 1206 nt, Artificial Sequence
  derived and/or modified sequence opt2 from DARS__Homo_sapiens__NP_001280241
auggucaaguucgccgccaacaucaacaaggaguccaucgucgacgucgagggcgucguccgcaaggucaaccagaagaucggcuccugcacccagcaggacgucgagcuccacguccagaagaucuacgucaucucccucgccgagccccgccucccccuccagcucgacgacgccguccgccccgaggccgagggcgaggaggagggccgcgccaccgucaaccaggacacccgccucgacaaccgcgucaucgaccuccgcaccuccaccucccaggccgucuuccgccuccaguccggcaucugccaccucuuccgcgagacccucaucaacaagggcuucgucgagauccagacccccaagaucaucuccgccgccuccgagggcggcgccaacgucuucaccgucuccuacuucaagaacaacgccuaccucgcccaguccccccagcucuacaagcagaugugcaucugcgccgacuucgagaaggucuucuccaucggccccgucuuccgcgccgaggacuccaacacccaccgccaccucaccgaguucgucggccucgacaucgagauggccuucaacuaccacuaccacgaggucauggaggagaucgccgacaccaugguccagaucuucaagggccuccaggagcgcuuccagaccgagauccagaccgucaacaagcaguuccccugcgagcccuucaaguuccucgagcccacccuccgccucgaguacugcgaggcccucgccaugcuccgcgaggccggcgucgagaugggcgacgaggacgaccucuccacccccaacgagaagcuccucggccaccucgucaaggagaaguacgacaccgacuucuacauccucgacaaguacccccucgccguccgccccuucuacaccaugcccgacccccgcaaccccaagcaguccaacuccuacgacauguucaugcgcggcgaggagauccucuccggcgcccagcgcauccacgacccccagcuccucaccgagcgcgcccuccaccacggcaucgaccucgagaagaucaaggccuacaucgacuccuuccgcuucggcgcccccccccacgccggcggcggcaucggccucgagcgcgucaccaugcucuuccucggccuccacaacguccgccagaccuccauguucccccgcgaccccaagcgccucacccccuga

SEQ ID NO: 42048 - RNA, 1248 nt, Artificial Sequence
  derived and/or modified sequence opt2 from DAW1__Homo_sapiens__NP_849143
augaagcucaagucccuccuccuccgcuacuacccccccggcaucaugcucgaguacgagaagcacggcgagcucaagaccaaguccaucgaccuccucgaccucggccccuccaccgacgucuccgcccucgucgaggagauccagaaggccgagccccuccucaccgccucccgcaccgagcaggucaagcuccucauccagcgccuccaggagaagcucggccagaacuccaaccacaccuucuaccucuucaagguccucaaggcccacauccucccccucaccaacgucgcccucaacaaguccggcuccugcuucaucaccggcuccuacgaccgcaccugcaagcucugggacaccgccuccggcgaggagcucaacacccucgagggccaccgcaacgucgucuacgccaucgccuucaacaaccccuacggcgacaagaucgccaccggcuccuucgacaagaccugcaagcucugguccgucgagaccggcaagugcuaccacaccuuccgcggccacaccgccgagaucgucugccucuccuucaacccccaguccacccucgucgccaccggcuccauggacaccaccgccaagcucugggacauccagaacggcgaggaggucuacacccuccgcggccacuccgccgagaucaucucccucuccuucaacaccuccggcgaccgcaucaucaccggcuccuucgaccacaccgucgucgucugggacgccgacaccggccgcaaggucaacauccucaucggccacugcgccgagaucuccuccgccuccuucaacugggacugcucccucauccucaccggcuccauggacaagaccugcaagcucugggacgccaccaacggcaagugcgucgccacccucaccggccacgacgacgagauccucgacuccugcuucgacuacaccggcaagcucaucgccaccgccuccgccgacggcaccgcccgcaucuucuccgccgccacccgcaagugcaucgccaagcucgagggccacgagggcgagaucuccaagaucuccuucaacccccagggcaaccaccuccucaccggcuccuccgacaagaccgcccgcaucugggacgcccagaccggccagugccuccagguccucgagggccacaccgacgagaucuucuccugcgccuucaacuacaagggcaacaucgucaucaccggcuccaaggacaacaccugccgcaucuggcgcuga

SEQ ID NO: 42049 - RNA, 2259 nt, Artificial Sequence
  derived and/or modified sequence opt2 from DAXX__Homo_sapiens__NP_001135442
augcgcggcuccgagaacugcggcgagggccgccucgagcgccgcuuccucuccaucaucguccucgacgacgacgacgaggacgaggccgccgcccagcccggccccucccacccccuccccaacgccgccucccccggcgccgaggcccccuccuccuccgagccccacggcgcccgcggcuccuccuccuccggcggcaagaagugcuacaagcucgagaacgagaagcucuucgaggaguuccucgagcucugcaagaugcagaccgccgaccaccccgaggucguccccuuccucuacaaccgccagcagcgcgcccacucccucuuccucgccuccgccgaguucugcaacauccucucccgcguccucucccgcgcccgcucccgccccgccaagcucuacgucuacaucaacgagcucugcaccguccucaaggcccacuccgccaagaagaagcucaaccucgcccccgccgccaccaccuccaacgagcccuccggcaacaacccccccacccaccucucccucgaccccaccaacgccgagaacaccgccucccaguccccccgcacccgcggcucccgccgccagauccagcgccucgagcagcuccucgcccucuacgucgccgagauccgccgccuccaggagaaggagcucgaccucuccgagcucgacgaccccgacuccgccuaccuccaggaggcccgccucaagcgcaagcucauccgccucuucggccgccucugcgagcucaaggacugcuccucccucaccggccgcgucaucgagcagcgcauccccuaccgcggcacccgcuaccccgaggucaaccgccgcaucgagcgccucaucaacaagcccggccccgacaccuuccccgacuacggcgacguccuccgcgccgucgagaaggccgccgcccgccacucccucggccucccccgccagcagcuccagcucauggcccaggacgccuuccgcgacgucggcauccgccuccaggagcgccgccaccucgaccucaucuacaacuucggcugccaccucaccgacgacuaccgccccggcgucgaccccgcccucuccgaccccguccucgcccgccgccuccgcgagaaccgcucccucgccaugucccgccucgacgaggucaucuccaaguacgccaugcuccaggacaaguccgaggagggcgagcgcaagaagcgccgcgcccgccuccagggcaccuccucccacuccgccgacacccccgaggccucccucgacuccggcgagggccccuccggcauggccucccagggcugccccuccgccucccgcgccgagaccgacgacgaggacgacgaggaguccgacgaggaggaggaggaggaggaggaggaggaggaggaggaggccaccgacuccgaggaggaggaggaccucgagcagaugcaggagggccaggaggacgacgaggaggaggacgaggaggaggaggccgccgccggcaaggacggcgacaagucccccauguccucccuccagaucuccaacgagaagaaccucgagcccggcaagcagaucucccgcuccuccggcgagcagcagaacaagggccgcaucgucucccccucccuccucuccgaggagccccucgcccccuccuccaucgacgccgaguccaacggcgagcagcccgaggagcucacccucgaggaggagucccccgucucccagcucuucgagcucgagaucgaggcccucccccucgacacccccuccuccgucgagaccgacaucuccuccucccgcaagcaguccgaggagcccuucaccaccguccucgagaacggcgccggcauggucuccuccaccuccuucaacggcggcgucuccccccacaacuggggcgacuccggcccccccugcaagaagucccgcaaggagaagaagcagaccggcuccggcccccucggcaacuccuacgucgagcgccagcgcuccguccacgagaagaacggcaagaagaucugcacccuccccuccccccccuccccccucgccucccucgcccccgucgccgacuccuccacccgcgucgacucccccucccacggccucgucaccuccucccucugcauccccucccccgcccgccucucccagaccccccacucccagcccccccgccccggcaccugcaagaccuccgucgccacccagugcgaccccgaggagaucaucguccucuccgacuccgacuga

SEQ ID NO: 42050 - RNA, 2235 nt, Artificial Sequence
  derived and/or modified sequence opt2 from DAZ1__Homo_sapiens__NP_004072
auguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaggccuacuccgccuacccccacucccccggccaggucaucaccggcugccagcuccucgucuacaacuaccaggaguaccccaccuaccccgacuccgccuuccaggucaccaccggcuaccagcuccccgucuacaacuaccagcccuuccccgccuacccccgcucccccuuccaggucaccgccggcuaccagcuccccgucuacaacuaccaggccuuccccgccuaccccaacucccccuuccaggucgccaccggcuaccaguuccccgucuacaacuaccagcccuuccccgccuaccccuccucccccuuccaggucaccgccggcuaccagcuccccgucuacaacuaccaggccuuccccgccuaccccaacucccccuuccaggucgccaccggcuaccaguuccccgucuacaacuaccaggccuuccccgccuaccccaacucccccguccaggucaccaccggcuaccagcuccccgucuacaacuaccaggccuuccccgccuaccccuccucccccuuccaggucaccaccggcuaccagcuccccgucuacaacuaccaggccuuccccgccuaccccaacuccgccguccaggucaccaccggcuaccaguuccacgucuacaacuaccagaugcccccccagugccccgucggcgagcagcgccgcaaccucuggaccgaggccuacaaguggugguaccucgucugccucauccagcgccgcgacuga

SEQ ID NO: 42051 - RNA, 1605 nt, Artificial Sequence
  derived and/or modified sequence opt2 from DAZ2__Homo_sapiens__NP_001005785
auguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaggccuacuccgccuacccccacucccccggccaggucaucaccggcugccagcuccucgucuacaacuaccaggaguaccccaccuaccccgacuccgccuuccaggucaccaccggcuaccagcuccccgucuacaacuaccagcccuuccccgccuacccccgcucccccuuccaggucaccgccggcuaccagcuccccgucuacaacuaccaggccuuccccgccuaccccaacucccccuuccaggucgccaccggcuaccaguuccccgucuacaacuaccagcccuuccccgccuaccccuccucccccuuccaggucaccgccggcuaccagcuccccgucuacaacuaccaggccuuccccgccuaccccaacucccccuuccaggucgccaccggcuaccaguuccccgucuacaacuaccaggccuuccccgccuaccccaacucccccguccaggucaccaccggcuaccagcuccccgucuacaacuaccaggccuuccccgccuaccccuccucccccuuccaggucaccaccggcuaccagcuccccgucuacaacuaccaggccuuccccgccuaccccuccucccccuuccaggucaccaccggcuaccagcuccccgucuacaacuaccaggccuuccccgccuaccccuccucccccuuccaggucaccaccggcuaccagcuccccgucuacaacuaccaggccuuccccgccuaccccuccucccccuuccaggucaccaccggcuaccagcuccccgucuacaacuaccaggccuuccccgccuaccccuccucccccuuccaggucaccaccggcuaccagcuccccgucuacaacuaccaggccuuccccgccuaccccuccucccccuuccaggucaccaccggcuaccagcuccccgucuacaacuaccaggccuuccccgccuaccccaacuccgccguccaggucaccaccggcuaccaguuccacgucuacaacuaccagaugcccccccagugccccgucggcgagcagcgccgcaaccucuggaccgaggccuacaaguggugguaccucgucugccucauccagcgccgcgacuga

SEQ ID NO: 42052 - RNA, 1317 nt, Artificial Sequence
  derived and/or modified sequence opt2 from DAZ3__Homo_sapiens__NP_065097
auguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaggccuacuccgccuacccccacucccccggccaggucaucaccggcugccagcuccucgucuacaacuaccaggaguaccccaccuaccccgacuccgccuuccaggucaccaccggcuaccagcuccccgucuacaacuaccagcccuuccccgccuacccccgcucccccuuccaggucaccgccggcuaccagcuccccgucuacaacuaccaggccuuccccgccuaccccaacucccccuuccaggucgccaccggcuaccaguuccccgucuacaacuaccaggccuuccccgccuaccccaacucccccguccaggucaccaccggcuaccagcuccccgucuacaacuaccaggccuuccccgccuaccccaacucccccuuccaggucgccaccggcuaccaguuccccgucuacaacuaccaggccuuccccgccuaccccaacucccccguccaggucaccaccggcuaccagcuccccgucuacaacuaccaggccuuccccgccuaccccaacucccccuuccaggucgccaccggcuaccaguuccccgucuacaacuaccaggccuuccccgccuaccccaacucccccguccaggucaccaccggcuaccagcuccccgucuacaacuaccaggccuuccccgccuaccccaacuccgccguccaggucaccaccggcuaccaguuccacgucuacaacuaccagaugcccccccagugccccgucggcgagcagcgccgcaaccucuggaccgaggccuacaaguggugguaccucgucugccucauccagcgccgcgacuga

SEQ ID NO: 42053 - RNA, 1740 nt, Artificial Sequence
  derived and/or modified sequence opt2 from DAZ4__Homo_sapiens__NP_001005375
auguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaguccgccgccaaccccgagacccccaacuccaccaucucccgcgaggccuccacccaguccuccuccgccgccgccucccagggcuggguccuccccgagggcaagaucguccccaacaccgucuucgucggcggcaucgacgcccgcauggacgagaccgagaucggcuccugcuucggccgcuacggcuccgucaaggaggucaagaucaucaccaaccgcaccggcgucuccaagggcuacggcuucgucuccuucgucaacgacgucgacguccagaagaucgucggcucccagauccacuuccacggcaagaagcucaagcucggccccgccauccgcaagcagaagcucugcgcccgccacguccagccccgcccccucgucgucaacccccccccccccccccaguuccagaacgucuggcgcaaccccaacaccgagaccuaccuccagccccagaucacccccaaccccgucacccagcacguccaggccuacuccgccuacccccacucccccggccaggucaucaccggcugccagcuccucgucuacaacuaccaggaguaccccaccuaccccgacuccgccuuccaggucaccaccggcuaccagcuccccgucuacaacuaccagcccuuccccgccuacccccgcucccccuuccaggucaccgccggcuaccagcuccccgucuacaacuaccaggccuuccccgccuaccccaacucccccuuccaggucgccaccggcuaccaguuccccgucuacaacuaccagcccuuccccgccuaccccuccucccccuuccaggucaccgccggcuaccagcuccccgucuacaacuaccaggccuuccccgccuaccccaacucccccuuccaggucgccaccggcuaccaguuccccgucuacaacuaccaggccuuccccgccuaccccaacucccccguccaggucaccaccggcuaccagcuccccgucuacaacuaccaggccuuccccgccuaccccuccucccccuuccaggucaccaccggcuaccagcuccccgucuacaacuaccaggccuuccccgccuaccccaacuccgccguccaggucaccaccggcuaccaguuccacgucuacaacuaccagaugcccccccagugccccgucggcgagcagcgccgcaaccucuggaccgaggccuacaaguggugguaccucgucugccucauccagcgccgcgacuga

SEQ ID NO: 42054 - RNA, 1224 nt, Artificial Sequence
  derived and/or modified sequence opt2 from DAZAP1__Homo_sapiens__NP_061832
augaacaacuccggcgccgacgagaucggcaagcucuucgucggcggccucgacugguccaccacccaggagacccuccgcuccuacuucucccaguacggcgaggucgucgacugcgucaucaugaaggacaagaccaccaaccagucccgcggcuucggcuucgucaaguucaaggaccccaacugcgucggcaccguccucgccucccgcccccacacccucgacggccgcaacaucgaccccaagcccugcaccccccgcggcaugcagcccgagcgcacccgccccaaggagggcuggcagaagggcccccgcuccgacaacuccaaguccaacaagaucuucgucggcggcaucccccacaacugcggcgagaccgagcuccgcgaguacuucaagaaguucggcgucgucaccgaggucgucaugaucuacgacgccgagaagcagcgcccccgcggcuucggcuucaucaccuucgaggacgagcaguccgucgaccaggccgucaacaugcacuuccacgacaucaugggcaagaaggucgaggucaagcgcgccgagccccgcgacuccaagucccaggcccccggccagcccggcgccucccaguggggcucccgcgucguccccaacgccgccaacggcugggccggccagcccccccccaccuggcagcagggcuacggcccccagggcauguggguccccgccggccaggccaucggcggcuacggccccccccccgccggccgcggcgccccccccccccccccccccuucaccuccuacaucgucuccaccccccccggcggcuucccccccccccagggcuucccccagggcuacggcgcccccccccaguucuccuucggcuacggcccccccccccccccccccgaccaguucgccccccccggcgucccccccccccccgccacccccggcgccgccccccucgccuucccccccccccccucccaggccgcccccgacauguccaagccccccaccgcccagcccgacuuccccuacggccaguacgccggcuacggccaggaccucuccggcuucggccagggcuucuccgaccccucccagcagccccccuccuacggcggccccuccguccccggcuccggcggcccccccgccggcggcuccggcuucggccgcggccagaaccacaacguccagggcuuccaccccuaccgccgcuga

SEQ ID NO: 42055 - RNA, 441 nt, Artificial Sequence
  derived and/or modified sequence opt2 from DAZAP2__Homo_sapiens__NP_001129736
augaacuccaagggccaguaccccacccagcccaccuaccccguccagccccccggcaaccccgucuacccccagacccuccaccucccccaggccccccccuacaccgacgccccccccgccuacuccgagcucuaccgccccuccuucguccaccccggcgccgccaccguccccaccauguccgccgccauccccauggccuacuaccccgucggccccaucuacccccccggcuccaccguccucgucgagggcggcuacgacgccggcgcccgcuucggcgccggcgccaccgccggcaacauccccccccccccccccggcugcccccccaacgccgcccagcucgccgucaugcagggcgccaacguccucgucacccagcgcaagggcaacuucuucaugggcggcuccgacggcggcuacaccaucugguga

SEQ ID NO: 42056 - RNA, 948 nt, Artificial Sequence
  derived and/or modified sequence opt2 from DAZL__Homo_sapiens__NP_001177740
auggccgcccccuccugcggcggcgaccgcaaggcccgccucacccccucccucccccacgaguccaccgccaaccccgagacccccaacuccaccaucucccgcgaggccuccacccaguccuccuccgccgccaccucccagggcuacauccuccccgagggcaagaucaugcccaacaccgucuucgucggcggcaucgacguccgcauggacgagaccgagauccgcuccuucuucgcccgcuacggcuccgucaaggaggucaagaucaucaccgaccgcaccggcgucuccaagggcuacggcuucgucuccuucuucaacgacgucgacguccagaagaucgucgagucccagaucaacuuccacggcaagaagcucaagcucggccccgccauccgcaagcagaaccucugcgccuaccacguccagccccgcccccucgucuucaaccaccccccccccccccaguuccagaacgucuggaccaaccccaacaccgagaccuacaugcagcccaccaccaccaugaaccccaucacccaguacguccaggccuaccccaccuaccccaacucccccguccaggucaucaccggcuaccagcuccccgucuacaacuaccagaugcccccccaguggcccgucggcgagcagcgcuccuacgucgucccccccgccuacuccgccgucaacuaccacugcaacgaggucgaccccggcgccgaggucguccccaacgagugcuccguccacgaggccaccccccccuccggcaacggcccccagaagaaguccgucgaccgcuccauccagaccgucgucuccugccucuucaaccccgagaaccgccuccgcaacuccgucgucacccaggacgacuacuucaaggacaagcgcguccaccacuuccgccgcucccgcgccaugcucaaguccgucuga

SEQ ID NO: 42057 - RNA, 2025 nt, Artificial Sequence
  derived and/or modified sequence opt2 from DBF4__Homo_sapiens__NP_006707
augaacuccggcgccaugcgcauccacuccaagggccacuuccagggcggcauccaggucaagaacgagaagaaccgccccucccucaagucccucaagaccgacaaccgccccgagaaguccaagugcaagccccucuggggcaaggucuucuaccucgaccuccccuccgucaccaucuccgagaagcuccagaaggacaucaaggaccucggcggccgcgucgaggaguuccucuccaaggacaucuccuaccucaucuccaacaagaaggaggccaaguucgcccagacccucggccgcaucucccccguccccucccccgaguccgccuacaccgccgagaccaccuccccccaccccucccacgacggcuccuccuucaagucccccgacaccgucugccucucccgcggcaagcuccucgucgagaaggccaucaaggaccacgacuucauccccuccaacuccauccucuccaacgcccucuccuggggcgucaagauccuccacaucgacgacauccgcuacuacaucgagcagaagaagaaggagcucuaccuccucaagaaguccuccaccuccguccgcgacggcggcaagcgcgucggcuccggcgcccagaagacccgcaccggccgccucaagaagcccuucgucaaggucgaggacaugucccagcucuaccgccccuucuaccuccagcucaccaacaugcccuucaucaacuacuccauccagaagcccugcucccccuucgacgucgacaagcccuccuccaugcagaagcagacccaggucaagcuccgcauccagaccgacggcgacaaguacggcggcaccuccauccagcuccagcucaaggagaagaagaagaagggcuacugcgagugcugccuccagaaguacgaggaccucgagacccaccuccucuccgagcagcaccgcaacuucgcccaguccaaccaguaccaggucgucgacgacaucgucuccaagcucgucuucgacuucgucgaguacgagaaggacacccccaagaagaagcgcaucaaguacuccgucggcucccucucccccgucuccgccuccguccucaagaagaccgagcagaaggagaaggucgagcuccagcacaucucccagaaggacugccaggaggacgacaccaccgucaaggagcagaacuuccucuacaaggagacccaggagaccgagaagaagcuccucuucaucuccgagcccaucccccaccccuccaacgagcuccgcggccucaacgagaagauguccaacaagugcuccaugcucuccaccgccgaggacgacauccgccagaacuucacccagcucccccuccacaagaacaagcaggagugcauccucgacaucuccgagcacacccucuccgagaacgaccucgaggagcuccgcgucgaccacuacaagugcaacauccaggccuccguccacgucuccgacuucuccaccgacaacuccggcucccagcccaagcagaaguccgacaccguccucuuccccgccaaggaccucaaggagaaggaccuccacuccaucuucacccacgacuccggccucaucaccaucaacuccucccaggagcaccucaccguccaggccaaggcccccuuccacaccccccccgaggagcccaacgagugcgacuucaagaacauggacucccuccccuccggcaagauccaccgcaaggucaagaucauccucggccgcaaccgcaaggagaaccucgagcccaacgccgaguucgacaagcgcaccgaguucaucacccaggaggagaaccgcaucugcuccucccccguccagucccuccucgaccucuuccagaccuccgaggagaaguccgaguuccucggcuucaccuccuacaccgagaaguccggcaucugcaacguccucgacaucugggaggaggagaacuccgacaaccuccucaccgccuucuucuccucccccuccaccuccaccuucaccggcuucuga

SEQ ID NO: 42058 - RNA, 1854 nt, Artificial Sequence
  derived and/or modified sequence opt2 from DBH__Homo_sapiens__NP_000778
augcccgcccucucccgcugggccucccuccccggccccuccaugcgcgaggccgccuucauguacuccaccgccgucgccaucuuccucgucauccucgucgccgcccuccagggcuccgccccccgcgaguccccccuccccuaccacaucccccucgaccccgagggcucccucgagcucuccuggaacgucuccuacacccaggaggccauccacuuccagcuccucguccgccgccucaaggccggcguccucuucggcauguccgaccgcggcgagcucgagaacgccgaccucgucguccucuggaccgacggcgacaccgccuacuucgccgacgccugguccgaccagaagggccagauccaccucgacccccagcaggacuaccagcuccuccagguccagcgcacccccgagggccucacccuccucuucaagcgccccuucggcaccugcgaccccaaggacuaccucaucgaggacggcaccguccaccucgucuacggcauccucgaggagcccuuccgcucccucgaggccaucaacggcuccggccuccagaugggccuccagcgcguccagcuccucaagcccaacauccccgagcccgagcuccccuccgacgccugcaccauggagguccaggcccccaacauccagauccccucccaggagaccaccuacuggugcuacaucaaggagcuccccaagggcuucucccgccaccacaucaucaaguacgagcccaucgucaccaagggcaacgaggcccucguccaccacauggaggucuuccagugcgcccccgagauggacuccgucccccacuucuccggccccugcgacuccaagaugaagcccgaccgccucaacuacugccgccacguccucgccgccugggcccucggcgccaaggccuucuacuaccccgaggaggccggccucgccuucggcggccccggcuccucccgcuaccuccgccucgagguccacuaccacaacccccucgucaucgagggccgcaacgacuccuccggcauccgccucuacuacaccgccaagcuccgccgcuucaacgccggcaucauggagcucggccucgucuacacccccgucauggccauccccccccgcgagaccgccuucauccucaccggcuacugcaccgacaagugcacccagcucgcccucccccccuccggcauccacaucuucgccucccagcuccacacccaccucaccggccgcaaggucgucaccguccucguccgcgacggccgcgagugggagaucgucaaccaggacaaccacuacuccccccacuuccaggagauccgcaugcucaagaaggucgucuccguccaccccggcgacguccucaucaccuccugcaccuacaacaccgaggaccgcgagcucgccaccgucggcggcuucggcauccucgaggagaugugcgucaacuacguccacuacuacccccagacccagcucgagcucugcaaguccgccgucgacgccggcuuccuccagaaguacuuccaccucaucaaccgcuucaacaacgaggacgucugcaccugcccccaggccuccgucucccagcaguucaccuccguccccuggaacuccuucaaccgcgacguccucaaggcccucuacuccuucgcccccaucuccaugcacugcaacaaguccuccgccguccgcuuccagggcgaguggaaccuccagccccuccccaaggucaucuccacccucgaggagcccaccccccagugccccaccucccagggccgcucccccgccggccccaccgucgucuccaucggcggcggcaagggcuga

SEQ ID NO: 42059 - RNA, 264 nt, Artificial Sequence
  derived and/or modified sequence opt2 from DBI__Homo_sapiens__NP_001073331
augucccaggccgaguucgagaaggccgccgaggagguccgccaccucaagaccaagcccuccgacgaggagaugcucuucaucuacggccacuacaagcaggccaccgucggcgacaucaacaccgagcgccccggcaugcucgacuucaccggcaaggccaagugggacgccuggaacgagcucaagggcaccuccaaggaggacgccaugaaggccuacaucaacaaggucgaggagcucaagaagaaguacggcaucuga

SEQ ID NO: 42060 - RNA, 1950 nt, Artificial Sequence
  derived and/or modified sequence opt2 from DBN1__Homo_sapiens__NP_004386
auggccggcgucuccuucuccggccaccgccucgagcuccucgccgccuacgaggaggucauccgcgaggaguccgccgccgacugggcccucuacaccuacgaggacggcuccgacgaccucaagcucgccgccuccggcgagggcggccuccaggagcucuccggccacuucgagaaccagaaggucauguacggcuucugcuccgucaaggacucccaggccgcccuccccaaguacguccucaucaacugggucggcgaggacguccccgacgcccgcaagugcgccugcgccucccacgucgccaaggucgccgaguucuuccagggcgucgacgucaucgucaacgccuccuccgucgaggacaucgacgccggcgccaucggccagcgccucuccaacggccucgcccgccucuccucccccguccuccaccgccuccgccuccgcgaggacgagaacgccgagcccgucggcaccaccuaccagaagaccgacgccgccgucgagaugaagcgcaucaaccgcgagcaguucugggagcaggccaagaaggaggaggagcuccgcaaggaggaggagcgcaagaaggcccucgacgagcgccuccgcuucgagcaggagcgcauggagcaggagcgccaggagcaggaggagcgcgagcgccgcuaccgcgagcgcgagcagcagaucgaggagcaccgccgcaagcagcagacccucgaggccgaggaggccaagcgccgccucaaggagcaguccaucuucggcgaccaccgcgacgaggaggaggagacccacaugaagaaguccgaguccgaggucgaggaggccgccgccaucaucgcccagcgccccgacaacccccgcgaguucuucaagcagcaggagcgcgucgccuccgccuccgccggcuccugcgacguccccucccccuucaaccaccgccccggcucccaccucgacucccaccgccgcauggcccccacccccauccccacccgcucccccuccgacuccuccaccgccuccacccccgucgccgagcagaucgagcgcgcccucgacgaggucaccuccucccagccccccccccucccccccccccccccccccgcccaggagacccaggagcccucccccauccucgacuccgaggagacccgcgccgccgccccccaggccugggccggccccauggaggagcccccccaggcccaggcccccccccgcggccccggcucccccgccgaggaccucauguucauggaguccgccgagcaggccguccucgccgcccccgucgagcccgccaccgccgacgccaccgagauccacgacgccgccgacaccaucgagaccgacaccgccaccgccgacaccaccgucgccaacaacgucccccccgccgccaccucccucaucgaccucuggcccggcaacggcgagggcgccuccacccuccagggcgagccccgcgcccccaccccccccuccggcaccgaggucacccucgccgaggucccccuccucgacgaggucgcccccgagccccuccuccccgccggcgagggcugcgccacccuccucaacuucgacgagcuccccgagccccccgccaccuucugcgaccccgaggaggucgagggcgagccccucgccgccccccagacccccacccuccccuccgcccucgaggagcucgagcaggagcaggagcccgagccccaccuccucaccaacggcgagaccacccagaaggagggcacccaggccuccgagggcuacuucucccagucccaggaggaggaguucgcccaguccgaggagcucugcgccaaggcccccccccccgucuucuacaacaagccccccgagaucgacaucaccugcugggacgccgaccccguccccgaggaggaggagggcuucgagggcggcgacuga

SEQ ID NO: 42061 - RNA, 1293 nt, Artificial Sequence
  derived and/or modified sequence opt2 from DBNL__Homo_sapiens__NP_001014436
auggccgccaaccucucccgcaacggccccgcccuccaggaggccuacguccgcgucgucaccgagaagucccccaccgacugggcccucuucaccuacgagggcaacuccaacgacauccgcgucgccggcaccggcgagggcggccucgaggagauggucgaggagcucaacuccggcaaggucauguacgccuucugccgcgucaaggaccccaacuccggccuccccaaguucguccucaucaacuggaccggcgagggcgucaacgacguccgcaagggcgccugcgccucccacgucuccaccauggccuccuuccucaagggcgcccacgucaccaucaacgcccgcgccgaggaggacgucgagcccgagugcaucauggagaaggucgccaaggccuccggcgccaacuacuccuuccacaaggaguccggccgcuuccaggacgucggcccccaggcccccgucggcuccgucuaccagaagaccaacgccgucuccgagaucaagcgcgucggcaaggacuccuucugggccaaggccgagaaggaggaggagaaccgccgccucgaggagaagcgccgcgccgaggaggcccagcgccagcucgagcaggagcgccgcgagcgcgagcuccgcgaggccgcccgccgcgagcagcgcuaccaggagcagggcggcgaggccuccccccagcgcaccugggagcagcagcaggaggucgucucccgcaaccgcaacgagcaggaguccgccguccacccccgcgagaucuucaagcagaaggagcgcgccauguccaccaccuccaucuccuccccccagcccggcaagcuccgcucccccuuccuccagaagcagcucacccagcccgagacccacuucggccgcgagcccgccgccgccaucucccgcccccgcgccgaccuccccgccgaggagcccgcccccuccaccccccccugccucguccaggccgaggaggaggccgucuacgaggagccccccgagcaggagaccuucuacgagcagcccccccucguccagcagcagggcgccggcuccgagcacaucgaccaccacauccagggccagggccucuccggccagggccucugcgcccgcgcccucuacgacuaccaggccgccgacgacaccgagaucuccuucgaccccgagaaccucaucaccggcaucgaggucaucgacgagggcugguggcgcggcuacggccccgacggccacuucggcauguuccccgccaacuacgucgagcucaucgaguga

SEQ ID NO: 42062 - RNA, 978 nt, Artificial Sequence
  derived and/or modified sequence opt2 from DBP__Homo_sapiens__NP_001343
auggcccgccccgucuccgaccgcacccccgccccccuccuccucggcggccccgccggcaccccccccggcggcggcgcccuccucggccuccgcucccuccuccagggcaccuccaagcccaaggagcccgccuccugccuccucaaggagaaggagcgcaaggccgcccuccccgccgccaccacccccggccccggccucgagaccgccggccccgccgacgcccccgccggcgccgucgucggcggcggcuccccccgcggccgccccggccccguccccgcccccggccuccucgccccccuccucugggagcgcacccuccccuucggcgacgucgaguacgucgaccucgacgccuuccuccucgagcacggccucccccccuccccccccccccccggcggccccucccccgagcccucccccgcccgcacccccgcccccucccccggccccggcuccugcggcuccgccuccccccgcuccucccccggccacgcccccgcccgcgccgcccucggcaccgccuccggccaccgcgccggccucaccucccgcgacacccccucccccgucgaccccgacaccgucgagguccucaugaccuucgagcccgaccccgccgaccucgcccucuccuccauccccggccacgagaccuucgacccccgccgccaccgcuucuccgaggaggagcucaagccccagcccaucaugaagaaggcccgcaagauccagguccccgaggagcagaaggacgagaaguacuggucccgccgcuacaagaacaacgaggccgccaagcgcucccgcgacgcccgccgccucaaggagaaccagaucuccguccgcgccgccuuccucgagaaggagaacgcccuccuccgccaggaggucgucgccguccgccaggagcucucccacuaccgcgccguccucucccgcuaccaggcccagcacggcgcccucuga

SEQ ID NO: 42063 - RNA, 1635 nt, Artificial Sequence
  derived and/or modified sequence opt2 from DBR1__Homo_sapiens__NP_057300
augcgcgucgccgucgccggcugcugccacggcgagcucgacaagaucuacgagacccucgcccucgccgagcgccgcggccccggccccgucgaccuccuccucugcugcggcgacuuccaggccguccgcaacgaggccgaccuccgcugcauggccgucccccccaaguaccgccacaugcagaccuucuaccgcuacuacuccggcgagaagaaggcccccguccucacccucuucaucggcggcaaccacgaggccuccaaccaccuccaggagcuccccuacggcggcugggucgcccccaacaucuacuaccucggccucgccggcgucgucaaguaccgcggcguccgcaucggcggcaucuccggcaucuucaagucccacgacuaccgcaagggccacuucgagugcccccccuacaacuccuccaccauccgcuccaucuaccacguccgcaacaucgaggucuacaagcucaagcagcucaagcagcccaucgacaucuuccucucccacgacuggccccgcuccaucuaccacuacggcaacaagaagcagcuccucaagaccaaguccuucuuccgccaggaggucgagaacaacacccucggcucccccgccgccuccgagcuccucgagcaccucaagcccaccuacugguucuccgcccaccuccacgucaaguucgccgcccucaugcagcaccaggccaaggacaagggccagaccgcccgcgccaccaaguuccucgcccucgacaagugccucccccaccgcgacuuccuccagauccucgagaucgagcacgaccccuccgcccccgacuaccucgaguacgacaucgaguggcucaccauccuccgcgccaccgacgaccucaucaacgucaccggccgccucuggaacaugcccgagaacaacggccuccacgcccgcugggacuacuccgccaccgaggagggcaugaaggagguccucgagaagcucaaccacgaccucaagguccccugcaacuucuccgucaccgccgccugcuacgaccccuccaagccccagacccagaugcagcucauccaccgcaucaacccccagaccaccgaguucugcgcccagcucggcaucaucgacaucaacguccgccuccagaaguccaaggaggagcaccacgucugcggcgaguacgaggagcaggacgacgucgaguccaacgacuccggcgaggaccaguccgaguacaacaccgacaccuccgcccucuccuccaucaaccccgacgagaucaugcucgacgaggaggaggacgaggacuccaucgucuccgcccacuccggcaugaacacccccuccgucgagcccuccgaccaggccuccgaguucuccgccuccuucuccgacguccgcauccuccccggcuccaugaucgucuccuccgacgacaccgucgacuccaccaucgaccgcgagggcaagcccggcggcaccgucgaguccggcaacggcgaggaccucaccaaggucccccucaagcgccucuccgacgagcacgagcccgagcagcgcaagaagaucaagcgccgcaaccaggccaucuacgccgccgucgacgacgacgacgacgacgccgccuga

SEQ ID NO: 42064 - RNA, 1032 nt, Artificial Sequence
  derived and/or modified sequence opt2 from DBX1__Homo_sapiens__NP_001025036
augauguuccccggccuccucgccccccccgccggcuaccccucccuccuccgccccacccccacccucacccucccccagucccuccaguccgccuucuccggccacuccuccuuccucgucgaggaccucauccgcaucucccgcccccccgccuaccucccccgcuccguccccaccgccuccaugucccccccccgccagggcgcccccaccgcccucaccgacaccggcgccuccgaccucggcucccccggccccggcucccgccgcggcggcuccccccccaccgccuucucccccgccuccgagaccaccuuccucaaguucggcgucaacgccauccucuccuccggcccccgcaccgagaccucccccgcccuccuccaguccgucccccccaagaccuucgccuuccccuacuucgagggcuccuuccagcccuucauccgcuccuccuacuuccccgccuccuccuccgucguccccauccccggcaccuucuccuggccccucgccgcccgcggcaagccccgccgcggcaugcuccgccgcgccgucuucuccgacguccagcgcaaggcccucgagaagauguuccagaagcagaaguacaucuccaagcccgaccgcaagaagcucgccgccaagcucggccucaaggacucccaggucaagaucugguuccagaaccgccgcaugaaguggcgcaacuccaaggagcgcgagcuccucuccuccggcggcugccgcgagcagacccuccccaccaagcucaacccccaccccgaccucuccgacgucggccagaagggccccggcaacgaggaggaggaggagggccccggcucccccucccaccgccucgccuaccacgccuccuccgacccccagcaccuccgcgacccccgccuccccggcccccucccccccucccccgcccacuccuccucccccggcaagcccuccgacuucuccgacuccgaggaggaggaggagggcgaggagcaggaggagaucaccgucuccuga

SEQ ID NO: 42065 - RNA, 1362 nt, Artificial Sequence
  derived and/or modified sequence opt2 from DCAF12__Homo_sapiens__NP_056212
auggcccgcaaggucgucucccgcaagcgcaaggcccccgccucccccggcgccggcuccgacgcccagggcccccaguucggcugggaccacucccuccacaagcgcaagcgccucccccccgucaagcgcucccucgucuacuaccucaagaaccgcgagguccgccuccagaacgagaccuccuacucccgcguccuccacggcuacgccgcccagcagcuccccucccuccucaaggagcgcgaguuccaccucggcacccucaacaaggucuucgccucccaguggcucaaccaccgccaggucgucugcggcaccaagugcaacacccucuucgucgucgacguccagaccucccagaucaccaagauccccauccucaaggaccgcgagcccggcggcgucacccagcagggcugcggcauccacgccaucgagcucaaccccucccgcacccuccucgccaccggcggcgacaaccccaacucccucgccaucuaccgccuccccacccucgaccccgucugcgucggcgacgacggccacaaggacuggaucuucuccaucgccuggaucuccgacaccauggccgucuccggcucccgcgacggcuccaugggccucugggaggucaccgacgacguccucaccaaguccgacgcccgccacaacgucucccgcguccccgucuacgcccacaucacccacaaggcccucaaggacauccccaaggaggacaccaaccccgacaacugcaagguccgcgcccucgccuucaacaacaagaacaaggagcucggcgccgucucccucgacggcuacuuccaccucuggaaggccgagaacacccucuccaagcuccucuccaccaagcuccccuacugccgcgagaacgucugccucgccuacggcuccgagugguccgucuacgccgucggcucccaggcccacgucuccuuccucgacccccgccagcccuccuacaacgucaaguccgucugcucccgcgagcgcggcuccggcauccgcuccgucuccuucuacgagcacaucaucaccgucggcaccggccagggcucccuccucuucuacgacauccgcgcccagcgcuuccucgaggagcgccucuccgccugcuacggcuccaagccccgccucgccggcgagaaccucaagcucaccaccggcaagggcuggcucaaccacgacgagaccuggcgcaacuacuucuccgacaucgacuucuuccccaacgccgucuacacccacugcuacgacuccuccggcaccaagcucuucgucgccggcggcccccuccccuccggccuccacggcaacuacgccggccucugguccuga

SEQ ID NO: 42066 - RNA, 1794 nt, Artificial Sequence
  derived and/or modified sequence opt2 from DCAF13__Homo_sapiens__NP_056235
augcaguggcccccccccuggcgccgcuccccccucgucuccgccacccccccccccggccccacccgcggccuccucugcccccgccgcgucuccgaggccggcgacuccuccaccgagggcgcccgcaccggccaccgccacuacgucacccccgccgaguccgccauggagggccgcucccagccccuccccucccuccgccccgccucccccaccaacgcccccgcccacggccgcggcuccgacugcaccgccaaggagcccccccucgccaacgucugccgccagaacuacggcgccgcccaggaccccgucgagcccgccggccgccgcuccgccucccacgucaccggcuccucccucggcaaggccgaggucgccugcggccgccgcuggcgcugggccgagcuccucgccgacaccuccuggucccccgccggccgcgccaccgagaugaaggucaagaugcucucccgcaaccccgacaacuacguccgcgagaccaagcucgaccuccagcgcgucccccgcaacuacgaccccgcccuccaccccuucgaggucccccgcgaguacauccgcgcccucaacgccaccaagcucgagcgcgucuucgccaagcccuuccucgccucccucgacggccaccgcgacggcgucaacugccucgccaagcaccccgagaagcucgccaccguccucuccggcgccugcgacggcgagguccgcaucuggaaccucacccagcgcaacugcauccgcaccauccaggcccacgagggcuucguccgcggcaucugcacccgcuucugcggcaccuccuucuucaccgucggcgacgacaagaccgucaagcaguggaagauggacggccccggcuacggcgacgaggaggagccccuccacaccauccucggcaagaccgucuacaccggcaucgaccaccacuggaaggaggccgucuucgccaccugcggccagcaggucgacaucugggacgagcagcgcaccaaccccaucugcuccaugaccuggggcuucgacuccaucuccuccgucaaguucaaccccaucgagaccuuccuccucggcuccugcgccuccgaccgcaacaucguccucuacgacaugcgccaggccaccccccucaagaaggucauccucgacaugcgcaccaacaccaucugcuggaaccccauggaggccuucaucuucaccgccgccaacgaggacuacaaccucuacaccuucgacaugcgcgcccucgacacccccgucaugguccacauggaccacgucuccgccguccucgacgucgacuacucccccaccggcaaggaguucgucuccgccuccuucgacaaguccauccgcaucuuccccgucgacaagucccgcucccgcgaggucuaccacaccaagcgcaugcagcacgucaucugcgucaaguggaccuccgacuccaaguacaucaugugcggcuccgacgagaugaacauccgccucuggaaggccaacgccuccgagaagcucggcguccucaccucccgcgagaaggccgccaaggacuacaaccagaagcucaaggagaaguuccagcacuacccccacaucaagcgcaucgcccgccaccgccaccuccccaaguccaucuacucccagauccaggagcagcgcaucaugaaggaggcccgccgccgcaaggaggucaaccgcaucaagcacuccaagcccggcuccgucccccucgucuccgagaagaagaagcacgucgucgccgucgucaaguga

SEQ ID NO: 42067 - RNA, 1362 nt, Artificial Sequence
  derived and/or modified sequence opt2 from DCAF17__Homo_sapiens__NP_001158293
augggccccacccgcaagcccaacgucugcucccgccucucccgccgcgcccucggcugcuucucccgcgacgccggcgucguccagcgcaccaaccucggcauccuccgcgcccucgucugccaggaguccaccaaguucaagaacgucuggaccacccacucccgcucccccaucgccuacgagcgcggccgcaucuacuucgacaacuaccgccgcugcgucuccuccgucgccuccgagccccgcaagcucuacgagaugcccaagugcuccaaguccgagaagaucgaggacgcccuccucugggagugccccgucggcgacauccuccccaacuccuccgacuacaaguccucccucaucgcccucaccgcccacaacuggcuccuccgcaucuccgccaccaccggcaagauccucgagaagaucuaccucgcccccuacugcaaguuccgcuaccucuccugggacaccccccaggaggucaucgccgucaaguccgcccagaaccgcggcuccgccgucgcccgccaggccggcauccagcagcacguccuccucuaccucgccgucuuccgcguccuccccuucucccucgucggcauccucgagaucaacaagaagaucuucggcaacgucaccgacgccacccucucccacggcauccucaucgucauguacuccuccggccucguccgccucuacuccuuccagaccaucgccgagcaguucaugcagcagaagcucgaccucggcugcgccugccgcuggggcggcaccaccggcaccgucggcgaggcccccuucggcauccccugcaacaucaagaucaccgacaugcccccccuccucuucgaggucuccucccucgagaacgccuuccagaucggcggccaccccuggcacuacaucgucacccccaacaagaagaagcagaagggcgucuuccacaucugcgcccucaaggacaacucccucaacgagaacguccucaccgucaccgccuccggccgcgucgucaagaaguccuucaaccuccucgacgacgaccccgagcaggagaccuucaagaucgucgacuacgaggacgagcucgaccuccucuccgucgucgccgucacccagaucgacgccgagggcaaggcccaccucgacuuccacugcaacgaguacggcacccuccucaaguccaucccccucgucgaguccugggacgucaccuacucccacgaggucuacuucgaccgcgaccucguccuccacaucgagcagaagcccaaccgcgucuucuccugcuacgucuaccagaugaucugcgacaccggcgaggaggaggagaccaucaaccgcuccugcuga

SEQ ID NO: 42068 - RNA, 1470 nt, Artificial Sequence
  derived and/or modified sequence opt2 from DCAF4__Homo_sapiens__NP_001156980
augaacaagucccgcuggcagucccgccgccgccacggccgccgcucccaccagcagaaccccugguuccgccuccgcgacuccgaggaccgcuccgacucccgcgccgcccagcccgcccacgacuccggccacggcgacgacgagucccccuccaccuccuccggcaccgccggcaccuccuccguccccgagcuccccggcuucuacuucgaccccgagaagaagcgcuacuuccgccuccuccccggccacaacaacugcaacccccucaccaaggaguccauccgccagaaggagauggaguccaagcgccuccgccuccuccaggaggaggaccgccgcaagaagaucgcccgcaugggcuucaacgccuccuccaugcuccgcaagucccagcucggcuuccucaacgucaccaacuacugccaccucgcccacgagcuccgccucuccugcauggagcgcaagaagguccagauccgcuccauggaccccuccgcccucgccuccgaccgcuucaaccucauccucgccgacaccaacuccgaccgccucuucaccgucaacgacgucaaggucggcggcuccaaguacggcaucaucaaccuccagucccucaagacccccacccucaaggucuucaugcacgagaaccucuacuucaccaaccgcaaggucaacuccgucugcugggccucccucaaccaccucgacucccacauccuccucugccucaugggccucgccgagacccccggcugcgccacccuccuccccgccucccucuucgucaacucccaccccgccggcaucgaccgccccggcaugcucugcuccuuccgcauccccggcgccugguccugcgccuggucccucaacauccaggccaacaacugcuucuccaccggccucucccgccgcguccuccucaccaacgucgucaccggccaccgccaguccuucggcaccaacuccgacguccucgccccccuccucuucaacggcugccgcuccggcgagaucuucgccaucgaccuccgcugcggcaaccagggcaagggcuggaaggccacccgccucuuccacgacuccgccgucaccuccguccgcauccuccaggacgagcaguaccucauggccuccgacauggccggcaagaucaagcucugggaccuccgcaccaccaagugcguccgccaguacgagggccacgucaacgaguacgccuaccucccccuccacguccacgaggaggagggcauccucgucgccgucggccaggacugcuacacccgcaucuggucccuccacgacgcccgccuccuccgcaccauccccucccccuaccccgccuccaaggccgacauccccuccgucgccuucuccucccgccucggcggcucccgcggcgcccccggccuccucauggccgucggccaggaccucuacugcuacuccuacuccuga

SEQ ID NO: 42069 - RNA, 2583 nt, Artificial Sequence
  derived and/or modified sequence opt2 from DCAF5__Homo_sapiens__NP_001271136
auggagcaggccauccacucccgcgucaagcccauccagcucaagggcgagcaccacuccaacaucuucugccucgccuucaacuccggcaacaccaaggucuucuccggcggcaacgacgagcaggucauccuccacgacgucgaguccuccgagacccucgacgucuucgcccacgaggacgccgucuacggccucuccgucucccccgucaacgacaacaucuucgccuccuccuccgacgacggccgcguccucaucugggacauccgcgaguccccccacggcgagcccuucugccucgccaacuaccccuccgccuuccacuccgucauguucaaccccgucgagccccgccuccucgccaccgccaacuccaaggagggcgucggccucugggacauccgcaagccccaguccucccuccuccgcuacggcggcaaccucucccuccaguccgccauguccguccgcuucaacuccaacggcacccagcuccucgcccuccgccgccgccucccccccguccucuacgacauccacucccgccuccccgucuuccaguucgacaaccagggcuacuucaacuccugcaccaugaaguccugcugcuucgccggcgaccgcgaccaguacauccucuccggcuccgacgacuucaaccucuacauguggcgcauccccgccgaccccgaggccggcggcaucggccgcgucgucaacggcgccuucaugguccucaagggccaccgcuccaucgucaaccagguccgcuucaacccccacaccuacaugaucugcuccuccggcgucgagaagaucaucaagaucuggucccccuacaagcagcccggcugcaccggcgaccucgacggccgcaucgaggacgacucccgcugccucuacacccacgaggaguacaucucccucguccucaacuccggcuccggccucucccacgacuacgccaaccaguccguccaggaggacccccgcaugauggccuucuucgacucccucguccgccgcgagaucgagggcugguccuccgacuccgacuccgaccucuccgaguccaccauccuccagcuccacgccggcgucuccgagcgcuccggcuacaccgacuccgaguccuccgccucccucccccgcucccccccccccaccgucgacgaguccgccgacaacgccuuccaccucggcccccuccgcgucaccaccaccaacaccgucgccuccaccccccccacccccaccugcgaggacgccgccucccgccagcagcgccucuccgcccuccgccgcuaccaggacaagcgccuccucgcccucuccaacgaguccgacuccgaggagaacgucugcgaggucgagcucgacaccgaccucuucccccgcccccgcucccccucccccgaggacgaguccuccuccuccuccuccuccuccuccuccgaggacgaggaggagcucaacgagcgccgcgccuccaccuggcagcgcaacgccaugcgccgccgccagaagaccacccgcgaggacaagcccuccgcccccaucaagcccaccaacaccuacaucggcgaggacaacuacgacuacccccagaucaaggucgacgaccucuccuccucccccaccuccucccccgagcgcuccaccuccacccucgagauccagcccucccgcgccucccccaccuccgacaucgaguccgucgagcgcaagaucuacaaggccuacaaguggcuccgcuacuccuacaucuccuacuccaacaacaaggacggcgagaccucccucgucaccggcgaggccgacgagggccgcgccggcaccucccacaaggacaaccccgcccccuccuccuccaaggaggccugccucaacaucgccauggcccagcgcaaccaggaccucccccccgagggcugcuccaaggacaccuucaaggaggagaccccccgcacccccuccaacggccccggccacgagcacuccucccacgccugggccgagguccccgagggcaccucccaggacaccggcaacuccggcuccgucgagcaccccuucgagaccaagaagcucaacggcaaggcccucuccucccgcgccgaggagccccccuccccccccguccccaaggccuccggcuccacccucaacuccggcuccggcaacugcccccgcacccaguccgacgacuccgaggagcgcucccucgagaccaucugcgccaaccacaacaacggccgccuccacccccgccccccccacccccacaacaacggccagaaccucggcgagcucgaggucgucgccuacuccucccccggccacuccgacaccgaccgcgacaacuccucccucaccggcacccuccuccacaaggacugcugcggcuccgagauggccugcgagacccccaacgccggcacccgcgaggaccccaccgacacccccgccaccgacuccucccgcgccguccacggccacuccggccucaagcgccagcgcaucgagcucgaggacaccgacuccgagaacuccuccuccgagaagaagcucaagaccuga

SEQ ID NO: 42070 - RNA, 2583 nt, Artificial Sequence
  derived and/or modified sequence opt2 from DCAF6__Homo_sapiens__NP_001017977
augucccgcggcggcuccuacccccaccuccucugggacguccgcaagcgcucccucggccucgaggaccccucccgccuccgcucccgcuaccucggccgccgcgaguucauccagcgccucaagcucgaggccacccucaacguccacgacggcugcgucaacaccaucugcuggaacgacaccggcgaguacauccucuccggcuccgacgacaccaagcucgucaucuccaaccccuacucccgcaagguccucaccaccauccgcuccggccaccgcgccaacaucuucuccgccaaguuccuccccugcaccaacgacaagcagaucgucuccugcuccggcgacggcgucaucuucuacaccaacgucgagcaggacgccgagaccaaccgccagugccaguucaccugccacuacggcaccaccuacgagaucaugaccguccccaacgaccccuacaccuuccucuccugcggcgaggacggcaccguccgcugguucgacacccgcaucaagaccuccugcaccaaggaggacugcaaggacgacauccucaucaacugccgccgcgccgccaccuccgucgccaucugcccccccauccccuacuaccucgccgucggcugcuccgacuccuccguccgcaucuacgaccgccgcaugcucggcacccgcgccaccggcaacuacgccggccgcggcaccaccggcauggucgcccgcuucauccccucccaccucaacaacaaguccugccgcgucaccucccucugcuacuccgaggacggccaggagauccucgucuccuacuccuccgacuacaucuaccucuucgaccccaaggacgacaccgcccgcgagcucaagacccccuccgccgaggagcgccgcgaggagcuccgccagccccccgucaagcgccuccgccuccgcggcgacugguccgacaccggcccccgcgcccgccccgaguccgagcgcgagcgcgacggcgagcagucccccaacgucucccucaugcagcgcauguccgacaugcucucccgcugguucgaggaggccuccgaggucgcccaguccaaccgcggccgcggccgcucccgcccccgcggcggcaccucccaguccgacaucuccacccuccccaccguccccuccucccccgaccucgaggucuccgagaccgccauggaggucgacacccccgccgagcaguuccuccagcccuccaccuccuccaccauguccgcccaggcccacuccaccuccucccccaccgaguccccccacuccaccccccuccucuccucccccgacuccgagcagcgccaguccgucgaggccuccggccaccacacccaccaccaguccgacaacaacaacgagaagcucucccccaagcccggcaccggcgagcccguccucucccuccacuacuccaccgagggcaccaccaccuccaccaucaagcucaacuucaccgacgagugguccuccaucgccuccuccucccgcggcaucggcucccacugcaaguccgagggccaggaggaguccuucgucccccaguccuccguccagccccccgagggcgacuccgagaccaaggcccccgaggaguccuccgaggacgucaccaaguaccaggagggcgucuccgccgagaaccccgucgagaaccacaucaacaucacccaguccgacaaguucaccgccaagccccucgacuccaacuccggcgagcgcaacgaccucaaccucgaccgcuccugcggcguccccgaggaguccgccuccuccgagaaggccaaggagcccgagaccuccgaccagaccuccaccgaguccgccaccaacgagaacaacaccaaccccgagccccaguuccagaccgaggccaccggccccuccgcccacgaggagaccuccacccgcgacuccgcccuccaggacaccgacgacuccgacgacgaccccguccucauccccggcgcccgcuaccgcgccggccccggcgaccgccgcuccgccgucgcccgcauccaggaguucuuccgccgccgcaaggagcgcaaggagauggaggagcucgacacccucaacauccgccgcccccucgucaagauggucuacaagggccaccgcaacucccgcaccaugaucaaggaggccaacuucuggggcgccaacuucgucauguccggcuccgacugcggccacaucuucaucugggaccgccacaccgccgagcaccucaugcuccucgaggccgacaaccacgucgucaacugccuccagccccaccccuucgaccccauccucgccuccuccggcaucgacuacgacaucaagaucugguccccccucgaggagucccgcaucuucaaccgcaagcucgccgacgaggucaucacccgcaacgagcucaugcucgaggagacccgcaacaccaucaccguccccgccuccuucaugcuccgcaugcucgccucccucaaccacauccgcgccgaccgccucgagggcgaccgcuccgagggcuccggccaggagaacgagaacgaggacgaggaguga

SEQ ID NO: 42071 - RNA, 1029 nt, Artificial Sequence
  derived and/or modified sequence opt2 from DCAF7__Homo_sapiens__NP_005819
augucccuccacggcaagcgcaaggagaucuacaaguacgaggcccccuggaccgucuacgccaugaacugguccguccgccccgacaagcgcuuccgccucgcccucggcuccuucgucgaggaguacaacaacaagguccagcucgucggccucgacgaggaguccuccgaguucaucugccgcaacaccuucgaccaccccuaccccaccaccaagcucauguggauccccgacaccaagggcgucuaccccgaccuccucgccaccuccggcgacuaccuccgcgucuggcgcgucggcgagaccgagacccgccucgagugccuccucaacaacaacaagaacuccgacuucugcgccccccucaccuccuucgacuggaacgaggucgaccccuaccuccucggcaccuccuccaucgacaccaccugcaccaucuggggccucgagaccggccagguccucggccgcgucaaccucgucuccggccacgucaagacccagcucaucgcccacgacaaggaggucuacgacaucgccuucucccgcgccggcggcggccgcgacauguucgccuccgucggcgccgacggcuccguccgcauguucgaccuccgccaccucgagcacuccaccaucaucuacgaggacccccagcaccacccccuccuccgccucugcuggaacaagcaggaccccaacuaccucgccaccauggccauggacggcauggaggucgucauccucgacguccgcguccccugcacccccgucgcccgccucaacaaccaccgcgccugcgucaacggcaucgccugggccccccacuccuccugccacaucugcaccgccgccgacgaccaccaggcccucaucugggacauccagcagaugccccgcgccaucgaggaccccauccucgccuacaccgccgagggcgagaucaacaacguccagugggccuccacccagcccgacuggaucgccaucugcuacaacaacugccucgagauccuccgcgucuga

SEQ ID NO: 42072 - RNA, 1794 nt, Artificial Sequence
  derived and/or modified sequence opt2 from DCAF8__Homo_sapiens__NP_056541
auguccuccaagggcuccuccaccgacggccgcaccgaccucgccaacggcucccucuccuccucccccgaggagauguccggcgccgaggagggccgcgagaccuccuccggcaucgaggucgaggccuccgaccucucccucucccucaccggcgacgacggcggccccaaccgcaccuccaccgagucccgcggcaccgacaccgaguccuccggcgaggacaaggacuccgacuccauggaggacaccggccacuacuccaucaacgacgagaaccgcguccacgaccgcuccgaggaggaggaggaggaggaggaggaggaggaggaggagcagccccgccgccgcguccagcgcaagcgcgccaaccgcgaccaggacuccuccgacgacgagcgcgcccucgaggacugggucuccuccgagaccuccgcccucccccgcccccgcuggcaggcccuccccgcccuccgcgagcgcgagcucggcuccuccgcccgcuucgucuacgaggccugcggcgcccgcgucuucguccagcgcuuccgccuccagcacggccucgagggccacaccggcugcgucaacacccuccacuucaaccagcgcggcaccuggcucgccuccggcuccgacgaccucaaggucgucgucugggacuggguccgccgccagcccguccucgacuucgaguccggccacaaguccaacgucuuccaggccaaguuccuccccaacuccggcgacuccacccucgccaugugcgcccgcgacggccagguccgcgucgccgagcucuccgccacccagugcugcaagaacaccaagcgcgucgcccagcacaagggcgccucccacaagcucgcccucgagcccgacucccccugcaccuuccucuccgccggcgaggacgccgucgucuucaccaucgaccuccgccaggaccgccccgccuccaagcucgucgucaccaaggagaaggagaagaaggucggccucuacaccaucuacgucaaccccgccaacacccaccaguucgccgucggcggccgcgaccaguucguccgcaucuacgaccagcgcaagaucgacgagaacgagaacaacggcguccucaagaaguucugcccccaccaccucgucaacuccgaguccaaggccaacaucaccugccucgucuacucccacgacggcaccgagcuccucgccuccuacaacgacgaggacaucuaccucuucaacuccucccacuccgacggcgcccaguacgucaagcgcuacaagggccaccgcaacaacgccaccgucaagggcgucaacuucuacggccccaaguccgaguucgucgucuccggcuccgacugcggccacaucuuccucugggagaaguccuccugccagaucauccaguucauggagggcgacaagggcggcgucgucaacugccucgagccccacccccaccuccccguccucgccaccuccggccucgaccacgacgucaagaucugggcccccaccgccgaggccuccaccgagcucaccggccucaaggacgucaucaagaagaacaagcgcgagcgcgacgaggacucccuccaccagaccgaccucuucgacucccacaugcucugguuccucaugcaccaccuccgccagcgccgccaccaccgccgcuggcgcgagcccggcgucggcgccaccgacgccgacuccgacgagucccccuccuccuccgacaccuccgacgaggaggagggccccgaccgcguccagugcaugcccuccuga

SEQ ID NO: 42073 - RNA, 735 nt, Artificial Sequence
  derived and/or modified sequence opt2 from DCANP1__Homo_sapiens__NP_570900
augcacuacggcgccgccacccacauccagaacucccgcucccacggccucgagaccguccccggccaccagcgccucgagcgcggcgccggcggcgagacccccgaguuccccggcugccacucccccgccccccccgagaacuucggcaacgagcuccucccccucuccgccccccuccagggccucuccgagggccucuacccccccggccgcaacaagacccuccccgccggcguccuccgcgagggcgccguccaguuccuccaccgcggccucugcaacuccaaccucuccuccgaggccuccgcccgccccuccggcacccaggacgagcuccacuccucccgccgcaagaccggccagacccgccgcgagggcgcccgcaagcaccucgucugcuccuuccgccucuaccccuucaccguccacaccgucucccccggcaacucccaccucgcccucuaccaggucuucaaggccgucaagcucugccccuccgagaccuccuucuuccucucccgcaagucccucaaguccuccgaccccuggcacccccccucccucucccccaacuccuggaaccgccaggccggcuuccgcgccugguccucccaccucaucucccucucccucaccugcuccgacucccagucccgccgcgucuccuccucccagcagcccccccuccacucccucuccucccaccgccgcgccgcccacguccccgaguga

SEQ ID NO: 42074 - RNA, 1620 nt, Artificial Sequence
  derived and/or modified sequence opt2 from DCBLD1__Homo_sapiens__NP_775945
augguccccggcgcccgcggcggcggcgcccucgcccgcgccgccggccgcggccuccucgcccuccuccucgccgucuccgccccccuccgccuccaggccgaggagcucggcgacggcugcggccaccucgucaccuaccaggacuccggcaccaugaccuccaagaacuaccccggcaccuaccccaaccacaccgucugcgagaagaccaucaccguccccaagggcaagcgccucauccuccgccucggcgaccucgacaucgagucccagaccugcgccuccgacuaccuccucuucaccuccuccuccgaccaguacggccccuacugcggcuccaugaccguccccaaggagcuccuccucaacaccuccgaggucaccguccgcuucgaguccggcucccacaucuccggccgcggcuuccuccucaccuacgccuccuccgaccaccccgaccucaucaccugccucgagcgcgccucccacuaccucaagaccgaguacuccaaguucugccccgccggcugccgcgacgucgccggcgacaucuccggcaacauggucgacggcuaccgcgacaccucccuccucugcaaggccgccauccacgccggcaucaucgccgacgagcucggcggccagaucuccguccuccagcgcaagggcaucucccgcuacgagggcauccucgccaacggcguccucucccgcgacggcucccucuccgacaagcgcuuccucuucaccuccaacggcugcucccgcucccucuccuucgagcccgacggccagauccgcgccuccuccuccuggcaguccgucaacgaguccggcgaccagguccacuggucccccggccaggcccgccuccaggaccagggccccuccugggccuccggcgacuccuccaacaaccacaagccccgcgaguggcucgagaucgaccucggcgagaagaagaagaucaccggcauccgcaccaccggcuccacccaguccaacuucaacuucuacgucaaguccuucgucaugaacuucaagaacaacaacuccaaguggaagaccuacaagggcaucgucaacaacgaggagaaggucuuccagggcaacuccaacuuccgcgaccccguccagaacaacuucaucccccccaucgucgcccgcuacguccgcgucgucccccagaccuggcaccagcgcaucgcccucaaggucgagcucaucggcugccagaucacccagggcaacgacucccucgucuggcgcaagaccucccaguccaccuccgucuccaccaagaaggaggacgagaccaucacccgccccauccccuccgaggagaccuccaccggcaucaacaucaccaccgucgccaucccccucguccuccucgucguccucgucuucgccggcaugggcaucuucgccgccuuccgcaagaagaagaagaagggcucccccuacggcuccgccgaggcccagaagaccgacugcuggaagcagaucaaguaccccuucgcccgccaccaguccgccgaguucaccaucuccuacgacaacgagaaggagaugacccagaagcucgaccucaucaccuccgacauggccggcuga

SEQ ID NO: 42075 - RNA, 2328 nt, Artificial Sequence
  derived and/or modified sequence opt2 from DCBLD2__Homo_sapiens__NP_563615
auggccucccgcgccgucguccgcgcccgccgcugcccccagugcccccagguccgcgccgccgccgccgcccccgccugggccgcccucccccucucccgcucccucccccccugcuccaacuccuccuccuucuccaugccccucuuccuccuccuccuccucguccuccuccuccuccucgaggacgccggcgcccagcagggcgacggcugcggccacaccguccucggccccgaguccggcacccucaccuccaucaacuacccccagaccuaccccaacuccaccgucugcgagugggagauccgcgucaagaugggcgagcgcguccgcaucaaguucggcgacuucgacaucgaggacuccgacuccugccacuucaacuaccuccgcaucuacaacggcaucggcgucucccgcaccgagaucggcaaguacugcggccucggccuccagaugaaccacuccaucgaguccaagggcaacgagaucacccuccucuucauguccggcauccacgucuccggccgcggcuuccucgccuccuacuccgucaucgacaagcaggaccucaucaccugccucgacaccgccuccaacuuccucgagcccgaguucuccaaguacugccccgccggcugccuccuccccuucgccgagaucuccggcaccaucccccacggcuaccgcgacuccuccccccucugcauggccggcguccacgccggcgucgucuccaacacccucggcggccagaucuccgucgucaucuccaagggcauccccuacuacgaguccucccucgccaacaacgucaccuccgucgucggccaccucuccaccucccucuucaccuucaagaccuccggcugcuacggcacccucggcauggaguccggcgucaucgccgacccccagaucaccgccuccuccguccucgaguggaccgaccacaccggccaggagaacuccuggaagcccaagaaggcccgccucaagaagcccggcccccccugggccgccuucgccaccgacgaguaccaguggcuccagaucgaccucaacaaggagaagaagaucaccggcaucaucaccaccggcuccaccauggucgagcacaacuacuacgucuccgccuaccgcauccucuacuccgacgacggccagaaguggaccgucuaccgcgagcccggcgucgagcaggacaagaucuuccagggcaacaaggacuaccaccaggacguccgcaacaacuuccucccccccaucaucgcccgcuucauccgcgucaaccccacccaguggcagcagaagaucgccaugaagauggagcuccucggcugccaguucauccccaagggccgcccccccaagcucacccagcccccccccccccgcaacuccaacgaccucaagaacaccaccgccccccccaagaucgccaagggccgcgcccccaaguucacccagccccuccagccccgcuccuccaacgaguuccccgcccagaccgagcagaccaccgccucccccgacauccgcaacaccaccgucacccccaacgucaccaaggacgucgcccucgccgccguccucguccccguccucgucaugguccucaccacccucauccucauccucgucugcgccuggcacuggcgcaaccgcaagaagaagaccgagggcaccuacgaccuccccuacugggaccgcgccggcugguggaagggcaugaagcaguuccuccccgccaaggccgucgaccacgaggagacccccguccgcuacuccuccuccgaggucaaccaccucuccccccgcgaggucaccaccguccuccaggccgacuccgccgaguacgcccagccccucgucggcggcaucgucggcacccuccaccagcgcuccaccuucaagcccgaggagggcaaggaggccggcuacgccgaccucgaccccuacaacucccccggccaggaggucuaccacgccuacgccgagccccuccccaucaccggccccgaguacgccacccccaucaucauggacauguccggccaccccaccaccuccgucggccagcccuccaccuccaccuucaaggccaccggcaaccagccccccccccucgucggcaccuacaacacccuccucucccgcaccgacuccugcuccuccgcccaggcccaguacgacacccccaaggccggcaagcccggccuccccgcccccgacgagcucgucuaccaggucccccaguccacccaggaggucuccggcgccggccgcgacggcgagugcgacgucuucaaggagauccucuga

SEQ ID NO: 42076 - RNA, 4344 nt, Artificial Sequence
  derived and/or modified sequence opt2 from DCC__Homo_sapiens__NP_005206
auggagaacucccuccgcugcgucuggguccccaagcucgccuucguccucuucggcgccucccucuucuccgcccaccuccaggucaccggcuuccagaucaaggccuucaccgcccuccgcuuccucuccgagcccuccgacgccgucaccaugcgcggcggcaacguccuccucgacugcuccgccgaguccgaccgcggcguccccgucaucaaguggaagaaggacggcauccaccucgcccucggcauggacgagcgcaagcagcagcucuccaacggcucccuccucauccagaacauccuccacucccgccaccacaagcccgacgagggccucuaccagugcgaggccucccucggcgacuccggcuccaucaucucccgcaccgccaaggucgccgucgccggcccccuccgcuuccucucccagaccgaguccgucaccgccuucaugggcgacaccguccuccucaagugcgaggucaucggcgagcccaugcccaccauccacuggcagaagaaccagcaggaccucacccccauccccggcgacucccgcgucgucguccuccccuccggcgcccuccagaucucccgccuccagcccggcgacaucggcaucuaccgcugcuccgcccgcaaccccgccuccucccgcaccggcaacgaggccgagguccgcauccucuccgaccccggccuccaccgccagcucuacuuccuccagcgccccuccaacgucgucgccaucgagggcaaggacgccguccucgagugcugcgucuccggcuaccccccccccuccuucaccuggcuccgcggcgaggaggucauccagcuccgcuccaagaaguacucccuccucggcggcuccaaccuccucaucuccaacgucaccgacgacgacuccggcauguacaccugcgucgucaccuacaagaacgagaacaucuccgccuccgccgagcucaccguccucgucccccccugguuccucaaccaccccuccaaccucuacgccuacgaguccauggacaucgaguucgagugcaccgucuccggcaagcccguccccaccgucaacuggaugaagaacggcgacgucgucauccccuccgacuacuuccagaucgucggcggcuccaaccuccgcauccucggcgucgucaaguccgacgagggcuucuaccagugcgucgccgagaacgaggccggcaacgcccagaccuccgcccagcucaucguccccaagcccgccauccccuccuccuccguccuccccuccgccccccgcgacgucguccccguccucgucuccucccgcuucguccgccucuccuggcgcccccccgccgaggccaagggcaacauccagaccuucaccgucuucuucucccgcgagggcgacaaccgcgagcgcgcccucaacaccacccagcccggcucccuccagcucaccgucggcaaccucaagcccgaggccauguacaccuuccgcgucgucgccuacaacgaguggggccccggcgaguccucccagcccaucaaggucgccacccagcccgagcuccagguccccggccccgucgagaaccuccaggccgucuccaccucccccaccuccauccucaucaccugggagccccccgccuacgccaacggccccguccagggcuaccgccucuucugcaccgaggucuccaccggcaaggagcagaacaucgaggucgacggccucuccuacaagcucgagggccucaagaaguucaccgaguacucccuccgcuuccucgccuacaaccgcuacggccccggcgucuccaccgacgacaucaccgucgucacccucuccgacguccccuccgcccccccccagaacgucucccucgaggucgucaacucccgcuccaucaaggucuccuggcuccccccccccuccggcacccagaacggcuucaucaccggcuacaagauccgccaccgcaagaccacccgccgcggcgagauggagacccucgagcccaacaaccucugguaccucuucaccggccucgagaagggcucccaguacuccuuccaggucuccgccaugaccgucaacggcaccggcccccccuccaacugguacaccgccgagacccccgagaacgaccucgacgagucccagguccccgaccagcccuccucccuccacguccgcccccagaccaacugcaucaucauguccuggacccccccccucaaccccaacaucgucguccgcggcuacaucaucggcuacggcgucggcucccccuacgccgagaccguccgcgucgacuccaagcagcgcuacuacuccaucgagcgccucgaguccuccucccacuacgucaucucccucaaggccuucaacaacgccggcgagggcgucccccucuacgaguccgccaccacccgcuccaucaccgaccccaccgaccccgucgacuacuacccccuccucgacgacuuccccaccuccguccccgaccucuccacccccaugcucccccccgucggcguccaggccgucgcccucacccacgacgccguccgcgucuccugggccgacaacuccguccccaagaaccagaagaccuccgagguccgccucuacaccguccgcuggcgcaccuccuucuccgccuccgccaaguacaaguccgaggacaccaccucccucuccuacaccgccaccggccucaagcccaacaccauguacgaguucuccgucauggucaccaagaaccgccgcuccuccaccugguccaugaccgcccacgccaccaccuacgaggccgcccccaccuccgcccccaaggaccucaccgucaucacccgcgagggcaagccccgcgccgucaucgucuccuggcagcccccccucgaggccaacggcaagaucaccgccuacauccucuucuacacccucgacaagaacauccccaucgacgacuggaucauggagaccaucuccggcgaccgccucacccaccagaucauggaccucaaccucgacaccauguacuacuuccgcauccaggcccgcaacuccaagggcgucggcccccucuccgaccccauccucuuccgcacccucaaggucgagcaccccgacaagauggccaacgaccagggccgccacggcgacggcggcuacuggcccgucgacaccaaccucaucgaccgcuccacccucaacgagccccccaucggccagaugcaccccccccacggcuccgucaccccccagaagaacuccaaccuccucgucaucaucgucgucaccgucggcgucaucaccguccucgucgucgucaucgucgccgucaucugcacccgccgcuccuccgcccagcagcgcaagaagcgcgccacccacuccgccggcaagcgcaagggcucccagaaggaccuccgcccccccgaccucuggauccaccacgaggagauggagaugaagaacaucgagaagcccuccggcaccgaccccgccggccgcgacucccccauccaguccugccaggaccucacccccgucucccacucccaguccgagacccagcucggcuccaaguccaccucccacuccggccaggacaccgaggaggccggcuccuccauguccacccucgagcgcucccucgccgcccgccgcgccccccgcgccaagcucaugauccccauggacgcccaguccaacaaccccgccgucgucuccgccauccccguccccacccucgaguccgcccaguaccccggcauccuccccucccccaccugcggcuacccccacccccaguucacccuccgccccguccccuuccccacccucuccgucgaccgcggcuucggcgccggccgcucccaguccgucuccgagggccccaccacccagcagccccccaugcucccccccucccagcccgagcacuccuccuccgaggaggcccccucccgcaccauccccaccgccugcguccgccccacccacccccuccgcuccuucgccaacccccuccuccccccccccauguccgccaucgagcccaagguccccuacaccccccuccucucccagcccggccccacccuccccaagacccacgucaagaccgccucccucggccucgccggcaaggcccgcuccccccuccuccccgucuccguccccaccgcccccgaggucuccgaggagucccacaagcccaccgaggacuccgccaacgucuacgagcaggacgaccucuccgagcagauggccucccucgagggccucaugaagcagcucaacgccaucaccggcuccgccuucuga

SEQ ID NO: 42077 - RNA, 1095 nt, Artificial Sequence
  derived and/or modified sequence opt2 from DCDC2C__Homo_sapiens__NP_001274373
augggcacccgcggccccuccgcccccgucgacaccacccccgccaagaccaucgucgucuaccgcaacggcgaccccuucuacgucggcaagaaguucguccucucccgccgccgcgccgccaccuucgaggcccuccucgagcagcucaccgagcaggucgacguccccuucggcguccgccgccucuucacccccacccgcggccaccgcguccucggccucgacgcccuccaggccggcggcaaguacgucgccgccggccgcgagcgcuucaaggagcucgacuacauccacaucgucccccgcaagcccgccaagauccgcaagcucaaggagaucaagcccgucguccacugcgacaucaacguccccuccaaguggcagaccuaccaccgcaucucccgccacaucaacgucuucaccaacggccgccucuucaucccccccgccaagaucaucauccccaaguucucccucuccgacugggacaucguccucgccaccaucggcgagaaggucuucccccucggcggcguccgcaagcucuucaccaugaacggccaccuccucggcgacuccaaggaccuccaggacaaccacuucuacgucgccgucggccucgagaccuucaaguacuuccccuacuggaaguccccccgcguccccuccgagguccagcagcgcuacgccaacgucgagaagaacucccagcgcaagaagaaggucgacuccaagggcaaggagcccugcaaguacgacggcaucccccccaagacccaggacuccgucuacuacgccaaggaggagaagaagaagacccucgccgagccccucguccagcgcggcgccgagggcgacgucuacaaggcccccacccccuccaaggagacccagggcgcccucgacgucaaggaggagcacaacguccagcucgagguccccgucgaccagcgccaggccgagaucgucaaggaggacgaggagauccacgagaacacccccgacuucgagggcaacaaggacaaggaggacgcccgccucugcgaggacgucgagcgcaagauggcccgcgaguggaagcccgucgacuga

SEQ ID NO: 42078 - RNA, 1431 nt, Artificial Sequence
  derived and/or modified sequence opt2 from DCDC2__Homo_sapiens__NP_057440
auguccggcuccuccgcccgcuccucccaccucucccagcccgucgucaaguccguccucgucuaccgcaacggcgaccccuucuacgccggccgccgcgucgucauccacgagaagaaggucuccuccuucgaggucuuccucaaggaggucaccggcggcguccaggcccccuucggcgccguccgcaacaucuacaccccccgcaccggccaccgcauccgcaagcucgaccagauccaguccggcggcaacuacgucgccggcggccaggaggccuucaagaagcucaacuaccucgacaucggcgagaucaagaagcgccccauggaggucgucaacaccgaggucaagcccgucauccacucccgcaucaacgucuccgcccgcuuccgcaagccccuccaggagcccugcaccaucuuccucaucgccaacggcgaccucaucaaccccgccucccgccuccucaucccccgcaagacccucaaccagugggaccacguccuccagauggucaccgagaagaucacccuccgcuccggcgccguccaccgccucuacacccucgagggcaagcucgucgaguccggcgccgagcucgagaacggccaguucuacgucgccgucggccgcgacaaguucaagaagcuccccuacuccgagcuccucuucgacaaguccaccaugcgccgccccuucggccagaaggccuccucccucccccccaucgucggcucccgcaaguccaagggcuccggcaacgaccgccacuccaaguccaccgucggcuccuccgacaacuccuccccccagccccucaagcgcaagggcaagaaggaggacgucaacuccgagaagcucaccaagcucaagcagaacgucaagcucaagaacucccaggagaccauccccaacuccgacgagggcaucuucaaggccggcgccgagcgcuccgagacccgcggcgccgccgagguccaggaggacgaggacacccaggucgagguccccgucgaccagcgccccgccgagaucgucgacgaggaggaggacggcgagaaggccaacaaggacgccgagcagaaggaggacuucuccggcaugaacggcgaccucgaggaggagggcggccgcgaggccaccgacgcccccgagcaggucgaggagauccucgaccacuccgagcagcaggcccgccccgcccgcgucaacggcggcaccgacgaggagaacggcgaggagcuccagcaggucaacaacgagcuccagcucguccucgacaaggagcgcaagucccagggcgccggcuccggccaggacgaggccgacgucgacccccagcgccccccccgccccgaggucaagaucaccucccccgaggagaacgagaacaaccagcagaacaaggacuacgccgccgucgccuga

SEQ ID NO: 42079 - RNA, 333 nt, Artificial Sequence
  derived and/or modified sequence opt2 from DCD__Homo_sapiens__NP_444513
augcgcuucaugacccuccucuuccucaccgcccucgccggcgcccucgucugcgccuacgaccccgaggccgccuccgcccccggcuccggcaaccccugccacgaggccuccgccgcccagaaggagaacgccggcgaggaccccggccucgcccgccaggcccccaagccccgcaagcagcgcuccucccuccucgagaagggccucgacggcgccaagaaggccgucggcggccucggcaagcucggcaaggacgccgucgaggaccucgaguccgucggcaagggcgccguccacgacgucaaggacguccucgacuccguccucuga

SEQ ID NO: 42080 - RNA, 9897 nt, Artificial Sequence
  derived and/or modified sequence opt2 from DCHS1__Homo_sapiens__NP_003728
augcagaaggagcucggcaucguccccuccugccccggcaugaaguccccccgcccccaccuccuccucccccuccuccuccuccuccuccuccuccucggcgccggcguccccggcgccuggggccaggccggcucccucgaccuccagaucgacgaggagcagcccgccggcacccucaucggcgacaucuccgccggccuccccgccggcaccgccgccccccucauguacuucaucuccgcccaggagggcuccggcgucggcaccgaccucgccaucgacgagcacuccggcgucguccgcaccgcccgcguccucgaccgcgagcagcgcgaccgcuaccgcuucaccgccgucacccccgacggcgccaccgucgaggucaccguccgcgucgccgacaucaacgaccacgcccccgccuucccccaggcccgcgccgcccuccagguccccgagcacaccgccuucggcacccgcuacccccucgagcccgcccgcgacgccgacgccggccgccucggcacccagggcuacgcccucuccggcgacggcgccggcgagaccuuccgccucgagacccgccccggccccgacggcacccccguccccgagcucgucgucaccggcgagcucgaccgcgagaaccgcucccacuacaugcuccagcucgaggccuacgacggcggcucccccccccgccgcgcccaggcccuccucgacgucacccuccucgacaucaacgaccacgcccccgccuucaaccagucccgcuaccacgccgucgucuccgagucccucgcccccggcucccccguccuccaggucuucgccuccgacgccgacgccggcgucaacggcgccgucaccuacgagaucaaccgccgccaguccgagggcgacggccccuucuccaucgacgcccacaccggccuccuccagcucgagcgcccccucgacuucgagcagcgccgcguccacgagcucgucguccaggcccgcgacggcggcgcccaccccgagcucggcuccgccuucgucaccguccacguccgcgacgccaacgacaaccagcccuccaugaccgucaucuuccucuccgccgacggcuccccccaggucuccgaggccgccccccccggccagcucgucgcccgcaucuccgucuccgaccccgacgacggcgacuucgcccacgucaacgucucccucgagggcggcgagggccacuucgcccucuccacccaggacuccgucaucuaccucgucugcgucgcccgccgccucgaccgcgaggagcgcgacgccuacaaccuccgcgucaccgccaccgacuccggcucccccccccuccgcgccgaggccgccuucguccuccacgucaccgacgucaacgacaacgcccccgccuucgaccgccagcucuaccgccccgagccccuccccgaggucgcccuccccggcuccuucgucguccgcgucaccgcccgcgaccccgaccagggcaccaacggccaggucaccuacucccucgcccccggcgcccacacccacugguucuccaucgaccccaccuccggcaucaucaccaccgccgccucccucgacuacgagcucgagccccagccccagcucaucgucgucgccaccgacggcggccuccccccccucgccuccuccgccaccgucuccgucgcccuccaggacgucaacgacaacgagccccaguuccagcgcaccuucuacaacgccucccuccccgagggcacccagcccggcaccugcuuccuccaggucaccgccaccgacgccgacuccggccccuucggccuccucuccuacucccucggcgccggccucggcuccuccggcuccccccccuuccgcaucgacgcccacuccggcgacgucugcaccacccgcacccucgaccgcgaccagggccccuccuccuucgacuucaccgucaccgccgucgacggcggcggccucaaguccauggucuacgucaaggucuuccucuccgacgagaacgacaaccccccccaguucuacccccgcgaguacgccgccuccaucuccgcccaguccccccccggcaccgccguccuccgccuccgcgcccacgaccccgaccagggcucccacggccgccucuccuaccacauccucgccggcaacucccccccccucuucacccucgacgagcaguccggccuccucaccgucgccuggccccucgcccgccgcgccaacuccgucguccagcucgagaucggcgccgaggacggcggcggccuccaggccgagcccuccgcccgcgucgacaucuccaucguccccggcacccccaccccccccaucuucgagcagcuccaguacgucuucuccguccccgaggacgucgcccccggcaccuccgucggcaucguccaggcccacaacccccccggccgccucgcccccgucacccucucccucuccggcggcgacccccgcggccucuucucccucgacgccgucuccggccuccuccagacccuccgcccccucgaccgcgagcuccucggccccguccucgagcucgagguccgcgccggcuccggcgucccccccgccuucgccgucgcccgcguccgcguccuccucgacgacgucaacgacaacucccccgccuuccccgcccccgaggacaccguccuccucccccccaacaccgcccccggcacccccaucuacacccuccgcgcccucgaccccgacuccggcgucaacucccgcgucaccuucacccuccucgccggcggcggcggcgccuucaccgucgaccccaccaccggccacguccgccucaugcgcccccucggccccuccggcggccccgcccacgagcucgagcucgaggcccgcgacggcggcucccccccccgcaccucccacuuccgccuccgcgucgucguccaggacgucggcacccgcggccucgccccccgcuucaacucccccaccuaccgcgucgaccuccccuccggcaccaccgccggcacccagguccuccagguccaggcccaggcccccgacggcggccccaucaccuaccaccucgccgccgagggcgccuccucccccuucggccucgagccccaguccggcuggcucuggguccgcgccgcccucgaccgcgaggcccaggagcucuacauccucaaggucauggccgucuccggcuccaaggccgagcucggccagcagaccggcaccgccaccguccgcgucuccauccucaaccagaacgagcacuccccccgccucuccgaggaccccaccuuccucgccgucgccgagaaccagccccccggcaccuccgucggccgcgucuucgccaccgaccgcgacuccggccccaacggccgccucaccuacucccuccagcagcucuccgaggacuccaaggccuuccgcauccacccccagaccggcgaggucaccacccuccagacccucgaccgcgagcagcaguccuccuaccagcuccucguccagguccaggacggcggcucccccccccgcuccaccaccggcaccguccacgucgccguccucgaccucaacgacaacucccccaccuuccuccaggccuccggcgccgccggcggcggccuccccauccagguccccgaccgcgucccccccggcacccucgucaccacccuccaggccaaggaccccgacgagggcgagaacggcaccauccucuacacccucaccggccccggcuccgagcucuucucccuccacccccacuccggcgagcuccucaccgccgccccccucauccgcgccgagcgcccccacuacguccucacccucuccgcccacgaccagggcucccccccccgcuccgccucccuccagcuccucguccagguccuccccuccgcccgccucgccgagcccccccccgaccucgccgagcgcgaccccgccgcccccguccccgucguccucaccgucaccgccgccgagggccuccgccccggcucccuccucggcuccgucgccgcccccgagcccgccggcgucggcgcccucaccuacacccucgucggcggcgccgaccccgagggcaccuucgcccucgacgccgccuccggccgccucuaccucgcccgcccccucgacuucgaggccggcccccccuggcgcgcccucaccguccgcgccgagggccccggcggcgccggcgcccgccuccuccgcguccagguccagguccaggacgagaacgagcacgcccccgccuucgcccgcgacccccucgcccucgcccuccccgagaaccccgagcccggcgccgcccucuacaccuuccgcgccuccgacgccgacggccccggccccaacuccgacguccgcuaccgccuccuccgccaggagccccccguccccgcccuccgccucgacgcccgcaccggcgcccucuccgccccccgcggccucgaccgcgagaccacccccgcccuccuccuccucgucgaggccaccgaccgccccgccaacgccucccgccgccgcgccgcccgcgucuccgcccgcgucuucgucaccgacgagaacgacaacgcccccgucuucgccucccccucccgcguccgccuccccgaggaccagccccccggccccgccgcccuccacgucgucgcccgcgaccccgaccucggcgaggccgcccgcgucuccuaccgccucgccuccggcggcgacggccacuuccgccuccacuccuccaccggcgcccucuccgucguccgcccccucgaccgcgagcagcgcgccgagcacguccucaccgucgucgccuccgaccacggcucccccccccgcuccgccacccagguccucaccgucuccgucgccgacgucaacgacgaggcccccaccuuccagcagcaggaguacuccguccuccuccgcgagaacaacccccccggcaccucccuccucacccuccgcgccaccgaccccgacgucggcgccaacggccaggucaccuacggcggcgucuccuccgaguccuucucccucgaccccgacaccggcguccucaccacccuccgcgcccucgaccgcgaggagcaggaggagaucaaccucaccgucuacgcccaggaccgcggcucccccccccagcucacccacgucaccguccgcgucgccgucgaggacgagaacgaccacgcccccaccuucggcuccgcccaccucucccucgagguccccgagggccaggacccccagacccucaccaugcuccgcgccuccgaccccgacgucggcgccaacggccagcuccaguaccgcauccucgacggcgaccccuccggcgccuucguccucgaccucgccuccggcgaguucggcaccaugcgcccccucgaccgcgaggucgagcccgccuuccagcuccgcaucgaggcccgcgacggcggccagcccgcccucuccgccacccuccuccucaccgucaccguccucgacgccaacgaccacgcccccgccuuccccguccccgccuacuccgucgagguccccgaggacguccccgccggcacccuccuccuccagcuccaggcccacgaccccgacgccggcgccaacggccacgucaccuacuaccucggcgccggcaccgccggcgccuuccuccucgagcccuccuccggcgagcuccgcaccgccgccgcccucgaccgcgagcagugccccuccuacaccuucuccgucuccgccgucgacggcgccgccgccggcccccucuccaccaccgucuccgucaccaucaccguccgcgacgucaacgaccacgcccccaccuuccccaccuccccccuccgccuccgccucccccgccccggccccuccuucuccacccccacccucgcccucgccacccuccgcgccgaggaccgcgacgccggcgccaacgccuccauccucuaccgccucgccggcacccccccccccggcaccaccgucgacuccuacaccggcgagauccgcgucgcccgcucccccgucgcccucggcccccgcgaccgcguccucuucaucgucgccaccgaccucggccgccccgcccgcuccgccaccggcgucaucaucgucggccuccagggcgaggccgagcgcggcccccgcuucccccgcgccuccuccgaggccaccauccgcgagaacgccccccccggcacccccaucgucuccccccgcgccguccacgccggcggcaccaacggccccaucaccuacuccauccucuccggcaacgagaagggcaccuucuccauccagcccuccaccggcgccaucaccguccgcuccgccgagggccucgacuucgaggucuccccccgccuccgccucguccuccaggccgaguccggcggcgccuucgccuucaccguccucacccucacccuccaggacgccaacgacaacgccccccgcuuccuccgcccccacuacgucgccuuccuccccgagucccgcccccucgagggcccccuccuccaggucgaggccgacgaccucgaccagggcuccggcggccagaucuccuacucccucgccgccucccagcccgcccgcggccucuuccacgucgaccccaccaccggcaccaucaccaccaccgccauccucgaccgcgagaucugggccgagacccgccucguccucauggccaccgaccgcggcucccccgcccucgucggcuccgccacccucaccgucauggucaucgacaccaacgacaaccgccccaccaucccccagcccugggagcuccgcgucuccgaggacgcccuccucggcuccgagaucgcccaggucaccggcaacgacgucgacuccggccccguccucugguacguccucucccccuccggcccccaggaccccuucuccgucggccgcuacggcggccgcgucucccucaccggcccccucgacuucgagcagugcgaccgcuaccagcuccagcuccucgcccacgacggcccccacgagggccgcgccaaccucaccguccucgucgaggacgucaacgacaacgcccccgccuucucccagucccucuaccaggucaugcuccucgagcacaccccccccggcuccgccauccucuccgucuccgccaccgaccgcgacuccggcgccaacggccacaucuccuaccaccucgccucccccgccgacggcuucuccgucgaccccaacaacggcacccucuucaccaucgucggcaccgucgcccucggccacgacggcuccggcgccgucgacgucguccucgaggcccgcgaccacggcgcccccggccgcgccgcccgcgccaccguccacguccagcuccaggaccagaacgaccacgcccccuccuucacccucucccacuaccgcgucgccgucaccgaggaccucccccccggcuccacccuccucacccucgaggccaccgacgccgacggcucccgcucccacgccgccgucgacuacuccaucaucuccggcaacuggggccgcgucuuccagcucgagccccgccucgccgaggccggcgaguccgccggccccggcccccgcgcccucggcugccucguccuccucgagccccucgacuucgagucccucacccaguacaaccucaccgucgccgccgccgaccgcggccagcccccccaguccuccgucguccccgucaccgucaccguccucgacgucaacgacaacccccccgucuucacccgcgccuccuaccgcgucaccguccccgaggacacccccgucggcgccgagcuccuccacgucgaggccuccgacgccgaccccggcccccacggccucguccgcuucaccgucuccuccggcgaccccuccggccucuucgagcucgacgaguccuccggcacccuccgccucgcccacgcccucgacugcgagacccaggcccgccaccagcucgucguccaggccgccgaccccgccggcgcccacuucgcccucgcccccgucaccaucgagguccaggacgucaacgaccacggccccgccuucccccucaaccuccucuccaccuccgucgccgagaaccagccccccggcacccucgucaccacccuccacgccaucgacggcgacgccggcgccuucggccgccuccgcuacucccuccucgaggccggccccggccccgagggccgcgaggccuucgcccucaacuccuccaccggcgagcuccgcgcccgcguccccuucgacuacgagcacaccgaguccuuccgccuccucgucggcgccgccgacgccggcaaccucuccgccuccgucaccgucuccguccucgucaccggcgaggacgaguacgaccccgucuuccucgcccccgccuuccacuuccagguccccgagggcgcccgccgcggccacucccucggccacguccaggccaccgacgaggacggcggcgccgacggccucguccucuacucccucgccaccuccucccccuacuucggcaucaaccagaccaccggcgcccucuaccuccgcgucgacucccgcgcccccggcuccggcaccgccaccuccggcggcggcggccgcacccgccgcgaggccccccgcgagcuccgccucgaggucaucgcccgcggcccccuccccggcucccgcuccgccaccguccccgucaccgucgacaucacccacaccgcccucggccucgcccccgaccucaaccuccuccucgucggcgccgucgccgccucccucggcgucgucgucguccucgcccucgccgcccucguccucggccucguccgcgcccgcucccgcaaggccgaggccgcccccggccccaugucccaggccgccccccucgccuccgacucccuccagaagcucggccgcgagccccccucccccccccccuccgagcaccucuaccaccagacccuccccuccuacggcggccccggcgccggcggccccuacccccgcggcggcucccucgaccccucccacuccuccggccgcggcuccgccgaggccgccgaggacgacgagauccgcaugaucaacgaguucccccgcgucgccuccgucgccuccucccucgccgcccgcggccccgacuccggcauccagcaggacgccgacggccucuccgacaccuccugcgagccccccgcccccgacaccugguacaagggccgcaaggccggccuccuccuccccggcgccggcgccacccucuaccgcgaggagggcccccccgccaccgccaccgccuuccucggcggcugcggccucucccccgcccccaccggcgacuacggcuuccccgccgacggcaagcccugcgucgccggcgcccucaccgccaucgucgccggcgaggaggagcuccgcggcuccuacaacugggacuaccuccucuccuggugcccccaguuccagccccucgccuccgucuucaccgagaucgcccgccucaaggacgaggcccgccccugcccccccgccccccgcaucgacccccccccccucaucaccgccgucgcccaccccggcgccaaguccgucccccccaagcccgccaacaccgccgccgcccgcgccaucuucccccccgccucccaccgcucccccaucucccacgagggcucccucuccuccgccgccaugucccccuccuucucccccucccucuccccccucgccgcccgcucccccgucgucucccccuucggcgucgcccagggccccuccgccuccgcccucuccgccgaguccggccucgagccccccgacgacaccgagcuccacaucuga

SEQ ID NO: 42081 - RNA, 4110 nt, Artificial Sequence
  derived and/or modified sequence opt2 from DCHS2__Homo_sapiens__NP_001136024
augucccccugcggccgcaagaugggcgagggccgccagcagcgccgcgcccccgucggcaagcuccuccuccuccccggccgccgcgacaccccccacggccgcuccggcuccuccggcgcccgcacccagcgcucccuccucuggcuccucguccacgucuggcucugggccgccuccggcuccuccgcccagcucuucaaccucacccucuccgucgacgagggccucccccccgacacccucgucggcgacauccgcgccggccuccccgccgcccagcagcaggagggcuccggcuucuuccucuccgaggacuccgacgacuccccccuccucgacgacuuccacguccaccccgacaccggcaucauccgcaccgcccgccgccucgaccgcgagcgccgcgaccacuacuccuucgucgccgccacccuccucggcgccgucguccaggucgagauccgcgucaacgacgucaacgaccacuccccccgcuucccccucgacucccuccagcucgacgucuccgagcucuccccccccggcaccgccuuccgccuccccgucgcccacgaccccgacgccggccucuucuccacccagggcuacacccucguccagcccuccgaccuccccaaggaccccgccggccccuucuuccagcuccgcuaccgcacccccggcccccuccccuccccccuccuccccggcuccuccuccccccucgagccccucgaccucguccuccuccgccgccucgaccgcgaggaggccgccgcccaccgccuccagaucgaggccugggacggcggccgcccccgccgcaccggccuccucuccgucgagcuccgcguccucgacgagaacgacaacccccccgucuucgagcaggacgaguaccgcgccgccguccgcgaggacgcccagcccggcgccgaggucugccgcguccgcgccaccgaccgcgaccucggccccaacggcuucguccgcuacuccguccgcgcccgccagguccccggcgccggcuccggcggcggcgcccucggcgacgccgccuacuucgccgucgaggagcucuccggcgucguccgcgucuggcgcccccucgaccgcgaggcccaggccuggcaccagcucgucgucgaggcccgcgacggcggcgccgagcccgaggucgccaccguccgcgucuccaucgccguccucgacgucaacgacaaccgccccgccauccacguccucuuccucaccgagggcggcgucgcccgcgucuccgagggcgcccgccccggcgacuacgucgcccgcgucuccgucuccgacgccgacggcgacugggagaaggaggacgaggccaccggcgagcucggcgucggccucggcgacggcuccaucucccucucccucgagggcggcgagggcgacuucgcccuccuccccggcggcccccccggcgucuucuuccucugcgucgagggcccccucgaccgcgagucccgcgaccucuacgagcuccuccucgucgccaccgacgccggcucccccccccucuccaccgaggagacccuccuccuccgcgucgccgaccucaacgaccagcccccccucuucucccagcagcacuacaaggccuccgucuccgaggccgccgcccccggcaccgucgucaugugggucuccgccuccgacgccgacgaggccggcuccgaccacgccuggcuccgcuacaccgucguccagcucuccgcccccugcaaccucggcucccuccaguccaagaugguccacaccgccgagugcggccccuccuucgccaucgacuccgaguccggcgccaucuccaccauccgcacccucgaccgcgagguccaggaggccgucgagcucaaggucgucgcccaggaccucggcgagcccccccucuccgccaccugccucgucuccaucaccgucgacgacgucaacgacaacgagcccaucuucuggcgccaggucuacaacgccaccaucgccgagcacgcccccgucggccacugcuuccuccaggucaccgccuccgacgccgacuccggccucuacggcuucaucgaguacucccucuacgacggcuuccucuccuacgaggccccccaggccuuccgcaucgacccccacgacggccagaucugcgucucccaggacaucgaccgcgagcgcgaccccgccaccuacgaccuccucgucgaggccaaggacggcggcggccucuccgcccaggccuucguccgcgucgaccucgaggacgucaacgacaaccaccccgucuucaaccccuccaccuacgucaccuccaucuccgacgagacccagcccggcaccgagaucaucaacguccucgccaccgaccaggacuccggcaucuacggcaccgucgccuacgagcucauccccggcaacgucuccucccucuucaccaucgacuccaccaccggcaucaucuaccucacccucccccucucccaccucgaguccaccacccucucccucauggucuccgcccaggacggcggcggccucaccgccgucaucaacgccgacgucaccauccacaucuuccagaccacccucgcccccgccgaguucgagcgccccaaguacaccuuccucgucuacgaggacguccccgaggacucccccaucggcaccgucaaggcccgcgagccccucaacuccuccgagcccaucuucuaccgcaucuccuccggcgaccucggcggcaaguucuccauccacccccgccucggcaccauccgcacccgcaagccccucgaccacgagacccagcccgucgucguccucaccguccaggcccagcucggcuccgcccccgccugcuccuccaccgaggucaacaucaccgucauggacgucaacgacaaccaccccgccuuccuccgcaccuccgacgagauccgcaucucccagaccaccccccccggcaccgcccucuaccucgcccgcgccgaggaccgcgacuccggccgcaacggccucauccgcuacuccaucgccuccccccagcccggcgucuucgccaucgaccgcgcccucggcguccucuuccucaacggcucccucggcgccggcgagcagcgcgagcucacccucacccuccgcgccgaggaccagggcguccacccccaggccgcccuccucguccucaccgucgucaucgagaagcgcgagcacucccccuccuggaccuucgagcaccucgucuaccaggucgaggucuccgagucccucucccccaugacccagaugcuccagacccaggcccacccccucggcccccagcgcgccgccuccccccuccgcuacucccucgagcccuccgucgacuccgccauguucggcauccgccccuacaccggcuggaucuaccuccgccgccaguucgacuacgaguccacccagaccuacaacuuccgcgucuucgccuggauccccgaggacggcuuccuccagaacgucuccaccaccgucaucguccgcgucugggacgagaacgacaacucccccaccuuccuccacgacguccucuuccucaaggucgaggagucccccgucccccagggcgucaucggcaagaucaccgccaucgacauggacuccggcaagaacggccagcuccucuacuuccuccucuccgacggcaaguucuucaagaugaaccccaacaccggcgagcucaucaacugggucgcccucgaccgcgagcaccgcggccaccacgagaugaccguccucgucaccgaccgcggcucccccccccgcaacgccaccauggccgucuacgucuccgucaccgacaucaacgacaaccgccccuucuucccccagugccuccccggcaaggagcuccacgucaagguccucgagggccagcccgucaacaugcucgucaccaccgucuucgccaaggaccccgacgagggcaacaacgccgaggucaccuacuccgucuccuccgcccgccccaugccccucaagggcaagaccgccuucggcaagcaguccugcaagaagcagaccaacaagcagaccaacaagauccucaccuga

SEQ ID NO: 42082 - RNA, 783 nt, Artificial Sequence
  derived and/or modified sequence opt2 from DCK__Homo_sapiens__NP_000779
auggccaccccccccaagcgcuccugccccuccuucuccgccuccuccgagggcacccgcaucaagaagaucuccaucgagggcaacaucgccgccggcaaguccaccuucgucaacauccucaagcagcucugcgaggacugggaggucguccccgagcccgucgcccgcuggugcaacguccaguccacccaggacgaguucgaggagcucaccaugucccagaagaacggcggcaacguccuccagaugauguacgagaagcccgagcgcugguccuucaccuuccagaccuacgccugccucucccgcauccgcgcccagcucgccucccucaacggcaagcucaaggacgccgagaagcccguccucuucuucgagcgcuccgucuacuccgaccgcuacaucuucgccuccaaccucuacgaguccgagugcaugaacgagaccgaguggaccaucuaccaggacuggcacgacuggaugaacaaccaguucggccagucccucgagcucgacggcaucaucuaccuccaggccacccccgagaccugccuccaccgcaucuaccuccgcggccgcaacgaggagcagggcaucccccucgaguaccucgagaagcuccacuacaagcacgaguccuggcuccuccaccgcacccucaagaccaacuucgacuaccuccaggagguccccauccucacccucgacgucaacgaggacuucaaggacaaguacgagucccucgucgagaaggucaaggaguuccucuccacccucuga

SEQ ID NO: 42083 - RNA, 1269 nt, Artificial Sequence
  derived and/or modified sequence opt2 from DCLK1__Homo_sapiens__NP_001182344
augcucgagcucaucgaggucaacggcacccccggcucccagcucuccaccccccgcuccggcaagucccccucccccucccccaccucccccggcucccuccgcaagcagcgcuccucccagcacggcggcuccuccaccucccucgccuccaccaaggucugcuccuccauggacgagaacgacggccccggcgaggaggucuccgaggagggcuuccagauccccgccaccaucaccgagcgcuacaaggucggccgcaccaucggcgacggcaacuucgccgucgucaaggagugcgucgagcgcuccaccgcccgcgaguacgcccucaagaucaucaagaaguccaagugccgcggcaaggagcacaugauccagaacgaggucuccauccuccgccgcgucaagcaccccaacaucguccuccucaucgaggagauggacguccccaccgagcucuaccucgucauggagcucgucaagggcggcgaccucuucgacgccaucaccuccaccaacaaguacaccgagcgcgacgccuccggcaugcucuacaaccucgccuccgccaucaaguaccuccacucccucaacaucguccaccgcgacaucaagcccgagaaccuccucgucuacgagcaccaggacggcuccaagucccucaagcucggcgacuucggccucgccaccaucgucgacggcccccucuacaccgucugcggcacccccaccuacgucgcccccgagaucaucgccgagaccggcuacggccucaaggucgacaucugggccgccggcgucaucaccuacauccuccucugcggcuucccccccuuccgcggcuccggcgacgaccaggagguccucuucgaccagauccucaugggccaggucgacuuccccucccccuacugggacaacgucuccgacuccgccaaggagcucaucaccaugaugcuccucgucgacgucgaccagcgcuucuccgccguccagguccucgagcaccccugggucaacgacgacggccuccccgagaacgagcaccagcucuccgucgccggcaagaucaagaagcacuucaacaccggccccaagcccaacuccaccgccgccggcgucuccgucaucgcccucgaccacggcuucaccaucaagcgcuccggcucccucgacuacuaccagcagcccggcauguacuggauccgccccccccuccucauccgccgcggccgcuucuccgacgaggacgccacccgcauguga

SEQ ID NO: 42084 - RNA, 2301 nt, Artificial Sequence
  derived and/or modified sequence opt2 from DCLK2__Homo_sapiens__NP_001035350
auggccuccacccgcuccaucgagcucgagcacuucgaggagcgcgacaagcgcccccgccccggcucccgccgcggcgcccccuccuccuccggcggcuccuccuccuccggccccaagggcaacggccucauccccucccccgcccacuccgcccacugcuccuucuaccgcacccgcacccuccaggcccucuccuccgagaagaaggccaagaaggcccgcuucuaccgcaacggcgaccgcuacuucaagggccucgucuucgccaucuccuccgaccgcuuccgcuccuucgacgcccuccucaucgagcucacccgcucccucuccgacaacgucaaccucccccagggcguccgcaccaucuacaccaucgacggcucccgcaaggucaccucccucgacgagcuccucgagggcgaguccuacgucugcgccuccaacgagcccuuccgcaaggucgacuacaccaagaacaucaaccccaacugguccgucaacaucaagggcggcaccucccgcgcccucgccgccgccuccuccgucaaguccgaggucaaggaguccaaggacuucaucaagcccaagcucgucaccgucauccgcuccggcgucaagccccgcaaggccguccgcauccuccucaacaagaagaccgcccacuccuucgagcagguccucaccgacaucaccgaggccaucaagcucgacuccggcgucgucaagcgccucugcacccucgacggcaagcaggucaccugccuccaggacuucuucggcgacgacgacgucuucaucgccugcggccccgagaaguuccgcuacgcccaggacgacuucguccucgaccacuccgagugccgcguccucaaguccuccuacucccgcuccuccgccgucaaguacuccggcuccaagucccccggccccucccgccgcuccaagucccccgccuccgucaacggcacccccuccucccagcucuccacccccaaguccaccaaguccuccuccuccucccccaccucccccggcuccuuccgcggccucaagcagaucuccgcccacggccgcuccuccuccaacgucaacggcggccccgagcucgaccgcugcaucucccccgagggcgucaacggcaaccgcugcuccgaguccuccacccuccucgagaaguacaagaucggcaaggucaucggcgacggcaacuucgccgucgucaaggagugcaucgaccgcuccaccggcaaggaguucgcccucaagaucaucgacaaggccaagugcugcggcaaggagcaccucaucgagaacgaggucuccauccuccgccgcgucaagcaccccaacaucaucaugcucgucgaggagauggagaccgccaccgagcucuuccucgucauggagcucgucaagggcggcgaccucuucgacgccaucaccuccuccaccaaguacaccgagcgcgacggcuccgccauggucuacaaccucgccaacgcccuccgcuaccuccacggccucuccaucguccaccgcgacaucaagcccgagaaccuccucgucugcgaguaccccgacggcaccaagucccucaagcucggcgacuucggccucgccaccgucgucgagggcccccucuacaccgucugcggcacccccaccuacgucgcccccgagaucaucgccgagaccggcuacggccucaaggucgacaucugggccgccggcgucaucaccuacauccuccucugcggcuucccccccuuccgcuccgagaacaaccuccaggaggaccucuucgaccagauccucgccggcaagcucgaguuccccgcccccuacugggacaacaucaccgacuccgccaaggagcucaucucccagaugcuccaggucaacgucgaggcccgcugcaccgccggccagauccucucccaccccugggucuccgacgacgccucccaggagaacaacaugcaggccgaggucaccggcaagcucaagcagcacuucaacaacgcccuccccaagcagaacuccaccaccaccggcgucuccgucaucaugaacaccgcccucgacaaggagggccagaucuucugcuccaagcacugccaggacuccggccgccccggcauggagcccaucucccccgucccccccuccgucgaggagauccccguccccggcgaggccguccccgcccccaccccccccgagucccccaccccccaccccccccccgccgcccccggcggcgagcgcgccggcaccuggcgccgccaccgcgacuga

SEQ ID NO: 42085 - RNA, 1947 nt, Artificial Sequence
  derived and/or modified sequence opt2 from DCLK3__Homo_sapiens__NP_208382
augggcaaggagccccucacccucaaguccauccaggucgccgucgaggagcucuaccccaacaaggcccgcgcccucacccucgcccagcacucccgcgcccccuccccccgccuccgcucccgccucuucuccaaggcccucaagggcgaccaccgcugcggcgagaccgagacccccaaguccugcuccgaggucgccggcugcaaggccgccaugcgccaccagggcaagauccccgaggagcucucccucgacgaccgcgcccgcacccagaagaaguggggccgcggcaagugggagcccgagcccuccuccaagcccccccgcgaggccacccucgaggagcgccacgcccgcggcgagaagcaccucggcgucgagaucgagaagaccuccggcgagaucauccgcugcgagaagugcaagcgcgagcgcgagcuccagcagucccucgagcgcgagcgccucucccucggcaccuccgagcucgacaugggcaagggccccauguacgacgucgagaagcucguccgcacccgcuccugccgccgcucccccgaggccaaccccgccuccggcgaggagggcuggaagggcgacucccaccgcuccuccccccgcaaccccacccaggagcuccgccgccccuccaaguccauggacaagaaggaggaccgcggccccgaggaccaggagucccacgcccagggcgccgccaaggccaagaaggaccucgucgagguccuccccgucaccgaggagggccuccgcgaggucaagaaggacacccgccccaugucccgcuccaagcacggcggcuggcuccuccgcgagcaccaggccggcuucgagaagcuccgccgcacccgcggcgaggagaaggaggccgagaaggagaagaagcccugcauguccggcggccgccgcaugacccuccgcgacgaccagcccgccaagcucgagaaggagcccaagacccgccccgaggagaacaagcccgagcgccccuccggccgcaagccccgccccaugggcaucaucgccgccaacgucgagaagcacuacgagaccggccgcgucaucggcgacggcaacuucgccgucgucaaggagugccgccaccgcgagacccgccaggccuacgccaugaagaucaucgacaagucccgccucaagggcaaggaggacauggucgacuccgagauccucaucauccagucccucucccaccccaacaucgucaagcuccacgaggucuacgagaccgacauggagaucuaccucauccucgaguacguccagggcggcgaccucuucgacgccaucaucgaguccgucaaguuccccgagcccgacgccgcccucaugaucauggaccucugcaaggcccucguccacaugcacgacaaguccaucguccaccgcgaccucaagcccgagaaccuccucguccagcgcaacgaggacaaguccaccacccucaagcucgccgacuucggccucgccaagcacgucguccgccccaucuucaccgucugcggcacccccaccuacgucgcccccgagauccucuccgagaagggcuacggccucgaggucgacaugugggccgccggcgucauccucuacauccuccucugcggcuucccccccuuccgcucccccgagcgcgaccaggacgagcucuucaacaucauccagcucggccacuucgaguuccucccccccuacugggacaacaucuccgacgccgccaaggaccucgucucccgccuccucgucgucgaccccaagaagcgcuacaccgcccaccagguccuccagcaccccuggaucgagaccgccggcaagaccaacaccgucaagcgccagaagcaggucucccccuccuccgagggccacuuccgcucccagcacaagcgcgucgucgagcaggucuccuga

SEQ ID NO: 42086 - RNA, 3123 nt, Artificial Sequence
  derived and/or modified sequence opt2 from DCLRE1A__Homo_sapiens__NP_055696
augcucgaggacaucuccgaggaggacaucugggaguacaaguccaagcgcaagcccaagcgcgucgaccccaacaacggcuccaagaacauccucaaguccgucgagaaggccaccgacggcaaguaccaguccaagcgcucccgcaaccgcaagcgcgccgccgaggccaaggaggucaaggaccacgaggucccccucggcaacgccggcugccagaccuccgucgccuccucccagaacuccuccugcggcgacggcauccagcagacccaggacaaggagaccacccccggcaagcucugccgcacccagaagucccagcacgucucccccaagauccgccccgucuacgacggcuacugccccaacugccagaugcccuucuccucccucaucggccagaccccccgcuggcacgucuucgagugccucgacucccccccccgcuccgagaccgagugccccgacggccuccucugcaccuccaccauccccuuccacuacaagcgcuacacccacuuccuccucgcccagucccgcgccggcgaccaccccuucuccucccccucccccgccuccggcggcuccuucuccgagaccaaguccggcguccucugcucccucgaggagcgcugguccuccuaccagaaccagaccgacaacuccgucuccaacgacccccuccucaugacccaguacuucaagaagucccccucccucaccgaggccuccgagaagaucuccacccacauccagaccucccagcaggcccuccaguucaccgacuucgucgagaacgacaagcucgucggcgucgcccuccgccucgccaacaacuccgagcacaucaaccucccccuccccgagaacgacuucuccgacugcgagaucuccuacuccccccuccaguccgacgaggacacccacgacaucgacgagaagcccgacgacucccaggagcagcucuucuucaccgaguccuccaaggacggcucccucgaggaggacgacgacuccugcggcuucuucaagaagcgccacggcccccuccucaaggaccaggacgaguccugccccaaggucaacuccuuccucacccgcgacaaguacgacgagggccucuaccgcuucaacucccucaacgaccucucccagcccaucucccagaacaacgaguccacccuccccuacgaccucgccugcaccggcggcgacuucguccucuucccccccgcccucgccggcaagcucgccgccuccguccaccaggccaccaaggccaagcccgacgagcccgaguuccacuccgcccaguccaacaagcagaagcaggucaucgaggaguccuccgucuacaaccaggucucccucccccucgucaagucccucaugcucaagcccuucgagucccaggucgagggcuaccucuccucccagcccacccagaacaccauccgcaagcucuccuccgagaaccucaacgccaagaacaacaccaacuccgccugcuucugccgcaaggcccucgagggcguccccgucggcaaggccaccauccucaacaccgagaaccucuccuccacccccgcccccaaguaccucaagauccuccccuccggccucaaguacaacgcccgccaccccuccaccaaggucaugaagcagauggacaucggcgucuacuucggccucccccccaagcgcaaggaggagaagcuccucggcgaguccgcccucgagggcaucaaccucaaccccguccccucccccaaccagaagcgcuccucccagugcaagcgcaaggccgagaagucccucuccgaccucgaguucgacgccuccacccuccacgagucccagcucuccgucgagcucuccuccgagcgcucccagcgccagaagaagcgcugccgcaaguccaacucccuccaggagggcgccugccagaagcgcuccgaccaccucaucaacaccgaguccgaggccgucaaccucuccaaggucaaggucuucaccaaguccgcccacggcggccuccagcgcggcaacaagaagauccccgaguccuccaacgucggcggcucccgcaagaagaccugccccuucuacaagaagauccccggcaccggcuucaccgucgacgccuuccaguacggcgucgucgagggcugcaccgccuacuuccucacccacuuccacuccgaccacuacgccggccucuccaagcacuucaccuuccccgucuacugcuccgagaucaccggcaaccuccucaagaacaagcuccacguccaggagcaguacauccacccccucccccucgacaccgagugcaucgucaacggcgucaaggucguccuccucgacgccaaccacugccccggcgccgucaugauccucuucuaccuccccaacggcaccgucauccuccacaccggcgacuuccgcgccgaccccuccauggagcgcucccuccucgccgaccagaagguccacaugcucuaccucgacaccaccuacugcucccccgaguacaccuuccccucccagcaggaggucauccgcuucgccaucaacaccgccuucgaggccgucacccucaacccccacgcccucgucgucugcggcaccuacuccaucggcaaggagaaggucuuccucgccaucgccgacguccucggcuccaaggucggcaugucccaggagaaguacaagacccuccagugccucaacauccccgagaucaacucccucaucaccaccgacaugugcuccucccucguccaccuccuccccaugaugcagaucaacuucaagggccuccagucccaccucaagaagugcggcggcaaguacaaccagauccucgccuuccgccccaccggcuggacccacuccaacaaguucacccgcaucgccgacgucaucccccagaccaagggcaacaucuccaucuacggcauccccuacuccgagcacuccuccuaccucgagaugaagcgcuucguccaguggcucaagccccagaagaucauccccaccgucaacgucggcaccuggaagucccgcuccaccauggagaaguacuuccgcgaguggaagcucgaggccggcuacuga

SEQ ID NO: 42087 - RNA, 2079 nt, Artificial Sequence
  derived and/or modified sequence opt2 from DCLRE1C__Homo_sapiens__NP_001029027
auguccuccuucgagggccagauggccgaguaccccaccaucuccaucgaccgcuucgaccgcgagaaccuccgcgcccgcgccuacuuccucucccacugccacaaggaccacaugaagggccuccgcgcccccacccucaagcgccgccucgagugcucccucaaggucuaccucuacugcucccccgucaccaaggagcuccuccucaccucccccaaguaccgcuucuggaagaagcgcaucaucuccaucgagaucgagacccccacccagaucucccucgucgacgaggccuccggcgagaaggaggagaucgucgucacccuccuccccgccggccacugccccggcuccgucauguuccucuuccagggcaacaacggcaccguccucuacaccggcgacuuccgccucgcccagggcgaggccgcccgcauggagcuccuccacuccggcggccgcgucaaggacauccaguccgucuaccucgacaccaccuucugcgacccccgcuucuaccagauccccucccgcgaggagugccucuccggcguccucgagcucguccgcuccuggaucacccgcucccccuaccacgucgucuggcucaacugcaaggccgccuacggcuacgaguaccucuucaccaaccucuccgaggagcucggcguccagguccacgucaacaagcucgacauguuccgcaacaugcccgagauccuccaccaccucaccaccgaccgcaacacccagauccacgccugccgccaccccaaggccgaggaguacuuccagugguccaagcuccccugcggcaucaccucccgcaaccgcaucccccuccacaucaucuccaucaagcccuccaccaugugguucggcgagcgcucccgcaagaccaacgucaucguccgcaccggcgaguccuccuaccgcgccugcuucuccuuccacuccuccuacuccgagaucaaggacuuccucuccuaccucugccccgucaacgccuaccccaacgucauccccgucggcaccaccauggacaaggucgucgagauccucaagccccucugccgcuccucccaguccaccgagcccaaguacaagccccucggcaagcucaagcgcgcccgcaccguccaccgcgacuccgaggaggaggacgacuaccucuucgacgacccccuccccaucccccuccgccacaagguccccuaccccgagaccuuccaccccgaggucuucuccaugaccgccgucuccgagaagcagcccgagaagcuccgccagacccccggcugcugccgcgccgagugcaugcaguccucccgcuucaccaacuucgucgacugcgaggaguccaacuccgaguccgaggaggaggucggcauccccgccucccuccagggcgaccucggcuccguccuccaccuccagaaggccgacggcgacgucccccagugggaggucuucuucaagcgcaacgacgagaucaccgacgagucccucgagaacuuccccuccuccaccgucgccggcggcucccagucccccaagcucuucuccgacuccgacggcgaguccacccacaucuccucccagaacuccucccaguccacccacaucaccgagcagggcucccagggcugggacucccaguccgacaccguccuccucuccucccaggagcgcaacuccggcgacaucaccucccucgacaaggccgacuaccgccccaccaucaaggagaacauccccgccucccucauggagcagaacgucaucugccccaaggacaccuacuccgaccucaagucccgcgacaaggacgucaccaucguccccuccaccggcgagcccaccacccucuccuccgagacccacauccccgaggagaagucccuccucaaccucuccaccaacgccgacucccaguccuccuccgacuucgagguccccuccacccccgaggccgagcuccccaagcgcgagcaccuccaguaccucuacgagaagcucgccaccggcgaguccaucgccgucaagaagcgcaagugcucccuccucgacaccuga

SEQ ID NO: 42088 - RNA, 1080 nt, Artificial Sequence
  derived and/or modified sequence opt2 from DCN__Homo_sapiens__NP_598010
augaaggccaccaucauccuccuccuccucgcccaggucuccugggccggccccuuccagcagcgcggccucuucgacuucaugcucgaggacgaggccuccggcaucggccccgagguccccgacgaccgcgacuucgagcccucccucggccccgucugccccuuccgcugccagugccaccuccgcgucguccagugcuccgaccucggccucgacaagguccccaaggaccucccccccgacaccacccuccucgaccuccagaacaacaagaucaccgagaucaaggacggcgacuucaagaaccucaagaaccuccacgcccucauccucgucaacaacaagaucuccaaggucucccccggcgccuucaccccccucgucaagcucgagcgccucuaccucuccaagaaccagcucaaggagcuccccgagaagaugcccaagacccuccaggagcuccgcgcccacgagaacgagaucaccaagguccgcaaggucaccuucaacggccucaaccagaugaucgucaucgagcucggcaccaacccccucaaguccuccggcaucgagaacggcgccuuccagggcaugaagaagcucuccuacauccgcaucgccgacaccaacaucaccuccaucccccagggccucccccccucccucaccgagcuccaccucgacggcaacaagaucucccgcgucgacgccgccucccucaagggccucaacaaccucgccaagcucggccucuccuucaacuccaucuccgccgucgacaacggcucccucgccaacaccccccaccuccgcgagcuccaccucgacaacaacaagcucacccgcguccccggcggccucgccgagcacaaguacauccaggucgucuaccuccacaacaacaacaucuccgucgucggcuccuccgacuucugcccccccggccacaacaccaagaaggccuccuacuccggcgucucccucuucuccaaccccguccaguacugggagauccagcccuccaccuuccgcugcgucuacguccgcuccgccauccagcucggcaacuacaaguga

SEQ ID NO: 42089 - RNA, 1272 nt, Artificial Sequence
  derived and/or modified sequence opt2 from DCP1A__Homo_sapiens__NP_001277136
auggccgacgucgucgaggaggagacccgccgcucccagcaggccgcccgcgacaagcagucccccucccaggccaacggcugcuccgaccaccgccccaucgacauccucgagaugcucucccgcgccaaggacgaguacgagcgcuccgcccccuccggccacaagcaccucaccgucgaggagcucuucggcaccucccuccccaaggagcagcccgccgucgucggccucgacuccgaggagauggagcgccuccccggcgacgccucccagaaggagcccaacuccuuccuccccuuccccuucgagcagcucggcggcgccccccaguccgagacccucggcguccccuccgccgcccaccacuccguccagcccgagaucaccacccccguccucaucacccccgccuccaucacccaguccaacgagaagcacgcccccaccuacaccaucccccucucccccguccucucccccacccuccccgccgaggcccccaccgcccaggucccccccucccucccccgcaacuccaccaugaugcaggccgucaagaccaccccccgccagcgcuccccccuccucaaccagcccguccccgagcucucccacgccucccucaucgccaaccagucccccuuccgcgccccccucaacgucaccaacaccgccggcaccucccuccccuccgucgaccuccuccagaagcuccgccucaccccccagcacgaccagauccagacccagccccucggcaagggcgccauggucgccuccuucucccccgccgccggccagcucgccacccccgaguccuucaucgagccccccuccaagaccgccgccgcccgcgucgccgccuccgccucccucuccaacaugguccucgccccccuccaguccaugcagcagaaccaggaccccgaggucuucguccagcccaagguccucuccuccgccauccccgucgccggcgccccccucgucaccgccaccaccaccgccgucuccuccguccuccucgcccccuccgucuuccagcagaccgucacccgcuccuccgaccucgagcgcaaggccuccucccccuccccccucaccaucggcacccccgagucccagcgcaagcccuccaucauccucuccaagucccagcuccaggacacccucauccaccucaucaagaacgacuccuccuuccucuccacccuccacgaggucuaccuccagguccucaccaagaacaaggacaaccacaaccucuga

SEQ ID NO: 42090 - RNA, 1854 nt, Artificial Sequence
  derived and/or modified sequence opt2 from DCP1B__Homo_sapiens__NP_689853
auggccgccgucgccgccggcggccucgucggcaagggccgcgacaucucccucgccgcccuccagcgccacgaccccuacaucaaccgcaucgucgacgucgccucccaggucgcccucuacaccuucggccaccgcgccaacgagugggagaagaccgacgucgagggcacccucuucgucuacacccgcuccgccucccccaagcacggcuucaccaucaugaaccgccucuccauggagaaccgcaccgagcccaucaccaaggaccucgacuuccagcuccaggaccccuuccuccucuaccgcaacgcccgccucuccaucuacggcaucugguucuacgacaaggaggagugccagcgcaucgccgagcucaugaagaaccucacccaguacgagcagcucaaggcccaccagggcaccggcgccggcaucucccccgucauccucaacuccggcgagggcaaggaggucgacauccuccgcaugcucaucaaggccaaggacgaguacaccaagugcaagaccugcuccgagcccaagaagaucaccuccuccuccgccaucuacgacaaccccaaccucaucaagcccauccccgucaagcccuccgagaaccagcagcagcgcaucccccagcccaaccagacccucgaccccgagccccagcaccucucccucaccgcccucuucggcaagcaggacaaggccaccugccaggagaccgucgagcccccccagacccuccaccagcagcagcagcagcagcagcagcagcaggagaagcuccccauccgccagggcgucguccgcucccucuccuacgaggagccccgccgccacuccccccccaucgagaagcagcucugccccgccauccagaagcucaugguccgcuccgccgaccuccacccccucuccgagcuccccgagaaccgccccugcgagaacggcuccacccacuccgccggcgaguucuucaccggccccguccagcccggcuccccccacaacaucggcaccucccgcggcguccagaacgccucccgcacccagaaccucuucgagaagcuccaguccacccccggcgccgccaacaagugcgaccccuccacccccgcccccgccuccuccgccgcccucaaccgcucccgcgcccccaccuccgucacccccgucgcccccggcaagggccucgcccagcccccccaggccuacuucaacggcucccuccccccccagaccgucggccaccaggcccacggccgcgagcaguccacccucccccgccagacccuccccaucuccggcucccagaccggcuccuccggcgucaucuccccccaggagcuccucaagaagcuccagaucguccagcaggagcagcagcuccacgccuccaaccgccccgcccucgccgccaaguuccccguccucgcccaguccuccggcaccggcaagccccucgaguccuggaucaacaagacccccaacaccgagcagcagaccccccucuuccaggucaucuccccccagcgcauccccgccaccgccgcccccucccuccucaugucccccauggucuucgcccagcccaccuccgucccccccaaggagcgcgaguccggccuccuccccgucggcggccaggagccccccgccgccgccaccucccuccuccuccccauccagucccccgagcccuccgucaucaccuccuccccccucaccaagcuccagcuccaggaggcccuccucuaccucauccagaacgacgacaacuuccucaacaucaucuacgaggccuaccucuucuccaugacccaggccgccaugaagaagaccauguga

SEQ ID NO: 42091 - RNA, 1014 nt, Artificial Sequence
  derived and/or modified sequence opt2 from DCPS__Homo_sapiens__NP_054745
auggccgacgccgccccccagcucggcaagcgcaagcgcgagcucgacgucgaggaggcccacgccgccuccaccgaggagaaggaggccggcgucggcaacggcaccugcgcccccguccgccuccccuucuccggcuuccgccuccagaagguccuccgcgaguccgcccgcgacaagaucaucuuccuccacggcaaggucaacgaggccuccggcgacggcgacggcgaggacgccgucgucauccucgagaagacccccuuccaggucgagcaggucgcccagcuccucaccggcucccccgagcuccagcuccaguucuccaacgacaucuacuccaccuaccaccucuuccccccccgccagcucaacgacgucaagaccaccgucgucuaccccgccaccgagaagcaccuccagaaguaccuccgccaggaccuccgccucauccgcgagaccggcgacgacuaccgcaacaucacccucccccaccucgagucccagucccucuccauccagugggucuacaacauccucgacaagaaggccgaggccgaccgcaucgucuucgagaaccccgaccccuccgacggcuucguccucauccccgaccucaaguggaaccagcagcagcucgacgaccucuaccucaucgccaucugccaccgccgcggcauccgcucccuccgcgaccucacccccgagcaccucccccuccuccgcaacauccuccaccagggccaggaggccauccuccagcgcuaccgcaugaagggcgaccaccuccgcgucuaccuccacuaccuccccuccuacuaccaccuccacguccacuucaccgcccucggcuucgaggcccccggcuccggcgucgagcgcgcccaccuccucgccgaggucaucgagaaccucgagugcgacccccgccacuaccagcagcgcacccucaccuucgcccuccgcgccgacgacccccuccucaagcuccuccaggaggcccagcaguccuga

SEQ ID NO: 42092 - RNA, 2046 nt, Artificial Sequence
  derived and/or modified sequence opt2 from DCST1__Homo_sapiens__NP_001137159
auggacaucaagcaccaccagaacggcacccgcggccagcgccgcaagcagccccacaccaccguccagcgccuccucaccuggggccuccccgucuccugcuccugguuccucuggcgccagcccggcgaguuccccgucaccgcccuccuccucggcgccggcgccggcggccuccucgccaucggccucggcgccaugggcuggggcaccuccccccacauccgcugcgccucccuccuccucguccccaagaugcucggcaaggagggccgccucuucguccucggcuacgcccucgccgccaucuacgucggccccgucgccaaccuccgccacaaccucaacaacgucaucgccucccucggcugcaccgucgagcuccagaucaacaacacccgcgccgccuggcgcaucuccaccgccccccuccgcgccauguucaaggaccuccucuccuccaaggagcuccuccgcgccgagacccgcaacaucuccgccaccuucgaggaccucgacgcccaggucaacuccgagaccggcuacacccccgaggacaccauggacuccggcgagaccgcccagggccgcgaggcccgccaggcccccgccucccgccuccaccucuccacccagaagauguacgagcucaagaccaagcuccgcugcuccuacgucgucaaccaggccauccucuccugccgccgcugguucgaccgcaagcacgagcagugcaugaagcacaucugggucccccuccucacccaccuccucugccuccccaugaaguucaaguucuucugcggcaucgccaaggucauggaggucuggugccgcaaccgcauccccgucgagggcaacuucggccagaccuacgacucccucaaccaguccauccgcggccucgacggcgaguucuccgccaacaucgacuucaaggaggagaagcaggccggcguccucggccucaacaccuccugggagcgcgucuccaccgagguccgcgacuacgucuaccgccaggaggcccgccucgagugggcccucggccuccuccacguccuccucuccugcaccuuccuccucguccuccacgccuccuucuccuacauggacuccuacaaccacgacauccgcuucgacaacaucuacaucuccaccuacuucugccagaucgacgaccgccgcaagaagcucggcaagcgcacccuccucccccuccgcaaggccgaggagaagaccgucaucuuccccugcaagcccaccauccaggccuccgagauguccaacgucguccgcgagcuccucgagacccuccccauccuccuccuccucgucguccucugcggccucgacugggcccucuacuccaucuucgacaccauccgccaccacuccuuccuccaguacuccuuccgcuccucccacaagcucgaggucaaggucggcggcgacuccaugcucgcccgccuccuccgcaagaccaucggcgcccucaacaccuccuccgagaccgucauggaguccaacaacaugcccugccucccccagcccgucggccucgacgcccgcgccuacuggcgcgccgccguccccaucggccuccucgucugccucugccuccuccaggccuucggcuaccgccuccgccgcgucaucgccgccuucuacuuccccaagcgcgagaagaagcgcauccucuuccucuacaacgaccuccucaagaagcgcgccgccuucaccaagcuccgccgcgccgccauccuccgccgcgagcgccagcagaaggccccccgccacccccucgccgacauccuccaccgcggcugcccccuccuccgccgcuggcucugccgccgcugcgucgucugccaggcccccgagacccccgaguccuacgucugccgcacccucgacugcgaggccgucuacugcugguccugcugggacgacaugcgccagcgcugccccgucugcaccccccgcgaggagcucuccuccuccgccuucuccgacuccaacgacgacaccgccuacgccggcuga

SEQ ID NO: 42093 - RNA, 2322 nt, Artificial Sequence
  derived and/or modified sequence opt2 from DCST2__Homo_sapiens__NP_653223
augcccaaggucaugaaggacgucguccacccccucggcggcgaggagcccuccauggcccgcgccgucguccgcuccgucggcggcuucacccucggccucucccucgccaccgccuacggccuccucgagcuccucgucgagggccacucccccuggggcugccucgucggcacccucacccucgccgccuuccucucccucggcaugggcuucucccgccagguccgcgccaccguccuccuccuccucccccaggccuucucccgccagggccgcacccuccuccucgucgccgccuucggccucguccuccagggccccugcgccaacacccuccgcaacuucacccgcgccuccgaggccgucgccugcggcgccgagcucgcccucaaccagaccgccgagguccuccagcgcgccaagcagccccucgucuccgcccucaacaagaucaaggccaucgcccgcaagaccaaggaggucgccgaccgcguccgcaaguucuuccgcuccaucauggacggcgucaagcacaucgcccgcgcccuccgcaacgucuggcaguggcuccuccacaucggcgacgucugcaacuccgagcucggcaaccccuaccucaagugcgcccgcgucuucgacgacgccaaggacuccugcaugauggucaucccccaggccuaccaccucugcuacguccucaugcccuucaagcucgcccucugcggccucgccucccucguccaggucuucugcgucauccccaaguacauccagcccuuccuccgccagaccaucggcacccccgucauccagcuccucaaccgcguccgccaggaguucgaguucaacaugaccgccacccaccacuucuccgucgaccucaacgccucccgcucccucucccaggucgccauggaccuccacgaggccgucuccaugaagcuccaccgcguccgcgaggcccucgcccucaugggcuucaccaccccccuccuccucguccuccucuaccuccaggcccucuucuaccgcuacugcuaccucaacugggaccacuacgacaacaucuacaucaccucccgcuuccuccgcauggaggccguccgcuccaccgccggccuccccaccguccucccccucuccgcccacgaggcccgccgcuacaucccccccggcuccaucuuccucucccagugggagaaguucuucuacauccucgagaccuucaaccucauccgccaccuccuccucguccucuuccucgucuuccucgacuacgccgucuucuggguccucgaccucgcccgccaccagcuccagggcgagaucgucgcccgcucccccguccucgucucccucaccgucgagggcaccggcuacgccggcaacaucuaccgcgaccucgucuccgccuucgacguccuccagcagggcaacaucuccauccucucccgccgcugccuccuccgccccuccgagcccgacuccaccggcuacaucgucaucggcgucauguacggccucugcuucuucaucacccucuucggcuccuacgucucccgccuccgccgcgucaucugcgccuccuacuaccccucccgcgagcaggagcgcaucuccuaccucuacaacguccuccucucccgccgcaccaaccuccucgccgcccuccaccgcuccguccgccgccgcgccgccgaccagggccaccgcuccgccuuccucguccucgccucccgcugccccugccucggccccuucgucucccacuucuggcuccaccaggccuacugccucggcugcggccagccccaggacgagggcgacauggagaacaccgucuccugcuccacccccggcugccagggccucuacugccucaccugcuuccgccuccucgacaacaccugcuccgucugcgccuccccccucuccuaccagggcgaccucgaccucgagcucgacuccuccgacgaggagggcccccagcucuggcucgccgccgcccagcgcaaggaccccgagcaggccuggcuccuccagcagcagcuccaggagguccucggccgcucccucuccauggaguccaccuccgaguccuccgaccucgacgaggagaagggcccccagcagcgcaagcacggccagcagccccuccccgaggcccaccagcccgucuccauccucaccucccccgagccccaccgcccccccgagaccuccuccgccaccaagggcgcccccacccccgccuccgagcccuccgucccccucuccccccccucccuccccgaccccucccaccccccccccaaguga

SEQ ID NO: 42094 - RNA, 1413 nt, Artificial Sequence
  derived and/or modified sequence opt2 from DCSTAMP__Homo_sapiens__XP_005251132
augggcaucuggaccuccggcaccgacaucuuccucucccucugggagaucuacgucuccccccgcucccccggcuggauggacuucauccagcaccucggcgucugcugccucgucgcccucaucuccgucggccuccucuccgucgccgccugcugguuccuccccuccaucaucgccgccgccgccuccuggaucaucaccugcguccuccucugcugcuccaagcacgcccgcugcuucauccuccucgucuuccucuccugcggccuccgcgagggccgcaacgcccucaucgccgccggcaccggcaucgucauccucggccacgucgagaacaucuuccacaacuucaagggccuccucgacggcaugaccugcaaccuccgcgccaaguccuucuccauccacuucccccuccucaagaaguacaucgaggccauccaguggaucuacggccucgccaccccccucuccgucuucgacgaccucgucuccuggaaccagacccucgccgucucccucuucucccccucccacguccucgaggcccagcucaacgacuccaagggcgagguccucuccguccucuaccagauggccaccaccaccgagguccucuccucccucggccagaagcuccucgccuucgccggccucucccucguccuccucggcaccggccucuucaugaagcgcuuccucggccccugcggcuggaaguacgagaacaucuacaucacccgccaguucguccaguucgacgagcgcgagcgccaccagcagcgccccugcguccucccccucaacaaggaggagcgccgcaaguacgucaucauccccaccuucuggcccacccccaaggagcgcaagaaccucggccucuucuuccuccccauccucauccaccucugcaucuggguccucuucgccgccgucgacuaccuccucuaccgccucaucuucuccgucuccaagcaguuccagucccuccccggcuucgagguccaccucaagcuccacggcgagaagcagggcacccaggacaucauccacgacuccuccuucaacaucuccgucuucgagcccaacugcauccccaagcccaaguuccuccucuccgagaccugggucccccucuccgucauccuccucauccucgucaugcucggccuccucuccuccauccucaugcagcucaagauccucgucuccgccuccuucuaccccuccgucgagcgcaagcgcauccaguaccuccacgccaagcuccucaagaagcgcuccaagcagccccucggcgaggucaagcgccgccucucccucuaccucaccaagauccacuucuggcuccccguccucaagaugauccgcaagaagcagauggacauggccuccgccgacaaguccuga

SEQ ID NO: 42095 - RNA, 570 nt, Artificial Sequence
  derived and/or modified sequence opt2 from DCTD__Homo_sapiens__NP_001012750
auggucggcggcggccagcccugcggccccaacauguccgaggucuccugcaagaagcgcgacgacuaccucgaguggcccgaguacuucauggccgucgccuuccucuccgcccagcgcuccaaggaccccaacucccaggucggcgccugcaucgucaacuccgagaacaagaucgucggcaucggcuacaacggcaugcccaacggcugcuccgacgacguccuccccuggcgccgcaccgccgagaacaagcucgacaccaaguaccccuacgucugccacgccgagcucaacgccaucaugaacaagaacuccaccgacgucaagggcugcuccauguacgucgcccucuuccccugcaacgagugcgccaagcucaucauccaggccggcaucaaggaggucaucuucauguccgacaaguaccacgacuccgacgaggccaccgccgcccgccuccucuucaacauggccggcgucaccuuccgcaaguucauccccaagugcuccaagaucgucaucgacuucgacuccaucaacucccgccccucccagaagcuccaguga

SEQ ID NO: 42096 - RNA, 1659 nt, Artificial Sequence
  derived and/or modified sequence opt2 from DCT__Homo_sapiens__NP_001123361
auguccccccucugguggggcuuccuccucuccugccucggcugcaagauccuccccggcgcccagggccaguucccccgcgucugcaugaccgucgacucccucgucaacaaggagugcugcccccgccucggcgccgaguccgccaacgucugcggcucccagcagggccgcggccagugcaccgagguccgcgccgacacccgccccugguccggccccuacauccuccgcaaccaggacgaccgcgagcucuggccccgcaaguucuuccaccgcaccugcaagugcaccggcaacuucgccggcuacaacugcggcgacugcaaguucggcuggaccggccccaacugcgagcgcaagaagccccccgucauccgccagaacauccacucccucuccccccaggagcgcgagcaguuccucggcgcccucgaccucgccaagaagcgcguccaccccgacuacgucaucaccacccagcacuggcucggccuccucggccccaacggcacccagccccaguucgccaacugcuccgucuacgacuucuucgucuggcuccacuacuacuccguccgcgacacccuccucggccccggccgccccuaccgcgccaucgacuucucccaccagggccccgccuucgucaccuggcaccgcuaccaccuccucugccucgagcgcgaccuccagcgccucaucggcaacgaguccuucgcccuccccuacuggaacuucgccaccggccgcaacgagugcgacgucugcaccgaccagcucuucggcgccgcccgccccgacgaccccacccucaucucccgcaacucccgcuucuccuccugggagaccgucugcgacucccucgacgacuacaaccaccucgucacccucugcaacggcaccuacgagggccuccuccgccgcaaccagaugggccgcaacuccaugaagcuccccacccucaaggacauccgcgacugccucucccuccagaaguucgacaacccccccuucuuccagaacuccaccuucuccuuccgcaacgcccucgagggcuucgacaaggccgacggcacccucgacucccaggucaugucccuccacaaccucguccacuccuuccucaacggcaccaacgcccucccccacuccgccgccaacgaccccaucuucgucgucaucuccaaccgccuccucuacaacgccaccaccaacauccucgagcacguccgcaaggagaaggccaccaaggagcuccccucccuccacguccucguccuccacuccuucaccgacgccaucuucgacgaguggaugaagcgcuucaacccccccgccgacgccuggccccaggagcucgcccccaucggccacaaccgcauguacaacaugguccccuucuucccccccgucaccaacgaggagcucuuccucaccuccgaccagcucggcuacuccuacgccaucgaccuccccgucuccgucgaggagacccccggcuggcccaccacccuccucgucgucaugggcacccucgucgcccucgucggccucuucguccuccucgccuuccuccaguaccgccgccuccgcaagggcuacaccccccucauggagacccaccucuccuccaagcgcuacaccgaggaggccuga

SEQ ID NO: 42097 - RNA, 3762 nt, Artificial Sequence
  derived and/or modified sequence opt2 from DCTN1__Homo_sapiens__NP_001128512
auggcccaguccaagcgccacgucuacucccgcacccccuccggcucccgcauguccgccgaggccuccgcccgcccccuccgcgucggcucccgcgucgaggucaucggcaagggccaccgcggcaccgucgccuacgucggcgccacccucuucgccaccggcaagugggucggcgucauccucgacgaggccaagggcaagaacgacggcaccguccagggccgcaaguacuucaccugcgacgagggccacggcaucuucguccgccagucccagauccaggucuucgaggacggcgccgacaccaccucccccgagacccccgacuccuccgccuccaagguccucaagcgcgagggcaccgacaccaccgccaagaccuccaagcuccccacccgccccgccuccaccggcgucgccggcgccuccuccucccucggccccuccggcuccgccuccgccggcgagcucuccuccuccgagcccuccacccccgcccagaccccccucgccgcccccaucauccccacccccguccucaccucccccggcgccguccccccccuccccucccccuccaaggaggaggagggccuccgcgcccagguccgcgaccucgaggagaagcucgagacccuccgccucaagcgcgccgaggacaaggccaagcucaaggagcucgagaagcacaagauccagcucgagcagguccaggaguggaaguccaagaugcaggagcagcaggccgaccuccagcgccgccucaaggaggcccgcaaggaggccaaggaggcccucgaggccaaggagcgcuacauggaggagauggccgacaccgccgacgccaucgagauggccacccucgacaaggagauggccgaggagcgcgccgagucccuccagcaggaggucgaggcccucaaggagcgcgucgacgagcucaccaccgaccucgagauccucaaggccgagaucgaggagaagggcuccgacggcgccgccuccuccuaccagcucaagcagcucgaggagcagaacgcccgccucaaggacgcccucguccgcaugcgcgaccucuccuccuccgagaagcaggagcacgucaagcuccagaagcucauggagaagaagaaccaggagcucgaggucguccgccagcagcgcgagcgccuccaggaggagcucucccaggccgaguccaccaucgacgagcucaaggagcaggucgacgccgcccucggcgccgaggagauggucgagaugcucaccgaccgcaaccucaaccucgaggagaagguccgcgagcuccgcgagaccgucggcgaccucgaggccaugaacgagaugaacgacgagcuccaggagaacgcccgcgagaccgagcucgagcuccgcgagcagcucgacauggccggcgcccgcguccgcgaggcccagaagcgcgucgaggccgcccaggagaccgucgccgacuaccagcagaccaucaagaaguaccgccagcucaccgcccaccuccaggacgucaaccgcgagcucaccaaccagcaggaggccuccgucgagcgccagcagcagcccccccccgagaccuucgacuucaagaucaaguucgccgagaccaaggcccacgccaaggccaucgagauggagcuccgccagauggaggucgcccaggccaaccgccacaugucccuccucaccgccuucaugcccgacuccuuccuccgccccggcggcgaccacgacugcguccucguccuccuccucaugccccgccucaucugcaaggccgagcucauccgcaagcaggcccaggagaaguucgagcucuccgagaacugcuccgagcgccccggccuccgcggcgccgccggcgagcagcucuccuucgccgccggccucgucuacucccucucccuccuccaggccacccuccaccgcuacgagcacgcccucucccagugcuccgucgacgucuacaagaaggucggcucccucuaccccgagauguccgcccacgagcgcucccucgacuuccucaucgagcuccuccacaaggaccagcucgacgagaccgucaacgucgagccccucaccaaggccaucaaguacuaccagcaccucuacuccauccaccucgccgagcagcccgaggacugcaccaugcagcucgccgaccacaucaaguucacccaguccgcccucgacugcauguccgucgaggucggccgccuccgcgccuuccuccagggcggccaggaggccaccgacaucgcccuccuccuccgcgaccucgagaccuccugcuccgacauccgccaguucugcaagaagauccgccgccgcaugcccggcaccgacgcccccggcauccccgccgcccucgccuucggcccccaggucuccgacacccuccucgacugccgcaagcaccucaccugggucgucgccguccuccaggaggucgccgccgccgccgcccagcucaucgccccccucgccgagaacgagggccuccucgucgccgcccucgaggagcucgccuucaaggccuccgagcagaucuacggcacccccuccuccucccccuacgagugccuccgccaguccugcaacauccucaucuccaccaugaacaagcucgccaccgccaugcaggagggcgaguacgacgccgagcgcccccccuccaagcccccccccgucgagcuccgcgccgccgcccuccgcgccgagaucaccgacgccgagggccucggccucaagcucgaggaccgcgagaccgucaucaaggagcucaagaagucccucaagaucaagggcgaggagcucuccgaggccaacguccgccucucccuccucgagaagaagcucgacuccgccgccaaggacgccgacgagcgcaucgagaagguccagacccgccucgaggagacccaggcccuccuccgcaagaaggagaaggaguucgaggagaccauggacgcccuccaggccgacaucgaccagcucgaggccgagaaggccgagcucaagcagcgccucaacucccaguccaagcgcaccaucgagggccuccgcggccccccccccuccggcaucgccacccucgucuccggcaucgccggcggcgccauccccggccaggcccccggcuccguccccggccccggccucgucaaggacuccccccuccuccuccagcagaucuccgccaugcgccuccacaucucccagcuccagcacgagaacuccauccucaagggcgcccagaugaaggccucccucgccucccuccccccccuccacgucgccaagcucucccacgagggccccggcuccgagcuccccgccggcgcccucuaccgcaagaccucccagcuccucgagacccucaaccagcucuccacccacacccacgucgucgacaucacccgcaccucccccgccgccaagucccccuccgcccagcucauggagcaggucgcccagcucaagucccucuccgacaccgucgagaagcucaaggacgagguccucaaggagaccgucucccagcgccccggcgccaccguccccaccgacuucgccaccuuccccuccuccgccuuccuccgcgccaaggaggagcagcaggacgacaccgucuacaugggcaaggucaccuucuccugcgccgccggcuucggccagcgccaccgccucguccucacccaggagcagcuccaccagcuccacucccgccucaucuccuga

SEQ ID NO: 42098 - RNA, 1212 nt, Artificial Sequence
  derived and/or modified sequence opt2 from DCTN2__Homo_sapiens__NP_001248341
auggccgaccccaaguacgccgaccuccccggcaucgcccgcaacgagcccgacgucuacgagaccuccgaccuccccgaggacgaccaggccgaguucgacgccgagcucgaggagcucaccuccaccuccgucgagcacaucaucgucaaccccaacgccgccuacgacaaguucaaggacaagcgcgucggcaccaagggccucgacuucuccgaccgcaucggcaagaccaagcgcaccggcuacgaguccggcgaguacgagaugcucggcgagggccucggcgucaaggagaccccccagcagaaguaccagcgccuccuccacgagguccaggagcucaccaccgaggucgagaagaucaagaccaccgucaaggaguccgccaccgaggagaagcucacccccguccuccucgccaagcagcucgccgcccucaagcagcagcucgucgccucccaccucgagaagcuccucggccccgacgccgccaucaaccucaccgaccccgacggcgcccucgccaagcgccuccuccuccagcucgaggccaccaagaacuccaagggcggcuccggcggcaagaccaccggcaccccccccgacuccucccucgucaccuacgagcuccacucccgccccgagcaggacaaguucucccaggccgccaaggucgccgagcucgagaagcgccucaccgagcucgagaccgccguccgcugcgaccaggacgcccagaacccccucuccgccggccuccagggcgccugccucauggagaccgucgagcuccuccaggccaaggucuccgcccucgaccucgccguccucgaccaggucgaggcccgccuccaguccguccucggcaaggucaacgagaucgccaagcacaaggccuccgucgaggacgccgacacccaguccaagguccaccagcucuacgagaccauccagcgcuggucccccaucgccuccacccuccccgagcucguccagcgccucgucaccaucaagcagcuccacgagcaggccaugcaguucggccagcuccucacccaccucgacaccacccagcagaugaucgccaacucccucaaggacaacaccacccuccucacccagguccagaccaccaugcgcgagaaccucgccaccgucgagggcaacuucgccuccaucgacgagcgcaugaagaagcucggcaaguga

SEQ ID NO: 42099 - RNA, 477 nt, Artificial Sequence
  derived and/or modified sequence opt2 from DCTN3__Homo_sapiens__NP_001268354
auggccggccucaccgaccuccagcgccuccaggcccgcgucgaggagcucgagcgcugggucuacggccccggcggcgcccgcggcucccgcaaggucgccgacggccucgucaagguccaggucgcccucggcaacaucuccuccaagcgcgagcgcgucaagauccucuacaagaagaucgaggaccucaucaaguaccucgaccccgaguacaucgaccgcaucgccauccccgacgccuccaagcuccaguucauccucgccgccguccccgagcacgccgcccgccuccagcgccucgcccagauccacauccagcagcaggaccagugcgucgagaucaccgaggaguccaaggcccuccucgaggaguacaacaagaccaccaugcuccucuccaagcaguucguccagugggacgagcuccucugccagcucgaggccgccacccaggucaagcccgccgaggaguga

SEQ ID NO: 42100 - RNA, 1404 nt, Artificial Sequence
  derived and/or modified sequence opt2 from DCTN4__Homo_sapiens__NP_001129115
auggccucccuccuccaguccgaccgcguccucuaccucguccagggcgagaagaagguccgcgccccccucucccagcucuacuucugccgcuacugcuccgagcuccgcucccucgagugcgucucccacgaggucgacucccacuacugccccuccugccucgagaacaugcccuccgccgaggccaagcucaagaagaaccgcugcgccaacugcuucgacugccccggcugcaugcacacccucuccacccgcgccaccuccaucuccacccagcuccccgacgaccccgccaagaccaccaugaagaaggccuacuaccucgccugcggcuucugccgcuggaccucccgcgacgucggcauggccgacaaguccgucgccuccggcggcuggcaggagcccgagaacccccacacccagcgcaugaacaagcucaucgaguacuaccagcagcucgcccagaaggagaaggucgagcgcgaccgcaagaagcucgcccgccgccgcaacuacaugccccucgccuucucccagcacaccauccacgucgucgacaaguacggccucggcacccgccuccagcgcccccgcgccggcgccuccaucuccacccucgccggccucucccucaaggagggcgaggaccagaaggagaucaagaucgagcccgcccaggccgucgacgaggucgagccccuccccgaggacuacuacacccgccccgucaaccucaccgaggucaccacccuccagcagcgccuccuccagcccgacuuccagcccgucugcgccucccagcucuacccccgccacaagcaccuccucaucaagcgcucccuccgcugccgcaagugcgagcacaaccucuccaagcccgaguucaaccccaccuccaucaaguucaagauccagcucgucgccgucaacuacauccccgagguccgcaucauguccauccccaaccuccgcuacaugaaggagucccagguccuccucacccucaccaaccccgucgagaaccucacccacgucacccucuucgagugcgaggagggcgaccccgacgacaucaacuccaccgccaaggucgucgucccccccaaggagcucguccucgccggcaaggacgccgccgccgaguacgacgagcucgccgagccccaggacuuccaggacgaccccgacaucaucgccuuccgcaaggccaacaaggucggcaucuucaucaaggucaccccccagcgcgaggagggcgaggucaccgucugcuucaagaugaagcacgacuucaagaaccucgccgcccccauccgccccaucgaggaguccgaccagggcaccgaggucaucuggcucacccagcacgucgagcucucccucggcccccuccuccccuga

SEQ ID NO: 42101 - RNA, 255 nt, Artificial Sequence
  derived and/or modified sequence opt2 from DCTN5__Homo_sapiens__NP_001185940
auggagcucggcgagcuccucuacaacaaguccgaguacaucgagaccgccuccggcaacaaggucucccgccaguccguccucugcggcucccagaacaucguccucaacggcaagaacuucgucaucuccgucuuccucucccccuacauccgcugccacuccgccugccgcgaccgcaagcgcuccgacgaguccguccgccucuccgucaacaaccgcgagugguggggccucgucaacuggcgcauguga

SEQ ID NO: 42102 - RNA, 573 nt, Artificial Sequence
  derived and/or modified sequence opt2 from DCTN6__Homo_sapiens__NP_006562
auggccgagaagacccagaaguccgucaagaucgcccccggcgccgucgucugcgucgaguccgagauccgcggcgacgucaccaucggcccccgcaccgucauccaccccaaggcccgcaucaucgccgaggccggccccaucgucaucggcgagggcaaccucaucgaggagcaggcccucaucaucaacgccuaccccgacaacaucacccccgacaccgaggaccccgagcccaagcccaugaucaucggcaccaacaacgucuucgaggucggcugcuacucccaggccaugaagaugggcgacaacaacgucaucgaguccaaggccuacgucggccgcaacgucauccucaccuccggcugcaucaucggcgccugcugcaaccucaacaccuucgaggucauccccgagaacaccgucaucuacggcgccgacugccuccgccgcguccagaccgagcgcccccagccccagacccuccagcucgacuuccucaugaagauccuccccaacuaccaccaccucaagaagaccaugaagggcuccuccacccccgucaagaacuga

SEQ ID NO: 42103 - RNA, 780 nt, Artificial Sequence
  derived and/or modified sequence opt2 from DCUN1D1__Homo_sapiens__NP_065691
augaacaagcucaaguccucccagaaggacaagguccgccaguucaugaucuucacccaguccuccgagaagaccgccgucuccugccucucccagaacgacuggaagcucgacgucgccaccgacaacuucuuccagaaccccgagcucuacauccgcgaguccgucaagggcucccucgaccgcaagaagcucgagcagcucuacaaccgcuacaaggacccccaggacgagaacaagaucggcaucgacggcauccagcaguucugcgacgaccucgcccucgaccccgccuccaucuccguccucaucaucgccuggaaguuccgcgccgccacccagugcgaguucuccaagcaggaguucauggacggcaugaccgagcucggcugcgacuccaucgagaagcucaaggcccagauccccaagauggagcaggagcucaaggagcccggccgcuucaaggacuucuaccaguucaccuucaacuucgccaagaaccccggccagaagggccucgaccucgagauggccaucgccuacuggaaccucguccucaacggccgcuucaaguuccucgaccucuggaacaaguuccuccucgagcaccacaagcgcuccauccccaaggacaccuggaaccuccuccucgacuucuccaccaugaucgccgacgacauguccaacuacgacgaggagggcgccuggcccguccucaucgacgacuucgucgaguucgcccgcccccagaucgccggcaccaaguccaccaccgucuga

SEQ ID NO: 42104 - RNA, 1326 nt, Artificial Sequence
  derived and/or modified sequence opt2 from DCX__Homo_sapiens__NP_000546
augaagacccucccccuccacucccacugcaccgagaugcagcgccuccuccccaagcucgagaugcucacccucggcuccuccuucugcucccuccagggcgaguucugccaggccauggacuccuucaccaccgucucccacgucggcaugugcgaggagaccgacgccuccuucaacgucuucucccccaaguuccaguucgaccgcucccacugccagucccuccgcuuccaccagaacauggagcucgacuucggccacuucgacgagcgcgacaagaccucccgcaacaugcgcggcucccgcaugaacggccuccccucccccacccacuccgcccacugcuccuucuaccgcacccgcacccuccaggcccucuccaacgagaagaaggccaagaagguccgcuucuaccgcaacggcgaccgcuacuucaagggcaucgucuacgccgucuccuccgaccgcuuccgcuccuucgacgcccuccucgccgaccucacccgcucccucuccgacaacaucaaccucccccagggcguccgcuacaucuacaccaucgacggcucccgcaagaucggcuccauggacgagcucgaggagggcgaguccuacgucugcuccuccgacaacuucuucaagaaggucgaguacaccaagaacgucaaccccaacugguccgucaacgucaagaccuccgccaacaugaaggccccccagucccucgccuccuccaacuccgcccaggcccgcgagaacaaggacuucguccgccccaagcucgucaccaucauccgcuccggcgucaagccccgcaaggccguccgcguccuccucaacaagaagaccgcccacuccuucgagcagguccucaccgacaucaccgaggccaucaagcucgagaccggcgucgucaagaagcucuacacccucgacggcaagcaggucaccugccuccacgacuucuucggcgacgacgacgucuucaucgccugcggccccgagaaguuccgcuacgcccaggacgacuucucccucgacgagaacgagugccgcgucaugaagggcaaccccuccgccaccgccggccccaaggccucccccaccccccagaagaccuccgccaagucccccggccccaugcgccgcuccaagucccccgccgacuccgccaacggcaccuccuccucccagcucuccacccccaaguccaagcagucccccaucuccacccccaccucccccggcucccuccgcaagcacaaggaccucuaccucccccucucccucgacgacuccgacucccucggcgacuccauguga

SEQ ID NO: 42105 - RNA, 735 nt, Artificial Sequence
  derived and/or modified sequence opt2 from DCXR__Homo_sapiens__NP_057370
auggagcucuuccucgccggccgccgcguccucgucaccggcgccggcaagggcaucggccgcggcaccguccaggcccuccacgccaccggcgcccgcgucgucgccgucucccgcacccaggccgaccucgacucccucguccgcgagugccccggcaucgagcccgucugcgucgaccucggcgacugggaggccaccgagcgcgcccucggcuccgucggccccgucgaccuccucgucaacaacgccgccgucgcccuccuccagcccuuccucgaggucaccaaggaggccuucgaccgcuccuucgaggucaaccuccgcgccgucauccaggucucccagaucgucgcccgcggccucaucgcccgcggcguccccggcgccaucgucaacgucuccucccagugcucccagcgcgccgucaccaaccacuccgucuacugcuccaccaagggcgcccucgacaugcucaccaaggucauggcccucgagcucggcccccacaagauccgcgucaacgccgucaaccccaccgucgucaugaccuccaugggccaggccaccugguccgacccccacaaggccaagaccaugcucaaccgcaucccccucggcaaguucgccgaggucgagcacgucgucaacgccauccucuuccuccucuccgaccgcuccggcaugaccaccggcuccacccuccccgucgagggcggcuucugggccugcuga

SEQ ID NO: 42106 - RNA, 558 nt, Artificial Sequence
  derived and/or modified sequence opt2 from DDAH1__Homo_sapiens__XP_011539460
auggucgacaugaugaaggaggcccucgagaagcuccagcucaacaucgucgagaugaaggacgagaacgccacccucgacggcggcgacguccucuucaccggccgcgaguucuucgucggccucuccaagcgcaccaaccagcgcggcgccgagauccucgccgacaccuucaaggacuacgccgucuccaccguccccgucgccgacggccuccaccucaaguccuucugcuccauggccggccccaaccucaucgccaucggcuccuccgaguccgcccagaaggcccucaagaucaugcagcagauguccgaccaccgcuacgacaagcucaccguccccgacgacaucgccgccaacugcaucuaccucaacauccccaacaagggccacguccuccuccaccgcacccccgaggaguaccccgaguccgccaaggucuacgagaagcucaaggaccacaugcucauccccgucuccauguccgagcucgagaaggucgacggccuccucaccugcugcuccguccucaucaacaagaaggucgacuccuga

SEQ ID NO: 42107 - RNA, 858 nt, Artificial Sequence
  derived and/or modified sequence opt2 from DDAH2__Homo_sapiens__NP_001289937
augggcacccccggcgagggccucggccgcugcucccacgcccucauccgcggcguccccgagucccucgccuccggcgagggcgccggcgccggccuccccgcccucgaccucgccaaggcccagcgcgagcacggcguccucggcggcaagcuccgccagcgccucggccuccagcuccucgagcucccccccgaggagucccucccccucggcccccuccucggcgacaccgccgucauccagggcgacaccgcccucaucacccgccccuggucccccgcccgccgccccgaggucgacggcguccgcaaggcccuccaggaccucggccuccgcaucgucgagaucggcgacgagaacgccacccucgacggcaccgacguccucuucaccggccgcgaguucuucgucggccucuccaaguggaccaaccaccgcggcgccgagaucgucgccgacaccuuccgcgacuucgccgucuccaccguccccgucuccggccccucccaccuccgcggccucugcggcaugggcggcccccgcaccgucgucgccggcuccuccgacgccgcccagaaggccguccgcgccauggccguccucaccgaccaccccuacgccucccucacccuccccgacgacgccgccgccgacugccucuuccuccgccccggccuccccggcgucccccccuuccuccuccaccgcggcggcggcgaccuccccaacucccaggaggcccuccagaagcucuccgacgucacccucguccccgucuccugcuccgagcucgagaaggccggcgccggccucuccucccucugccucguccucuccacccgcccccacuccuga

SEQ ID NO: 42108 - RNA, 3423 nt, Artificial Sequence
  derived and/or modified sequence opt2 from DDB1__Homo_sapiens__NP_001914
auguccuacaacuacgucgucaccgcccagaagcccaccgccgucaacggcugcgucaccggccacuucaccuccgccgaggaccucaaccuccucaucgccaagaacacccgccucgagaucuacgucgucaccgccgagggccuccgccccgucaaggaggucggcauguacggcaagaucgccgucauggagcucuuccgccccaagggcgaguccaaggaccuccucuucauccucaccgccaaguacaacgccugcauccucgaguacaagcaguccggcgaguccaucgacaucaucacccgcgcccacggcaacguccaggaccgcaucggccgccccuccgagaccggcaucaucggcaucaucgaccccgagugccgcaugaucggccuccgccucuacgacggccucuucaaggucaucccccucgaccgcgacaacaaggagcucaaggccuucaacauccgccucgaggagcuccacgucaucgacgucaaguuccucuacggcugccaggcccccaccaucugcuucgucuaccaggacccccagggccgccacgucaagaccuacgaggucucccuccgcgagaaggaguucaacaagggccccuggaagcaggagaacgucgaggccgaggccuccauggucaucgccguccccgagcccuucggcggcgccaucaucaucggccaggaguccaucaccuaccacaacggcgacaaguaccucgccaucgccccccccaucaucaagcaguccaccaucgucugccacaaccgcgucgaccccaacggcucccgcuaccuccucggcgacauggagggccgccucuucaugcuccuccucgagaaggaggagcagauggacggcaccgucacccucaaggaccuccgcgucgagcuccucggcgagaccuccaucgccgagugccucaccuaccucgacaacggcgucgucuucgucggcucccgccucggcgacucccagcucgucaagcucaacgucgacuccaacgagcagggcuccuacgucgucgccauggagaccuucaccaaccucggccccaucgucgacaugugcgucgucgaccucgagcgccagggccagggccagcucgucaccugcuccggcgccuucaaggagggcucccuccgcaucauccgcaacggcaucggcauccacgagcacgccuccaucgaccuccccggcaucaagggccucuggccccuccgcuccgaccccaaccgcgagaccgacgacacccucguccucuccuucgucggccagacccgcguccucaugcucaacggcgaggaggucgaggagaccgagcucaugggcuucgucgacgaccagcagaccuucuucugcggcaacgucgcccaccagcagcucauccagaucaccuccgccuccguccgccucgucucccaggagcccaaggcccucgucuccgaguggaaggagccccaggccaagaacaucuccgucgccuccugcaacuccucccaggucgucgucgccgucggccgcgcccucuacuaccuccagauccacccccaggagcuccgccagaucucccacaccgagauggagcacgaggucgccugccucgacaucaccccccucggcgacuccaacggccucuccccccucugcgccaucggccucuggaccgacaucuccgcccgcauccucaagcuccccuccuucgagcuccuccacaaggagaugcucggcggcgagaucaucccccgcuccauccucaugaccaccuucgaguccucccacuaccuccucugcgcccucggcgacggcgcccucuucuacuucggccucaacaucgagaccggccuccucuccgaccgcaagaaggucacccucggcacccagcccaccguccuccgcaccuuccgcucccucuccaccaccaacgucuucgccugcuccgaccgccccaccgucaucuacuccuccaaccacaagcucgucuucuccaacgucaaccucaaggaggucaacuacaugugcccccucaacuccgacggcuaccccgacucccucgcccucgccaacaacuccacccucaccaucggcaccaucgacgagauccagaagcuccacauccgcaccgucccccucuacgaguccccccgcaagaucugcuaccaggaggucucccagugcuucggcguccucuccucccgcaucgagguccaggacaccuccggcggcaccaccgcccuccgccccuccgccuccacccaggcccucuccuccuccgucuccuccuccaagcucuucuccuccuccaccgccccccacgagaccuccuucggcgaggaggucgagguccacaaccuccucaucaucgaccagcacaccuucgagguccuccacgcccaccaguuccuccagaacgaguacgcccucucccucgucuccugcaagcucggcaaggaccccaacaccuacuucaucgucggcaccgccauggucuaccccgaggaggccgagcccaagcagggccgcaucgucgucuuccaguacuccgacggcaagcuccagaccgucgccgagaaggaggucaagggcgccgucuacuccauggucgaguucaacggcaagcuccucgccuccaucaacuccaccguccgccucuacgaguggaccaccgagaaggagcuccgcaccgagugcaaccacuacaacaacaucauggcccucuaccucaagaccaagggcgacuucauccucgucggcgaccucaugcgcuccguccuccuccucgccuacaagcccauggagggcaacuucgaggagaucgcccgcgacuucaaccccaacuggauguccgccgucgagauccucgacgacgacaacuuccucggcgccgagaacgccuucaaccucuucgucugccagaaggacuccgccgccaccaccgacgaggagcgccagcaccuccaggaggucggccucuuccaccucggcgaguucgucaacgucuucugccacggcucccucgucaugcagaaccucggcgagaccuccacccccacccagggcuccguccucuucggcaccgucaacggcaugaucggccucgucaccucccucuccgaguccugguacaaccuccuccucgacaugcagaaccgccucaacaaggucaucaaguccgucggcaagaucgagcacuccuucuggcgcuccuuccacaccgagcgcaagaccgagcccgccaccggcuucaucgacggcgaccucaucgaguccuuccucgacaucucccgccccaagaugcaggaggucgucgccaaccuccaguacgacgacggcuccggcaugaagcgcgaggccaccgccgacgaccucaucaaggucgucgaggagcucacccgcauccacuga

SEQ ID NO: 42109 - RNA, 1284 nt, Artificial Sequence
  derived and/or modified sequence opt2 from DDB2__Homo_sapiens__NP_000098
auggcccccaagaagcgccccgagacccagaagaccuccgagaucguccuccgcccccgcaacaagcgcucccgcuccccccucgagcucgagcccgaggccaagaagcucugcgccaagggcuccggccccucccgccgcugcgacuccgacugccucugggucggccucgccggcccccagauccucccccccugccgcuccaucguccgcacccuccaccagcacaagcucggccgcgccuccuggcccuccguccagcagggccuccagcaguccuuccuccacacccucgacuccuaccgcauccuccagaaggccgcccccuucgaccgccgcgccaccucccucgccuggcaccccacccaccccuccaccgucgccgucggcuccaagggcggcgacaucaugcucuggaacuucggcaucaaggacaagcccaccuucaucaagggcaucggcgccggcggcuccaucaccggccucaaguucaacccccucaacaccaaccaguucuacgccuccuccauggagggcaccacccgccuccaggacuucaagggcaacauccuccgcgucuucgccuccuccgacaccaucaacaucugguucugcucccucgacgucuccgccuccucccgcauggucgucaccggcgacaacgucggcaacgucauccuccucaacauggacggcaaggagcucuggaaccuccgcaugcacaagaagaaggucacccacgucgcccucaaccccugcugcgacugguuccucgccaccgccuccgucgaccagaccgucaagaucugggaccuccgccagguccgcggcaaggccuccuuccucuacucccucccccaccgccaccccgucaacgccgccugcuucucccccgacggcgcccgccuccucaccaccgaccagaaguccgagauccgcgucuacuccgccucccagugggacugcccccucggccucaucccccacccccaccgccacuuccagcaccucacccccaucaaggccgccuggcacccccgcuacaaccucaucgucgucggccgcuaccccgaccccaacuucaaguccugcacccccuacgagcuccgcaccaucgacgucuucgacggcaacuccggcaagaugaugugccagcucuacgaccccgaguccuccggcaucuccucccucaacgaguucaaccccaugggcgacacccucgccuccgccaugggcuaccacauccucaucuggucccaggaggaggcccgcacccgcaaguga

SEQ ID NO: 42110 - RNA, 1443 nt, Artificial Sequence
  derived and/or modified sequence opt2 from DDC__Homo_sapiens__NP_000781
augaacgccuccgaguuccgccgccgcggcaaggagauggucgacuacgucgccaacuacauggagggcaucgagggccgccaggucuaccccgacgucgagcccggcuaccuccgcccccucauccccgccgccgccccccaggagcccgacaccuucgaggacaucaucaacgacgucgagaagaucaucaugcccggcgucacccacuggcacucccccuacuucuucgccuacuuccccaccgccuccuccuaccccgccaugcucgccgacaugcucugcggcgccaucggcugcaucggcuucuccugggccgccucccccgccugcaccgagcucgagaccgucaugauggacuggcucggcaagaugcucgagcuccccaaggccuuccucaacgagaaggccggcgagggcggcggcgucauccagggcuccgccuccgaggccacccucgucgcccuccucgccgcccgcaccaaggucauccaccgccuccaggccgccucccccgagcucacccaggccgccaucauggagaagcucgucgccuacuccuccgaccaggcccacuccuccgucgagcgcgccggccucaucggcggcgucaagcucaaggccauccccuccgacggcaacuucgccaugcgcgccuccgcccuccaggaggcccucgagcgcgacaaggccgccggccucauccccuucuucauggucgccacccucggcaccaccaccugcugcuccuucgacaaccuccucgaggucggccccaucugcaacaaggaggacaucuggcuccacgucgacgccgccuacgccggcuccgccuucaucugccccgaguuccgccaccuccucaacggcgucgaguucgccgacuccuucaacuucaacccccacaaguggcuccucgucaacuucgacugcuccgccaugugggucaagaagcgcaccgaccucaccggcgccuuccgccucgaccccaccuaccucaagcacucccaccaggacuccggccucaucaccgacuaccgccacuggcagaucccccucggccgccgcuuccgcucccucaagaugugguucgucuuccgcauguacggcgucaagggccuccaggccuacauccgcaagcacguccagcucucccacgaguucgagucccucguccgccaggacccccgcuucgagaucugcgucgaggucauccucggccucgucugcuuccgccucaagggcuccaacaaggucaacgaggcccuccuccagcgcaucaacuccgccaagaagauccaccucguccccugccaccuccgcgacaaguucguccuccgcuucgccaucugcucccgcaccgucgaguccgcccacguccagcgcgccugggagcacaucaaggagcucgccgccgacguccuccgcgccgagcgcgaguga

SEQ ID NO: 42111 - RNA, 2640 nt, Artificial Sequence
  derived and/or modified sequence opt2 from DDHD1__Homo_sapiens__NP_001153619
augaacuaccccggccgcggcuccccccgcucccccgagcacaacggccgcggcggcggcggcggcgccugggagcucggcuccgacgcccgccccgccuucggcggcggcgucugcugcuucgagcaccuccccggcggcgaccccgacgacggcgacgucccccucgcccuccuccgcggcgagcccggccuccaccucgcccccggcaccgacgaccacaaccaccaccucgcccucgaccccugccucuccgacgagaacuacgacuucuccuccgccgaguccggcuccucccuccgcuacuacuccgagggcgaguccggcggcggcggcuccucccucucccuccaccccccccagcagcccccccucguccccaccaacuccggcggcggcggcgccaccggcggcucccccggcgagcgcaagcgcacccgccucggcggccccgccgcccgccaccgcuacgaggucgucaccgagcucggccccgaggagguccgcugguucuacaaggaggacaagaagaccuggaagcccuucaucggcuacgacucccuccgcaucgagcucgccuuccgcacccuccuccagaccaccggcgcccgcccccagggcggcgaccgcgacggcgaccacgucugcucccccaccggccccgccuccuccuccggcgaggacgacgacgaggaccgcgccugcggcuucugccaguccaccaccggccacgagcccgagauggucgagcucgucaacaucgagcccgucugcguccgcggcggccucuacgaggucgacgucacccagggcgagugcuaccccgucuacuggaaccaggccgacaagauccccgucaugcgcggccagugguucaucgacggcaccuggcagccccucgaggaggaggaguccaaccucaucgagcaggagcaccucaacugcuuccgcggccagcagaugcaggagaacuucgacaucgaggucuccaaguccaucgacggcaaggacggcuccggcaucaacuacuccgccguccacuccuucaagcucucccgcaaccacgucgacuggcacuccgucgacgaggucuaccucuacuccgacgccaccaccuccaagaucgcccgcaccgucacccagaagcucggcuucuccaaggccuccuccuccggcacccgccuccaccgcggcuacgucgaggaggccacccucgaggacaagcccucccagaccacccacaucgucuucgucguccacggcaucggccagaagauggaccagggccgcaucaucaagaacaccgccaugaugcgcgaggccgcccgcaagaucgaggagcgccacuucuccaaccacgccacccacgucgaguuccuccccgucgaguggcgcuccaagcucacccucgacggcgacaccgucgacuccaucacccccgacaagguccgcggccuccgcgacaugcucaacuccuccgccauggacaucauguacuacaccuccccccucuaccgcgacgagcucgucaagggccuccagcaggagcucaaccgccucuacucccucuucugcucccgcaaccccgacuucgaggagaagggcggcaaggucuccaucgucucccacucccucggcugcgucaucaccuacgacaucaugaccggcuggaaccccguccgccucuacgagcagcuccuccagaaggaggaggagcuccccgacgagcgcuggauguccuacgaggagcgccaccuccucgacgagcucuacaucaccaagcgccgccucaaggagaucgaggagcgccuccacggccucaaggccuccuccaugacccagacccccgcccucaaguucaaggucgagaacuucuucugcaugggcuccccccucgccgucuuccucgcccuccgcggcauccgccccggcaacaccggcucccaggaccacauccucccccgcgagaucugcaaccgccuccucaacaucuuccaccccaccgaccccgucgccuaccgccucgagccccucauccucaagcacuacuccaacaucucccccguccagauccacugguacaacaccuccaacccccuccccuacgagcacaugaagcccuccuuccucaaccccgccaaggagcccaccuccgucuccgagaacgagggcaucuccaccauccccucccccgucaccucccccguccucucccgccgccacuacggcgaguccaucaccaacaucggcaaggccuccauccucggcgccgccuccaucggcaagggccucggcggcaugcucuucucccgcuucggccgcuccuccaccacccaguccuccgagaccuccaaggacuccauggaggacgagaagaagcccgucgccucccccuccgccaccaccgucggcacccagacccucccccacuccuccuccggcuuccucgacuccgcccucgagcucgaccaccgcaucgacuucgagcuccgcgagggccucgucgagucccgcuacugguccgccgucaccucccacaccgccuacugguccucccucgacgucgcccucuuccuccucaccuucauguacaagcacgagcacgacgacgacgccaagcccaaccucgaccccaucuga

SEQ ID NO: 42112 - RNA, 684 nt, Artificial Sequence
  derived and/or modified sequence opt2 from DDHD2__Homo_sapiens__NP_001157706
auguccuccguccagucccagcaggagcagcucucccaguccgaccccucccccucccccaacuccugcuccuccuucgagcucaucgacauggacgccggcucccucuacgagcccgucuccccccacugguucuacugcaagaucaucgacuccaaggagaccuggauccccuucaacuccgaggacucccagcagcucgaggaggccuacuccuccggcaagggcugcaacggccgcgucguccccaccgacggcggccgcuacgacguccaccucggcgagcgcaugcgcuacgccgucuacugggacgagcucgccuccgagguccgccgcugcaccugguucuacaagggcgacaaggacaacaaguacguccccuacuccgaguccuucucccagguccucgaggagaccuacaugcucgccgucacccucgacgaguggaagaagaagcucgagucccccaaccgcgagaucaucauccuccacaaccccaagcucaugguccacuaccagcccgucgccggcuccgacgacuggggcuccacccccaccgagcagggccgcccccgcaccgucaagcgcggcgucgagaacaucuccgucgacauccacugcggcaacgucaaccgccucuucuuccucaccuucggcugcaucugccuccuccucaagcucuga

SEQ ID NO: 42113 - RNA, 1191 nt, Artificial Sequence
  derived and/or modified sequence opt2 from DDI1__Homo_sapiens__NP_001001711
augcucaucaccgucuacugcguccgccgcgaccucuccgaggucaccuucucccuccaggucucccccgacuucgagcuccgcaacuucaagguccucugcgaggccgagucccgcguccccgucgaggagauccagaucauccacauggagcgccuccucaucgaggaccacugcucccucggcuccuacggccucaaggacggcgacaucgucguccuccuccagaaggacaacgucggcccccgcgcccccggccgcgcccccaaccagccccgcgucgacuucuccggcaucgccguccccggcaccuccuccucccgcccccagcaccccggccagcagcagcagcgcacccccgccgcccagcgcucccagggccucgccuccggcgagaaggucgccggccuccagggccucggcucccccgcccucauccgcuccaugcuccucuccaacccccacgaccucucccuccucaaggagcgcaaccccccccucgccgaggcccuccucuccggcucccucgagaccuucucccagguccucauggagcagcagcgcgagaaggcccuccgcgagcaggagcgccuccgccucuacaccgccgacccccucgaccgcgaggcccaggccaagaucgaggaggagauccgccagcagaacaucgaggagaacaugaacaucgccaucgaggaggcccccgaguccuucggccaggucaccaugcucuacaucaacugcaaggucaacggccacccccucaaggccuucgucgacuccggcgcccagaugaccaucaugucccaggccugcgccgagcgcugcaacaucaugcgccucgucgaccgccgcugggccggcgucgccaagggcgucggcacccagcgcaucaucggccgcguccaccucgcccagauccagaucgagggcgacuuccuccagugcuccuucuccauccucgaggaccagcccauggacaugcuccucggccucgacaugcuccgccgccaccagugcuccaucgaccucaagaagaacguccucgucaucggcaccaccggcacccagaccuacuuccuccccgagggcgagcucccccucugcucccgcauggucuccggccaggacgaguccuccgacaaggagaucacccacuccgucauggacuccggccgcaaggagcacuga

SEQ ID NO: 42114 - RNA, 2997 nt, Artificial Sequence
  derived and/or modified sequence opt2 from DDIAS__Homo_sapiens__NP_659455
augaaccgccgccgcaaguuccuccucgccuccguccucgcccuccagaacuccuccuucaucuaccccuccugccagaagugcuucucccgcaucauccucgucuccaagcgcuccaacugccccaagugcggcuccaccggcgaguccggcaacgccaacuaccgcuacaagcucucccucaaggucgccgaguccaacaagcucuucgucaucaccgucuucggcuccugccucgacaccuucuucggccucaccgccaccggccuccaccgcuacauccaggaccccaacaagauccccgagacccucgacaacgacaccacccagaaccuccucaccaaggccgucgagaccugcuucgucggccaguccuucaucuucggcgucaccaacuucgagaaccagcccggccagggcuccgacgccuccaacuuccuccagcagugcuccgaccacaagcgcaaggccaaggcccucgucgccugccagaucguccuccccgaccccggcaucgccggcuucaccgucaucgacuacuuccaccagcuccuccagaccuucaacuuccgcaagcuccagugcgacucccaggcccccaacaaccaccuccucgcccucgaccacuccaacuccgaccucuccuccaucuacaccuccgacuccaccuccgacuucuucaaguccugcuccaaggacaccuucuccaaguucuggcagcccucccucgaguucaccugcaucgucucccagcucaccgacaacgacgacuucuccgccuccgagcaguccaaggccuucggcacccuccagcagaaccgcaaguccaucuccaucgccgaggccaccggcuccuccuccugccacgaccccauccaggacuccuggucccucgucuccuacauggacaagaaguccaccgccgagaagcucggcaaggagcucggccuccaggccaaggagcucuccgccguccacuccucccaccacgagaucggcgucaacgacuccaaccucuucucccucgagaugcgcgagccccucgaguccuccaacaccaaguccuuccacuccgccgucgagaucaagaaccgcucccagcacgagcuccccugcuuccagcaccacggcaucgacacccccaccucccuccagaagcgcuccgccugcugcccccccucccuccuccgccucgaggagaccgccuccuccucccaggacggcgacccccagaucugggacgaccuccccuucuccgagucccucaacaaguuccucgccguccucgaguccgagaucgccgucacccaggccgacgucuccucccgcaagcaccacgucgacaacgacaucgacaaguuccacgccgaccacucccgccucuccgucaccccccagcgcaccaccggcgcccuccacaccccccccaucgcccuccgcuccucccaggucaucgucaaggccaacugcuccaaggacgacuuccucuucaacugcaagggcaaccucucccccuccgucgagaaggagucccagcccgacaacaaggucgaggccgucuccgucaaccacaacggccgcgacauguccgaguacuuccuccccaaccccuaccucuccgcccucuccuccuccuccaaggaccucgagaccaucgucacccucaagaagaccauccgcaucuccccccaccgcgaguccgaccacuccucccucaacaacaaguaccucaacggcugcggcgagaucuccgucuccgagaugaacgagaagcucaccacccucugcuaccgcaaguacaacgacgucuccgaccucugcaagcucgagaacaagcaguacugccgcugguccaagaaccaggacgacuccuucaccaucugccgcaagcucaccuacccccucgagacccucugcaacucccccaaccgcuccaccaacacccucaaggagaugcccuggggccacaucaacaacaacgucacccaguccuacuccaucggcuacgagggcuccuacgacgccuccgccgaccucuucgacgacaucgccaaggagauggacaucgccaccgagaucaccaagaagucccaggacauccuccucaaguggggcaccucccucgccgagucccaccccuccgaguccgacuucucccuccgcucccucuccgaggacuucauccagcccucccagaagcucucccuccagucccucuccgacucccgccacucccgcaccugcucccccaccccccacuuccaguccgacuccgaguacaacuucgagaacucccaggacuucguccccugcucccaguccacccccaucuccggcuuccaccagacccgcauccacggcaucaaccgcgccuucaagaagcccgucuucuacuccgaccucgacggcaacuacgagaagauccgcaucuuccccgagaacgacaagcagcaggccucccccuccugccccaagaacaucaagacccccucccagaagauccgcucccccaucgucuccggcgucucccagcccgacgucuucaaccacuaccccuucgccgagugccacgagaccgacuccgacgagugggucccccccaccacccagaagaucuuccccuccgacaugcucggcuuccagggcaucggccucggcaagugccucgccgccuaccacuuccccgaccagcaggagcucccccgcaagaagcucaagcacauccgccagggcaccaacaagggccucaucaagaagaagcucaagaacaugcucgccgccgucgucaccaagaagaagacccacaaguacaacugcaaguccuccggcuggaucuccaagugccccgacauccagguccucgccgccccccagcuccaccccauccucggccccgacuccugcuccgaggucaagugcugccuccccuucuccgagaagggcccccccuccgucugcgagacccgcuccgccuggucccccgagcucuucuccuga

SEQ ID NO: 42115 - RNA, 579 nt, Artificial Sequence
  derived and/or modified sequence opt2 from DDIT3__Homo_sapiens__NP_001181983
auggagcucguccccgccaccccccacuaccccgccgacguccucuuccagaccgaccccaccgccgagauggccgccgagucccuccccuucuccuucggcacccucuccuccugggagcucgaggccugguacgaggaccuccaggagguccucuccuccgacgagaacggcggcaccuacgucuccccccccggcaacgaggaggaggaguccaagaucuucaccacccucgaccccgccucccucgccuggcucaccgaggaggagcccgagcccgccgaggucaccuccaccucccaguccccccacucccccgacuccucccaguccucccucgcccaggaggaggaggaggaggaccagggccgcacccgcaagcgcaagcaguccggccacucccccgcccgcgccggcaagcagcgcaugaaggagaaggagcaggagaacgagcgcaaggucgcccagcucgccgaggagaacgagcgccucaagcaggagaucgagcgccucacccgcgaggucgaggccacccgccgcgcccucaucgaccgcauggucaaccuccaccaggccuga

SEQ ID NO: 42116 - RNA, 699 nt, Artificial Sequence
  derived and/or modified sequence opt2 from DDIT4__Homo_sapiens__NP_061931
augcccucccucugggaccgcuucuccuccuccuccaccuccuccucccccuccucccucccccgcacccccacccccgaccgccccccccgcuccgccuggggcuccgccacccgcgaggagggcuucgaccgcuccaccucccucgaguccuccgacugcgagucccucgacuccuccaacuccggcuucggccccgaggaggacaccgccuaccucgacggcgucucccuccccgacuucgagcuccucuccgaccccgaggacgagcaccucugcgccaaccucaugcagcuccuccaggagucccucgcccaggcccgccucggcucccgccgccccgcccgccuccucaugcccucccagcucgucucccaggucggcaaggagcuccuccgccucgccuacuccgagcccugcggccuccgcggcgcccuccucgacgucugcgucgagcagggcaaguccugccacuccgucggccagcucgcccucgaccccucccucguccccaccuuccagcucacccucguccuccgccucgacucccgccucuggcccaagauccagggccucuucuccuccgccaacucccccuuccuccccggcuucucccagucccucacccucuccaccggcuuccgcgucaucaagaagaagcucuacuccuccgagcagcuccucaucgaggagugcuga

SEQ ID NO: 42117 - RNA, 582 nt, Artificial Sequence
  derived and/or modified sequence opt2 from DDIT4L__Homo_sapiens__NP_660287
auggucgccaccggcucccucuccuccaagaaccccgccuccaucuccgagcuccucgacugcggcuaccaccccgagucccuccucuccgacuucgacuacugggacuacgucguccccgagcccaaccucaacgaggucaucuucgaggaguccaccugccagaaccucgucaagaugcucgagaacugccucuccaaguccaagcagaccaagcucggcugcuccaagguccucguccccgagaagcucacccagcgcaucgcccaggacguccuccgccucuccuccaccgagcccugcggccuccgcggcugcgucaugcacgucaaccucgagaucgagaacgucugcaagaagcucgaccgcaucgucugcgacuccuccgucguccccaccuucgagcucacccucgucuucaagcaggagaacugcuccuggaccuccuuccgcgacuucuucuucucccgcggccgcuucuccuccggcuuccgccgcacccucauccucuccuccggcuuccgccucgucaagaagaagcucuacucccucaucggcaccaccgucaucgagggcuccuga

SEQ ID NO: 42118 - RNA, 2136 nt, Artificial Sequence
  derived and/or modified sequence opt2 from DDN__Homo_sapiens__NP_055901
augcucgacggcccccucuucuccgagggccccgacuccccccgcgagcuccaggacgaggaguccggcuccugccucuggguccagaaguccaagcuccucgucaucgaggucaagaccaucuccugccacuacucccgccgcgcccccucccgccagcccauggacuuccaggccucccacugggcccgcggcuuccagaaccgcaccugcggcccccgccccggcuccccccagccccccccccgccgccccugggccucccgcguccuccaggaggccaccaacuggcgcgccggcccccucgccgagguccgcgcccgcgagcaggagaagcgcaaggccgccucccaggagcgcgaggccaaggagaccgagcgcaagcgccgcaaggccggcggcgcccgccgcuccccccccggccgcccccgccccgagccccgcaacgccccccgcgucgcccagcucgccggccuccccgccccccuccgccccgagcgccucgcccccgucggccgcgccccccgccccuccgcccagccccaguccgaccccggcuccgccugggccggccccuggggcggccgccgccccggcccccccuccuacgaggcccaccuccuccuccgcggcuccgccggcaccgccccccgccgccgcugggaccgccccccccccuacgucgccccccccuccuacgagggcccccaccgcacccucggcaccaagcgcggccccggcaacucccagguccccaccuccuccgcccccgccgccacccccgcccgcaccgacggcggccgcaccaagaagcgccucgacccccgcaucuaccgcgacguccucggcgccuggggccuccgccagggccagggccuccucggcggcucccccggcugcggcgccgcccgcgcccgccccgagcccggcaagggcgucgucgagaagucccucggccucgccgccgccgaccucaacuccggcuccgacucccacccccaggccaaggccaccggcuccgccggcaccgagaucgcccccgccggcuccgccaccgccgcccccugcgccccccaccccgccccccgcucccgccaccaccucaagggcucccgcgagggcaaggagggcgagcagaucugguuccccaagugcuggauccccucccccaagaagcagcccccccgccacucccagacccucccccgccccugggcccccggcggcaccggcuggcgcgagucccucggccucggcgagggcgccggccccgagacccucgagggcuggaaggccacccgccgcgcccacacccucccccgcuccucccagggccucucccgcggcgagggcgucuucgucaucgacgccaccugcgucgucauccgcucccaguacguccccaccccccgcacccagcagguccagcuccuccccuccggcgucacccgcgucgucggcgacucccccucccaguccaagcccggcaaggaggagggcgagggcgccaccgucuuccccucccccugccagaagcgccucuccuccucccgccuccuccaccagcccggcggcggccgcggcggcgaggccgagggcggccgccccggcgacuccacccucgaggagcgcaccuuccgcauccucggccuccccgcccccgaggucaaccuccgcgacgcccccacccagcccggcucccccgagcaccaggcccucggccccgccgccuccggcgcccagggccgcgccgagggcuccgaggucgccgucguccagcgccgcgccggccgcggcugggcccgcacccccggccccuacgccggcgcccuccgcgaggccgucucccgcauccgccgccacaccgcccccgacuccgacaccgacgaggccgaggagcucuccguccacuccggcuccuccgacggcuccgacaccgaggcccccggcgccuccuggcgcaacgagcgcacccuccccgaggucggcaacuccucccccgaggaggacggcaagaccgccgagcucuccgacuccgucggcgagauccucgacgucaucucccagaccgaggagguccucuucggcguccgcgacauccgcggcacccagcagggcaaccgcaagcgccaguga

SEQ ID NO: 42119 - RNA, 1110 nt, Artificial Sequence
  derived and/or modified sequence opt2 from DDO__Homo_sapiens__NP_003640
augcgccccgcccgccacugggagacccgcuucggcgcccgcgacuucggcggcuuccaggacugcuucuuccgcgaccgccucauggacaccgcccgcaucgccgucgucggcgccggcgucgucggccucuccaccgccgucugcaucuccaagcucgucccccgcugcuccgucaccaucaucuccgacaaguucacccccgacaccaccuccgacgucgccgccggcaugcucaucccccacaccuaccccgacacccccauccacacccagaagcagugguuccgcgagaccuucaaccaccucuucgccaucgccaacuccgccgaggccggcgacgccggcguccaccucgucuccggcuggcagaucuuccaguccacccccaccgaggagguccccuucugggccgacgucguccucggcuuccgcaagaugaccgaggccgagcucaagaaguucccccaguacgucuucggccaggccuucaccacccucaagugcgagugccccgccuaccuccccuggcucgagaagcgcaucaagggcuccggcggcuggacccucacccgccgcaucgaggaccucugggagcuccaccccuccuucgacaucgucgucaacugcuccggccucggcucccgccagcucgccggcgacuccaagaucuuccccguccgcggccagguccuccagguccaggcccccugggucgagcacuucauccgcgacggcuccggccucaccuacaucuaccccggcaccucccacgucacccucggcggcacccgccagaagggcgacuggaaccucucccccgacgccgagaacucccgcgagauccucucccgcugcugcgcccucgagcccucccuccacggcgccugcaacauccgcgagaaggucggccuccgccccuaccgccccggcguccgccuccagaccgagcuccucgcccgcgacggccagcgccuccccgucguccaccacuacggccacggcuccggcggcaucuccguccacuggggcaccgcccucgaggccgcccgccucgucuccgagugcguccacgcccuccgcacccccauccccaaguccaaccucuga

SEQ ID NO: 42120 - RNA, 1527 nt, Artificial Sequence
  derived and/or modified sequence opt2 from DDR1__Homo_sapiens__NP_001189450
augggccccgaggcccucuccucccuccuccuccuccuccucgucgccuccggcgacgccgacaugaagggccacuucgaccccgccaagugccgcuacgcccucggcaugcaggaccgcaccauccccgacuccgacaucuccgccuccuccuccugguccgacuccaccgccgcccgccacucccgccucgaguccuccgacggcgacggcgccuggugccccgccggcuccgucuuccccaaggaggaggaguaccuccaggucgaccuccagcgccuccaccucgucgcccucgucggcacccagggccgccacgccggcggccucggcaaggaguucucccgcuccuaccgccuccgcuacucccgcgacggccgccgcuggaugggcuggaaggaccgcuggggccaggaggucaucuccggcaacgaggaccccgagggcgucguccucaaggaccucggcccccccauggucgcccgccucguccgcuucuacccccgcgccgaccgcgucauguccgucugccuccgcgucgagcucuacggcugccucuggcgcgacggccuccucuccuacaccgcccccgucggccagaccauguaccucuccgaggccgucuaccucaacgacuccaccuacgacggccacaccgucggcggccuccaguacggcggccucggccagcucgccgacggcgucgucggccucgacgacuuccgcaagucccaggagcuccgcgucuggcccggcuacgacuacgucggcugguccaaccacuccuucuccuccggcuacgucgagauggaguucgaguucgaccgccuccgcgccuuccaggccaugcagguccacugcaacaacaugcacacccucggcgcccgccuccccggcggcgucgagugccgcuuccgccgcggccccgccauggccugggagggcgagcccaugcgccacaaccucggcggcaaccucggcgacccccgcgcccgcgccgucuccgucccccucggcggccgcgucgcccgcuuccuccagugccgcuuccucuucgccggccccuggcuccucuucuccgagaucuccuucaucuccgacgucgucaacaacuccucccccgcccucggcggcaccuucccccccgcccccugguggccccccggccccccccccaccaacuucuccucccucgagcucgagccccgcggccagcagcccgucgccaaggccgagggcucccccaccgccauccucaucggcugccucgucgccaucauccuccuccuccuccucaucaucgcccucaugcucuggcgccuccacuggcgccgccuccucuccaaggccgagcgccgcguccucgaggaggagcucaccguccaccucuccguccccggcgacaccauccucaucaacaaccgccccggcccccgcgagcccccccccuaccaggagccccgcccccgcggcaaccccccccacuccgcccccugcguccccaacggcuccggcgcccccgucuga

SEQ ID NO: 42121 - RNA, 2568 nt, Artificial Sequence
  derived and/or modified sequence opt2 from DDR2__Homo_sapiens__XP_011507889
augauccucaucccccgcaugcuccucguccucuuccuccuccuccccauccucuccuccgccaaggcccaggucaaccccgccaucugccgcuacccccucggcauguccggcggccagauccccgacgaggacaucaccgccuccucccagugguccgaguccaccgccgccaaguacggccgccucgacuccgaggagggcgacggcgccuggugccccgagauccccgucgagcccgacgaccucaaggaguuccuccagaucgaccuccacacccuccacuucaucacccucgucggcacccagggccgccacgccggcggccacggcaucgaguucgcccccauguacaagaucaacuacucccgcgacggcacccgcuggaucuccuggcgcaaccgccacggcaagcagguccucgacggcaacuccaaccccuacgacaucuuccucaaggaccucgagccccccaucgucgcccgcuucguccgcuucauccccgucaccgaccacuccaugaacgucugcaugcgcgucgagcucuacggcugcgucuggcucgacggccucgucuccuacaacgcccccgccggccagcaguucguccuccccggcggcuccaucaucuaccucaacgacuccgucuacgacggcgccgucggcuacuccaugaccgagggccucggccagcucaccgacggcgucuccggccucgacgacuucacccagacccacgaguaccacgucuggcccggcuacgacuacgucggcuggcgcaacgaguccgccaccaacggcuacaucgagaucauguucgaguucgaccgcauccgcaacuucaccaccaugaagguccacugcaacaacauguucgccaagggcgucaagaucuucaaggagguccagugcuacuuccgcuccgaggccuccgagugggagcccaacgccaucuccuucccccucguccucgacgacgucaaccccuccgcccgcuucgucaccgucccccuccaccaccgcauggccuccgccaucaagugccaguaccacuucgccgacaccuggaugauguucuccgagaucaccuuccaguccgacgccgccauguacaacaacuccgaggcccuccccaccucccccauggcccccaccaccuacgaccccaugcucaaggucgacgacuccaacacccgcauccucaucggcugccucgucgccaucaucuucauccuccucgccaucaucgucaucauccucuggcgccaguucuggcagaagaugcucgagaaggccucccgccgcaugcucgacgacgagaugaccgucucccucucccuccccuccgacuccuccauguucaacaacaaccgcuccuccucccccuccgagcagggcuccaacuccaccuacgaccgcaucuucccccuccgccccgacuaccaggagcccucccgccucauccgcaagcuccccgaguucgcccccggcgaggaggaguccggcugcuccggcgucgucaagcccguccagcccuccggccccgagggcgucccccacuacgccgaggccgacaucgucaaccuccagggcgucaccggcggcaacaccuacuccguccccgccgucaccauggaccuccucuccggcaaggacgucgccgucgaggaguucccccgcaagcuccucaccuucaaggagaagcucggcgagggccaguucggcgagguccaccucugcgaggucgagggcauggagaaguucaaggacaaggacuucgcccucgacgucuccgccaaccagcccguccucgucgccgucaagaugcuccgcgccgacgccaacaagaacgcccgcaacgacuuccucaaggagaucaagaucaugucccgccucaaggaccccaacaucauccaccuccucgccgucugcaucaccgacgacccccucugcaugaucaccgaguacauggagaacggcgaccucaaccaguuccucucccgccacgagccccccaacuccuccuccuccgacguccgcaccgucuccuacaccaaccucaaguucauggccacccagaucgccuccggcaugaaguaccucuccucccucaacuucguccaccgcgaccucgccacccgcaacugccucgucggcaagaacuacaccaucaagaucgccgacuucggcaugucccgcaaccucuacuccggcgacuacuaccgcauccagggccgcgccguccuccccauccgcuggauguccugggaguccauccuccucggcaaguucaccaccgccuccgacgucugggccuucggcgucacccucugggagaccuucaccuucugccaggagcagcccuacucccagcucuccgacgagcaggucaucgagaacaccggcgaguucuuccgcgaccagggccgccagaccuaccucccccagcccgccaucugccccgacuccgucuacaagcucaugcucuccugcuggcgccgcgacaccaagaaccgccccuccuuccaggagauccaccuccuccuccuccagcagggcgacgaguga

SEQ ID NO: 42122 - RNA, 945 nt, Artificial Sequence
  derived and/or modified sequence opt2 from DDRGK1__Homo_sapiens__NP_076424
auggucgcccccgucugguaccucgucgccgccgcccuccucgucggcuucauccucuuccucacccgcucccgcggccgcgccgccuccgccggccaggagccccuccacaacgaggagcucgccggcgccggccgcgucgcccagcccggcccccucgagcccgaggagccccgcgccggcggccgcccccgccgccgccgcgaccucggcucccgccuccaggcccagcgccgcgcccagcgcgucgccugggccgaggccgacgagaacgaggaggaggccgucauccucgcccaggaggaggagggcgucgagaagcccgccgagacccaccucuccggcaagaucggcgccaagaagcuccgcaagcucgaggagaagcaggcccgcaaggcccagcgcgaggccgaggaggccgagcgcgaggagcgcaagcgccucgagucccagcgcgaggccgaguggaagaaggaggaggagcgccuccgccucgaggaggagcagaaggaggaggaggagcgcaaggcccgcgaggagcaggcccagcgcgagcacgaggaguaccucaagcucaaggaggccuucgucgucgaggaggagggcgucggcgagaccaugaccgaggagcagucccaguccuuccucaccgaguucaucaacuacaucaagcaguccaaggucguccuccucgaggaccucgccucccaggucggccuccgcacccaggacaccaucaaccgcauccaggaccuccucgccgagggcaccaucaccggcgucaucgacgaccgcggcaaguucaucuacaucacccccgaggagcucgccgccgucgccaacuucauccgccagcgcggccgcgucuccaucgccgagcucgcccaggccuccaacucccucaucgccuggggccgcgagucccccgcccaggcccccgccuga

SEQ ID NO: 42123 - RNA, 357 nt, Artificial Sequence
  derived and/or modified sequence opt2 from DDT__Homo_sapiens__NP_001077861
augcccuuccucgagcucgacaccaaccuccccgccaaccgcguccccgccggccucgagaagcgccucugcgccgccgccgccuccauccucggcaagcccgccgaccgcgucaacgucaccguccgccccggccucgccauggcccucuccggcuccaccgagcccugcgcccagcucuccaucuccuccaucggcgucgucggcaccgccgaggacaaccgcucccacuccgcccacuucuucgaguuccucaccaaggagcucgcccucggccaggaccgcauccucauccgcuucuucccccucgaguccuggcagaucggcaagaucggcaccgucaugaccuuccucuga

SEQ ID NO: 42124 - RNA, 405 nt, Artificial Sequence
  derived and/or modified sequence opt2 from DDTL__Homo_sapiens__NP_001077862
augcccuuccucgagcucgacaccaaccuccccgccaaccgcguccccgccggccucgagaagcgccucugcgccgccgccgccuccauccucggcaagcccgccgaccgcgucaacgucaccguccgccccggccucgccauggcccucuccggcuccaccgagcccugcgcccagcucuccaucuccuccaucggcgucgucggcaccgccgaggacaaccgcucccacuccgcccacuucuucgaguuccucaccaaggagcucgcccucggccaggaccgcuuccccaccguccucuccaccucccccgccgcccacggcggcccccgcugccccggcgagaucaucgagggcaagaaguccugccucaacgaggaggcccucuucaucuacuucaucuga

SEQ ID NO: 42125 - RNA, 2628 nt, Artificial Sequence
  derived and/or modified sequence opt2 from DDX10__Homo_sapiens__NP_004389
augggcaagaccgccaacucccccggcuccggcgcccgccccgaccccguccgcuccuucaaccgcuggaagaagaagcacucccaccgccagaacaagaagaagcagcuccgcaagcagcucaagaagcccgaguggcaggucgagcgcgaguccaucucccgccucaugcagaacuacgagaagaucaacgucaacgagaucacccgcuucuccgacuucccccucuccaagaagacccucaagggccuccaggaggcccaguaccgccucgucaccgagauccagaagcagaccaucggccucgcccuccagggcaaggacguccucggcgccgccaagaccggcuccggcaagacccucgccuuccucguccccguccucgaggcccucuaccgccuccaguggaccuccaccgacggccucggcguccucaucaucucccccacccgcgagcucgccuaccagaccuucgagguccuccgcaaggucggcaagaaccacgacuucuccgccggccucaucaucggcggcaaggaccucaagcacgaggccgagcgcaucaacaacaucaacauccucgucugcacccccggccgccuccuccagcacauggacgagaccgucuccuuccacgccaccgaccuccagaugcucguccucgacgaggccgaccgcauccucgacaugggcuucgccgacaccaugaacgccgucaucgagaaccuccccaagaagcgccagacccuccucuucuccgccacccagaccaaguccgucaaggaccucgcccgccucucccucaagaaccccgaguacgucuggguccacgagaaggccaaguacuccacccccgccacccucgagcagaacuacaucgucugcgagcuccagcagaagaucuccguccucuacuccuuccuccgcucccaccucaagaagaaguccaucgucuucuucuccuccugcaaggagguccaguaccucuaccgcgucuucugccgccuccgccccggcgucuccauccucgcccuccacggccgccagcagcagaugcgccgcauggaggucuacaacgaguucguccgcaagcgcgccgccguccucuucgccaccgacaucgccgcccgcggccucgacuuccccgccgucaacuggguccuccaguucgacugccccgaggacgccaacaccuacauccaccgcgccggccgcaccgcccgcuacaaggaggacggcgaggcccuccucauccuccuccccuccgagaaggccaugguccagcagcuccuccagaagaagguccccgucaaggagaucaagaucaaccccgagaagcucaucgacguccagaagaagcucgaguccauccucgcccaggaccaggaccucaaggagcgcgcccagcgcugcuucgucuccuacguccgcuccgucuaccucaugaaggacaaggaggucuucgacgucuccaagcuccccauccccgaguacgcccucucccucggccucgccgucgccccccgcguccgcuuccuccagaagaugcagaagcagcccaccaaggagcucguccgcucccaggccgacaaggucaucgagccccgcgcccccucccucaccaacgacgaggucgaggaguuccgcgccuacuucaacgagaagauguccauccuccagaagggcggcaagcgccucgagggcaccgagcaccgccaggacaacgacaccggcaacgaggagcaggaggaggaggaggacgacgaggaggagauggaggagaagcucgccaaggccaagggcucccaggcccccucccuccccaacaccuccgaggcccagaagaucaaggagguccccacccaguuccucgaccgcgacgaggaggaggaggacgccgacuuccucaaggucaagcgccacaacgucuucggccucgaccucaaggacgagaagacccuccagaagaaggagcccuccaaguccuccaucaagaagaagaugaccaaggucgccgaggccaagaaggucaugaagcgcaacuucaaggucaacaagaagaucaccuucaccgacgagggcgagcucguccagcaguggccccagaugcagaaguccgccaucaaggacgccgaggaggacgacgacaccggcggcaucaaccuccacaaggccaaggagcgccuccaggaggaggacaaguucgacaaggaggaguaccgcaagaagaucaaggccaagcaccgcgagaagcgccucaaggagcgcgaggcccgccgcgaggccaacaagcgccaggccaaggccaaggacgaggaggaggccuuccucgacugguccgacgacgacgacgacgacgacgacggcuucgaccccuccacccuccccgaccccgacaaguaccgcuccuccgaggacuccgacuccgaggacauggagaacaagaucuccgacaccaagaagaagcagggcaugaagaagcgcuccaacuccgaggucgaggacgucggccccaccucccacaaccgcaagaaggcccgcugggacacccucgagccccucgacaccggccucucccucgccgaggacgaggagcucguccuccaccuccuccgcucccaguccuga
